United States Patent 6,812,339 (POLYMORPHISMS IN KNOWN GENES ASSOCIATED WITH HUMAN DISEASE, METHODS OF DETECTION AND USES THEREOF) - sequence listing, part 96

SEQ ID NO: 96183 - DNA, 601 bp, Human
tctcagccttcttcttttccccttctttttctagagaatacatttaaaatatttcctttagggaaatttagtatgaaagcaaaaccaaggttgaaatgaaggatttttgttaagtcagttctgcctccagctagctttgtgactgagcaagtaatttaatcccactaagtcttattttcctcatttatcaaataataatacctccctcaaagttaatgtttacaaaacactgtgtaaagtgcctggctcacagtaaatgtgtaacgttgtagactgctaatactgtttacaaataatgaaygtgatagtttgaactttctgaaccaaacaattgtttatctagtgcctaaaagtattgatatataaaattaaaatatatttcttggaaaatatactgcagataaactagaagaattaatatttgttttcttttatacatttaatttcattagaaataatatattagaccattaaaaaggtatcttttgatgtagctgtttttcatatctggctcttgccaacaggcatttaagcctgatgacaagtgtctggcagtgtgttggaaacataacttccacggtcctttctgagtggttgtatc

SEQ ID NO: 96184 - DNA, 601 bp, Human
attatttgaaaacaaccaattaaaatatatatatatgtgtaaaacaaaccaatcaagtattttctgccctctacataaaatgacttttaaaattagactgaattagttaaatagtaaccatcatattcacatatatagttaaagtaaagtagtgaattagagagaattaagcagctgctcttaagaaagaaaaaataatcacagtagtaattttcaaaaagtgtttaggattgaattctctttttaaaaattgacaattttaattttatttggaatatctagacatgttaagagtgttcaytaataacaatgacaatgcatttattaagggaatttctttcctagaaaataatagatttaccagtagtattatgcatggacactaattgatttatgtggtacatggcttttaaatttcctacctttcttttttgtttcagaagtaactttcttctcagccttcttcttttccccttctttttctagagaatacatttaaaatatttcctttagggaaatttagtatgaaagcaaaaccaaggttgaaatgaaggatttttgttaagtcagttctgcctccagctagctttgtgactgagca

SEQ ID NO: 96185 - DNA, 601 bp, Human
aacgtaatccatctaaggaaacaaagaaagtgcaataccttttttttccacatcaatggcagtttccttctcacttttctttttgatatcttctttttctgctggtaaaataagaaagttataagcctttacctgtttaacttgcaaatatttcagggcatgcatgactaccagtgaggcatctaatttatcttgtatagagaaatcttaaatcagccataagtcatgtcaaatatgaataaggtagcaccttcataacagactagtggcttaggtataatttctcttcaggaaacagaaytttttttttttttttgccaaaggcaaaaattatttaataacagtgaaaacattaaatggcattattaattatggtattatttaacagctttcctaacatatattgaaaagaatatattgaatgttctctgagctatgaggtcaccagaaccatgtcaaaagttctgaaatctctgaagttcacttgggacatcagataaattatttgaaaacaaccaattaaaatatatatatatgtgtaaaacaaaccaatcaagtattttctgccctctacataaaatgacttttaaaattagactga

SEQ ID NO: 96186 - DNA, 601 bp, Human
tagtagctgggacatttacaagccacttttcagtttcacaacccataaagcctttctcaaggaactgagagccatccctttgaaatgtaatcatcaagaaagatagtgccccatctctaagtttctgtggaagagtaggagcctaacttccttggactcctcgctccacattgtgaaactacttcttaccatgcagatataagactgaaagtttacgttttgagggggaaaagccaatatgcaaaaacagatgtcctgtgattccccataccagccattacaaacattcctgcgttttttkgggggggaattgagttcagactcaattccagtctctctgtcctattgcaatagccttgaataaagtcttctttgcctgtttaactttgtctagtgcaagttttgctttgaccttcacgtcttgggtagatataagtaactgtgtgcaatttgtgtatgttgcatgaggagtctttcatgaagcaaacatcctgaacgtaatccatctaaggaaacaaagaaagtgcaataccttttttttccacatcaatggcagtttccttctcacttttctttttgatatcttctttttctgctggta

SEQ ID NO: 96187 - DNA, 601 bp, Human
cataatacttgagatgattgtcttttccatgtaaacttaagcctaacctgaatcgaagccaatattcatgtttgaacaagaatagaaacagaacaaaatttaaagcaaaaatcgaaactgtcaaatagttgaataaccttatttcttaatagggtgcattattctttctcagcttcttatctttgcaatgtggtattgttattactatgtatctcttctcaagttcattgtatcttgaccaaggtggtcctcaccttgattaaactttaataggtttctttctgaccttcagcagctcctratctcccttttcttagagcatttacttcagaaaactggaaaacttgtcattgtaaattctttctctactttattgagatacagattttttttttttttttttttttttttgtagggggatgaggagacagggtcttcctctgctacccaggctggagtgcagtagtgcaattatggtgctcactacagcctcaacctcctgggctcaagcaatgctcctgtcttggccactctagtagctgggacatttacaagccacttttcagtttcacaacccataaagcctttctcaaggaactga

SEQ ID NO: 96188 - DNA, 601 bp, Human
tttcaggtgagaatgcttatcaccaaaccataatacttgagatgattgtcttttccatgtaaacttaagcctaacctgaatcgaagccaatattcatgtttgaacaagaatagaaacagaacaaaatttaaagcaaaaatcgaaactgtcaaatagttgaataaccttatttcttaatagggtgcattattctttctcagcttcttatctttgcaatgtggtattgttattactatgtatctcttctcaagttcattgtatcttgaccaaggtggtcctcaccttgattaaactttaatargtttctttctgaccttcagcagctcctaatctcccttttcttagagcatttacttcagaaaactggaaaacttgtcattgtaaattctttctctactttattgagatacagattttttttttttttttttttttttttgtagggggatgaggagacagggtcttcctctgctacccaggctggagtgcagtagtgcaattatggtgctcactacagcctcaacctcctgggctcaagcaatgctcctgtcttggccactctagtagctgggacatttacaagccacttttcagtttcaca

SEQ ID NO: 96189 - DNA, 601 bp, Human
ggaaatttggatgcaaaggaatgggcaatcaactcttggacacacagaatgtctggctgatccttcttgctcatttcatgggccacataatcatgcaattcttaatattttacattttttctaccccatttatagcatgatgccagatatttctacgcatttctatttgctgcttgctaatcataatctttatatagttgacatcctatgtatgctcttctttttagggtcctcaccaccatcattttttccacatacattattactacttagaaaaggaaagattttcactaaaatgccrtctaacccagcctgccctccccagacggttccccaccctgaagttttcaatcttcttcgtttaagcttacctaccacctcatgttctggggtacaatttttagcttactattacacaggaaagatctggaaatctcatttactttaagttcttaatagctgagaggaattaggtttttaccccatatacacaagccctagaagatctgcattttaataggggacgattccttcataactcaaaggaatggaatggttctaatggtagaattttaagcatcactgacatcagtggaggaaa

SEQ ID NO: 96190 - DNA, 601 bp, Human
cacacatacgcatgagcacacacaaacacacacaaaaccattgagttttgccaaaaacacgttttcagattttgcatttgcgtgcatatgaaaaatgcttgaaaattacaactcaaaattttcttctgcaactcttttagtaaaattgatggcaaggaagaagtatcttggtttatctttacccctcaatcatgtaattttcacaaatccactgctctaagcaagcagtttctcagattcatagagtcagaactgtttttcccttcttatgataaaatacatatttcatcagaaaataagraagttttaaaagaaaatgagtgaatatttaatagaacaatagactacaataatacagccttaataatggaaatttggatgcaaaggaatgggcaatcaactcttggacacacagaatgtctggctgatccttcttgctcatttcatgggccacataatcatgcaattcttaatattttacattttttctaccccatttatagcatgatgccagatatttctacgcatttctatttgctgcttgctaatcataatctttatatagttgacatcctatgtatgctcttctttttagggtcct

SEQ ID NO: 96191 - DNA, 601 bp, Human
actggctccaagaaagacaacactagctgaatagtcctgcctagatgtgctgagcaattactcagtttggtctctgcttcggtggctgagcactgtccttgtaggaagtgatatgggcataatccgttctcttgccagtggtgcacaacctcactttgacatgactgctgggctaataacacaggtctcccagtggcaggggagtatcagattttcccatgaaccattgcacataaacaagtttcatcatttccctcaaaaagctaaaaccaagccaaacacacatgcacacacacatacrcatgagcacacacaaacacacacaaaaccattgagttttgccaaaaacacgttttcagattttgcatttgcgtgcatatgaaaaatgcttgaaaattacaactcaaaattttcttctgcaactcttttagtaaaattgatggcaaggaagaagtatcttggtttatctttacccctcaatcatgtaattttcacaaatccactgctctaagcaagcagtttctcagattcatagagtcagaactgtttttcccttcttatgataaaatacatatttcatcagaaaataagaaagttttaa

SEQ ID NO: 96192 - DNA, 601 bp, Human
taagcatgtaggcatatcttatgccttataaatttgctatttggggctacagtagtgagatcatatgctctgccatgttcctctactttaggaagaaatgacctttgtcccccagctcttcaagatttcaggttattctcaatttctctcattatctctgtaaaattttactactttcataataagcttgaaacctgctgtttgtaaaccatattgctgtcacatgaaaatataaagaattattaaaccctaaaaagaaacgagttaaaaactagcactaactgaaactcaatctctctgtctctctctctctctctctgacacagacacacacaaacacaaacacacacacacacacatgcacacactgttttgagtatttgggggttgagggattgtaaacaaataaactctgcctatcttttatcaggaagttgaactgatttggaaaaatcaatggaattttgtgtaatcaaaagtaaaaatgacaagcatacaaacagaaaactggctccaagaaagacaacactagctgaatagtcctgcctagatgtgctgagcaattactcagtttggtctctgcttcggtggctgagcactg

SEQ ID NO: 96193 - DNA, 601 bp, Human
tcagtttcaacccctattaattaatgggttggcaattttgtatcatataaagcccatccacctacaacttccccagagatcactggcaaagtgtgatttaccagtgtcatacggtagaagcccatttatcactgaatagagtttaagccttaggtttgtcatgtcggcataataatacaatataagggaataaaataaaataataatataacatataacatataactaaatgcatatattttataatataaataatattaacattaacataaatataataaaatatcacaataacactcayatattaaataagcatgtaggcatatcttatgccttataaatttgctatttggggctacagtagtgagatcatatgctctgccatgttcctctactttaggaagaaatgacctttgtcccccagctcttcaagatttcaggttattctcaatttctctcattatctctgtaaaattttactactttcataataagcttgaaacctgctgtttgtaaaccatattgctgtcacatgaaaatataaagaattattaaaccctaaaaagaaacgagttaaaaactagcactaactgaaactcaa

SEQ ID NO: 96194 - DNA, 601 bp, Human
ctgttgatctgccctgatgcttaataatccaaattttgattatttgatttcagttattttagtccttcaataacattgtaggtactcagttccctgtatagaatgtcttctagcagtgccaactacagtgtttagtgtttctagcactgaagtctaatacaaacctagagagatgtttttaaagtctttatttcttttgttgattgcttttttcatggtatttcttcaagtgaaaatgtaccttataacattgcaaaaataccaagatgatttttttttaattttacataatgtttttaaktggcaggtatttatttaattttttgccatggatgatttcaaatatacactaaataaaggagtgttataattaaccccaatataccaattgctcagtttcaacccctattaattaatgggttggcaattttgtatcatataaagcccatccacctacaacttccccagagatcactggcaaagtgtgatttaccagtgtcatacggtagaagcccatttatcactgaatagagtttaagccttaggtttgtcatgtcggcataataatacaatataagggaataaaataaaataataatat

SEQ ID NO: 96195 - DNA, 601 bp, Human
catttttatagatactattgatagcctctttcaacttccatttcactccactttcacttgagaaaattggaatgcatcttacagactcacttgcagccagagttctggagacatatcaagttccaccagactgaaagcagaaatggtttggcagagcagatgaatgatttggcaaatgaagatgttagtaatctgctgaggcttgcctcaacatttccaggatctagtctttgtggttgtgagaagacagtgctggtgaacaaagcagtctcctaacctgttgatctgccctgatgcttartaatccaaattttgattatttgatttcagttattttagtccttcaataacattgtaggtactcagttccctgtatagaatgtcttctagcagtgccaactacagtgtttagtgtttctagcactgaagtctaatacaaacctagagagatgtttttaaagtctttatttcttttgttgattgcttttttcatggtatttcttcaagtgaaaatgtaccttataacattgcaaaaataccaagatgatttttttttaattttacataatgtttttaattggcaggtatttatttaattttt

SEQ ID NO: 96196 - DNA, 601 bp, Human
aaagataggtttcatcactataaagtgtaggtgttcaaaaaccatctcttattgtatgaattttatcatcttggacattcctgaaagtatcatttttatagatactattgatagcctctttcaacttccatttcactccactttcacttgagaaaattggaatgcatcttacagactcacttgcagccagagttctggagacatatcaagttccaccagactgaaagcagaaatggtttggcagagcagatgaatgatttggcaaatgaagatgttagtaatctgctgaggcttgcctcarcatttccaggatctagtctttgtggttgtgagaagacagtgctggtgaacaaagcagtctcctaacctgttgatctgccctgatgcttaataatccaaattttgattatttgatttcagttattttagtccttcaataacattgtaggtactcagttccctgtatagaatgtcttctagcagtgccaactacagtgtttagtgtttctagcactgaagtctaatacaaacctagagagatgtttttaaagtctttatttcttttgttgattgcttttttcatggtatttcttcaagtgaa

SEQ ID NO: 96197 - DNA, 601 bp, Human
cttttatctacagtgaaggtgaagagcaacataaacttcaggtaagtgtgccttgtgaacacttggaattgccaaatttgatcatattgcttagttgtgtcatccttttcatcttttgggggaactcaaagataggtttcatcactataaagtgtaggtgttcaaaaaccatctcttattgtatgaattttatcatcttggacattcctgaaagtatcatttttatagatactattgatagcctctttcaacttccatttcactccactttcacttgagaaaattggaatgcatcttacaractcacttgcagccagagttctggagacatatcaagttccaccagactgaaagcagaaatggtttggcagagcagatgaatgatttggcaaatgaagatgttagtaatctgctgaggcttgcctcaacatttccaggatctagtctttgtggttgtgagaagacagtgctggtgaacaaagcagtctcctaacctgttgatctgccctgatgcttaataatccaaattttgattatttgatttcagttattttagtccttcaataacattgtaggtactcagttccctgtatagaatgtc

SEQ ID NO: 96198 - DNA, 601 bp, Human
tatgattttataccattatcaatagttattttgtcaaaattattttcacagttaataagtttataaacatataagatgatgacaaatttaactcctaaaagtttacaattgtaactatgaaaaggccaacccaagagcaatgggtcatcttagctttggcctgtttctcttgtgtgtctatatattttgcccaggttataattgttttgttatgagacaagtcaacttgttaattgttcaaatattataatctaatcaagtaggtgaaacgttatttcttcaaaaatatcaccttgtggtrgaagagagaaagaatatccatgcttcttttatctacagtgaaggtgaagagcaacataaacttcaggtaagtgtgccttgtgaacacttggaattgccaaatttgatcatattgcttagttgtgtcatccttttcatcttttgggggaactcaaagataggtttcatcactataaagtgtaggtgttcaaaaaccatctcttattgtatgaattttatcatcttggacattcctgaaagtatcatttttatagatactattgatagcctctttcaacttccatttcactccactttcact

SEQ ID NO: 96199 - DNA, 601 bp, Human
atcctattggaaagtgtgataattaaatatgattttataccattatcaatagttattttgtcaaaattattttcacagttaataagtttataaacatataagatgatgacaaatttaactcctaaaagtttacaattgtaactatgaaaaggccaacccaagagcaatgggtcatcttagctttggcctgtttctcttgtgtgtctatatattttgcccaggttataattgttttgttatgagacaagtcaacttgttaattgttcaaatattataatctaatcaagtaggtgaaacgttwtttcttcaaaaatatcaccttgtggtggaagagagaaagaatatccatgcttcttttatctacagtgaaggtgaagagcaacataaacttcaggtaagtgtgccttgtgaacacttggaattgccaaatttgatcatattgcttagttgtgtcatccttttcatcttttgggggaactcaaagataggtttcatcactataaagtgtaggtgttcaaaaaccatctcttattgtatgaattttatcatcttggacattcctgaaagtatcatttttatagatactattgatagcctcttt

SEQ ID NO: 96200 - DNA, 601 bp, Human
agctatgtggttttaatatccttcttgtaatttatagttctatacagataattcctgaaaaaaaaatcctattggaaagtgtgataattaaatatgattttataccattatcaatagttattttgtcaaaattattttcacagttaataagtttataaacatataagatgatgacaaatttaactcctaaaagtttacaattgtaactatgaaaaggccaacccaagagcaatgggtcatcttagctttggcctgtttctcttgtgtgtctatatattttgcccaggttataattgttttrttatgagacaagtcaacttgttaattgttcaaatattataatctaatcaagtaggtgaaacgttatttcttcaaaaatatcaccttgtggtggaagagagaaagaatatccatgcttcttttatctacagtgaaggtgaagagcaacataaacttcaggtaagtgtgccttgtgaacacttggaattgccaaatttgatcatattgcttagttgtgtcatccttttcatcttttgggggaactcaaagataggtttcatcactataaagtgtaggtgttcaaaaaccatctcttattgta

SEQ ID NO: 96201 - DNA, 601 bp, Human
gctcaatctcttccattacacttttaataaagtccaaacacctatacatgttcctgcatattctgactcctagtacaaaccacactccccttcccccacacatcataaatatatatatatatatataatatatatatatatatatatacatcacacaatgatccagcaatcaatggctgagtcctttcaatacatcagatctcaatttaaatgctgtctctcagagaggcctgctctaataatcttatctatttaaataacttccccaccccaacgcattatattctatcattgccttaartttattttctccactgcccttactcagagttgaacttgtggacattttgtctttattcactgtgtgcctcccttgtcaaactgtaagctccattagggcagatcttgtctgtttatccacttctgtgtactcagcacctagtacaaagcttggcatatagtaggcattttttaaatatttccttcaagatgcatgcatgcatgaatgaatgaacacattcatttttttctagtagcttatttcagaaaagctatgtggttttaatatccttcttgtaatttatagttctatacagataat

SEQ ID NO: 96202 - DNA, 601 bp, Human
gagctttgttaaaatacatttcacaaactttcctcagtgagcacaaaagacattttggatatatctttttctaaaattgaggcttttatctcagaatgtatttattattggagttttagttttatcaccagagccacctaatcatatattgtatatcttacaaatgcatgcctctcttttaaggcaatctgcatagaatcctagtcataatttgaaaacatcaactttttaaatatcacagcacctgtggtattatctccaaaaaaaaaaaagagtagttttcaccaaatactcatcaaastataatttctcaattatcttttcgatttctgcttatatattctgtccctctgagcatcaatctcctacattctgtttatgtacatcgggcactagattgaactattaaagcaaaactagacaaaacacaaaagactttactcctcctacagccgtaatccttcccccttccccgcaaaatctacactttagtctccatttttgcacctcccattccaacctgactttatctttcactccactgactgcccttgtgtcttctgccctcgtaaaacaaacttgtaagtgacattcacaaagt

SEQ ID NO: 96203 - DNA, 601 bp, Human
aatgatccttaaagagctttgttaaaatacatttcacaaactttcctcagtgagcacaaaagacattttggatatatctttttctaaaattgaggcttttatctcagaatgtatttattattggagttttagttttatcaccagagccacctaatcatatattgtatatcttacaaatgcatgcctctcttttaaggcaatctgcatagaatcctagtcataatttgaaaacatcaactttttaaatatcacagcacctgtggtattatctccaaaaaaaaaaaagagtagttttcaccamatactcatcaaagtataatttctcaattatcttttcgatttctgcttatatattctgtccctctgagcatcaatctcctacattctgtttatgtacatcgggcactagattgaactattaaagcaaaactagacaaaacacaaaagactttactcctcctacagccgtaatccttcccccttccccgcaaaatctacactttagtctccatttttgcacctcccattccaacctgactttatctttcactccactgactgcccttgtgtcttctgccctcgtaaaacaaacttgtaagtg

SEQ ID NO: 96204 - DNA, 601 bp, Human
taaagctctaatggggtattgtaaatgaatgatccttaaagagctttgttaaaatacatttcacaaactttcctcagtgagcacaaaagacattttggatatatctttttctaaaattgaggcttttatctcagaatgtatttattattggagttttagttttatcaccagagccacctaatcatatattgtatatcttacaaatgcatgcctctcttttaaggcaatctgcatagaatcctagtcataatttgaaaacatcaactttttaaatatcacagcacctgtggtattatctccaaaaaaaaaaaagagtagttttcaccaaatactcatcaaagtataatttctcaattatcttttcgatttctgcttatatattctgtccctctgagcatcaatctcctacattctgtttatgtacatcgggcactagattgaactattaaagcaaaactagacaaaacacaaaagactttactcctcctacagccgtaatccttcccccttccccgcaaaatctacactttagtctccatttttgcacctcccattccaacctgactttatctttcactccactgactgcccttgtgtcttc

SEQ ID NO: 96205 - DNA, 601 bp, Human
tagaaatttaagtgatctgtagtctgccatatatattattttgagctagaacaacttgttacaaaagattcaaaagtaaaatacataatattctaatgcctggtagacaataatatttaatggtatattcaaagcaataagcttctgtaaaggactctttgcaatttctcaatgagaaaagcagattttgtagagagaaagcaaatagccaaaggttttagtttgtgcagaatattatttgccacatacagtaattgaaaaaatttgatggaaatagatacgaatgtatcccttaaacagmacaaattctttatgagttctatactagacaaatcttacctgaccaattcaccaccacaaagatgtttcagtgtaaagctctaatggggtattgtaaatgaatgatccttaaagagctttgttaaaatacatttcacaaactttcctcagtgagcacaaaagacattttggatatatctttttctaaaattgaggcttttatctcagaatgtatttattattggagttttagttttatcaccagagccacctaatcatatattgtatatcttacaaatgcatgcctctcttttaaggcaat

SEQ ID NO: 96206 - DNA, 601 bp, Human
aaatatttaaaataggtttcttttagttacatgtaaatgtagaaatttaagtgatctgtagtctgccatatatattattttgagctagaacaacttgttacaaaagattcaaaagtaaaatacataatattctaatgcctggtagacaataatatttaatggtatattcaaagcaataagcttctgtaaaggactctttgcaatttctcaatgagaaaagcagattttgtagagagaaagcaaatagccaaaggttttagtttgtgcagaatattatttgccacatacagtaattgaaaawatttgatggaaatagatacgaatgtatcccttaaacagcacaaattctttatgagttctatactagacaaatcttacctgaccaattcaccaccacaaagatgtttcagtgtaaagctctaatggggtattgtaaatgaatgatccttaaagagctttgttaaaatacatttcacaaactttcctcagtgagcacaaaagacattttggatatatctttttctaaaattgaggcttttatctcagaatgtatttattattggagttttagttttatcaccagagccacctaatcatatat

SEQ ID NO: 96207 - DNA, 601 bp, Human
tatcaaatatcctgaaaaaatttatctagatttcaatgtctaacaataccaattggatgcatttgttaaatcttgcccaaatacatatttgcaaaactccagaaaaaagataactttctaaaaccaagtgcttttcaaataaggagaaagatgtgggtgatcagaaaaaaagctataatcttctcaatatacaagtctagaaaatggaaggatgttcttttaaactaaaacttaacatgaatacatatgaaagatactatatgttattttgtccaattataaatgtacacataaatatttmaaataggtttcttttagttacatgtaaatgtagaaatttaagtgatctgtagtctgccatatatattattttgagctagaacaacttgttacaaaagattcaaaagtaaaatacataatattctaatgcctggtagacaataatatttaatggtatattcaaagcaataagcttctgtaaaggactctttgcaatttctcaatgagaaaagcagattttgtagagagaaagcaaatagccaaaggttttagtttgtgcagaatattatttgccacatacagtaattgaaaaaatttgatg

SEQ ID NO: 96208 - DNA, 601 bp, Human
gacaagatctatgtctattacactgatctatgtccaacattaagcagatttccttgcatgtattatgggattattaaatattttttgagtgaatgaatgaaggaaagcataatttctacaagaaaagtaagagtcagacctacaggatctcttctgcattttttcctacatgtttaccactgtctgcaatatcatctgaaggaaattagcaaaaaagaaaaagagggaggaaaaaaaaagacactaaagcagtctaccaccattgtttcctagaattagaagacaaagtgcttttgggtcycaaaagacagtgaagctttatttggtgactttcatactgacttcactctacttactggtgatgatgggcaagtaatttacctattccaatgctgggtttctctttctataaaaagtggattataatggttaccttacagagttgttatgattaaatgagaaaacagatttaataactgttgttatgattactttaaaatgctgctgataaaatgaatctatactggcagaatttgctgttgtttcaaaaatacgcttttgggatccctagagaggctgcagttgagggagatatcacttt

SEQ ID NO: 96209 - DNA, 601 bp, Human
tttatttgacctttcaggacactgatctattccacccctacccgctttcccaagtccctagcaggacatgaacaagagaggatatagggcagcacctatggccaatttacagctacataggccaatcccaagggagtagagtccaaaagcagagagaggtaaatctcctgatgatattgtgtgacctctgcatcaagctaaactcaaagccagtttactccagaatagtagttggataaactaataaattccttctttgagatcatctgccacttgcaagatcaagtatcttcagtgatayaccactgttaaaagtgtatgtgttccagtctctatcctgattaaaaataaatattatatgtgtcttggtcaaatacctaattacataggtcggtggtgtccctgttctagatctctaatagtcactcacctaccacaaaagagaagtaatttctatacttctgccttgatttttgcgtgaggccttgtatttaccctattatagtgctcatggtataatttttacttatttgtttgctgaagtccttggagacaagatctatgtctattacactgatctatgtccaacattaagcagatt

SEQ ID NO: 96210 - DNA, 601 bp, Human
ttagtgaatgaaacctgcaattttgcttgcttttgttgatcacactgctttattctatgttgggttggttttctaaaatacttaagtatcccctccatagatgacactaaaatttctcccttgtgttattctctaaataaaaataaagaaatcatatcacctagattttcaccatctagaaatgacttcttgaagagagtacttatatttctttttcaatgttgtagctagtccatctcatcattttttaaacctaatctagggaatcatcacccaatccaatttcagctcgaatgttttrgacaaagtttatgtaatttctctgctggaaggataggacccgtggcctaaaataaaccaatcagattattctttcacccacaccacaaaggttagttcaggaatgggcctatgaagactgatactgctcaagtttttatttgacctttcaggacactgatctattccacccctacccgctttcccaagtccctagcaggacatgaacaagagaggatatagggcagcacctatggccaatttacagctacataggccaatcccaagggagtagagtccaaaagcagagagaggtaaatct

SEQ ID NO: 96211 - DNA, 601 bp, Human
aataatttggctgatagagaagaagggtaaaaaggtaaaggagttttaaaaaaggaacagtttggagagagtagtctcagaaaagagagagtgaactattaggattctatttctaaaacataatggaatcaccaggcattctttcaaaagctaacttaggattgatttcacaaacgtccactgagcccctgctgcatgtgtggaatagtggagcaatagtaagtagtacaaattcctgggaatgttagtgtctatacatatttttagagggaagacagcccaagtggtttaccacattccrctgataggcttatatcacatgttcaagccatggtgtattttcttctttctcctcagatttgtataacatatattttcacctctacatcagcatggtatctttcaaggcaattattttatatgcctttccttctggtgtattttagcattaactacttcatctgttagcattagctacttcatcatttttgaccttatattccaaaattaatatagctaaccggatatgtgcaagtgactaacaaaattacttaattgtttatactgacattaattattttttgaaaaatactgttcttaa

SEQ ID NO: 96212 - DNA, 601 bp, Human
aatcaaacacataaaagttcccctacaaaatagtgggaattccacacatttaaaaaattattgaatggaatcattgctgctcacaatttatacaagtagtaatttaggtcaaagtggttaaataaaatggggcaagtttatgtaacaagacttaggcctaacaaaaaaagtcttcagtacttattacctaaggttaaattctagattgcaaacccctctacttatcctcaatgacaactataacaggttttaaaacctcctaaatctgctgtagatacagataataataataaggttgtgkgtttccttcaaggggctattaggaaaaaattagtaaaaaggtgtaacaggaataaattatggattactatgtagcacaaaggatagtggattttttctaactataattactagcaaagcagataaatgtaacagcgttatgggtagctgtgtctaatttgtcttgggctgtctcgctgtgtttattaatagtttggaggaataaacatgttgttaattttatactccagctataaaatgccatcttttcacattaaacattttaaaaaacagaagttaaagctcagaataaaattaaaag

SEQ ID NO: 96213 - DNA, 601 bp, Human
tctaacatgttacccaagtttggccaatcagaaaatttccttagaattttgagttcagcatgttttttccttggggttcagcatttaatgactttgtaagcctgacatttacagaagcaatcttgttacaaggtatagagtttttatccaaaactttaactaagcaggaaagcttagttaagggagatgggaaaagttatgggagatgggaaaagagagattcagagagagagccatgataatacccttcataactctgaatccaacattcctcccattggaattccaagaaaagcaatcwaatacatattttaaaaactaatttggactaaattaatcatgatgaatcaaacacataaaagttcccctacaaaatagtgggaattccacacatttaaaaaattattgaatggaatcattgctgctcacaatttatacaagtagtaatttaggtcaaagtggttaaataaaatggggcaagtttatgtaacaagacttaggcctaacaaaaaaagtcttcagtacttattacctaaggttaaattctagattgcaaacccctctacttatcctcaatgacaactataacaggttttaaaac

SEQ ID NO: 96214 - DNA, 601 bp, Human
aaaaatacatctcatgtgatggaagatgcttcctttgtttattcaatgggtggattcagcatctgcttcatactggcattatactaggtgctagatactcagtgtcgaaaaaaacagaatggactcacttttttttctctagcctaaagattacttaagtaacaaaggaaccacattataaattaatggaaaaaatttttaattgttgttaaatgccaaaaggaaaatggtttttgggttccccaaaatattgtttaacaacaactgaaccagccaactgaagtgctcatatgaaaacagyatgtttttaaaaagtcatcatgacagaacggtatctatttccctctgattctttcttttttctaacaacattcttcttccagttaaaagagaggaaacagcagagatcacaaaattctctgaggaaatttatctgctaaaaagccatttaaataaatactgatacatgttttcttttccttccttagaagctcagttgctatatactgggtgaatttcctttataatgctttccgtggctctctcctctcaatctgccacgttggattaggccctccttacctgtcaccagcattgttgt

SEQ ID NO: 96215 - DNA, 601 bp, Human
agtacccagaaaagcatctttctaatgaaaggactcaataagtgaacaaatgaatcaatgaaggaatacctaaggagaataagagaatcattaagtctatacaaatcatttctcaagaatgaggatttgcataccaccaaggtcactctcagtcctgcatctccttttatatctgtctcataaaattattatgttatgatctctccaaatttgaaattttctaaattaatttgagggaagcatattaagtctacctttcagattcaggtattattggcctaaaatcctacaatataaaatattttgatccctattaccaaaatcacagagtgcaatttggttttactttcagctaactgagataggaatggctttccgtgttcagttccagggatacaaattattctttatattctaatgcaggaagactggtagcaatgtatataaataacattataaagggctatttctgtgattgttttgaagatcagaaatatggtcaaaggggctctttcaatgcctttataaagcgaaatcacaaaggtcagccaatgagaagagaaaagaggtttcttttttcctcattcccccacgtatcctt

SEQ ID NO: 96216 - DNA, 601 bp, Human
atagagatggggcttcaccatattggccaggctggacttgagctcctgaccttaggtgatccacctgcctccgtctcccaaagttgtgggattacaggcgtgagccaccacgcccagccaccattattctttagtacccagaaaagcatctttctaatgaaaggactcaataagtgaacaaatgaatcaatgaaggaatacctaaggagaataagagaatcattaagtctatacaaatcatttctcaagaatgaggatttgcataccaccaaggtcactctcagtcctgcatctccttttrtatctgtctcataaaattattatgttatgatctctccaaatttgaaattttctaaattaatttgagggaagcatattaagtctacctttcagattcaggtattattggcctaaaatcctacaatataaaattttttgatccctattaccaaaatcacagagtgcaatttggttttactttcagctaactgagataggaatggctttccgtgttcagttccagggatacaaattattctttatattctaatgcaggaagactggtagcaatgtatataaataacattataaagggctattt

SEQ ID NO: 96217 - DNA, 601 bp, Human
agctcgctgaaacctccgtctcccgggtccaagcgattctctcgcctcagtttctcaagtagctaggattacaggcatctgccaccaagcctagctaattttttgtatttttaatagagatggggcttcaccatattggccaggctggacttgagctcctgaccttaggtgatccacctgcctccgtctcccaaagttgtgggattacaggcgtgagccaccacgcccagccaccattattctttagtacccagaaaagcatctttctaatgaaaggactcaataagtgaacaaatgaatyaatgaaggaatacctaaggagaataagagaatcattaagtctatacaaatcatttctcaagaatgaggatttgcataccaccaaggtcactctcagtcctgcatctccttttatatctgtctcataaaattattatgttatgatctctccaaatttgaaattttctaaattaatttgagggaagcatattaagtctacctttcagattcaggtattattggcctaaaatcctacaatataaaattttttgatccctattaccaaaatcacagagtgcaatttggttttactttcagctaa

SEQ ID NO: 96218 - DNA, 601 bp, Human
tcaggccctttgaaagcatcagacctcactcaggataatatcttttgtgatccagatctccacaactcggttaacttcacctcctaccacctgctcctcactcatgctattctattccactgcttcttttcctgttccctgatcattggggtttttgcatttcttctgtgtgaaggttgcatttttactgtatgaaactattttcacaaatgtgtgtgcagctcactcctttcttcatccaagtctctgttcagatagcatctccttagacagcccttcccagaccacccagtgaaaacayagcaccttccatattctctatccacttgccctctcaattcttcatagcaagtatcattctcggatatcatactacatgccctttatgatttgtctccttcactggactatgaagttctataaatgcaaaaactttgtctccttgtcaccattattcttttcctctttttttctttttttttagttgacagagtcttgctctgttgcactcaggctggagtgcagcggcataatctcagctcgctgaaacctccgtctcccgggtccaagcgattctctcgcctcagtttctcaagtagct

SEQ ID NO: 96219 - DNA, 601 bp, Human
ataaagggtccttcaagcaacaggatgagtgtgaatatcaaaaggagagtttgcgaatagaggctgaagagaactgaattgctttgtatgacctagttggaaagtttggaatttctgggggaaatccaaaactcaggatgtgagaacaagctatggcagaaggaaggcaccaaagaggagtcagagagatgacgtgcagtgggagggaacctgggaaagggcagtgaagagtagcctgaggatattaaatagcaaagatacccaatacttaatctgtatttattaatattgccacatagtragaactttccccatcccctctaccatctgcaggtatctttttaaaaaaattctatgctttgcacaactggtttctgaaaatggattttatggaaactaaagaaaagtgcttttatggaaaaaaacaaaaggccagcatacagagaattaagaagccagtccatgagctgaaccaagtaagtaagagcagaactcacagagagaagtgatctagggcatgtaaaccttagcaacatttaagaaaacatgggaaggatttgggacttttaaagagtataggtatattagagacagtttttac

SEQ ID NO: 96220 - DNA, 601 bp, Human
ctcttcacttattgaaactaaaagtattttaagtatatatttattgtgtatccacaataagtgactagggaatttatgacagcaacagcaacaaataaacatagggtcagtgaaaatacatgtggtattaattaaatgtacagtgatttatacacagttttactaaaatgatagtggattacatcactgtttatacatatctggacatcacaaatattagtatttaagagtcagctttgagggtgaaatagaatgtgtaattaaaaggaagacagagatgaaagtctgaatctttccaaargttgtagcctttatttctgtcccttagtgtgttaatatatttctaaattttgcttcacaaatacataacaaaatgacacctattgattgccaacatacatcagcagtgtgctaggcattttgaaaattattatacccaatactaatataatgaacggccaaatttgatatttacaagcagaagagtgcctggtgtgtagctgttattcaataagttttgttacatgtatgaataactttctttctttttttttttttttgagtcagagtctcgctctgttgcccaggctggagtgcagtg

SEQ ID NO: 96221 - DNA, 601 bp, Human
cacgctttgaatcttggctttgccatttcatattttccttgagcatgcttaagttttcaaaggctcatattgctgtgaggattaaatgaggtgacatatgtaaagtaccaaccataatactttgaacataatagccacttgcaaaggtattcattcttcctacttttgaatgttagcaaagaaacagattcttctgcttatgtattgcagttattaattctccttaattttgaacacaagcatgacattcacttcacaaaatgtgccttgctctgtcagttaaaacagataatgtaatttccacacacacacacacacacacacacccaaaactcagagtctagtgagaaacaaatacccagtattgtatgccatgtgctattataagggatagagattttatgaaattcattgaaacaagacacctgtccatccagaagaccagtaaggggtgatattttatgaaagtaacaactggtattcaaacaaaggggaggtggagagaggaggataaggatttgaacaaagaaggctctgaaataatcataattgtaagagagagtgggttgactttaaacaattggatggacttttatatgga

SEQ ID NO: 96222 - DNA, 601 bp, Human
ctgcctttaaaataaaataacaacaatggcaattataacagctaatttctatacagcaaatttatagaaaatcctatattgttttacttaagaagagaaagtattatttcacataacaggaagtccaacatagaagggtttcaaggtttactgattcaaaaacaaaaattgtcgtctttatctctgtgctctccccttgctccaagcctggtgggttggctggtagggtaatcaatttcaggggcttcagtagagtaggaaaaagagaaaagaaacccacaataccttcccaccttcaggmtccaagctcagggtgcttgctgagagggcccaagcttaggtgggggtggggtgggggaaatttttatttgaatgaaagttgggagctttgataatatactggattggatgtcttgaaaaaagacaccattgttttattatctgagttgagcatgaccgggcaagctatagtgtctgttcctgatttcacccaaggggtgaagagaagcaagtctacagagtgggtttgcattggtagttacagaaagaataaagttgctttctgcttataccaaccaaaccgaacgaaacatgttttatt

SEQ ID NO: 96223 - DNA, 601 bp, Human
agtcagaaacatttttaagccaagtaaaagccaaaatagaatgatgtaggaccaaagaaaactaaaacctataaatattctgaatgttattttcaacaaaaataaatttcacaaacatcaagattgtataccacattaaattcagaaagtatctccaatatactgaaaagctcactctacactattatttgaataaaaagttaaatttttaaacacagtgtttaaaaagtctttgcattaattactgcacttgatctgtatcattactttgtaagataggccactaggcctggactaaackgcaagcattctgaccctagcccagcatgttgtcaatataacaagaattaccacttctcttcaaaataatgccatttttccttgcaattttaaactataaattttaatataaagcttaaaactttatattatgtaatatataatattaaattttattttccgtcatatgcatgtatataaaatgaaaagccaatataatttctaaaaggttttgctgtgactcattgtgatagccatatataaacataggaaaatcttttacataaatgtctctgcctttaaaataaaataacaacaatgg

SEQ ID NO: 96224 - DNA, 601 bp, Human
ccttgaaaagatatggagattctaaagtcatgcacatcgaagtgtaaactgaaattaagagcgtgaacaatttttcccagagacagatgaacagaaggcttcagactaccatcctatcaagaaatatattagttaataatctataagaaaaatccaaatgttgatttcaacaaggccagggaaaagacatttttttaaatgaggcaataaagttcagggttaaataaaaagaaataaaattttatatctaagagatccctggaaaccattgtggatatggttttggaatggaaaagagcayagaaggaagcctacctttagagctgtaaggtggacagtaacaaaatagaagtgagtggaatccattcctgtgacaaatgtggcagaggccataggaaaaaaagaaactacaaaggggcttgaagatggcaggaagatcaagcaaaggcttttttcctgttttgtttgaggagaataaagaaacaccaaatggagagaaaaatatggaaaagtctgggaaatgggaagacaattagggtagcaagatcccagaatgtgtgggaagaaataagaaaaaagcataggtataagtatctgccta

SEQ ID NO: 96225 - DNA, 601 bp, Human
agtatgttttttgtaacagaaaacagtctcagtcaatcacaaacagctgagcttcagccagtcacaggcagccaactgatcagaccacgtccaaataaggcaaatgtctagatttaaccaatcaagctatttctgtacttcccttcagtttgggctataacagcacactgtccacctgagcagagctctctgaaacactttagttttgaatcgtgccaggtttatgcatcattttttgctcaagtaaattgttaaatttaatttgtttaaaggttttattttaataaaccaaatgttaaartttgtttaaaagtaaattatggtcaaaataattgaccctgaaatctcagcaaataagatagacttttgtcttagtacattgagcgctactgcatttttgggcaggaaagttacacggcagtgttttgaagagataaaagtgtccatgattgtctgggaaagggcttctgtccctttagcatagaagccaggtacaatgtcactggaatactctgtgtaaggtgataataccttagactaagcaaatgttaatggaaatggaaaaaaaataagctagatatttaaaagaagaatctaatac

SEQ ID NO: 96226 - DNA, 601 bp, Human
tcgagacagcctactggccaacatggtgaaaccccatctctactaaaaatacaaaaattagctgggtgtgggggtgctcacctgtaattccagctactaggaaggctgaggcaggagaattgcttgaacccgggaggtggaggttgcagtgagccaagatcacgccactgcactccagcctgggtaacggagcgagactccaactcaaaaagaaaaaaaaaaaaaaaactaaaggagagataaggtgtagagccacaaaggggaaagggaaagaaagctgcagagtgaatgacaatgtatyctcctggaattatgaatcaatccagctggagcagaagagtcttgtttgatgttaatgagaagtaaaacacatgaaataagcagaaggccattggcctgaggctgtcttcacattgtgagttcctacataatgaactgcaacctaactcagtatgtaaacaaactgaaaccttacttaagagtatgttttttgtaacagaaaacagtctcagtcaatcacaaacagctgagcttcagccagtcacaggcagccaactgatcagaccacgtccaaataaggcaaatgtctagatttaaccaa

SEQ ID NO: 96227 - DNA, 601 bp, Human
tatcaccattctgtttttcctttcctagaaaataagaaacacacacaccacttttatctccttacccaatttggaaatgttataaacaaacagaattgtgtgaatgtagtcctctgaaaatataacgtaataagaatagtggaaagaaaaactaagggcaaagactggcttttgtgtaccttgtatctctaacacagttcttggtactgagcagccatcccgaaatgttattgcgtgaaaaagtgaataatgattgggagacaaggtgtttgaaaagcccatattatatgcctgacaattmtaaaccaaatatgtggcaattatcctcacaaaattacgcagacttcttgagccctttttttcctctacagttctatagatgtcaaaatctaaagatgttataatcatattcaaagagaatttaagttttttgtaaaaatggctaggtttgtaaaatgcagattacattgataaattaccatgatttccaaagggtagacatcctgaatggagaattctaaatcaagcagcccaaggaagaattcagaggctatttctaagcaaacgctttctggtacacttagtcctcagattaaacagg

SEQ ID NO: 96228 - DNA, 601 bp, Human
atctaaatatagcacttaaaaaaccagccccttttttctaatattagtaagcagtatatgtgaatatcaccattctgtttttcctttcctagaaaataagaaacacacacaccacttttatctccttacccaatttggaaatgttataaacaaacagaattgtgtgaatgtagtcctctgaaaatataacgtaataagaatagtggaaagaaaaactaagggcaaagactggcttttgtgtaccttgtatctctaacacagttcttggtactgagcagccatcccgaaatgttattgcgtraaaaagtgaataatgattgggagacaaggtgtttgaaaagcccatattatatgcctgacaattctaaaccaaatatgtggcaattatcctcacaaaattacgcagacttcttgagccctttttttcctctacagttctatagatgtcaaaatctaaagatgttataatcatattcaaagagaatttaagttttttgtaaaaatggctaggtttgtaaaatgcagattacattgataaattaccatgatttccaaagggtagacatcctgaatggagaattctaaatcaagcagcccaagg

SEQ ID NO: 96229 - DNA, 601 bp, Human
cgtgcagtggcacgatcttggctcactgcaacctccgcctccggagttcaggcaattctcctgcctcagcctcctgagtagccgggattacaggcgtccgccactgcgcccagctaatttttttctattttcagtaaagtcagggtttcaccatgttggtcaggctggtctcgaactgctgacctcgtgattcacctgcctcggcctcccaaagtgctaggattacaggtgtgagccaccgtgcctggccgaccgttcttattttcttaggtaagaaaactaaatatagaaaagttgaatsgcttttccacagatcaggagttaaattcatgtttattaattcagcagctaaaatttgacccagcattataaaaccttgacccctcaaaatatatacatcctttattttttgcataagatagtggaaactaatgacaaattatcttgcagtccaaagagctgctaaatcaaattctaagttattgttttctattcttataaaatccagtattatttttagatatagatagtaccaaaatagagaaaggttaacatttaagctaaaagttgctacatacttgaaagctctaggctaagcctc

SEQ ID NO: 96230 - DNA, 601 bp, Human
tcgcccaggctggcgtgcagtggcacgatcttggctcactgcaacctccgcctccggagttcaggcaattctcctgcctcagcctcctgagtagccgggattacaggcgtccgccactgcgcccagctaatttttttctattttcagtaaagtcagggtttcaccatgttggtcaggctggtctcgaactgctgacctcgtgattcacctgcctcggcctcccaaagtgctaggattacaggtgtgagccaccgtgcctggccgaccgttcttattttcttaggtaagaaaactaaatatrgaaaagttgaatggcttttccacagatcaggagttaaattcatgtttattaattcagcagctaaaatttgacccagcattataaaaccttgacccctcaaaatatatacatcctttattttttgcataagatagtggaaactaatgacaaattatcttgcagtccaaagagctgctaaatcaaattctaagttattgttttctattcttataaaatccagtattatttttagatatagatagtaccaaaatagagaaaggttaacatttaagctaaaagttgctacatacttgaaagctc

SEQ ID NO: 96231 - DNA, 601 bp, Human
tctttttgaaatggtgtctcactccgtcgcccaggctggcgtgcagtggcacgatcttggctcactgcaacctccgcctccggagttcaggcaattctcctgcctcagcctcctgagtagccgggattacaggcgtccgccactgcgcccagctaatttttttctattttcagtaaagtcagggtttcaccatgttggtcaggctggtctcgaactgctgacctcgtgattcacctgcctcggcctcccaaagtgctaggattacaggtgtgagccaccgtgcctggccgaccgttcttaytttcttaggtaagaaaactaaatatagaaaagttgaatggcttttccacagatcaggagttaaattcatgtttattaattcagcagctaaaatttgacccagcattataaaaccttgacccctcaaaatatatacatcctttattttttgcataagatagtggaaactaatgacaaattatcttgcagtccaaagagctgctaaatcaaattctaagttattgttttctattcttataaaatccagtattatttttagatatagatagtaccaaaatagagaaaggttaacatttaagct

SEQ ID NO: 96232 - DNA, 601 bp, Human
tgcatggattttgttaaaagaataggaggagaaacaaacaacaaaaaatgaaaatattggaattctacttaagagcatgtttgagataaacattttttcaggattcaaattatgaatcaaatttattttattaatcttccaaagaaatgaaaacagctttaaagctgtctcttgctacttcatcaatattacaaggaacttagactgttcttattttcttttatttctttttgaaatggtgtctcactccgtcgcccaggctggcgtgcagtggcacgatcttggctcactgcaacctccrcctccggagttcaggcaattctcctgcctcagcctcctgagtagccgggattacaggcgtccgccactgcgcccagctaatttttttctattttcagtaaagtcagggtttcaccatgttggtcaggctggtctcgaactgctgacctcgtgattcacctgcctcggcctcccaaagtgctaggattacaggtgtgagccaccgtgcctggccgaccgttcttattttcttaggtaagaaaactaaatatagaaaagttgaatggcttttccacagatcaggagttaaattcatgtttat

SEQ ID NO: 96233 - DNA, 601 bp, Human
cagccctttgaaatcgatggcacatgtagaaccaaataagatgacttactgaaggtcccttagtgactaatgtgagaataaagcctgaaacaaccaatcccaagttcaagcctttgactctaaaatgcccttccctaaactgcagtggcaccaatcactattagtgtggccctgggcaaaatatatccgagagaatgagcaagcttcattatgaatctttcttccctcttgttctaagttttttttgctatgtttttctcctttgttcagaatttttcctttaaagaaaaaggatttattaaaaaaaaacttatatgataaacatttaaatatacttaatcagaatgggaaataatgggtaaataaaaatttcaaaaaataacggctcacttcacatttgacttagtatggtttctgattgtctttactgttttcaattattgaattattatttaataatggaaagtaagattgggtcatttgttttagatattcactttcattcattcatccatcacatgtttagcaataattatgtgtggacacgaagttaggtggatatgtagtagttgattcacatatatattcaatctttcattta

SEQ ID NO: 96234 - DNA, 601 bp, Human
tgaaaatctcagaattctatttaaattatgtctgtattatcagccctttgaaatcgatggcacatgtagaaccaaataagatgacttactgaaggtcccttagtgactaatgtgagaataaagcctgaaacaaccaatcccaagttcaagcctttgactctaaaatgcccttccctaaactgcagtggcaccaatcactattagtgtggccctgggcaaaatatatccgagagaatgagcaagcttcattatgaatctttcttccctcttgttctaagttttttttgctatgtttttctcmtttgttcagaatttttcctttaaagaaaaaggatttattaaaaaaaaacttatatgataaacatttaaatatacttaatcagaatgggaaataatgggtaaataaaaatttcaaaaaataacggctcacttcacatttgacttagtatggtttctgattgtctttactgttttcaattattgaattattatttaataatggaaagtaagattgggtcatttgttttagatattcactttcattcattcatccatcacatgtttagcaataattatgtgtggacacgaagttaggtggata

SEQ ID NO: 96235 - DNA, 601 bp, Human
ccaaacactgttttgcctcactgttaactggccatggaatatcactttgcatttgttgagcatctgaatttgaaaatctcagaattctatttaaattatgtctgtattatcagccctttgaaatcgatggcacatgtagaaccaaataagatgacttactgaaggtcccttagtgactaatgtgagaataaagcctgaaacaaccaatcccaagttcaagcctttgactctaaaatgcccttccctaaactgcagtggcaccaatcactattagtgtggccctgggcaaaatatatccgaragaatgagcaagcttcattatgaatctttcttccctcttgttctaagttttttttgctatgtttttctcctttgttcagaatttttcctttaaagaaaaaggatttattaaaaaaaaacttatatgataaacatttaaatatacttaatcagaatgggaaataatgggtaaataaaaatttcaaaaaataacggctcacttcacatttgacttagtatggtttctgattgtctttactgttttcaattattgaattattatttaataatggaaagtaagattgggtcatttgttttagat

SEQ ID NO: 96236 - DNA, 601 bp, Human; identical to SEQ ID NO: 33877

SEQ ID NO: 96237 - DNA, 601 bp, Human; identical to SEQ ID NO: 33878

SEQ ID NO: 96238 - DNA, 601 bp, Human; identical to SEQ ID NO: 33879

SEQ ID NO: 96239 - DNA, 601 bp, Human
attagaggcaaattaattatttttgtcaaagtttttcattttcacctcaggactcctttaaaatcttaactattaaaactcccaaacagcttttatttacgtagcttctttctattgatgcttatcattttaaaaaaattaaagctgaggaaatttttaaaatatggtattatttatgcatttattaaaaataataaacctattaaatgttaacataaataacatatttttatgatcgatacacttcccaatacaaaaatatggtgaaatgagtgacttttttattacttttgtgactatkattaatgtctggtttaatgagaaagcaataggatttgcacatctgcttgggcgtttactgtgttgtattattaccattgtttatcctctagaagtctcactcaagtgagaacgacagtgagaaaggcaaatgaaaacttcctatcatttataaaaataattttaaccttatagaaccactgaaaagatctcagagacccacaggagtccttgaccactgattttggagattattgatctagtttacatgagaagttagtaagaccaacatgaggtcacaaatggcaatgtgagatcacaa

SEQ ID NO: 96240 - DNA, 601 bp, Human
gacgtgtccccaacttgtgttgcattatctggccccttttgtttgggcttcatcctttttggtgtgtggggcaacaaccttggagagctggaacctctggctactcttacatttgctatgaaagtaataaattgtctcaatctcaaaaagggatcattgcatctttactgttggaattgtttaggccttggtcatgaccttgccttgatgtacgcttaataggcagttaggaaagacgattcagaaaaagaatttaaaaactttaattgaaggttaacacttgtagagtacattcagtgtrctctacagagtcattgtaaagccactcaatattttaaataggttatgacatgaaaagttgaatgaaatctgttgactattttggaaagaggtaatattagaggcaaattaattatttttgtcaaagtttttcattttcacctcaggactcctttaaaatcttaactattaaaactcccaaacagcttttatttacgtagcttctttctattgatgcttatcattttaaaaaaattaaagctgaggaaatttttaaaatatggtattatttatgcatttattaaaaataataaacctatta

SEQ ID NO: 96241 - DNA, 601 bp, Human
tctcagagacaggaaaatgtatgaatgttcatagaaggaaaaaggataagctctgttaggataacagcaagaacaaaggcaagatgccacattgtatatgtaaaatagagaatgacttggtacagatgaagatgataaaggaagaactgggtgagaatatcagataacagctcaccatgatgtcctggcaactttgcacatatccatacaggccatgcaggtaaagttttgaaccacagttaatttaagttttggtaggatgctttgtgattctcccagaacacagaaagacgggaggctygtaaagacctgctgtgagaccacctcccacatggctccctatctctcccaggaggatgtcaagaggcagcttctcatcacctcctgattccgcctaaagctgcctggaatggagctgcagaccacaaaatcattttgctgtagtctggattagctcctcagcaatgacgtgtccccaacttgtgttgcattatctggccccttttgtttgggcttcatcctttttggtgtgtggggcaacaaccttggagagctggaacctctggctactcttacatttgctatgaaagtaataaattgt

SEQ ID NO: 96242 - DNA, 601 bp, Human
attatgccacaatgtggaaaatattaactaaataagataaattaaataatgcaaaataaaaataaaaacataatataaaatgactttatgtgtgcatgtgagtgtgtatgaagaaagattagaagaaaatatgccaacatactaatggtagttgtggacagattaaataattaggcaagattttattacctctctttctgaatttcaaatttttctgtaacacgaatatgttttatttgtaaggggaaaaaactcttgattttaaaaaataatcgattcctgagacaaaacatttgcttaktcatcatttgttaaacactgttgtgtccagcacactacaatgaaaataattttagaatagatttttcttaattaaccccagctctgaaaaccaatgtgaaaaatattcttgctatttagtttgtcatcaggaattttaaattagtaggctacatttgctatctgaaacatatgtgctttgcaaacattttcctattcattttcttcctgaataattattttaattggataagcaagcaattcaaatacacagaaaaaatatgacataatacagttttatattaacaatatgcagtggcca

SEQ ID NO: 96243 - DNA, 601 bp, Human
aagttaacttgaaactttcatttgttcaatctaagtcagtccaggtgaattatgttgcactgtctttgaataatcaatacacttccaatatagatattcagacattcttatggtaatggaaaagaaatagattactgttgactcatgggttactgatgaatacatcactatatttataactgttatgtagtaatgtctatttcgtggtcaaaagacatcgatttcatttatagtagacgggcattcagcctagatctgataaatttattattttctattatttaggccatgaaactttctkctcccaccacttgaaaatgaaaacaagaggtttttaagctcatttgttttaagattgaagcacctgagcttgaatttttgcttagaatattttattttttaatcttctttgtccttttactgtttctgtaagaacttttaaattctctattactgaaattagaatcataataatgaactatgaattgatacctgcaaaaggtagctaaattgttttctggcttataattatctggcttggaacctagaacagtagacattcactaatagtttgcaagttaatggatttctgtgccttaca

SEQ ID NO: 96244 - DNA, 601 bp, Human
gagaaactctttataaaatatcttatattaataatattttataaagaatataaaacattgaaaaatataaaggaaaatatacccacatataatttataaagaaattttgttttgcctatgtaagttagtaacctgttaatagaacatcaaactgagtaaatatatgctctgtttccataaagatgcttaggagttcatgaagttaacttgaaactttcatttgttcaatctaagtcagtccaggtgaattatgttgcactgtctttgaataatcaatacacttccaatatagatattcagrcattcttatggtaatggaaaagaaatagattactgttgactcatgggttactgatgaatacatcactatatttataactgttatgtagtaatgtctatttcgtggtcaaaagacatcgatttcatttatagtagacgggcattcagcctagatctgataaatttattattttctattatttaggccatgaaactttctgctcccaccacttgaaaatgaaaacaagaggtttttaagctcatttgttttaagattgaagcacctgagcttgaatttttgcttagaatattttatttttta

SEQ ID NO: 96245 - DNA, 601 bp, Human
ttagatgattgcatgagcttgagaaagagttctaaaaatgattactatgcttctcagtccactctaacccccagactgtgtattttttcacttggacaaaaaacaacagagttcacatgcataaaacataggaaaagcggattcaaaattgcaggtctaaatacagcagcaggcaaataatagtagtaaaaaaaaaagtacacaaatacactgcatgcatttccttactttttcccttgggttgttctactgaaagaaatacaaacaaaatcattgctcttaaaactttaaagataaaacrtactaccctacatattgattagactgtaatttttcccacccctccttccaattttctctccttaaatttcacaatgaggtgaaatttcacagtgaggctctgaggtattgttaattactgtaggtgcttccataatttgattggcaaatattatttgacaataaattaacccaggattatactgtttaaccattttaaattatttacacctgatatgtaatagtctcttaaacacataaaaacacatgtgaacaagtctaggaggcacaggtatacttgccaaatgaattattcaagacc

SEQ ID NO: 96246 - DNA, 601 bp, Human
ctgtgccagtactcatcagtagctctgcacacacgtaaatctggaactgagagaactctctgtagatggattgctccccctggctgagttgtagtataatttcacgagtgtctccacagggcattttagagcatttttacaacgttgaatgtctcagcatccttgctttttgtagggccaaaacacataaatatattttaattggtatatattttaaaacatttttgatatcactagaatcttaaaatctatattgctggtaatgtgctaatttttaatagtgtattgaataagttcaagkgtttttttttttttttgctttcttttgttaaatatatcttattttcttcagaggagaacctatatttgtgaaagacatacattaagttattgagcttgactgaattgttagcacacagtcttaatagtgttaaagcaacagtggatgaggctgaatagcaaccctattagacagagctcatagtgagtgtaggggggaaattatgttatgggaaaaatgtcatatatcacatgggcatgccaaaatatctacagattacaaaaagaaagataggaaaaaagttgtaaaactagcctgtaa

SEQ ID NO: 96247 - DNA, 601 bp, Human
aaagttttatttaatgaatagattttgaagactagaatatgttcatactgaaagaactctacaaactatattttaaaaatatagagtgtcatagaatgctacggtcatcacatcaatttcccaagtatacaattttgttagtcaggcttctaattaaataagtgtggtataatgagcaacttatcctcttttaagacagcctttaagcagcaaaacaaaaaaatgaaacaaatggcttggccaagtgttgcaggtcaaaaagaagaagctatgacgatttagctaaaattaaacaaaatgrgaacattatcaaatgttgtctggcaaatgaagagcaattaaatacattgtttaatttattgcttaactgaagctctaattataaaacatttccaagaaatttgtgatgacagtcacaaacagtgataacagtcaaaaaagtactggaagcagatttggacatgcatcagaatcgaataccagctatacataagattaaaagttaaaataaagtcccctcaatcttatcagaaagctgaaaaatagctgtgctaatttgttcattatataggatagctcatggtgtaattattgaattacc

SEQ ID NO: 96248 - DNA, 601 bp, Human
acatttacattataataagtactaattttataagaattgcaagcactaattttacatgaagtgctatcatctacatttctattcttatttattttgccttgacaaccttgtcaaattaatgtaaaagaagattttcaagaaatactttaacatacccacatttttatctgatattttaaagaagaatggaaagattcttaaagttttatttaatgaatagattttgaagactagaatatgttcatactgaaagaactctacaaactatattttaaaaatatagagtgtcatagaatgctayggtcatcacatcaatttcccaagtatacaattttgttagtcaggcttctaattaaataagtgtggtataatgagcaacttatcctcttttaagacagcctttaagcagcaaaacaaaaaaatgaaacaaatggcttggccaagtgttgcaggtcaaaaagaagaagctatgacgatttagctaaaattaaacaaaatgagaacattatcaaatgttgtctggcaaatgaagagcaattaaatacattgtttaatttattgcttaactgaagctctaattataaaacatttccaagaaatt

SEQ ID NO: 96249 - DNA, 601 bp, Human
aaatgttattaagtaagattatgaataaggagataatatttgctggaagtgattattccatattttaaaaacaaagcgatgtataatgcatttacaaaaagtgttttgttcttgttttgttttgcttttacactaaactgtgaaagagtacttcgcaaatactgcacagatgaattcactgagggtcttgtgaagttgcagactctgattcagtaggtcttgagtggggccaaaaatccttcatttctaataacattttgggtgattctgatgctgctagttcacagaacacacattgagragcaagagtgtaacatttggctttcattttctaaaactgcattgatgttatgtccatgtcaagaacttggaaaaaacactgtgagatggaagcattccccaccctttactggcgctgccttaccacctgtttgaggctacagcattaataaacactggacatgagtattcggaatccagcaacagtggtcttactcacctgagtgttctttctttggtgactttgctgtatcaaaaaggaaagaaaaaaaaatcagcattctatgtcattcaattgtaattcagtattcaattgcaaatc

SEQ ID NO: 96250 - DNA, 601 bp, Human
atagttttaaatgagggaaatataaatggtttcagaaattttcatttgaaatgattaattgggcaggttaaatgctagaaaacttcaagacaataatttggtatccacagcaactgcacttttagtttttgttgataggtttatttgtcttgtctagttgtttgactctcaatcagtttttttctcatcagaatgtaaatatattttgggcaaaatctacttttgctctcactgcaactcccctgagcactcaggaaatgttattaagtaagattatgaataaggagataatatttgctgsaagtgattattccatattttaaaaacaaagcgatgtataatgcatttacaaaaagtgttttgttcttgttttgttttgcttttacactaaactgtgaaagagtacttcgcaaatactgcacagatgaattcactgagggtcttgtgaagttgcagactctgattcagtaggtcttgagtggggccaaaaatccttcatttctaataacattttgggtgattctgatgctgctagttcacagaacacacattgaggagcaagagtgtaacatttggctttcattttctaaaactgcattga

SEQ ID NO: 96251 - DNA, 601 bp, Human
ttcatgttaaacctctcttgtaaagttctcaatgtctatgtgtatacttcaaactgtaactttttttaaaaaaagacattcctatcaagctactcaatatatttttcaatttttatctgatgtatctactgacataatatgtctcaaaaactacttgggaggcttaggcaggagaatcacttgaacccaggaggcggaggtgcagtgagccaagatcacgccgctgcactccagcctggtgacagagaaagactccatcaaaaaaaacaaaaacaaaaacaaaaaaacaaacaaaaaaaamcctcagcactaaataacaggcatttgttttatgtattagtagcatcaccagtacttgtttacctctaacctctcaaaaaatatataagcacattgatgtcacgcatagaactgaggactgacttaaatcctatatacaaagcttatgtatttcttcctaaggcaaaatattttccattatgcttaaaataacttttattaataacagtcagttacttcatcaaactaagaaatatcaacaatttctcagcattttttcctaagcatattgtcaaagttaccattgctgcaaatgccacag

SEQ ID NO: 96252 - DNA, 601 bp, Human
ttctacagactaagtatcagcatagcaaagactccataatatagagttccaatcagctttacatttaactaaaaattttcatggaaatataaatggaattttagattcatgttaaacctctcttgtaaagttctcaatgtctatgtgtatacttcaaactgtaactttttttaaaaaaagacattcctatcaagctactcaatatatttttcaatttttatctgatgtatctactgacataatatgtctcaaaaactacttgggaggcttaggcaggagaatcacttgaacccaggaggcrgaggtgcagtgagccaagatcacgccgctgcactccagcctggtgacagagaaagactccatcaaaaaaaacaaaaacaaaaacaaaaaaacaaacaaaaaaaaacctcagcactaaataacaggcatttgttttatgtattagtagcatcaccagtacttgtttacctctaacctctcaaaaaatatataagcacattgatgtcacgcatagaactgaggactgacttaaatcctatatacaaagcttatgtatttcttcctaaggcaaaatattttccattatgcttaaaataacttt

SEQ ID NO: 96253 - DNA, 601 bp, Human
taaataaaggagtctttgctgacttgcagaaattgtcagtctagtttcagcatccctgcctagcccaaggtacactttcttcatccacaccacaccctgacacataactttcgatgtggaagcatggagtgctcttctttagcatcgcaccagtaatctgaaaggttttcattttcttgaagctcatgttactatgagactctatgatatggtttggctgtgtccccacctgaatctcatcttcaattcccacacgttgtggaagggacccagtgggaggtaattgaatcatgggggcaastcttccctatgctgttctcgtgatagtgaataagtctcacaagagctgatggttttaaaaatgggagttctctcacacaagctctctttttgcctgcaaccatccatgtaagatgtgacttgctcctccttgccttacactattattgtgaggcctccctggccatgtggggctgtcagttcattaaacctctttctttggtaaattgcccagtgtgggatatgtctttatcagcagcatgaaaagggactaatatatgctctattctgaaggtgatgtacgtcccaagcttgtccatgt

SEQ ID NO: 96254 - DNA, 601 bp, Human
tactatatttcttcttgaagattcaccatatatacagtgttaaagccatgaagcactctacagtctacacatctacttgttgtgtcctctccatgcttggaaatgactaattttattgtcaacctctgtgttgctatccaatgtgtggagaggcacatgcaggggaatgtaggtaggggaggtgggtgtgttgaggtatttttgctcacactatgataaataaaggagtctttgctgacttgcagaaattgtcagtctagtttcagcatccctgcctagcccaaggtacactttcttcatmcacaccacaccctgacacataactttcgatgtggaagcatggagtgctcttctttagcatcgcaccagtaatctgaaaggttttcattttcttgaagctcatgttactatgagactctatgatatggtttggctgtgtccccacctgaatctcatcttcaattcccacacgttgtggaagggacccagtgggaggtaattgaatcatgggggcaagtcttccctatgctgttctcgtgatagtgaataagtctcacaagagctgatggttttaaaaatgggagttctctcacacaagctc

SEQ ID NO: 96255 - DNA, 601 bp, Human
ttgaagctgcgttgctgcaatttctgcttttatgttcatgtggcagtcttctgtatgcatctgtgtgtcccaaatttcctcttcttttaaggataccagtcatcagattgagggcccaccctaatccagcatgacctcatcttaacttgagtatatctatgaagaccctatttcaaaatcggtcacattcataggtaccagggtagagcttcaacatatcttttggtgggaggcacgaatcaacccactatgtctgccaaaacaccaaatgtactttatgcctaccacctgagcagtcatygaagctgaaggaagacccccaccctgcagcagacctcacttcaaatgtggatcacatttatgagatcacttagcactggccagtaatattaccacagacccaataaagttgctttctcatactcttaacaaaagttgaaaatattctcttccctccttaaacatcctacaacataaaagtaagctgctgttgagaaattcatagagaaaataggggcagactaaattacatcactgttccactaccacaccagcacatactcatccatttttctttccagttccaaaaggtgatcagttc

SEQ ID NO: 96256 - DNA, 601 bp, Human
ttctagaggctggaagtccaaaattcaggcattggcaggaccctagaaatctccctctaaaggatcttgggaagaatccttccttgcctcctcctagagtctgctagttgccaggaacccttggcattccttggcttgaagctgcgttgctgcaatttctgcttttatgttcatgtggcagtcttctgtatgcatctgtgtgtcccaaatttcctcttcttttaaggataccagtcatcagattgagggcccaccctaatccagcatgacctcatcttaacttgagtatatctatgaagamcctatttcaaaatcggtcacattcataggtaccagggtagagcttcaacatatcttttggtgggaggcacgaatcaacccactatgtctgccaaaacaccaaatgtactttatgcctaccacctgagcagtcatcgaagctgaaggaagacccccaccctgcagcagacctcacttcaaatgtggatcacatttatgagatcacttagcactggccagtaatattaccacagacccaataaagttgctttctcatactcttaacaaaagttgaaaatattctcttccctccttaaacatc

SEQ ID NO: 96257 - DNA, 601 bp, Human
gacctccttggcctcctcaattcagaaaactagaaactccacttctctggcaatttccaactatatttgtaccctcagaattttcctttactgccagaattttgattttaaaaattatattctttggcaccatttttttctctttagagctcacttacacaagaactcccattatacggtatctgatcccattaatacttccattccttgttcttgccactttctcatttttcaagattttcctcatatcctcactttacttcttaccaagcttatgcataaatgagccatagttaaatcrctcacgtattttctgttgttatagtcatctgctgtattaatttcctaggactgccttaaaactattgggtagataaatacaaaacaaatacatttttccacagttctagaggctggaagtccaaaattcaggcattggcaggaccctagaaatctccctctaaaggatcttgggaagaatccttccttgcctcctcctagagtctgctagttgccaggaacccttggcattccttggcttgaagctgcgttgctgcaatttctgcttttatgttcatgtggcagtcttctgtatgcatct

SEQ ID NO: 96258 - DNA, 601 bp, Human
ccgcactttggaaactgataaccaaatttcccctatgaatcagtcaagactattcctactgtgagtccccctccctacttacctcagttactaccatgagtttcagccttctagcagaaaacagagtccatatggctctgtatttctcctagaagctgacatacttccaaatcccttcctctgtgtcctctgtccatcagcagcattcactcctgtatcttcagcctcttctcagaatgttcattttactttcttcctttaatcaaatcctagctcactaaggccactgtatcccctcctratggtagtcttctaaaatggagaatgcttgtttttccatcctccacataccaaggtgtatagaagtaatgcatatttatatcctctttgtttctcattactcttcatagattatctccttgcttcctccaaaccccagttcttttgaagtacatgctatcaggttgcaccactctctactcctcttcattgttgtcatcaaccagtcttgtggcctttcctgacattcattgactatttttgcacacagttatcatctgctctactactactatgaatattattaagaatcattcttaac

SEQ ID NO: 96259 - DNA, 601 bp, Human
tcgttcagtttctgcaagttcagatattaaaggaatgagaagtggatattagtgatgccaaattcacatcttatactattgagaataaaattaaagataaaatgtatgttgcacatgagagcaaagcaagctgtagagaaagccaaaatacaaagtgcttatatgattttttcaattaataaacttccttaaatagcaataaagaaattctcttccaaggtgcaactctattatcttaaaaatgtaggtagtgaccataaaagaaggtggcctattccatagactttagatcaatagttcktaaaattaaggccacattcaatacaatgggatactaatttattagtctacaatttttttttttaaacggagattggctcttgttgcccaggctggaatgcagtggcgcaatctcgactcactgcaacctctccctcccaggttcaagcaattcccctgccccagcctcccgagtagctgggactacaaccgcccgccaccatgcccagctaatttttgtatttttagtagagacggggtttcaccatgttggccaggctggtcttgaactcctgacctcaggtgatccgcccgcctcagc

SEQ ID NO: 96260 - DNA, 601 bp, Human
tcttgtgcaaaataggtttgtttctatatcaacgaactagtaaaatcaataaatagagctcttttctaagcacaaaacaatacattgttagaaaccttagcagaaataacttatagttatgacatctttatctttaagctgcatttaccttttttaattgaaaccgcaccaatctcctctttggctcgttcagtttctgcaagttcagatattaaaggaatgagaagtggatattagtgatgccaaattcacatcttatactattgagaataaaattaaagataaaatgtatgttgcacaygagagcaaagcaagctgtagagaaagccaaaatacaaagtgcttatatgattttttcaattaataaacttccttaaatagcaataaagaaattctcttccaaggtgcaactctattatcttaaaaatgtaggtagtgaccataaaagaaggtggcctattccatagactttagatcaatagttcttaaaattaaggccacattcaatacaatgggatactaatttattagtctacaatttttttttttaaacggagattggctcttgttgcccaggctggaatgcagtggcgcaatctcg

SEQ ID NO: 96261 - DNA, 601 bp, Human
ccagatgatggggatcctatggagtttaaacagttacatttctataatttttcaaaattaacttgcaatttgactagcataactagctttaatttatggtcctaaaggaataaaactataggctttagaacagtaatgataaaatcttgtgcaaaataggtttgtttctatatcaacgaactagtaaaatcaataaatagagctcttttctaagcacaaaacaatacattgttagaaaccttagcagaaataacttatagttatgacatctttatctttaagctgcatttaccttttttamttgaaaccgcaccaatctcctctttggctcgttcagtttctgcaagttcagatattaaaggaatgagaagtggatattagtgatgccaaattcacatcttatactattgagaataaaattaaagataaaatgtatgttgcacatgagagcaaagcaagctgtagagaaagccaaaatacaaagtgcttatatgattttttcaattaataaacttccttaaatagcaataaagaaattctcttccaaggtgcaactctattatcttaaaaatgtaggtagtgaccataaaagaaggtggcc

SEQ ID NO: 96262 - DNA, 601 bp, Human
gttcgattcctaatctcttaaggcagtatgttgcactagaatgctctccagatgatggggatcctatggagtttaaacagttacatttctataatttttcaaaattaacttgcaatttgactagcataactagctttaatttatggtcctaaaggaataaaactataggctttagaacagtaatgataaaatcttgtgcaaaataggtttgtttctatatcaacgaactagtaaaatcaataaatagagctcttttctaagcacaaaacaatacattgttagaaaccttagcagaaataasttatagttatgacatctttatctttaagctgcatttaccttttttaattgaaaccgcaccaatctcctctttggctcgttcagtttctgcaagttcagatattaaaggaatgagaagtggatattagtgatgccaaattcacatcttatactattgagaataaaattaaagataaaatgtatgttgcacatgagagcaaagcaagctgtagagaaagccaaaatacaaagtgcttatatgattttttcaattaataaacttccttaaatagcaataaagaaattctcttccaaggtgcaa

SEQ ID NO: 96263 - DNA, 601 bp, Human
atgagaacaatatattttttcatgcacggctgattgtcagtgagaggtaggagatgaacaagttacttgacaaatgagaaaagtatcctttgatttttgtttgtaatttgtcaaattggtaaaacccttcatgagtttcaaaacagctatggttgctttgaaaaggacacttatttctgttcgtgctgtagttgcaaataaactcaatatgtagaattatatttaaattgagaattggggtatgagatctatgaccaactagaagcaaagtagttgatgtcaataatgcatgcgaatagayagataatttatttcctttcacttccctctaagcctgacaagcaagtctacgtaaccccaaccaaaatgtttggccatactctataaactcagtgaccattcttagttgaggactctggtgagttcactaattgatggttcaatttcaattctgtctatgtgctaactccaatttgtcctgattcaaccccatactatgtgagcttatatttctaccctaaatactgttcaatcaagcctagcctgaagttgcctccttacatattttgagtttggcgtagaggtttctctgtacatagtg

SEQ ID NO: 96264 - DNA, 601 bp, Human
aatacatgatgagaacaatatattttttcatgcacggctgattgtcagtgagaggtaggagatgaacaagttacttgacaaatgagaaaagtatcctttgatttttgtttgtaatttgtcaaattggtaaaacccttcatgagtttcaaaacagctatggttgctttgaaaaggacacttatttctgttcgtgctgtagttgcaaataaactcaatatgtagaattatatttaaattgagaattggggtatgagatctatgaccaactagaagcaaagtagttgatgtcaataatgcatgygaatagatagataatttatttcctttcacttccctctaagcctgacaagcaagtctacgtaaccccaaccaaaatgtttggccatactctataaactcagtgaccattcttagttgaggactctggtgagttcactaattgatggttcaatttcaattctgtctatgtgctaactccaatttgtcctgattcaaccccatactatgtgagcttatatttctaccctaaatactgttcaatcaagcctagcctgaagttgcctccttacatattttgagtttggcgtagaggtttctctgt

SEQ ID NO: 96265 - DNA, 601 bp, Human
acctccatgcaaagggcaccaatgtatacatctccagcctatcattgtctggagctctagttttatttctagaaccacctatgtgatgctaccttcatgtgctactagcactttgacttaaatttatgtaaaattaatcttgccttttctctccaaagtctttagcttttctttttcattgttattaagaatattaacaatattcttctggcagccagtctgaagaacgctattgtcattaaattatttttcttttcttccctcccaaagcttatcatcagttgtgaaattccactgaatmtacttctttattagtgctaacataatctctctctcttccaatctcataactaatgccctagtccaggtcctaacacttttcactacattgttgagaatctttctaatctgcctatttcaaaattttcctttattagttactctccctaaagcatatgtttgagtgttatttatatacttacaatttttcatcacctccctaattgcccatggaataaagtccaattttaaaacaaggccttttatggcattattagcccagtttatattaattcctacaatggtcttgagataattactg

SEQ ID NO: 96266 - DNA, 601 bp, Human
tttattcccagccaactatcttcatcatcatttctcatatacttcactccctctttcctcattcaatttgtcaccctttagggtttttggatgtcactcccctgaaaattctgtattgaaaattattaatatattatgtacctgacaaatcccatgaccatcaccttcctattggaagtttttttttctgcagttactgaagttattttagtctgcttttatctttgattttccttgttctttccccaaacaaatgcaaatgtaaatgttaccttatctcatcatgaccagacaagctcarttacctccatgcaaagggcaccaatgtatacatctccagcctatcattgtctggagctctagttttatttctagaaccacctatgtgatgctaccttcatgtgctactagcactttgacttaaatttatgtaaaattaatcttgccttttctctccaaagtctttagcttttctttttcattgttattaagaatattaacaatattcttctggcagccagtctgaagaacgctattgtcattaaattatttttcttttcttccctcccaaagcttatcatcagttgtgaaattccactga

SEQ ID NO: 96267 - DNA, 601 bp, Human
agcaatgatgatgtcatcagcattggctggagcttcagtggcatggtagggacaggagcttagtctttgtggaaggccagaggcagtgctaggattccagcattcagaaagctggctgacatgggaaggagataaagtggtagagagacagagagaaagagagagagagagacggagagagagagagagagagagacagggagagagagagaggtgtaaatcaaggaaaagaagtaattttaatcagagaaaaaacatttccaagatgaggaacaatgccagtaacaagaaagaggaggaygccacaaaatggtatggatgactgatttgaaggaaaaactggagaaactggtcctgaagagaaggagaaacactacctctgagattaaaagatagatggatatgtgccacattttctttatccagtctatcattgatgggcatttgggttggttccaagtctttgctattgtgaatagtgccgcaataaacatacgtgtgcatgtgtctttatagtagaatgatttataatcctttaggtatatatacccagtaataggattgccgtgtcaaacagtatttctggttctagatccttgag

SEQ ID NO: 96268 - DNA, 601 bp, Human
ataagaggctagtaagatgtgtagtgcctgagtctattctatgaatgttctgtctcaaatcaacatggaaatgaaacactgacaatttgtaactataatagagccacacaggtaggtattcttattcataattcttttattcagaataatcattataagtatgtttaggaaatacatattttttagttattttaattgaatcccctgaagggtaaatgtctcagaaaacaactgaagtgtgacttacatataaagaccaagttttcttttcaacgatgggttcataatttctggcacacayattaaatagagaaggctagtcccttaaagtgctatgttttttgttgctcagaaaaggtcactggaaatgctgattatctatacagaaaagataacatttcacataaaatgttgatcctttcttttctggttctaatgtaaaattcatcaattctaattctatgaagagcaaacattagaaataaacagctcatctaagtaagtgaattttttaacttcttggagtcaaaagaagaccgtcatcagtttctctttctataccacaagatatctggaatatcctttagtgctgagtgaagaa

SEQ ID NO: 96269 - DNA, 601 bp, Human
tcaagtcatctgattggtgaacataaaatatccctccattgagttttgtgttccttaatttctcaaatatgttaaaatgtaagagatcttcaagaacattatgcataatttgttacatttatttcaagatattttatggatttgatgctattatattagaacagcattgtagtcatctttcactttattttccaaagttttgctcttgatttctaaagcagttatgtttcatttgacattttatgcagaaaacttgctagtcactcagttgtagcaattttcctctatagattgttttgawttttttaagtagataatcatatcatttgtgaataacgtgttttatttcttacttctctatttgcatatttatgatttctttttctcattttactgcactggatggaaaacccactatggtgtgtgatagaactggtgatcgcaaacatccttattttgttttgattagcagggggaaaacctttaatttcctccattaagtatgatgtttgctaatggtttttgcagatgttttatcagattaagtaagtttctattcttgtgatgaattatatcaaatgtatctactatgatgaatata

SEQ ID NO: 96270 - DNA, 601 bp, Human
aagtattatttccaaggtatccaactgaaatttagctaagccagatttagctttcagtttcatcaaatacaggatgtatagaacattttaaaccatattgtgaagaaataattagaccaatcaaaaatgtctataaggtaactggtcctgatctttgtaaaaagacagtgtaattaagaagggaagaaggaaggagggagggagggaaaaaaaggaggtgaatttcacctttaattatatctgttgaaaaaaacagatatccaaaaatttgaatatgcactggttagaaaaaaattccctrtatttccaggaaagtaacctattattttacccaattatgaccccaaaatagagcaaaccatgtgactgtgaagcaagggagatgttaaactaaaagcaaataaatatgtatgaacctcacagatcacacctgtagataaatcttacataacacaagatattatagggtaaataccaatgaatgctatgctctttattttgctgtttttgttagattatagtcaatattagggttaggacagtgggaaggggtaggcaagttggccttcaatgctgaaataaaggcacaagtcccaagata

SEQ ID NO: 96271 - DNA, 601 bp, Human
tctacttgcattccaggttattgctggagtcatttagtgtcttgtaaatgtcaactagatgctcctttatattcgtgcttaacatagcttaatcagctgaaacaatagtgtagtcatgcctgagattcatttaaatattaaatgaaaccatcccaaatcatcagtaaccaaaaggggattatttgggtgctgtacccctttctctaagatgttttgctctcagtgaagtattcactgtttacctatttacagtagttgacagtccaaaagtagaacagtacaaatgattcatttggaatcrgtgcactccattgaaagaattgattcaagaaaatcttcagagttcattagcaaccattaaatgaaagattgatgaggaactgattattgctattgcacccaaatatcaccccacataaaactgaaagaagaaaaaatacaactttaaaatgaagaaatgtgtctgtagccaacttaacccactgatgaaacttagaaacattcattcatatcaggacatccagacatcttttgcttcctgatgagatgccgtgtagcatatacagtatcatctctaaagtattatttccaaggtatccaa

SEQ ID NO: 96272 - DNA, 601 bp, Human
tttataacactgaaatttcagacctcttgggagaatggttgaagtcataatatagtatatatcataatatactctatttttgctgttattttcttcattttaacttttacatattttttttcaagcaacagaaatagtttttgcatgtataggattgggccatctttatttttcaaattataatcagtaaggtggtgttaaaaccacaaatcaaataggaatatgtctaccagttaccctggatcattgtcttattcccagcaatcttcagcatgtcccctgatgtaattaaacagtttgkggagtttccctgttcggaactgatattcaaagttcagttacacaaaagaaagaccaacccagattgctgtctcacattctccctggcacagaaaaacatgcaaggacagtgataaagagtaatagacttaaaggttattgtcttccgcctgtctgaatccagtgctttcctccgcatgttgttgtctttctaaagaagataatgtcaacctccttcatttttttttaccttgctccactgtcttggttgttttctcttccttctttccaggtacagctgcaaaacaaagataaggtttaa

SEQ ID NO: 96273 - DNA, 601 bp, Human
gaaaaaatgcctaagtatctgttacatgcttatctagaagtttacacattttcatatcctttcacatatgttttcatgtttgccctatacaacatcttctcagatgggcagatcagggataattacctttattttttaaaaaaataaatttagactcaggaacacgcataaatgaacacactgaaattaggatccagtgctcccactttatatttcagaaactaaaattccactcttcttcaaaaagaaaccaacagaaacatctactgaactgtaaaatttcagagtccccagaagccaraataaattggaaaacattttccatgcaattataaagggattttattttgaaaagcccaaggaaataaattcttaaccaatctttttacttaactgaattcttaaccttagtttacttatttgacatgtgagggattgaaggattttcttgatatatttatgtcaaaagatcttaacttctgatattaggatttcatacatttaattgcatctcaaatttgaaggagaaatcatttagactttgttcttgataaaattattgcaagttctaatttaatttattacaataaatatagtatta

SEQ ID NO: 96274 - DNA, 601 bp, Human
gaataccatggagtgtgaaagttcatgtggattcttgaatggagaacgtggggtagaaacagtgaaccttggctggaaagtcacactgaggcttggtagcaaaaggaacttgtgttaccctctaaggaatttaaatgtatatgcttccagtgataaggatttaaagatcctaaagccaaacttgttcctgccattgtaccaatgaatttgcaaaattttgctaagagaatatagtacgtactgaaaaactgacagtacaaagtcattattgccatgttgtaaaaataatcagaaaccaccmgtcacacacagttgttatctacattatcttatctccagagacattaagttcttctgccccattttttatagttttttttctgtgtgtatcaagggcatactttctatatcctgtgtgccattattactaattctcatgcttacaaccttacttaaagcattttatgtcatttaatttggtacccaatagcatgccttattcctgagatatttttgaaatttaagtgtaatgtaaagtatcagcaaaactttaaatattgtcattccatttagtagatttaaataatattttaaggtattt

SEQ ID NO: 96275 - DNA, 601 bp, Human
ttgaggtccaagactctcaaaaagggtttggttggagtaaaataaaagccgatgctatttcaacaaaccagaaactgttctttgtgttgtgcttaccagaatgacagagtgtctctcctgtggataaagaagtccaggacccctagaatcctttctcttgaaaatgatattataaaaggaggacacaagtttgtgttttaaaagataaaccatattatatttaatagatatttgttgagtgtctcttttctactgagagctggaaaaataaggaagattgtgtggagttcgaactgtgttgtgatgcaaccacatagacagattaaatacgatgataaagggctcagaactctgggtgcatagcagaaagactggcaaactcgacctgagaaaatgaaagaagacttcacagaaacactggcatttgtgatggattcaaaaactgataaaatttggaatgaaagaagaattagaaaggcatttcaaacataaaaaaaaaacataagaataccatggagtgtgaaagttcatgtggattcttgaatggagaacgtggggtagaaacagtgaaccttggctggaaagtcacactgaggcttgg

SEQ ID NO: 96276 - DNA, 601 bp, Human
tttatattttagatttttattaaatttttaaaaaatttccacactaactgtattgtaatctttgtgatggatatgtacacagaaagaaaattgaggtccaagactctcaaaaagggtttggttggagtaaaataaaagccgatgctatttcaacaaaccagaaactgttctttgtgttgtgcttaccagaatgacagagtgtctctcctgtggataaagaagtccaggacccctagaatcctttctcttgaaaatgatattataaaaggaggacacaagtttgtgttttaaaagataaacyatattatatttaatagatatttgttgagtgtctcttttctactgagagctggaaaaataaggaagattgtgtggagttcgaactgtgttgtgatgcaaccacatagacagattaaatacgatgataaagggctcagaactctgggtgcatagcagaaagactggcaaactcgacctgagaaaatgaaagaagacttcacagaaacactggcatttgtgatggattcaaaaactgataaaatttggaatgaaagaagaattagaaaggcatttcaaacataaaaaaaaaacataagaatac

SEQ ID NO: 96277 - DNA, 601 bp, Human
tgttattgattacttaaacacttttcaaatgtcaaactagacttgcatatctggaatacgtataattctttttatgtattgttgaatttgattttttatattttagatttttattaaatttttaaaaaatttccacactaactgtattgtaatctttgtgatggatatgtacacagaaagaaaattgaggtccaagactctcaaaaagggtttggttggagtaaaataaaagccgatgctatttcaacaaaccagaaactgttctttgtgttgtgcttaccagaatgacagagtgtctctmctgtggataaagaagtccaggacccctagaatcctttctcttgaaaatgatattataaaaggaggacacaagtttgtgttttaaaagataaaccatattatatttaatagatatttgttgagtgtctcttttctactgagagctggaaaaataaggaagattgtgtggagttcgaactgtgttgtgatgcaaccacatagacagattaaatacgatgataaagggctcagaactctgggtgcatagcagaaagactggcaaactcgacctgagaaaatgaaagaagacttcacagaaaca

SEQ ID NO: 96278 - DNA, 601 bp, Human
aggacgtaaagactatttttgagggttttttgttttcttttttatttttgtttatggatgtccagttgttgcaacaccaatttgttcaaaagtctatcctttctccagcaaattgttttttctcctttgtcaaagatcagctgattatatttttgtgagtgcatttctgagttctctattctctttcattgatttatttgtctattctttcactaatatcatactgtcctgattactgtatttttacagtaagttgtgaagttcagtagtgtcagtttgccacttaattctcattttccartgctgtgttggctcttctgggtcttttgccttttcatataaactttagaattagtttgtcaatagccacaagataacttgctagaattgtttttggaattgtgttaaatctgtagctcaatttaggaagaattggcagcttgacaatactaagtcattgtatcaatgaatatggagtatctctcaatttatttagtttctgtttatttcttttacgtggtttccctccaacaggtcttatacataatttaaaaaatatacctaagtgtttatgtttttggtgccaatataagtgatcgtt

SEQ ID NO: 96279 - DNA, 601 bp, Human
gtagatatcaccacaaattgttcctaaaagtgaacagggtgcctatctgaatcaccaaataacatcaatgttcttcataactgccagcctgccacagccttgcaaatcatatgtctgaagcagggactaggtagcctaacacatactcgaaattccacaactatctgttgaatgagttaataaatttgtcaaattttgtgctgatcacattttatcaggaaacttattgtcaaatctttacacagtaacctgatcatcattataaacatctttcatgattagccattttccaatttgtaayctttgtgtggcaaaagtgtcaagtaaaatgaaatggccaatatctgatagtcttcctggacaaaaaagaaaattacgtatatttaaatccaatgtttacctcacattttattttttttgttatctaagaaattttgagtgactttccaaagttcagtaatctcacacacatatattacacttttatgcccatttattttttataataacttctgattatccattcatttaagatataatacattctttatttctataacaatgttattcattatattctatattgtcttttgaacttttt

SEQ ID NO: 96280 - DNA, 601 bp, Human
aaaaggagaggtctttggaggaagacattatttctgttttgaaagtattgtgtttcatatgtcaacaggacgcccaaaaaggaaacatccagcaagcagttggaaaaaacaggtgaagtgcagatcatttacaggtgctgcaaagcaacctacagtattccttataaatgaaaactatcaatataactagtagcttgttttttcaaaggcctcaaattaatcttatttgctttgttcacacagactgacttgacttattaagtaaaccaattatataaaagcaaaataaaccagaaagtgwacaattattttcttaataatatgtgactggtgaaaacacacccacacactaagactagtgttctcagctgttctttttaccggcatgtttcaaatccaatctcatataatttgtctgtattgacatatcatttatatattggtagtgatggccttaactttatacattttgatgtgctattgccagacctttaaaaatttaaaatacagattatgatcaaaatagctatagaagtcgagttttaaataatctgagataaaaactattcattttgaaaataatactcaatagaaatgcatc

SEQ ID NO: 96281 - DNA, 601 bp, Human
ttgtgaaaaggtagttaatcaacaaagagcaaaatatttgaccctgtgaaaagtactccagtaaagttatatagataatagggaaagaatttattaattctaattttaaaattggggaaggttttcactgagagtacgccatttagatttaggcttataaattgggtggaatttcattggccaggaaatgccattttaattgcataactgtaagtagatgtattaggggtttttttttgtttttgtttttgttttttttgtcttgctttgttgccaggctggagtgcagtggcgcgatctyggctcactgaaatcccaggttcaagtgattctcctgcctcagcctcccaagtagctgggattacaggcacccaccagcatgcccggctaatttttgtatttttagtagagacaggttttcaccatactagccaggctggtctcgaactcctgacctcaagtgatctgctgaactcggtctcccaaagtgctgggattacaggcgtgagccaccatgcccggccatgtattaggtttttttgtttttgtttttgttttttaagctgagaatggttcttagagttcttacttggcttacagt

SEQ ID NO: 96282 - DNA, 601 bp, Human
atgatgaacaacatgaaatcagctgttgttttacaccactaagttttgaaatggcctgtatgtagaaatagttgtgaaaaggtagttaatcaacaaagagcaaaatatttgaccctgtgaaaagtactccagtaaagttatatagataatagggaaagaatttattaattctaattttaaaattggggaaggttttcactgagagtacgccatttagatttaggcttataaattgggtggaatttcattggccaggaaatgccattttaattgcataactgtaagtagatgtattaggggkttttttttgtttttgtttttgttttttttgtcttgctttgttgccaggctggagtgcagtggcgcgatcttggctcactgaaatcccaggttcaagtgattctcctgcctcagcctcccaagtagctgggattacaggcacccaccagcatgcccggctaatttttgtatttttagtagagacaggttttcaccatactagccaggctggtctcgaactcctgacctcaagtgatctgctgaactcggtctcccaaagtgctgggattacaggcgtgagccaccatgcccggccatgtat

SEQ ID NO: 96283 - DNA, 601 bp, Human
accattttctcattcagtgctcacaactccatgaggtatataggttctgttattatttctacttttcacataaattgattaaataactttccaagatctttaaataggagaccttggatttgaaccactatatctatgctctcaagcacataagtactggctccagtagttgcataatgggctcagtgaaggatgtaagaaagtatgtagtactgaggcagaacttgacaagggaaagaaattagacccacaaacatgaaatggaaagaaagacacattttagagaaacagagagagaatrggaggcctggacagggcagatctatcagttttgctccgtaggccatttacaaccaacagaagtggaggtgatgctgtgtgacttccaaggcgaaatcaaaaaaggtcatgcagtattcacctgctaatctagtgacacctgctttgggaaatgcagctgccatgtgagtaatctaattaacaccaccatgctggagaggctacatctaggcagtccaactaacagccccagctgagctcccagccaacagctagtatcaactgccagccctctgagagagccatccttcacatccaggag

SEQ ID NO: 96284 - DNA, 601 bp, Human
tgtgttttgtatactgaggcttaagatcacagggcatctgagttgatattcacaatacaaatgtctccaggcatatgttgtctataagacattggactaaatatgtaaacaatagaaaataagcccatgaatttctatcactagtacagactatgccatatatacaaaaaaaggtacatgtaaactaacatgggctttgaagaagaaagatataagaatgatagctaacattgtctacttactacgtgtcaggcaatattctctaccattttctcattcagtgctcacaactccatgaggyatataggttctgttattatttctacttttcacataaattgattaaataactttccaagatctttaaataggagaccttggatttgaaccactatatctatgctctcaagcacataagtactggctccagtagttgcataatgggctcagtgaaggatgtaagaaagtatgtagtactgaggcagaacttgacaagggaaagaaattagacccacaaacatgaaatggaaagaaagacacattttagagaaacagagagagaatgggaggcctggacagggcagatctatcagttttgctc

SEQ ID NO: 96285 - DNA, 601 bp, Human; identical to SEQ ID NO: 33880

SEQ ID NO: 96286 - DNA, 601 bp, Human; identical to SEQ ID NO: 33881

SEQ ID NO: 96287 - DNA, 601 bp, Human; identical to SEQ ID NO: 33882

SEQ ID NO: 96288 - DNA, 601 bp, Human; identical to SEQ ID NO: 33883

SEQ ID NO: 96289 - DNA, 601 bp, Human; identical to SEQ ID NO: 33884

SEQ ID NO: 96290 - DNA, 601 bp, Human
cctcgcagttaaatgtatcaagaatctaaatcttccctggtggcaaggggatgggactgatgcatgccacctggcacgcatgccctcacacttcctcctcctttgtgctggctgcaatgccaatgcataggcagaacttggaaccatgtactgaagatggcagaggccgccccaaatgaccacacacccccaaccaacaccaacaccacctgcaaacctatcttattattaattttttcatatgatttggaatttcaggttatatttcagcctgagaactgtattattgtggttgttgccrtttttgtttctttttttcctatgaattgcgattgtgtgattccttcctctcgcaccaatctttcactgggcctctagtcccaagtacactttgatggctccaaaacttgcctcatagtgttagtagggatattcctgaacaagtctctatttcaatacatgacttgcttcaggtcctagatgaggggctgagtttattttctccactttcctgggtctgcactttcctattaactgtagcaccagagaactatttacggcaactgtttttcaccttcttttcttgaatgggggttccact

SEQ ID NO: 96291 - DNA, 601 bp, Human
tcttcaaacatatggaaaggcatgtaatggcagaaaatcctgactagccaacacaacttgttcttcattccttctctcacccagaatccctcgcagttaaatgtatcaagaatctaaatcttccctggtggcaaggggatgggactgatgcatgccacctggcacgcatgccctcacacttcctcctcctttgtgctggctgcaatgccaatgcataggcagaacttggaaccatgtactgaagatggcagaggccgccccaaatgaccacacacccccaaccaacaccaacaccacctgmaaacctatcttattattaattttttcatatgatttggaatttcaggttatatttcagcctgagaactgtattattgtggttgttgccgtttttgtttctttttttcctatgaattgcgattgtgtgattccttcctctcgcaccaatctttcactgggcctctagtcccaagtacactttgatggctccaaaacttgcctcatagtgttagtagggatattcctgaacaagtctctatttcaatacatgacttgcttcaggtcctagatgaggggctgagtttattttctccactttcct

SEQ ID NO: 96292 - DNA, 601 bp, Human
tagcaagacaaaaacactggttaagtttactatggcatatgttgaattaacttattctgaaaggtgccttttgggataagtctctgagaccaactgtcttgattctttcttataaaagcagactacacaacacatactccttcaataaatcattgagctttcccctgcaggtttgtatctgaattaatcaatattaaaatagtgcttatagaaacaacattgtacctttgcaatgagacacaaaaactagtgacaactgaacatgcaaaattaccaatttctgtaaaataaatagcagagwgagtgattactagtattggacttcaagtttgttggtagtactcatgttaagaagaaggtttagggttcctcaattttgagacttaactttatcctctcctaacattatttctcttactcttggctctttccataagaaatcgcacccatgcatggcatgccaacatcttcaaattcagaatacaggttcacaagtgtatctccaacccaaatattttttctgatactcacacccaaatagccagcttccagctctagatttctactagaatgtcctaaaaatacctcaaattcagcatgg

SEQ ID NO: 96293 - DNA, 601 bp, Human
gataagttttgctaatatattccaatattgaaaaaaagaaaaataagattatttttagtggttattaagtctgatactaagtagctaattcagcataaaaatcttggctaatcatttaatctttgggcatcaatttcttcactgttaacatgacagttgtagtatttctccttaaaatacttcagggcagaattaaatcatgctaagaatttatattagagactaggcaccaagaaactcagaaaaagtacagaaaaattaaaatactaatgttgattactaaaccaaatattctagaccyagtattagactatgaaaatattttactgaaagttctaatatttcgtagaggaggacaatgacatgagtgaagatgacatatgtgaattgcaatactattggaacattttaaaaatttagagtagtgaataaaatatatagattaattgaatcttcttagagttatcagtttcaaaagacaaaataaatccctgttatatcagtttaaacagaatcagaacactaaataactttaaaactggaactttggggacaaaactccacctttttatgttaatcactggacactggaatatttatg

SEQ ID NO: 96294 - DNA, 601 bp, Human
cagtatcgattttcttgaatttgaagtaagaataatcaattaagtagataaaatgtcataggtttaagtatgaatcatcttatatcttgttcaaaaatgtaaaaataatagaagacttacagtagaaataatatattttttaaaatgttaatggacagaagccaggtgtgtggtgcatgcttataattccaggtactcaggaggctgaggcaggaggagctcttgagcccaggagtttgaggccagcctgagcaacagagcaagacctcatctctgaaaagaaaaaacaaaaaacaaaacraaacaaaataaaacaaaaaaaccttcaaggagagaagcatattagaacatatgcataaaatagcttggagtgataagacaggttgcagtgagattgtgacccattctttcattcaattctgccttttgaatgagggctgatatttaaaaaataccaaggaatgaatattggagctctacacttagagttgcacgtgtatttcacctacatacagctgtacacatgttgctgtatattaacattttggatgaagattataaaaattctcagtgcttggatacaatacttttgtatagctaa

SEQ ID NO: 96295 - DNA, 601 bp, Human
gtgatgttatttgaagatggcagatggcgagttggaaatatttcagctaatgagcctgctgactttaaaccattcaatgagttcagaaagttgtgcaaaggccacttaccaaggtaaacaagcaggcattccttagttttcctttactgaggggaagtcactagactcttgcttgtttttctgggtaccagtatcgattttcttgaatttgaagtaagaataatcaattaagtagataaaatgtcataggtttaagtatgaatcatcttatatcttgttcaaaaatgtaaaaataatagawgacttacagtagaaataatatattttttaaaatgttaatggacagaagccaggtgtgtggtgcatgcttataattccaggtactcaggaggctgaggcaggaggagctcttgagcccaggagtttgaggccagcctgagcaacagagcaagacctcatctctgaaaagaaaaaacaaaaaacaaaacgaaacaaaataaaacaaaaaaaccttcaaggagagaagcatattagaacatatgcataaaatagcttggagtgataagacaggttgcagtgagattgtgacccattctttcat

SEQ ID NO: 96296 - DNA, 601 bp, Human
gaagggagcattggcgaacacttcacttttcccctgtcccagctctttttttaaaatttattattattattattattattattattattattattatttttgagacggagtctcactgtcacccaggctggagtgcagtggcgcaatctcggctcactgcaacctccacctcctggattcatgccattctcctgcctcagcctccccagcagctgggactataggtgcctaccaccacgcccagctaatttttgtatttttagtagagacggggtttcaccatattagccaggatggtgtygatctcctgacctcgtgatccacctgcctcagcctcccaaagtgctgggattataggcataagccaccgcgcttggcctgtcccaccttttttcactgtcttgtgagatctttgaggacagggaatatgtcttttcatctttggagcctcactgcctagaatagccacagaacattatgtgaacactcaaaaattgttacggatatataacaaaattaaaatgctgtttcaaaatgacaggaaaatcaaaatgctaacttcatttttagggtgtttaaaccaaaatatgaagcagaatcc

SEQ ID NO: 96297 - DNA, 601 bp, Human
actatattattatttaaaagaaaatgtgatgcactttgcatgtgcctgcacacacacacactcacactcttccacattctgttttctgcatgaggaagtactgcatggaatatagaaatactgtcactccaaatagcttgacttcaatgtttcagatatgagataagcctccctaaataagtcttaagaggaatgcttattttgcaaagattcagtctgctatactagatggtatctgatttcttctgctgcagacacaatgctttgtggtccggataaatataactgtgaaaaagacaakatttcactgcctttgagtttgattttgaacttcttcagttcatagattgccaaaagaagaaattgttctaactttgggtgaggtcacacagtgaaccaacacccagcatctgctactacatagcttttcatcttatctggctgtacatttctttacttcaatattttactgactgtttaacattttcctttctcttatttagccacatccatatggtcttgacacttcatgcattctctatgctcccattttccctgattatctttctgaattagtatcatctttgctcatgaactgagg

SEQ ID NO: 96298 - DNA, 601 bp, Human
caatttcacaactttgttgtggtcctaactatattattatttaaaagaaaatgtgatgcactttgcatgtgcctgcacacacacacactcacactcttccacattctgttttctgcatgaggaagtactgcatggaatatagaaatactgtcactccaaatagcttgacttcaatgtttcagatatgagataagcctccctaaataagtcttaagaggaatgcttattttgcaaagattcagtctgctatactagatggtatctgatttcttctgctgcagacacaatgctttgtggtccrgataaatataactgtgaaaaagacaagatttcactgcctttgagtttgattttgaacttcttcagttcatagattgccaaaagaagaaattgttctaactttgggtgaggtcacacagtgaaccaacacccagcatctgctactacatagcttttcatcttatctggctgtacatttctttacttcaatattttactgactgtttaacattttcctttctcttatttagccacatccatatggtcttgacacttcatgcattctctatgctcccattttccctgattatctttctgaatt

SEQ ID NO: 96299 - DNA, 601 bp, Human
catttggacctttttttattcaggatctcctgaatatttggactttgatgaaaacctgttgctactacttgctattactactattaccactactacacacaaagacacgcaatttcacaactttgttgtggtcctaactatattattatttaaaagaaaatgtgatgcactttgcatgtgcctgcacacacacacactcacactcttccacattctgttttctgcatgaggaagtactgcatggaatatagaaatactgtcactccaaatagcttgacttcaatgtttcagatatgagatragcctccctaaataagtcttaagaggaatgcttattttgcaaagattcagtctgctatactagatggtatctgatttcttctgctgcagacacaatgctttgtggtccggataaatataactgtgaaaaagacaagatttcactgcctttgagtttgattttgaacttcttcagttcatagattgccaaaagaagaaattgttctaactttgggtgaggtcacacagtgaaccaacacccagcatctgctactacatagcttttcatcttatctggctgtacatttctttacttcaatat

SEQ ID NO: 96300 - DNA, 601 bp, Human
ccaattttaaatacaatacgtattttaaaattaaaaaaaacattttatttgttataagcaacattcatacatttattccaaacccatggtttttccatcatttggacctttttttattcaggatctcctgaatatttggactttgatgaaaacctgttgctactacttgctattactactattaccactactacacacaaagacacgcaatttcacaactttgttgtggtcctaactatattattatttaaaagaaaatgtgatgcactttgcatgtgcctgcacacacacacactcacamtcttccacattctgttttctgcatgaggaagtactgcatggaatatagaaatactgtcactccaaatagcttgacttcaatgtttcagatatgagataagcctccctaaataagtcttaagaggaatgcttattttgcaaagattcagtctgctatactagatggtatctgatttcttctgctgcagacacaatgctttgtggtccggataaatataactgtgaaaaagacaagatttcactgcctttgagtttgattttgaacttcttcagttcatagattgccaaaagaagaaattgt

SEQ ID NO: 96301 - DNA, 601 bp, Human
tcctggagtagtattcaatatttaatgacatgggaagttgttatatttaaaagcgggtcacaaaacctactcctgtaaaatatataaaggaacattagcagtgttatctctggtcaaccataggtgaatttcagtatgagggggtctggaaaacgtggtggctgaggacataggtctaaaatcagactgccagacaccagttctggatccacatcaggcaattgtgtgacctgggcaagtaactctcagtgcttccattttcacgttaatgcaaacaggattgctgtgaaaattaaacacyacacgtgaagtacttcgaatggtgccaggtacaaagcaaacggtggaggtcaatcatttcactgatattttaaactacttttctcgcacttttctaacccaattttaaatacaatacgtattttaaaattaaaaaaaacattttatttgttataagcaacattcatacatttattccaaacccatggtttttccatcatttggacctttttttattcaggatctcctgaatatttggactttgatgaaaacctgttgctactacttgctattactactattaccactactacacacaaag

SEQ ID NO: 96302 - DNA, 601 bp, Human
actactaatagtcattaggattataattaacatatacagtataatcacagaggtttctattttttttcaagccagtctttaaatcatgaatcgtattatatagtttcctacgttgagctggtaaaactaagcagtctgagcattaatagaaaatgaataactctctcacacactcctggagtagtattcaatatttaatgacatgggaagttgttatatttaaaagcgggtcacaaaacctactcctgtaaaatatataaaggaacattagcagtgttatctctggtcaaccataggtgartttcagtatgagggggtctggaaaacgtggtggctgaggacataggtctaaaatcagactgccagacaccagttctggatccacatcaggcaattgtgtgacctgggcaagtaactctcagtgcttccattttcacgttaatgcaaacaggattgctgtgaaaattaaacactacacgtgaagtacttcgaatggtgccaggtacaaagcaaacggtggaggtcaatcatttcactgatattttaaactacttttctcgcacttttctaacccaattttaaatacaatacgtattttaaa

SEQ ID NO: 96303 - DNA, 601 bp, Human
actccctagtaagtggcaaaactgggatttgaattccgtttccaaagttttaagcacttcaacacacttctataactaaagttgctactgatagaattaaaagctttgaagcatttaatacataaaaactgtatagcacaccacattctacttcttataagtggtctgtctatattatctatgttgtattatctacacaaactactaatagtcattaggattataattaacatatacagtataatcacagaggtttctattttttttcaagccagtctttaaatcatgaatcgtattatayagtttcctacgttgagctggtaaaactaagcagtctgagcattaatagaaaatgaataactctctcacacactcctggagtagtattcaatatttaatgacatgggaagttgttatatttaaaagcgggtcacaaaacctactcctgtaaaatatataaaggaacattagcagtgttatctctggtcaaccataggtgaatttcagtatgagggggtctggaaaacgtggtggctgaggacataggtctaaaatcagactgccagacaccagttctggatccacatcaggcaattgtgtg

SEQ ID NO: 96304 - DNA, 601 bp, Human
tgttattattagactcaatttacagatagcaatactgagacttaataatatgtttaaatatatactccctagtaagtggcaaaactgggatttgaattccgtttccaaagttttaagcacttcaacacacttctataactaaagttgctactgatagaattaaaagctttgaagcatttaatacataaaaactgtatagcacaccacattctacttcttataagtggtctgtctatattatctatgttgtattatctacacaaactactaatagtcattaggattataattaacatatacwgtataatcacagaggtttctattttttttcaagccagtctttaaatcatgaatcgtattatatagtttcctacgttgagctggtaaaactaagcagtctgagcattaatagaaaatgaataactctctcacacactcctggagtagtattcaatatttaatgacatgggaagttgttatatttaaaagcgggtcacaaaacctactcctgtaaaatatataaaggaacattagcagtgttatctctggtcaaccataggtgaatttcagtatgagggggtctggaaaacgtggtggctga

SEQ ID NO: 96305 - DNA, 601 bp, Human
aggtaagtatattatatatgttatctatattttattgatataatattaaatattcatttgtttattagctctctaaccctagtagcatataaacttcatgagtcctgggatgatttttttattttccctaatacatgatagtgcttagactgttctttgcacagaagagagatcaacaaatatttgttgaaaaaatggacaaattacataatccttacataccactcctatgtggtaaatgttattattagactcaatttacagatagcaatactgagacttaataatatgtttaaatatatactccctagtaagtggcaaaactgggatttgaattccgtttccaaagttttaagcacttcaacacacttctataactaaagttgctactgatagaattaaaagctttgaagcatttaatacataaaaactgtatagcacaccacattctacttcttataagtggtctgtctatattatctatgttgtattatctacacaaactactaatagtcattaggattataattaacatatacagtataatcacagaggtttctattttttttcaagccagtctttaaatcatgaatcgtattat

SEQ ID NO: 96306 - DNA, 601 bp, Human
gctttgtcttcataaaaagaaaagaaataaatttattcaatatataaatcccaataatctgcattattttcagaatgcctctattttaagtactttgcaaggcaaaagctaaatatcatagatttttttctcaatttattttgttattatcacggttgtttctttagcacatagatatctcacatgtggaataaaataaaataataatcattattattattttgcaccaatgacactttgtatttgccacatggtagtctctaaggtaagtatattatatatgttatctatattttattgwtataatattaaatattcatttgtttattagctctctaaccctagtagcatataaacttcatgagtcctgggatgatttttttattttccctaatacatgatagtgcttagactgttctttgcacagaagagagatcaacaaatatttgttgaaaaaatggacaaattacataatccttacataccactcctatgtggtaaatgttattattagactcaatttacagatagcaatactgagacttaataatatgtttaaatatatactccctagtaagtggcaaaactgggatttgaattc

SEQ ID NO: 96307 - DNA, 601 bp, Human
tttggatttcttagaaatgaattcccacaaatttaaatcttttcttcctaggacacagttcattagcattttgctcatcaataataggtatctatttgaaacagccttgcttcccactctgcacacggctttcactcctgtcaatcatattgtaatcttgaaatgaaatcttctcagccttaatgtttgtcaaacgatcttttggaaaaaataaaaattgtggagaatatttataccaactatgggtacaatacaaccagaaccaacttcgatcttgtacacagaattttgtaagcactcytatgaaaaggtattatctaacgtgtggctgtgggccctcttactagaatagaactactggctttagtgttatgtgaacagtaatgctaaagatgaccttaggacaagttcttttggtgtatgaagagtcggtttttgggttttataatctgactttaaaagcaagctcatttcctaagttttgtgaccttgggcattacttaaaacctcaagtcttcattctgtcattgctaaaatggagaaaataatgtaaaattgatgtgagaattagaagtgatgtatataaagagcttagctattt

SEQ ID NO: 96308 - DNA, 601 bp, Human
catcttatgactctgcaactagagataaaaattcaatgtcacatagctgttgcatttatattttattttagaaacttaaaaaaataagtgatgtctttatgtgtccaatgatagcaaatatggcctgcaacaattcaatgataccttcaattattgggtttcctggtgctatgttttgtctcagtcagtttaggctaaagttaattcctatctaattacttagtctacaatacacaattctctcttttgatggtgagttctgatgagattttggcttcactggaaaggaaacaactttttyttttctctaatagttctttctttattgaatctatgctaggtcaacagtacagtttaaactttcaagcaaattagcacaattctagtgatgagaattattttttctggagtacttatggctcaagtgctggtcaattattgacttgcattattccattattttatgaagtacatgctattttaatccccatttggtagatgaagtgactgaaacttacggaagttagtttgcggaacctcattcagctgctaagtggcagaaccaagattccattttcccaacctatttcccttcacccgg

SEQ ID NO: 96309 - DNA, 601 bp, Human
cttgaattaggataagccatagaaagactataattgaaattttccttaggatttagtgtcttccttttctacattttcccatattctatgatattcatccactcaaccttcatcactagccttgagtgcccagctaatctcttgacttcttcccttgcaaaacctgtttttagaaagtctattttaaaagtatttcagctttcaaattaatggccaataggtcaatggattacttctccataaaatatttgcacatttaattgtgtgaaagaaaagtgtttaatctgttaggttgaaccaygtgggactccttttttggagatcaaaatggttgaaagtaggtaaatacaggttcataaaactcaatccatgataataataaattttaggcatttgacatgctctgtatggagcctctgacatttaaggtgccctcttagcatttcataaacagtgttcaattgcccagtaaataaacaaagagcagcgtatgtgctaatggttctagtgctttgataaacttacccaaaatctgctaccagaaagcaaggaatttttgttaactttagcatacatttagttttattgcttattacttgta

SEQ ID NO: 96310 - DNA, 601 bp, Human
ctttcactctacagagagatatagatatagatacaactttcttttggatagatataaacatataaatctccttataaagatacaaaatacttgaattaggataagccatagaaagactataattgaaattttccttaggatttagtgtcttccttttctacattttcccatattctatgatattcatccactcaaccttcatcactagccttgagtgcccagctaatctcttgacttcttcccttgcaaaacctgtttttagaaagtctattttaaaagtatttcagctttcaaattaatrgccaataggtcaatggattacttctccataaaatatttgcacatttaattgtgtgaaagaaaagtgtttaatctgttaggttgaaccatgtgggactccttttttggagatcaaaatggttgaaagtaggtaaatacaggttcataaaactcaatccatgataataataaattttaggcatttgacatgctctgtatggagcctctgacatttaaggtgccctcttagcatttcataaacagtgttcaattgcccagtaaataaacaaagagcagcgtatgtgctaatggttctagtgct

SEQ ID NO: 96311 - DNA, 601 bp, Human
atatatgcaaaaatttttagaccaacatcatgaatgtctgcttttttgtagtatcactttcactctacagagagatatagatatagatacaactttcttttggatagatataaacatataaatctccttataaagatacaaaatacttgaattaggataagccatagaaagactataattgaaattttccttaggatttagtgtcttccttttctacattttcccatattctatgatattcatccactcaaccttcatcactagccttgagtgcccagctaatctcttgacttcttccctygcaaaacctgtttttagaaagtctattttaaaagtatttcagctttcaaattaatggccaataggtcaatggattacttctccataaaatatttgcacatttaattgtgtgaaagaaaagtgtttaatctgttaggttgaaccatgtgggactccttttttggagatcaaaatggttgaaagtaggtaaatacaggttcataaaactcaatccatgataataataaattttaggcatttgacatgctctgtatggagcctctgacatttaaggtgccctcttagcatttcataaacagtg

SEQ ID NO: 96312 - DNA, 601 bp, Human
ggcagcagaaaagttctcagacaccattaagaaaatcattgagaagaaaggatttctgcctgaacaggtttttaatgcaaaggaaagtgacccattttggaaaaaaataatactacaaaggacattcattagtaagaaagagaattgagccccagaatttaaagcaggaagggacaagttaactctactgttctgtgcaaatgcaattgggtttatgaccaggactgactttatctagaaatatactaacccccaaggactgaagggaaagcataaacaccagcttcaaatcttttgattrtacaagaagacctggacaatgagaacctgtattagtctgtttcatactgctaaaataaataccgaagactgggtaattttataaagaaaagaggcttaattgactcatagttcgcatggctggggagacctcaggaaacttacaatcatggcagaaagggaagcaggaacattttacgtggcagcagacaagagggagcaagtgtgaaaaaagaactgccagacacttataaaaccatcagatcccatgagaacttactatcatgagaatagcatgggggaaatcgcccccatgatccaa

SEQ ID NO: 96313 - DNA, 601 bp, Human
aggataattattcaaaaagaaaaggaaatttgtgaaattttcattgcagctataccagcaggagtgaaaaccttgtacttattgcaaaatacttttttatctcattttgataatgtagcttttatgtgggtgcaggattgctataacaaagttgttcctatagactttatcataattgaagaaaaaatgaagtcattatatgacaacttaaagaaaaagaaaggtgaaggatgtaaagctggagaatttaataccagaaacggatggcttgataattttagaaagagatttggcttttttwaaaatgtcacaacaataggagaagaaggttcagccaaccaagagaaggcagcagaaaagttctcagacaccattaagaaaatcattgagaagaaaggatttctgcctgaacaggtttttaatgcaaaggaaagtgacccattttggaaaaaaataatactacaaaggacattcattagtaagaaagagaattgagccccagaatttaaagcaggaagggacaagttaactctactgttctgtgcaaatgcaattgggtttatgaccaggactgactttatctagaaatatactaaccccc

SEQ ID NO: 96314 - DNA, 601 bp, Human
gtccaccatttcaagatatataaatccagcataaggataattattcaaaaagaaaaggaaatttgtgaaattttcattgcagctataccagcaggagtgaaaaccttgtacttattgcaaaatacttttttatctcattttgataatgtagcttttatgtgggtgcaggattgctataacaaagttgttcctatagactttatcataattgaagaaaaaatgaagtcattatatgacaacttaaagaaaaagaaaggtgaaggatgtaaagctggagaatttaataccagaaacggatggyttgataattttagaaagagatttggctttttttaaaatgtcacaacaataggagaagaaggttcagccaaccaagagaaggcagcagaaaagttctcagacaccattaagaaaatcattgagaagaaaggatttctgcctgaacaggtttttaatgcaaaggaaagtgacccattttggaaaaaaataatactacaaaggacattcattagtaagaaagagaattgagccccagaatttaaagcaggaagggacaagttaactctactgttctgtgcaaatgcaattgggtttatgacca

SEQ ID NO: 96315 - DNA, 601 bp, Human
tattgtgatgaactgaagttttgtgggtagctgcttaaaatgctgtgtgacattaatctctgcataagcagttcatctgtccagtaaatcgcatatttcagtaaaaggtgatttttttgtagttcttatttatcatttttagtgcaatatcataaaccttgactaaaatgatgggaccaatatgaagtgccactagtgatgctgagaatgctccaaagaagcataaaaaagtcataacattaatggaaaaatttgaattgcttgataggtactatagattgaggtctgcagctgtggttgyccaccatttcaagatatataaatccagcataaggataattattcaaaaagaaaaggaaatttgtgaaattttcattgcagctataccagcaggagtgaaaaccttgtacttattgcaaaatacttttttatctcattttgataatgtagcttttatgtgggtgcaggattgctataacaaagttgttcctatagactttatcataattgaagaaaaaatgaagtcattatatgacaacttaaagaaaaagaaaggtgaaggatgtaaagctggagaatttaataccagaaacggatggct

SEQ ID NO: 96316 - DNA, 601 bp, Human
acttccactataaacacttccagatcatacaaggtgccatgcacagtcaagagaaaggtaaacaaatgtaaagatgcaatattaaaggataactgaatgaaattaactatagtacatatggtactactgtagtgattttgtagcctctcttgctactattgtgatgaactgaagttttgtgggtagctgcttaaaatgctgtgtgacattaatctctgcataagcagttcatctgtccagtaaatcgcatatttcagtaaaaggtgatttttttgtagttcttatttatcatttttagtgmaatatcataaaccttgactaaaatgatgggaccaatatgaagtgccactagtgatgctgagaatgctccaaagaagcataaaaaagtcataacattaatggaaaaatttgaattgcttgataggtactatagattgaggtctgcagctgtggttgtccaccatttcaagatatataaatccagcataaggataattattcaaaaagaaaaggaaatttgtgaaattttcattgcagctataccagcaggagtgaaaaccttgtacttattgcaaaatacttttttatctcattttgataa

SEQ ID NO: 96317 - DNA, 601 bp, Human
aagtaatttaagtaaagttacacccctgaacaaggggcaaagggagtaaaattcatgtatcgctagtataaagccaacactggttccatcatactttatagtaatttccttgtctcagctgctcttacacagttgactcttgaacaacacaggtttgaactggtcaggttcacctatacatagttttttttcaataaatacattgaaaattttggggaggtttgcaacaatttgaaaaaacacacatgaactgtgttgtgtaaaaatataaaaaaataaagaggtatatcataactgcatraaatatatgtaggtactagtctgttttgtcatttgttaccataaaatatacaaatatataaatcgattataaaaagataaaatttgtctaaacttccactataaacacttccagatcatacaaggtgccatgcacagtcaagagaaaggtaaacaaatgtaaagatgcaatattaaaggataactgaatgaaattaactatagtacatatggtactactgtagtgattttgtagcctctcttgctactattgtgatgaactgaagttttgtgggtagctgcttaaaatgctgtgtgacat

SEQ ID NO: 96318 - DNA, 601 bp, Human
agctcctaaatatagctaccatactgaaactgggccaagtagaaagcatcatttctgtttcatgtaacaaatatgctaggtgagtatgatgagcttcacccaatagataagaaaattaatgttcagaaacattaagtaatttaagtaaagttacacccctgaacaaggggcaaagggagtaaaattcatgtatcgctagtataaagccaacactggttccatcatactttatagtaatttccttgtctcagctgctcttacacagttgactcttgaacaacacaggtttgaactggtcagrttcacctatacatagttttttttcaataaatacattgaaaattttggggaggtttgcaacaatttgaaaaaacacacatgaactgtgttgtgtaaaaatataaaaaaataaagaggtatatcataactgcataaaatatatgtaggtactagtctgttttgtcatttgttaccataaaatatacaaatatataaatcgattataaaaagataaaatttgtctaaacttccactataaacacttccagatcatacaaggtgccatgcacagtcaagagaaaggtaaacaaatgtaaagatg

SEQ ID NO: 96319 - DNA, 601 bp, Human
tcagaaatttctaaactagtttccacagtgtctgagctaatttacattcccatcaacaatatataagtattcctttttctcaggtttgaagaactctctttcctttgtcttctactctggacctctcgcctcataaatacaaaacccagcctgaggattcaaagtgaatgttcccaaattacaagtgtctatagaaaatctctatgtagagtctccacaagcactcaccccacttgaattccctttgcaacttctagttaatcaccttcatcttcccatgcttcagaccttgtagttatayagaactaatgtcatcaacacctattattttcatatgaaacagtttgatgattacaaaagccattataacacagtacagagagaatgatagtctgtttaaagcacaagtactcacaggcctgaaggaatatgtaacaaaatgtcattagtagttttcaataggtttcaaagctgagtgattttttaaaacttaaaaaatcatttactgaacattagtcatggctctaaataattttgaaagtaatcaatgttaattaatttaatgtaaatattccaaggtcattactttctctttatgcaa

SEQ ID NO: 96320 - DNA, 601 bp, Human
tgtctatttttgccatctttatgtccatgagtatctaatgtttagctcccagttataactgagaacttgcagtatttgcttttctgttcctgcactgattcacttaggataacgacttccagctgcatcaattttgcttcaaaggacatgattttattctttttatggctgcatagtattccatcatgtagttgtaccatattttctttatccaatccaccatggatgggcacctagcttgattccatgtctttgttattgtgagtagtgctgtgatgaacatatgagtgcacgtgtgtgtttttttttttttttggtagaaagcttttgcataaatacccagtaattggattgctggattgaatggtagttctgtttcaagttctttcagaaatttctaaactagtttccacagtgtctgagctaatttacattcccatcaacaatatataagtattcctttttctcaggtttgaagaactctctttcctttgtcttctactctggacctctcgcctcataaatacaaaacccagcctgaggattcaaagtgaatgttcccaaattacaagtgtctatagaaaatctctatgtagagtct

SEQ ID NO: 96321 - DNA, 601 bp, Human
tgatactgtggtttggggtacaaatgatcccatcagcaaggtagtgagcatatcacccaatagttagtttctcaaccctttgtcccctctctttctcccatctctagtagtcctaagtgtctatttttgccatctttatgtccatgagtatctaatgtttagctcccagttataactgagaacttgcagtatttgcttttctgttcctgcactgattcacttaggataacgacttccagctgcatcaattttgcttcaaaggacatgattttattctttttatggctgcatagtattccaycatgtagttgtaccatattttctttatccaatccaccatggatgggcacctagcttgattccatgtctttgttattgtgagtagtgctgtgatgaacatatgagtgcacgtgtgtgtttttttttttttttggtagaaagcttttgcataaatacccagtaattggattgctggattgaatggtagttctgtttcaagttctttcagaaatttctaaactagtttccacagtgtctgagctaatttacattcccatcaacaatatataagtattcctttttctcaggtttgaagaactct

SEQ ID NO: 96322 - DNA, 601 bp, Human
taattctctgcacatacttgactgctggaattgcttgttgtaacctgaaaccagttttatctatagcttccgagataacttgctgcaactctaggactaattttgtccacctctgtcactcaccaatgggagctggctaaactttctcgaaaaacaatacataaaatctatcctttcttaataaatcctctaatcttgtctttgttctttagacataatcaaagaccacccagtctgcaggtatgtcatgaattgctattctttcttcccaaataaaacatgaaatttagaaaattgtctktatatctttatttttacttcaaatgcatgtcatgtttgccaccatttttataaaggggtaaagaaaaaaaaagaaatttagtgtccaacaatatgctatgctaaaaataaataattgttatactgttgctccagtatttaaaagcatagtcattttttgttgttttatttttaaccgttgctggttaaatgatttagctttgctaaagagaggattttttctttttctgagaaataagaggtggaaaacattgtctaatattgctgaggggtcataataagcaagaaaaccatcctccgg

SEQ ID NO: 96323 - DNA, 601 bp, Human
ctagaaaagccagggggagaaaacactcagggcacaaaacagggctccaagaatgtaattctctgcacatacttgactgctggaattgcttgttgtaacctgaaaccagttttatctatagcttccgagataacttgctgcaactctaggactaattttgtccacctctgtcactcaccaatgggagctggctaaactttctcgaaaaacaatacataaaatctatcctttcttaataaatcctctaatcttgtctttgttctttagacataatcaaagaccacccagtctgcaggtatgycatgaattgctattctttcttcccaaataaaacatgaaatttagaaaattgtctttatatctttatttttacttcaaatgcatgtcatgtttgccaccatttttataaaggggtaaagaaaaaaaaagaaatttagtgtccaacaatatgctatgctaaaaataaataattgttatactgttgctccagtatttaaaagcatagtcattttttgttgttttatttttaaccgttgctggttaaatgatttagctttgctaaagagaggattttttctttttctgagaaataagaggtgga

SEQ ID NO: 96324 - DNA, 601 bp, Human
tttttctttctggcccatttgttacttaaatgtggcctaagtctctgatgaccccaaacatttccccagacatgggacagagacaactaggacaggttcatcttggcatgaagggataattaagcctaactgtaaaatgattgattagtgatgctttcagataaggatgttgatcaaaaggggggaaatgtgaaagctgataatctaaattgggtcattcttgtcatactcaactaaaacaaagtctagaaaagccagggggagaaaacactcagggcacaaaacagggctccaagaatgkaattctctgcacatacttgactgctggaattgcttgttgtaacctgaaaccagttttatctatagcttccgagataacttgctgcaactctaggactaattttgtccacctctgtcactcaccaatgggagctggctaaactttctcgaaaaacaatacataaaatctatcctttcttaataaatcctctaatcttgtctttgttctttagacataatcaaagaccacccagtctgcaggtatgtcatgaattgctattctttcttcccaaataaaacatgaaatttagaaaattgtctt

SEQ ID NO: 96325 - DNA, 601 bp, Human
atgtcaaaaacagattttaaaaaaattattaaccaatgatttcctttccataaagataatgttgttggacctactgtggctatagtggcttttgaaatatttttttctgccttagatattaaagacataactcacagaacagataatataggagctaagacacaaggttagaataaatctatgcaacaaacgacatgaataccacatgatacattagaagaaaacatgtgcaaacagaccaaggataaagacatgtttaccgctagaaagtcatgggcaggtgggatagtttgttgatgarattcgaggttagatgaataaataggatgttttcagtgagggactgagtgaaaggggaagattcaaaagacattgagaagagaaaaattcacagaactggtaatggtttttaaatgtctgtgtgggcttctggtgatggttgtggtggattaaacaagtagaaactatggaaataaatatgttgagggcagtatgacaatgaatgacagtaacctagcactgttccctacagatgtccattttgtaaagataagtagcataggcttgtggtagatctttaaagagaaaatgtaaacaagat

SEQ ID NO: 96326 - DNA, 601 bp, Human
tcccagtacatatatgtatgtatgtatgtatatatatacatatatatatatatatacatatatatatatatatacataaatgaaaatatctggtggttattcaataaaccattttgtcagtgatagaaatactgattcaactgccaactcataaatgaaaaattcatatggcggtctgcgtgtatatttatgtaatatttcttatcagtcatcacagatattaaccgtttaatgatctttgcattgatacatttcttgagtgtttaggttattcacctatacatcctcaaaggctagcaargcctaatgcatgataaaaaattcaattttacatataatatgtatatgtataattctacatattatattttatatatatatgtttctcttgcaggatcactatgggaacttttaaatagatattatatttattctactgatgacagatataaactaaatagagtaatcaattagaagtttcttaagtgatatgagccaaagagactctggtgactgatgagtatcgatgcatactgtttttctttgagtaagtcattcacccattatgtaaaatttttagccaactggtaaaatataaagg

SEQ ID NO: 96327 - DNA, 601 bp, Human
acaaaaatttctactctaaggaatatggagtctattgtcctgacagcatctacatttattatcttagctttactttaggtttccaattcaaaatagcgcacaatttcaaattttccacctttcctcctaccccattcatctctgtttatattgagaatagaattgtagtggtatttttcaagttctatgttttgtagcaaaataatatggaggatatgttgacaagaggaatatacactgctttaaaggttaaattgaagtaaaagataactatctgtgacactgtaaatctttctttcaygtccttgaaatcaagttggccatgtgagtaaggtcattgataagttgaaagaagccaggtcatctatcaactttgtaacctgaacatccaattgatctttgtgagtccacttccctgcctgtagcttgggcaaaataatgaaacttaatgtcagtttatgattttacattatgaaatcaatttatacatgtatgtgaatgaatcctcttaattaattgattgattgctccaccaatattagttatttttaaattttccaggatctggcttagtaagtactcaataaatgtccttgaacta

SEQ ID NO: 96328 - DNA, 601 bp, Human
tacatatcttattgcacttgatcattcaaatacattaactgggctcttattgtgtgccaggaactgttcctagcacaagaaacacatgaaatgaacctacaaaaatttctactctaaggaatatggagtctattgtcctgacagcatctacatttattatcttagctttactttaggtttccaattcaaaatagcgcacaatttcaaattttccacctttcctcctaccccattcatctctgtttatattgagaatagaattgtagtggtatttttcaagttctatgttttgtagcaaaayaatatggaggatatgttgacaagaggaatatacactgctttaaaggttaaattgaagtaaaagataactatctgtgacactgtaaatctttctttcacgtccttgaaatcaagttggccatgtgagtaaggtcattgataagttgaaagaagccaggtcatctatcaactttgtaacctgaacatccaattgatctttgtgagtccacttccctgcctgtagcttgggcaaaataatgaaacttaatgtcagtttatgattttacattatgaaatcaatttatacatgtatgtgaatgaa

SEQ ID NO: 96329 - DNA, 601 bp, Human
actcaagtcacatgaaataaaaattaattttagttttgtaagctaaatggccaataatagtgttctattcagattttgaaagatgtagcaacatttaattctggaaagttgctgtctcatgtacttactagtataatatataactaaaatattagatatttagtttgtgtccagaaccattccaagcattttaaaagaaatatcttaccattatgtccatgaagtcagtttccccttttaacgaattaagaaacaggcttccaggtccattttactacataacttacatatcttattgcayttgatcattcaaatacattaactgggctcttattgtgtgccaggaactgttcctagcacaagaaacacatgaaatgaacctacaaaaatttctactctaaggaatatggagtctattgtcctgacagcatctacatttattatcttagctttactttaggtttccaattcaaaatagcgcacaatttcaaattttccacctttcctcctaccccattcatctctgtttatattgagaatagaattgtagtggtatttttcaagttctatgttttgtagcaaaataatatggaggatatgt

SEQ ID NO: 96330 - DNA, 601 bp, Human
agtacttcatgatagacttgagaaaattattcatacataaattctattatattaatccactaaatgggaaagtagaaaaaaaatgagctaagagcattgttttaaaaactagttaatacattgagcattaaaaatagtatataagcatagttggatgagagaatgaaaaaaggagattgagaataggttcaaataatgaaaaactaatatattttagaatagcaaagaagatataaactaagcaatatgttcacatggagaaaacttgtttcttttaaatttctgaacattctgtcagagkaacttacaaattagcttagaaacagaatcctttctaatacagttgacttcttaacagtcaagtgtttaagaagcttccaagtttttcttttaatttagaagaaccacagcatctgcttcctatgtggtaagtaataaggacttatctagtgaatggcttgtaccactctgaaagatgcagtttaaatttcattactaccaccttcctgagttaaagtttagtttgggttgaaattgggaaggaagattttcagtaatttattttttaaaaggaaagaaaagagcattatttttaaattcc

SEQ ID NO: 96331 - DNA, 601 bp, Human
gtaaagatatctcgagtatgaccccacttgtttatttcttcctccatttctgccttcattgtagcctcaaatatatcatttttccttttagatgtcctttctcttttttgctacatttcaacataccatgcccatttactaagactcagctcactcttcatctttctctggaagcctttcctgacctccttccaccaagggttagagataatttgtactctcaacatcttatgtaagtcgccatccctttacattctaattgcaatgatctgtaatcatttactcatttgtctccccagayagagtaagaaattcactaggcaagggactgcagctatcatctttgtattcttagcacttgtgcattgtcacacatgataaaccataattgtctttaataaacaagtgacaacaccatataaaatggggaatttatttattgagaaatttacactccaaatacacttctgctaacaattcatcaaaatactgctaaaatattggggagggagttgcaaaaaagagaattactctgcagccctttactgaaacatgccattaaaggaaatactactttttctctccacataggagatttttc

SEQ ID NO: 96332 - DNA, 601 bp, Human
ttgaaaatttccctttagtcttttaaaggccatttggtaaacaagaattgtctctgacaattagaacaaatttctggaaaaaattttgcttcatgtcaggatagatagaaaagtgacctgatagataagaagtagaaatattatttatggtgttttttatttttaaaagcagcaataatgggcaagataagagagtgtttggaaagtcctttaaacaagattatctgtaacagggtctgtggttgatatgcctttttcatcctagttggtatgcattggctatatattatgctaagttttygaggcacccattatttttaaagttttttttgaggctgcactacaataatttctatgaaatatttttagttgttattcaagcatcttactgttgaccattctgttctcacttttcatctcagacagttatctgatattttgcctcaaatgagtagtgagaaaccctttgtgttctgcctcttgatgttcaaaggtgattaaagtgatgttgaagagactgtttagtagcaaatttttgtttgcaccatgatcgagcatgaaagattagaggaagttaatagagaaccaatagagaagtaga

SEQ ID NO: 96333 - DNA, 601 bp, Human
gggctcacctgccctgcatctataatgtattatatattttaaaattgccaaaagaaaatattttttatattcttattacaaaacaatgaaaaattggtgaggtgataggtatcttaattaagttgattgactctttctacaatgcatccataaatcagaacatcacattgtacctcatatatatacacaattattatttatcaattaacgtggtagctcatgcctgtaatcccagcactttggaagaccgaggcaggtggatcactcgagaccaggagtttgagaccgacctggccaacayagcgaaaccccatctatactaaaaatacaaaaagttagccaagtgtagtggcatatgcctataatcccagctactcaggagactgaaacacgagaatcgcttgaacccaggaggtggaggttacagtgaaatgagatggcgccactgcattccagcctgggtgatggagtaagactgtgtctcaaacagaaaaaaaaaaaagatgaatgaatggcaaattaaaacttttaaaattttattaatttaaatctcaagagtaaattgcttaatggggaaatgcagttcagataaaaatcaacc

SEQ ID NO: 96334 - DNA, 601 bp, Human
tccagatcacaacatacaagggaaaaatcactgcctagtctggaaaggtaggagtaccccccttctgaaaaataaagattgtcctgccacccccattggaacagggaaaaaatatctctatagacacaacttggaagcaaaggataaacatcacaccctgtagggcttctgtttgtgccccctctgggctcatttttgtttctggtcatgaatgggaagaagtcaaacactgtaacctttaggaactccctagggagtcacctgttgtcttaggagtagctttcccctgtacatcaaaaayttggaacagagatgaatgtacattggccagcgttgtcccccaggggtcactgtccattatttcataagacccacgaataccagaagtaagctagcaatagggttgattccggcaggaatcaaggcagtgatgggactagcagcaccttggggaggctttgtctaccataagtcaatcctaaggagcttgactcaaaccctagaaaccttagctaccaacacaggtcaggcattaaagggaattcaagtgtccttagaccatttggcaaatgtagtttttgataatagactagtgttggat

SEQ ID NO: 96335 - DNA, 601 bp, Human
attcttccagatcacaacatacaagggaaaaatcactgcctagtctggaaaggtaggagtaccccccttctgaaaaataaagattgtcctgccacccccattggaacagggaaaaaatatctctatagacacaacttggaagcaaaggataaacatcacaccctgtagggcttctgtttgtgccccctctgggctcatttttgtttctggtcatgaatgggaagaagtcaaacactgtaacctttaggaactccctagggagtcacctgttgtcttaggagtagctttcccctgtacatcaaaaacttggaacagagatgaatgtacattggccagcgttgtcccccaggggtcactgtccattatttcataagacccacgaataccagaagtaagctagcaatagggttgattccggcaggaatcaaggcagtgatgggactagcagcaccttggggaggctttgtctaccataagtcaatcctaaggagcttgactcaaaccctagaaaccttagctaccaacacaggtcaggcattaaagggaattcaagtgtccttagaccatttggcaaatgtagtttttgataatagactagtgt

SEQ ID NO: 96336 - DNA, 601 bp, Human
ttttcaattctgcaatatatttcttttgaaagctatgcagatccatgtaactctctccttcagcttttttgtcagctcctgttaatttttctcctctgtttatgactgctgttgtggtctgatggtaaagtgttttgtcctagagatctgtgggagcagtgtttcctccaaatacagcttaattctatgctgttggttttcctcaatgggtaatctcattttggcttttggtttttgattcttaagttgcttagaaggaattttggggctagtgggtacctgctcaactccattcccttcsgcccatggatcttgatttttgttttgtattacctctttttgtcatggtgtgctagaggcagcatcaatggccatgttttattttgtcctatgctgatgacaaggtcatgtgctgcctgccctgggtccataatgtccctcagtgggacccccatggctggggcatttggagccaggggacttgtagccagttggatgttctggcctggatcagagcggaagtgggtggacacttattggcccttgaacccctttttagcagtgtgggagccagagactaggagccaggaaatgtatttat

SEQ ID NO: 96337 - DNA, 601 bp, Human
tattaatttgctaaattaccagaaaattttattttcaattctgcaatatatttcttttgaaagctatgcagatccatgtaactctctccttcagcttttttgtcagctcctgttaatttttctcctctgtttatgactgctgttgtggtctgatggtaaagtgttttgtcctagagatctgtgggagcagtgtttcctccaaatacagcttaattctatgctgttggttttcctcaatgggtaatctcattttggcttttggtttttgattcttaagttgcttagaaggaattttggggcyagtgggtacctgctcaactccattcccttcggcccatggatcttgatttttgttttgtattacctctttttgtcatggtgtgctagaggcagcatcaatggccatgttttattttgtcctatgctgatgacaaggtcatgtgctgcctgccctgggtccataatgtccctcagtgggacccccatggctggggcatttggagccaggggacttgtagccagttggatgttctggcctggatcagagcggaagtgggtggacacttattggcccttgaacccctttttagcagtgtgggag

SEQ ID NO: 96338 - DNA, 601 bp, Human
gccagacatggtggcacatatctgtaattccagctacttgggggactgaggcagcataatcatttgaacccaagaggcagaggtttcagtgagccgagactgcacaactgcactcttgtctgggtggtggagtgagactctgtcaaaaaaaatgtattttcttttccaagaaagcatataataaaagagtaattttatatgaagagggatcttgtatagtcatattttgtcctagagtaacatgactggttatttaagaaagaggtagtataggctgggtgcggtggatcacgcctgtaakcccagcactttggaaggccgaggcaggtggatcaggaggtcaggtgattgggaccatcctggctaacacggtgaaaccctgtctctactaaaaaatacaaaaaattagcctggagtggtggcgggcacctgtagtcccagctaatcaggaggctgaggcaggagaatggcatgaacccgggaggcagagcttgcagtgagccgagatcacaccactgcactccaacctgggcgacagagtgagactccgtcacacaaaaaagaaagaggtagtataggacaagtcagaaatttcaagcaa

SEQ ID NO: 96339 - DNA, 601 bp, Human
ttggagaccagcctggccaacatggtgaaactctgtttctattaaaaatacaaaaattagccagacatggtggcacatatctgtaattccagctacttgggggactgaggcagcataatcatttgaacccaagaggcagaggtttcagtgagccgagactgcacaactgcactcttgtctgggtggtggagtgagactctgtcaaaaaaaatgtattttcttttccaagaaagcatataataaaagagtaattttatatgaagagggatcttgtatagtcatattttgtcctagagtaacrtgactggttatttaagaaagaggtagtataggctgggtgcggtggatcacgcctgtaagcccagcactttggaaggccgaggcaggtggatcaggaggtcaggtgattgggaccatcctggctaacacggtgaaaccctgtctctactaaaaaatacaaaaaattagcctggagtggtggcgggcacctgtagtcccagctaatcaggaggctgaggcaggagaatggcatgaacccgggaggcagagcttgcagtgagccgagatcacaccactgcactccaacctgggcgacagagtg

SEQ ID NO: 96340 - DNA, 601 bp, Human
tctttagtgtctccactactgggtgagctctctggtgccttagggactccgggatagtcccttgagtaatgcagttcactccttcccttctttatttgatgctatggaatccccttccctgtctctttctattttccacacctattgaggcaaacaaaatttagtcaggcagctgggtcccaattttgtaaataacttgaatccagttgtcttgtataggtcattttatctagtgtgtttctttagctctatctacaggcattgtgatatgtgttgtgtctagcatgctttgaaattggcytataaataaaagagcactcataaattaaataagactagtcaaagcttactagtttgaagagaatattatgtcttctaaaatttaacagaatttttatctaagtaaatcactgatgttcattggctttaaaatggttaaaatggctttaaatggtgacatgttttgcatggtatcttgtttcttagaagtggtctagataaaactgttaaaagtgaaagaacggaatcgatgcttaaataatgaacttattgtgtggtttaaagtcttaaaatgatagaataatcctcacctatagaatgt

SEQ ID NO: 96341 - DNA, 601 bp, Human
cacgtacacacacaaaataggatactatacagccttaaaaaaaagaagaaaattctgtcatttgcaacatcagtggatactgcatgattatatgtggaatctaaataagtcaatctcatagaaacagagaataggaaggtggttaccagagggtagagaatagagggagagatgggaaaagcgatgatgctgataaaagggtgcaaagtttcagttaaactggaggaataagttttagtaatctattgttctcatggcgatcacagtcaataataatgaggtagggggcagaactcaactstggaggtggcactcagacactggaccagattgaggcctagctaaaacagggcctcagtgaaagcagctttcaatcagacacttccactagcgtgccatgtcaatttaccattgccatgacaacactcaggagttactgcccctttccatggcaatgtcctagtgattacaacccctttcatagaaatgtctgcataatcttcaccttaatcttcatgcaattgaaagtgggtataaatatgactgcaaaactgccctgagctgctactctctgcctatggggtagtctcttttccctcag

SEQ ID NO: 96342 - DNA, 601 bp, Human
tccaaaaacacacaataggaaaagaacaatctctttaataaacagtgccaggaaaactggatattcacatgcagagaaagaaattgggctcttatttcacagtgtatacataaaatcaactcaaaattgatagaagacttaatataagacctgaaattgtaaagctactaaaagaaaacaccggaagaactccactggtcagagtagttatttctcaggtaggactccaaaagtacaggcaacaaaatcaaaaataaactaatgggattgagtgaaactaaaaagcctctgcacagcaaayggaacaataaaaatgaagagacaacctatggaatgggaggtaatattggtaaatcatacttctgataaagggctaaaagcaaagagatttgaggactcaaacatttcaataacagaaaacaaacaccttattttaaaatgggcaaagcatgtgaacagacacttctcaaaagaaaatatatgaaaggccaacagatatgtgaaaagatgtttgacatttctaatcatgtgggaaatataaattaaactacaataagataacacctcacacctgtctgaatgagtattatcaaaaagatga

SEQ ID NO: 96343 - DNA, 601 bp, Human
gagacatcaatagataaagctaaaaacagagcatgcttgtgttgatcatggtatgtcaacttttcaatcccaatgacagtaatattcaaattagacatttgtgattgaggtctataaaatatatgatatgaaatcaaatttatataagaaaaaatattttaacaaacaaaatcaaataatagacttgatgttctaatggaggtaataattggctgtgtatgatggaatatgtttcaaatagtgagtagcaatataagagtagacacacacacccatatatgtttattgtaatgatagggaytttagccttattttttattatagttattatattttctatattttccaaatttctttaattgcattaaaagcaaacaaaatgtcaatggcatgtttccatttataccctattatgcatagattaatttttaaaataaaaatataaaggtcacattcaatgaattagcaaaggaattaaaaaggaaaaatcaagtgttccaaaaacacacaataggaaaagaacaatctctttaataaacagtgccaggaaaactggatattcacatgcagagaaagaaattgggctcttatttcacagtgt

SEQ ID NO: 96344 - DNA, 601 bp, Human
acatatccaaatatattaatgaatacagtgtctgtatatgtctgtctatccatggtctaagcctacgtactccctaaggtctatatttaggcagcaatagtaagcccaagagtagattactgggggagaattctgtaaggcagtggttctcaaacaacaatatcacataagaacttattagaaatgtaaatttaatcttccaggtgtacctgatgcatgttgaaatttgagaaccactgtttgataaccgtagttgctttttttaagagcattcatgtaacacaaaggaatggctgtttgycacaattctgagtcccacgtaattgtatatattatgtttcagcaaataaggcttaattagagtcagagagaaagttttcagtctactgagacatcaatagataaagctaaaaacagagcatgcttgtgttgatcatggtatgtcaacttttcaatcccaatgacagtaatattcaaattagacatttgtgattgaggtctataaaatatatgatatgaaatcaaatttatataagaaaaaatattttaacaaacaaaatcaaataatagacttgatgttctaatggaggtaataattggc

SEQ ID NO: 96345 - DNA, 601 bp, Human
tagaacaggacaaggatgcccactcccaccacttctgttcaacatagtactggaaattctagccagatcaatcaaacaagagagagaaataaagggcattcaaatcagtaaagaggaagtcaaactgtcgctgtttgctgaggatataattatacgcccagaaaaccctagacttctcccaaaagcccctagaactgataaatgaattcagcaaagtttgaggatacaaaattaatgtacacacatcagtagctctgctatataccagcagtgaccaagctgagactcgaatcaagaactygacctcttttacaatagctgcaaaaaaattaaaatacttagaaatatacctaaccaaggaagtgaaacacctctacaaggaaaactacaaaacagtgctgaaagcaatcacagacaatacaaacaaatggaaacatatcacatgctcatggatggatagaatcagtattgtgaaaatgaccagggtagaatcaatatgtgaaaatgaccacattgcccaaagcaatctacaaattcagttcaattcccatcaaaataccatcattattcttcacagaactagaaaaaaaaatcctagaat

SEQ ID NO: 96346 - DNA, 601 bp, Human
acatagatgcaaaaactccttaccaaaatactagctaaccaaatccagcagcatatcaaaaagacaatccatcatgatcacgtgtgtttcatactagggatgcagggatggtttaacatatacaagtcaataaatatgatataccacataaagagaattaaaaacaaaaatcacatgatcatctgaatagacacagaaaaagcatttgataaaatccagcatcactttatgattaaaaccctcagcaaaattggcatacaggggaaacccctaaatgtaataaaagccatctaccacaaayccacagccagcgtaacactgaatgggaaaaagttgaaagcattccctctgaaaactagaacaggacaaggatgcccactcccaccacttctgttcaacatagtactggaaattctagccagatcaatcaaacaagagagagaaataaagggcattcaaatcagtaaagaggaagtcaaactgtcgctgtttgctgaggatataattatacgcccagaaaaccctagacttctcccaaaagcccctagaactgataaatgaattcagcaaagtttgaggatacaaaattaatgtacacaca

SEQ ID NO: 96347 - DNA, 601 bp, Human
cataacaaaaaagaaaactacagatcaatattcttgattaacatagatgcaaaaactccttaccaaaatactagctaaccaaatccagcagcatatcaaaaagacaatccatcatgatcacgtgtgtttcatactagggatgcagggatggtttaacatatacaagtcaataaatatgatataccacataaagagaattaaaaacaaaaatcacatgatcatctgaatagacacagaaaaagcatttgataaaatccagcatcactttatgattaaaaccctcagcaaaattggcatacargggaaacccctaaatgtaataaaagccatctaccacaaacccacagccagcgtaacactgaatgggaaaaagttgaaagcattccctctgaaaactagaacaggacaaggatgcccactcccaccacttctgttcaacatagtactggaaattctagccagatcaatcaaacaagagagagaaataaagggcattcaaatcagtaaagaggaagtcaaactgtcgctgtttgctgaggatataattatacgcccagaaaaccctagacttctcccaaaagcccctagaactgataaatga

SEQ ID NO: 96348 - DNA, 601 bp, Human
tcaatagcgtcaatcttccaactttgttctttgtcttcggtaccgtgtttgctattctggatctttttccattccacgtaaactttatattcagtttgtcaacacacacaaaataattttctgggaattttccataattgcattgactctataggtcaatttggaaagaattgacaccttcataattttgaatcttcctatctacatatagtatctctctatctagatgttctttgacttttttcatcatcagggtttagtcccctcactattttctttttgttcctcttcttttctttcttttttttttttttttggctaacctctgcttaaggcctagtttagctgtctctttctcagaagcctttttctgatgcagcggaattgcttactccttttatgtgctaatactacttggtagatctctttatcattatgttagtcataatctattgcaagtatcaacttaagtgaatgccttcttttctacattgtgagatatttggggacagtggtcatgtgtatctatcattgaatgcagggaattggtgcgattcctaatacatggtgataagataggctctcattctttttttgctca

SEQ ID NO: 96349 - DNA, 601 bp, Human
ttctttttaagttcctgttcacttggcttttgggaaaggtaaacataatatgtatgctctactgtaatgagataaatattaatactgccttcttttaatttcaaaactatcctagtaactttttcttttagcaaagataacataacaggggtctaattactcctcatactggaaattaaggaaaacagacaaaatacataaaacaatggttttaaagatattgaacatcagacaacaaagaacagtgatactttagtgatgggaaacaaatgagatgtaccctgtgattgcttccgcttartgcttggagaaagttacaaggccttagtgcagcaatgagttgcctagcaaatcacggagcttataagatggagctggtagtctggaaaggccaagacagtcagttatcacagatcagagtaaggtagagcagagagcagcagagaagaggaagggagttctggagatgtgtggaaggtgacattaagtcatcagaagagcactgaacagcatatacacacaaataaactacttgaggccaaggaaagaaaaaatggaaagaattttaaaactttataataagctttgaagttcaatagcg

SEQ ID NO: 96350 - DNA, 601 bp, Human
agtctgtgggccattttgtcagcctctgctctattcatagtcagttttaattttctctcttttttgcatcaacaaatatttgaatagtcaacacttttctctgattctgttttcttacaaatgccatctagtacctgtctgtcactgttcaactcaactttttaaggaatatcatctttacttgttttttctacttctcactcccacttcatcattaattcactgtaatctagtttctagctccaccattctatggattagtctctctggtcaccaatttcccattactttccaagactartgaacatatttgaccatattgatcactttccctttctttttaagttcctgttcacttggcttttgggaaaggtaaacataatatgtatgctctactgtaatgagataaatattaatactgccttcttttaatttcaaaactatcctagtaactttttcttttagcaaagataacataacaggggtctaattactcctcatactggaaattaaggaaaacagacaaaatacataaaacaatggttttaaagatattgaacatcagacaacaaagaacagtgatactttagtgatgggaaac

SEQ ID NO: 96351 - DNA, 601 bp, Human
ataaattattttaacaacaagagttggaagagactctttgaaatagatctaattgggtacttacgtgatttaggaattgagacaaataatgttatggctcaaatgtgttctcccaaacaatctgttgagtcctaacccccagtacctaagaatgtaaccttatttggaaatagggttgctactgatgtaattagttaaggtaagatgaggtcatgctagagaagggtaggtttttaatccaatatgactattgtccttataagaagaggaaaagagacacaaatagagaagatgaccacgmgataatagaggcagagattgaagtcatatatcttcacaccaagaaacaccgaagattgccagaaaacaccagaagctaggagaagcaaacaaatattctcctctacggttttaaaaagaagtgttgctttgtcaacaccttgattttggacttttaacttccaaaattgtgagagagaaaaatttctccagttttaagcaacacaatttgtgatattttattgtagccatccaaggaaactaatcaattttggtttaggaacataggtgctgctgaaacaaatacctgtacatgtaaaag

SEQ ID NO: 96352 - DNA, 601 bp, Human
gaaaatagttccaaagtcaacataagataaattattttaacaacaagagttggaagagactctttgaaatagatctaattgggtacttacgtgatttaggaattgagacaaataatgttatggctcaaatgtgttctcccaaacaatctgttgagtcctaacccccagtacctaagaatgtaaccttatttggaaatagggttgctactgatgtaattagttaaggtaagatgaggtcatgctagagaagggtaggtttttaatccaatatgactattgtccttataagaagaggaaaagrgacacaaatagagaagatgaccacgcgataatagaggcagagattgaagtcatatatcttcacaccaagaaacaccgaagattgccagaaaacaccagaagctaggagaagcaaacaaatattctcctctacggttttaaaaagaagtgttgctttgtcaacaccttgattttggacttttaacttccaaaattgtgagagagaaaaatttctccagttttaagcaacacaatttgtgatattttattgtagccatccaaggaaactaatcaattttggtttaggaacataggtgctgct

SEQ ID NO: 96353 - DNA, 601 bp, Human
cttgctatagaagttttcctaacttaaattgttccctaacatgccaatatgagccctattttttgccttcactgtatttcagtgtatttatctgcccagaggtactgctttataaaatatatgttcccttactattattaaattagaataggaaggagcaattttttatcttcttgtactgatacctccctgggaacccaggaataggtggagaacccaaatttcttacagtgtgaagctggggaagaacaaagttgatgcctttgtgggatgtcctttgttctcagtgatttttcatagwcaaagatgtttgggtcaaagtaaagagattattgccctgatactacatgaaattaaacttctcaagcatttcacactgggtatgaatcaactgatcaaatatcctaagtagaaagtttcactggataacagagaatttaaagagcatggtggtgtaactgaagtaaaagagttgttcctacaagacaatgcatttgatgtacgctcagagactaaagtctgtcacttctctttatttcacctcaagttggctaatatttgggacataagaaaataacaatgtttcatttaatgaggagct

SEQ ID NO: 96354 - DNA, 601 bp, Human
taaacttaacctgttttctttgaccactaatattttactgtcagcaaatacattaatcaaactgcaaaaaactagtaagacacatgctacgcacataaaatttaaaacaatctatatatttgagtcacaaatacattgagctagcttcttcataattcccaaacatccatacaactgaatgagatactcaggtggccatattaataccttagggtgcaaattaaaggaacatttactaaaattataaacttaggcagtggtcggaagaaagtataatggtcatatgaagtaatgtgaaaayggccttatgagatttctttctttctacttataaactagtctataatttctaggaataattggatctctcctgaattctattatattttttcctccaagaaactatttaaatccttattatctgattatctcagggaaaaacatgtttcacagagtttttcttttggaatgattattagtaagagatgggattctcttaatggctgaggtgggtaggatttctgtcttggaatcaaacagaggaagttcagtgactcagatgtgaattgatttcaagactcataagttttctttttcctta

SEQ ID NO: 96355 - DNA, 601 bp, Human
aggttagttctgggtattaaaacatataaatacaacatccagatacactttggattgaaatgctcaatttttaatccaggttacagtctgagtattctaacaggattaaataaacagcttcactgtttattgttgcatatttactattgtttaagatgtccaggaaagccccgtgattttgaattacaaaataaaatgtacctcagggctttaaaaaaattagaaaataaaaagctaatgtgttaaaattaaataaattgaggacatatattatgtgctcttaatttttctcaacccacamaataactgttagaagatctccatactgtgtttattcaatacatctaaacaaacaattgaaagtagataagagagagacacaattactgtgtcttttgtttttgttttgttttggttttcttttgttgttgtttgtttgtttatttgcacaggtattagttatcatggtaaatgtgttagcaaaccaggtatatcaacagaaaacatgataggcattccctcatacatcctggtccagtgtcatagacctaagaggtgctcaataaatacatgttcaaggattaataaatgtaatacaggc

SEQ ID NO: 96356 - DNA, 601 bp, Human
tataaatctgttacatttttaatcttcattgatgcatgcaaacattcattcatataatatttattaaagtagcttcatttataagatgctgtcagaaatgcaattgagtgtggtcatgggatgagattaaaagttaataaaaacaaactcagttcatattgactacagtctgataagtgatagaagacataaaattatatttgccttttgcctatgctcatacagaaccatgctttcttcttgttccttcagtaaacttacagattaatatttctaagtataacctggaaagttttttttwaaaaaaactttgtgtcacaaataatttcaaataataacatttccagaaaataaaaattctctggtagtttaagaaatatctctcataaaatatcaatgttttctacaaacgtggtatcagttttatcagtcttacataactattttgagtagctattttcaaaattcaaaaaaaaattaaaatattttatgacaatgaaggtatacaataaataatgtttcataaaaatatagtactttaaaatggctttataatgatgtttcatattagcattctagttttgacttccaacccttaatt

SEQ ID NO: 96357 - DNA, 601 bp, Human
aaaataactaaaatattagaatttttataacacaaaaaatatgataaatgctgatgtgatggataccccatttacttgcctatatcaaaatatctcatgtacccataaatatatacaactactaagtacctaccaagttaaaaataaaataaaatgaaatgtaaaaaattaaaaaacatacgatataattaatgaattctaaattcaaaattggttttcttagttacaaattataaatctgttacatttttaatcttcattgatgcatgcaaacattcattcatataatatttattaaagwagcttcatttataagatgctgtcagaaatgcaattgagtgtggtcatgggatgagattaaaagttaataaaaacaaactcagttcatattgactacagtctgataagtgatagaagacataaaattatatttgccttttgcctatgctcatacagaaccatgctttcttcttgttccttcagtaaacttacagattaatatttctaagtataacctggaaagttttttttaaaaaaaactttgtgtcacaaataatttcaaataataacatttccagaaaataaaaattctctggtagtt

SEQ ID NO: 96358 - DNA, 601 bp, Human
ttcttgctacactttttagacaaaagtgagaagaaaaacaatatttaatgggtgacttataagtttgtatgcggtaagaatggacacattgcatcatttactccttataacaagccttttgggaagtcattatgcctgttctgtagaacagaatatctggaatttgagcagctaagggattttctaaatgttatacatctagaaacttaaatttacatactgtttccacaactgtatcttatctcctctgaaaaagtaaatatttacctgattctgtgacttctgatgttccttctttagaaaaaaaaaaaaaaagaatgtagaaagaaaggaaaaaaaataaaaagaaaaagtatagttttttattcagtagcaaacaattgaaacttatcttctgatatttcttcctaaattacaataggcacacatactcaaaatggcaaagaaatgtactgatgattaatatttctgatagctgtaactagacatctattttgaaaatagaacaaatattcaattaatctaaaatggtatatttaaatattatagaataggttagatagaataaacaagatctagtacttgatagaacaacaggctg

SEQ ID NO: 96359 - DNA, 601 bp, Human
ttttcattgtgatgttagggtgttgattttagatctttcccactttctctgtatcagagtaatatatttattaacaagtcttcttaaggtgaggaattgaattttatgtaggcaatattcacagttcagtagtaatatgaaaagaagtctgtagttttaatttagtagtaacaggtagagtctgctttcagttctaaattcctgatccttttagatatttaataaaaatgcaataactatatgttttgcatgatgaactgtaatgtactataattatgatatgtgctataaaatcagtgtyttcattttcatcaactgtttttaaatcatataatttgtataaatttgttttttgttcctctgtttttgtggctaatttgatgtatatgtcttaaaatgtcatttttacctttactttctttttcagatatttcagttttcttctttcctaggggaaagaaaaacaacaagaaaccatcattttaaaaaacatgactttcttactcattcttggagtaaacagttggagatgagacttaatcttatgagtggagggagtcagggctctctcatttcatttttgttatgcttggtcattctg

SEQ ID NO: 96360 - DNA, 601 bp, Human
gtttaagttcctattagattctggatattatccctttgtcatataaatagattacaaaaattttctctcattctgtaggttgcctgttcactctgatgatagttccttttgctgtgcagaagctctttactttaattagatcccatttgtcaatcttggcttttgctgcaaatgctttagctgttttagtcatgaagtctttgtccatgtctatgtcctgaatggtattccctaggttttcttctagggtttttatggttttaggtctcacatttaaatctttttcttttcttttctttctttttttttttttagacagagtctcactctggcaccaagctagagtgcagtggcatgatacttggctcactgcaacctctgcctctcaggttcaagtgattctcctgcctcagcctcctgagtagctggaccactggtgtgtgccaccatgccaggctaatttttgtatttttagtagagacagagtttcaccatgttggccagggtggtctcgatctcttgacctcgtgatccgcccacatcagcctcccaaagtgctgggatttcaggcatgagcaaccacgcccggcatgtttaaatc

SEQ ID NO: 96361 - DNA, 601 bp, Human
ttagttatgatatgtttacctagcaccttcgaatttaaagcacttttttaaagtaattgaatttccctaaaattatgttgccaaggctacataatttagtataaacgttatttacagttttatgataatatcagcaaaatagatcattctctttttaagaaaaaaatgtctgcattgtgcatgctggcatttgcctattttgtgtctaggttgaattaatttaaaggtctaatttataagcaataaaaaatatattcatgatcttaactatatgttatttagtgatagataaaaataaatmccagtaatatttatttttactaccatattacttttgacattattcatgctaaaaaagtctttgtaattgataatttttcttctgatgtgtaacagaatatttgttcatgttaatgttgctaatagttctgatttcttcatgttttcttattttctattgaaatataagctttctgctagattttctacctgtccacttcctctgctattaagagaagtttgcatcttctagatttctttgttccaaaataatttaatattaatattaagcaacaacataattcatatgttttcatacaaa

SEQ ID NO: 96362 - DNA, 601 bp, Human
agccaatatttttttcttcctagaaggagtaacagcagcaaacagtaggagagaagatgccaagttagaagtgcatatagctctcttccacaggaggcctacatgccgccacttgtgctgccgccatgtctctagtgatccctgaaaagtcccagcatattttgccgagtagtcaacaccaacattgatgggtggcggaaaatggcctttgccatcactgccgttaagggtgtgggccgaagatatgctcatgtggtgttgaggaaagcagacactgacctcaccaagagggcgggagaattcactgaggatgaggtggaacatgtgatcaccattatgcagaatccacactagtacaagatgccagcctggttcttgaacagacagaaggatgtaaaggatggaaaatatagccaggtcctagccaatggtctggacaacaagctctgtgaagacctggagcgactgaaaaagattcgggcccgtagagggctgcgtcacttctggggccttcgtgtccgaggccagcacaccaagaccacaggctgccgtggccgcatcgtgggtgtgtctaagaagaagtaagtctgtaggccttgtc

SEQ ID NO: 96363 - DNA, 601 bp, Human; identical to SEQ ID NO: 30874

SEQ ID NO: 96364 - DNA, 601 bp, Human
ctagttctttaactgaatgttggatatgaggattcattaaaaaattattttaaaaatgtttttggccaggcgcagggggctcacacctataatctcagcactttgggtggctgagacaggtggatcacctgaggtcaggagttcgagatcagcctggccaacatggtgaaaccccatctctattaaaaatacaaaaattagccgggcgtactggcaggtgcttataatcccagctactcgggaggctgaggcaggagaatcacttgaacccaggagggggatattgcagtgagccaagatsgtgccactgcactccagcctgggcgacagagcgagactccatcaaaaaaaaaaaaaaaaaaaaattgtttgtctggcatattttcaaataaaatgtaaaaggtgtgactcaaaaatgttaataatatttagaaacaatcaagtctagcacattctttcatttcataagtctaaacaatcaagtctagcacattctttcatttcataagtctaagtgcctaatggagtcacccaagtttatccaacagaatcaagacctgacccacatcttctggctctcatccagtgatgataccatctt

SEQ ID NO: 96365 - DNA, 601 bp, Human
catataaggaacagtgacataccctacacagagaatcaacacagggtgatgtaacaaatgtgactggatagctacataagactgaatggctagggaagaccagttaagaaggtgacttcagctaaaccgtaaaaaaacaagaaggactcaaccatttataaatcaggattaggtattccacacagaaataacagcaacagagagaagaccagcgcagctgataaaggggagaactgtaggaaatggggcaagaactgtaagaaatgcggcaggaatacatgtgggttttgcaagcaatagraatggtctgccttttacctcaagtaaagtgagaagatattgcagagttcgaagcaagaagataacagtatctgatttatgcttaaaaaaaaaagttctttatgggtcatgtgaagtttgaaaggcctatttgaaatccatgtgaagatagccaggaagcagctggatagagaaattacgaatttcagagaaaggccatttctggagagagagatttggaattcattgacatatagatggcatgaagtcacctagaatataagaaattaacctaactgtaatatttatctgggatgtttga

SEQ ID NO: 96366 - DNA, 601 bp, Human
aaaagaaacaaaacaattacacatataaggaacagtgacataccctacacagagaatcaacacagggtgatgtaacaaatgtgactggatagctacataagactgaatggctagggaagaccagttaagaaggtgacttcagctaaaccgtaaaaaaacaagaaggactcaaccatttataaatcaggattaggtattccacacagaaataacagcaacagagagaagaccagcgcagctgataaaggggagaactgtaggaaatggggcaagaactgtaagaaatgcggcaggaatacaygtgggttttgcaagcaatagaaatggtctgccttttacctcaagtaaagtgagaagatattgcagagttcgaagcaagaagataacagtatctgatttatgcttaaaaaaaaaagttctttatgggtcatgtgaagtttgaaaggcctatttgaaatccatgtgaagatagccaggaagcagctggatagagaaattacgaatttcagagaaaggccatttctggagagagagatttggaattcattgacatatagatggcatgaagtcacctagaatataagaaattaacctaactgta

SEQ ID NO: 96367 - DNA, 601 bp, Human
aaagacctttttgttttgttttgttttgtttgaggagtttcgccctttcacccagggtggagtgcgatggcaagatcttggctcactgcaacctccgccttctgagttcaagggattttcccgcctcagcttcccaagtagctgggattacaggcgcccgccaccacaccccgctaatttttgtattttcagtagagacggggtttcgccatgttggccaggctgatctcaaactcctgacctcaggtgatccacccgcctacacctcccaaagtggtaggattacaggcatgagccaccrtgcctggcctaaagacctttttgagaatgatatatgatatatgagtatgctgtatgagtgaggggggatacaagattatggggatatggcatcatggagactggagttcacgcatgcaattctggtgagttcctatacccttacaagttcattcttttccttttttaaattaaaaaatatttgtttgtagagatgtggtctcacattgttgccaggctgatcttgaactcctaggctcaagcaatcctcctgcctcagcctcccaaagaactggcattatgggtgtgagccactgcaccc

SEQ ID NO: 96368 - DNA, 601 bp, Human
ttgtgggtaacttctcatttaagtgccagaggtattttcaagtggggatataaacatttgtttgtagtttgcatagaaggagacaaggccaggaggcagtaggtgacaaagagtaaactggactaaatcttcaaaatggactaaagacctttttgttttgttttgttttgtttgaggagtttcgccctttcacccagggtggagtgcgatggcaagatcttggctcactgcaacctccgccttctgagttcaagggattttcccgcctcagcttcccaagtagctgggattacaggcgccygccaccacaccccgctaatttttgtattttcagtagagacggggtttcgccatgttggccaggctgatctcaaactcctgacctcaggtgatccacccgcctacacctcccaaagtggtaggattacaggcatgagccaccgtgcctggcctaaagacctttttgagaatgatatatgatatatgagtatgctgtatgagtgaggggggatacaagattatggggatatggcatcatggagactggagttcacgcatgcaattctggtgagttcctatacccttacaagttcattctttt

SEQ ID NO: 96369 - DNA, 601 bp, Human
gagagatggaagtaggacattccagacagagggaacggtatgaacagagggcaaatttcaactttaacccacggacaatcactaaagagtattaaatcagacagtgtatggtcaaaattgtgggtaacttctcatttaagtgccagaggtattttcaagtggggatataaacatttgtttgtagtttgcatagaaggagacaaggccaggaggcagtaggtgacaaagagtaaactggactaaatcttcaaaatggactaaagacctttttgttttgttttgttttgtttgaggagtttcrccctttcacccagggtggagtgcgatggcaagatcttggctcactgcaacctccgccttctgagttcaagggattttcccgcctcagcttcccaagtagctgggattacaggcgcccgccaccacaccccgctaatttttgtattttcagtagagacggggtttcgccatgttggccaggctgatctcaaactcctgacctcaggtgatccacccgcctacacctcccaaagtggtaggattacaggcatgagccaccgtgcctggcctaaagacctttttgagaatgatatatgatata

SEQ ID NO: 96370 - DNA, 601 bp, Human
atggaagagacatgatagagaaggaatcttgaaacaccaggaaagcatgaagagcaaggaaaacgctaaatatccaggtaaacataaatgactattcttctcatcttgattttttttttttttaagagacagggtctcattctgttgctcaggctacagcatagtggtatgattatagctcactacagcctcaaactcctgggctcaagtgatcctcttgtgtctggagtagctgggaccacaggcatgtgccaccatccaccatgcccagctatttttttttttttttggtagagacacygtctatgatttgttactcacgctggtcttgaactcctgacttcaagcaatcctcttgcgtcagcctcccaaagtgctgggattgcaggcataagccactgcattcagcctgtcaccttgagttctttaaaagaacttgatggttgaaagcaaaattgttacattgttggatgaggtaggttttgagacagggtcacattttgttgcccaggctggtgtgcagtggtacactcttagctcttactgcagccttgacctcctggacttaagggatcctcccacttactggtgcccccgcccc

SEQ ID NO: 96371 - DNA, 601 bp, Human
taaatatttgaagacatgatggctgaacacaccccaaatttgatcaaacacataaacctacagatttaagatgcctggtgaataccaaacggaataaagcctgagaaatccatgcccagacctatcataattacgatacagaaaaaaaattattgaaagcaactagagaaacataatgcattatttgagagatctgaataattgcagatgtctcatcaaattatgaacgacagaaggaagtagacattttaaagtgctgtaagaactaaaacccagaattttgtatcaagtgataatacayatattttttgagatggagtctcgggctgtcgccccggctggagtgcagtggtgtcatcttgtctccctacaacctccgcctcctgggttcaagcaattctcctgcctcagcttcccaagtagctgggattacaggtgcacgccaccagcccagataatttttatattttagtagagacggggtttcaacatgttggccaggctggtctcaaactcctgacctcaggtgatccacctgccttggcctcccaaagtgctgggattacaggcatgagccactgcgcccggcctcaagtgataa

SEQ ID NO: 96372 - DNA, 601 bp, Human
ctccaaaaaaaaaaaaaaaaaaaaaaaatccagagtctcataacatattattcaaaatgtccaggatacaatccaaaataacttagtatacaaaacaaacaaacaaaaaacaaaaacagaaaatttcaacatagaaaaagtcagtattgatatgacatagatgctagaattttctgacaaaaacttgaaagtagccattataggccgggtgcggtggctcatgcctgtaatcccagcactttgggaggctgaggcgggcagatcacaaggtcaggagttcgagatcagcctggccaatgcrgtgaaaccccgtctctactaaaaacacaaaaaaattacccgggtgtggtggcgagcaactgtagtcccagctacctgggaggctgaggcggaacaattgcttgaacccgggaggcggtggcggaggctgcagtgagccgagatagtgccactgcaccccagcttgggcaacagggcaagactctgtctcaaaaaaaaaaaaaagtagccattataaaaatgctccaggttgggcatggtggctcacgcctgtaatcccagcactttgggaggccgaggtgggcagatcacgaggtcagga

SEQ ID NO: 96373 - DNA, 601 bp, Human; identical to SEQ ID NO: 30875

SEQ ID NO: 96374 - DNA, 601 bp, Human; identical to SEQ ID NO: 30876

SEQ ID NO: 96375 - DNA, 601 bp, Human
taaattcatatgtaccacttgctttatataaaataaatatgtattaatttaataaatagtattactgttagatttatatagtatgcaaggtggaaagatgaaaactcacaagttaataaatcagtaggtaagtaaataaataaacttgtggcgaacgttagtgtacattaattattaagtccataccacaggtgtgaataattaattttgatttatgacacttgtttaactagaaccagaccacgtcctttcagcttaaatactgtcagtacatgcctggccactgaattaaatacttcgycatttcttcagtctgattcttcagaataatttatgcaaaaaattgtggtataaattttggcatttggtcattaatgtaaagccattcaccatcatcattttttctagccacaacaaaacatatagccaaagcaaacggtcaggttaaaaaaacaaaacaaaacaacaatccacataccagcctcctccccgaccaatgaagcacccaggaaacaaaatacatacaaatacttgcaacatttaacacatgtgacggaagagatggttaatgtctaacctttatccactggagatttgtctg

SEQ ID NO: 96376 - DNA, 601 bp, Human
ctgtctgggcagtaacaaattcaaatagtaatttaccatttacatataaacagtatatcttatttgtaaatggtattttatgtgtagatagtaaattactgtttacatgtaaaatgcgatgaaaaatttaaacttatttaacaaaatgacaacatatttattaaaactaataggaatgcataacgtacaccacctgtaaaattacttgacattaaaaatagtaggattttaactaattctgaaacaacataaacatgttttgctatattacacaactgtaaatgttccacagcagagaagkttctagaaagtaattttaaaacacagcatctagttctcaaaaagggcaaaaaccaaagcaaaaactcatatagtttttttaaaagaaaataaatccccattttaatattaggatattatccacataaaaatcacttgagcttcaccaaaaggttaaaacccctactgtttattttggaatcacttttatatttaaatagaaagctacatggtctcaaataagtcacataacctttctaggactcggtgttcaaaaataaagaatgataaagcatattttggttttaaataaatgggtagt

SEQ ID NO: 96377 - DNA, 601 bp, Human
aacaggtggggattcctagagggtggtgcactcagggagggcatggaagctccatgcccctttccgtccctccaccccaaccatacctcaccctatgcatctcttcatctgtgtcctttgcaatatcctttatcataaacaggtgaaagcgagtgttttcctgagttctgtgagctgctccagcaagttagttgaacccaaagagagggtcatgggaaccccaacttgaagcccatgggtcagaagttccagaggcctggacttgagactggtgtgtgtgtgtgtgtgtgtgtgtgtgtgygcgcgcgcgtgcgctaggggggtgcagaggaggcagacctcggtactgagccctcaatctatgggatctgacactatctctgggtggatagtgtcaggactgaattagagacacccagctggtgcctgctgtttggtgtatggggaaaaaaattccacaaatttggtcataaaagtcttcttctgtgttgacgattgttacgatttgagagtagagaaaaaacacggttagaaagaattttccatacacagcgtaacatttcaataatttggaaagttaaatgtcacgtattcttatata

SEQ ID NO: 96378 - DNA, 601 bp, Human
gatgaaaataaaacaataaagcaacctctaggagataactgcaatggtctaaaatttgtcacaaaagtcatagcaccaacagaagcaatcttcatgatagtcatttacattgcaattgagttcagaatgttcattcttttataaaagtttcaataagtccaagaagtactgtcctattcaaaactgttgatgtcacccacatcacagtcagaatgtgtcactttcacaaaaaaatatttttagactgcatttgaggtataagcatcagtcatcagtcacaggttgcctgcagaatgtaacyatcagaacaaatagagttttcttgaaatacccttttgatgactttggtttccggcccatttgctggtccatctcttttcccaccacacttggccaaccatgccaaagatggactatacttgtcccggtgataactgaaaatgttcacaaattataagtgcaacattcagctcaaatgctttcatttccacaacaaaattgatggattttctctagcaacaaacaatgaaatgctctcgtcaatgtcttgtaattggttctaatatcagcaagccaatcaaaagggagaaaaaccaaattt

SEQ ID NO: 96379 - DNA, 601 bp, Human
aggaataaatgtttgcaaagcataaactgccaggattgccttctctcaccacaaagttcaaaaacaaacaataatcaatatggcagctcactgagcacttctgtagagcatcaattattgtcacgcatctttatgattattgaatactatatgaatttttatttcacagtaatttatattaattcagtcattcattttccaagccacgtattccagttcagggacttgggaggccagagcccatcctggcaactcagagcaccagacaggagccaacactggcagggatgccattctatcrcagggcacagtcgtagacacataaacactcacatggggacaatgtagacacaccaattcccctaacgtgcacagtttgggacatgtgaggaaaccagagtactagaagaaaacccacagagacaaaagaaaaccccacatagacagtgcccccctagctgagatacagttttttcccttgccaatattataacacagtgatgctcaatgaaacaacattattcaaggacctgccgtacattaaagtttgagaagttctgctctacgtgatggcacgtggatctttaccccttaccactgc

SEQ ID NO: 96380 - DNA, 601 bp, Human
gaatgagactttgactggtctctcttgggaaggcactgtgtgttctcttgatgataagaaagagagtgcatggatatttgtgggaccagcatggagattttgaaatgcagtattatattgagaatagtatagctgccttgctagcctgtgttcctttttagagcagagactacgtacctaggctggactttatgtgggaaagatacacatatctatattgtttgaaacatggaaacttggggtatttttattatagtagctcagtctacaccctgagaaatctgaaaagacaatgagaacrgctgcatttgtaattatataatccattttaatgtttgtccccctccaaatgtaagatccataaagacaagtgtctgtctgttcataactctatcctcattccttaacattataccatattggaaacacttaataaatactgaatgtatacataaaccaaggtactgtttctatactcctaggattttgcataaagtatctttgaggatctttgtgaccctctagactattggcttttgagaatattgatactgtgtcaatattacgtgagaatcaggattagttgattagaaatctgaat

SEQ ID NO: 96381 - DNA, 601 bp, Human
tattgcagctctattcacaatagccaaggtttggaaaaaatttaagtgtccatcaacaaatgaatggataaagaaaacgtggtacatatacacaaatggagtactattctgccatagaaaagattgagatcctgtcatttgcaacaacatggatggaaatggaggtcattatcttaagcaaaataagccaagcacagaaaaacatctcatgttctcacttatttgcagaatctaaaaatcaaaacaatggaactcatggacatagagagtagaaaggtagttgccagaggctgggaaggayagtggaggagtcggggagggggcagcgggatggttaatgggtacaaaaaatacttaggaaaaatgaataatacccagtattcgatagcacaacagggtgactatcgtcaaaataatgtaactgcacatttaaaaataaataagagtataattggattgtttgtaacacaaaagattaatgctggagggggtggatcccccgttctccatgatgtgattattatgcattgcatgcttgtgtcaaaacatctcaagtaccccataaatacatacacctactatgtacccacaaaaatttaaa

SEQ ID NO: 96382 - DNA, 601 bp, Human
tgagttgtggtgaagaataagtcaatgacaaggtcagcatccattccagaggaagattttgaaaaaaaacaaaaacaaaaacaaaacaaaacaaaacaaaacaaaacaaaaacaaaacaaaaacacttaggcatttggggaaaggctgctcttatcactgagacatttatttgggtaagaatttttcgataggtgtatctagaactagagaacttcagtgagctttgccttcaaaccaaatcacagtatcttctctaataattatctaaaaacaaccattgcctccacttctggactgcgycagatccacccgttttatgctctcttgctttccttgtttgcatcaccacaatttgaactaagcaattattactttgatggtgggattacataaaaagcaacgatttttctcatccttgacttcaaaaagctttattgaatcatttagcttagcttacatttgaaaactcagaatggagtggtgggtatgggggtgtggagagggagagaagtactggatttatagtctaggtcttgcataggtggtcgtccagcacttactgctgtctttgtgcctgggctggagagaatgtggagaaaa

SEQ ID NO: 96383 - DNA, 601 bp, Human
tgtgtctctcttcctgtttcctgctcttatgtgaatatacagacaatcctttctggtgacattatctttgctctcaggaacaaagaatgaccttattacatttacctatatcatcactacccctttcacattttaattagcaccaaattgtagaaaaacaattatgtaaattattagcagagatagtggcctctctgtctctttcaagattaatatgactgagttgtggtgaagaataagtcaatgacaaggtcagcatccattccagaggaagattttgaaaaaaaacaaaaacaaaaacaaaacaaaacaaaacaaaacaaaacaaaaacaaaacaaaaacacttaggcatttggggaaaggctgctcttatcactgagacatttatttgggtaagaatttttcgataggtgtatctagaactagagaacttcagtgagctttgccttcaaaccaaatcacagtatcttctctaataattatctaaaaacaaccattgcctccacttctggactgcgtcagatccacccgttttatgctctcttgctttccttgtttgcatcaccacaatttgaactaagcaattattactttgatggt

SEQ ID NO: 96384 - DNA, 601 bp, Human
ggaaggcagattaggatagaagcttataatgtattgctgctttatagttttatcactgtttggaaagtatttcattttatttatagctctgtaggaaaattactaaaaaaattatgataactaatacttactgatgtcttaccatgtgctgagctcaggtttcagcttcttaaatgtgtcattaggtgactacaaaagtaagtgttgttttcacattcatggaacttgccatttgatattgaaatacattcttaaataaatgtgattatgttatacatcattttaatgagcatttctcacttttttttttttttgctaatgacttattacttgctgtttattttatgtttattttagactatggaaatgatgttagacaaaaagcaaattcgagcgtttttcttattcgagttcaaaatggattgtaaagaagcagaggcaactcgcaatgtcaaaaacacatttggccaagttactgctaacaaacgcacagtgcagtggtggttcaagaagtttttcaaaggagataagagtcttgaagatgaggggcgtagtggctggccatcagaagttgacaatgaccgattgagaccaatcatcg

SEQ ID NO: 96385 - DNA, 601 bp, Human
caaagcagccattttgttattttaagaaatacatatgaaaattcttctgtgaatactgaaagcaaatgtgggtataaatctctgcttatgcaataaaatgtatacttaaaattacattacagatgaagaatcatacatagctctacctttgctgtattttgacatttctgtttgcaataaaagctttttaatagaggcacagctcttcatgaatatagtaaggattttagttactaggaaataagaaagaacattacttcaatattgagttcttaacataaatgagagcataaaaattacrtcaaagatatctttagattttactaggaaatatttgccacaatacttttgaaaaaataataggaattttatagacattcattatataaaaaataaaacaccatatatgaaaatatgagagtttaaatcagcatgagaagctttgcattaaaactaaatacatatgaatcatctgtatttgggagcctcagtggttgcagccttatactatctcttagagaaaaatatttcataatccattccaatcatgtatgtattaaagtttatgacaacatagctgtcccccaaccccatgtacttt

SEQ ID NO: 96386 - DNA, 601 bp, Human
agctgattgaaccagtgagtagagcgtaggcatagcgatataagagcagtactaatttgctgattaggtgatgaaaattagtaaacactcagattttgctactaataaatgtattgctgcaaaatgtaactgacggttaaactacaatcattcaataataatttgttgaacatctcctaggtataaagcattataagaccaaaagaaatccaagaattacatcccgtataatcctagttgtggatttatatttttctttttgatactgggtgtgtaaaatagactcaaaaaatgatttttycccctttaagatttttgtttgctcattgaatcgtggttggctacatcaggcagagattttaagggaaaacctattttcaacaagacagagtaagtcaattctaagcaactctgcggctaatacatgttgtagggttcatataatttcttcttcacagagacaattgtccctattatgacacctctcaacattgccattgtttatctagaacaatgacatccaataaaattataatgagagcgatacatgtaatttaaaattttctacacattacaaaagtaaaaaacaggtcaaattaat

SEQ ID NO: 96387 - DNA, 601 bp, Human
atttttggccatattcattttctgcaacttcatgttggaataaataaaatcagcaggtgcctattgatttttggagggagaaatctcattcgtaagactgaaaaaaagtgaagtccatcataaccaactgatgaacaaatacgtgtgaaaattgaagaaaataataacgtagaaacaaagggtaaatatcgatacaactatttaatatgactgattttcaaatctggatttgttgtctctaggagttggaaggtgggaaggcctgcaaaattttttttattaatttaaaataggacgatawacattccatacagcgattatttattttcttaaccataacagtcttaactagagcacacagcagaatcaattgggtaggagtttttgttttattttgttttaatatgtatatccaagctccataccagagaatctaattccataagtttgtaatggagtcgcgatagctcaacctaatttttctatttataatatagaaatagatgcttagatcccagtggtacaaacatccctgctagagcccacacaaactgcaatgcctattagtagtaagaaaatgagactgcttctctttttaaca

SEQ ID NO: 96388 - DNA, 601 bp, Human
attttctgcttcaactgacgatctagtcttttgaagaacaggcttttttttttttaaccatttttggccatattcattttctgcaacttcatgttggaataaataaaatcagcaggtgcctattgatttttggagggagaaatctcattcgtaagactgaaaaaaagtgaagtccatcataaccaactgatgaacaaatacgtgtgaaaattgaagaaaataataacgtagaaacaaagggtaaatatcgatacaactatttaatatgactgattttcaaatctggatttgttgtctctasgagttggaaggtgggaaggcctgcaaaattttttttattaatttaaaataggacgatatacattccatacagcgattatttattttcttaaccataacagtcttaactagagcacacagcagaatcaattgggtaggagtttttgttttattttgttttaatatgtatatccaagctccataccagagaatctaattccataagtttgtaatggagtcgcgatagctcaacctaatttttctatttataatatagaaatagatgcttagatcccagtggtacaaacatccctgctagagc

SEQ ID NO: 96389 - DNA, 601 bp, Human
acaatataggtaaaatgtaaaaattaaattattaaaatatatcagaaaagtatgtggaatacatttataaacttatattcaattgcagtgtgctcctccaaacttttaagatatgaccttggcataggcacattatttcagctgcttagcacaggatttgtaataatctcaattttataagaaaatgcatttctaaattggttggagaaggctaaaacaatgcataaatccagtgcactgaatataattttctgcttcaactgacgatctagtcttttgaagaacaggcttttttttttttaaccatttttggccatattcattttctgcaacttcatgttggaataaataaaatcagcaggtgcctattgatttttggagggagaaatctcattcgtaagactgaaaaaaagtgaagtccatcataaccaactgatgaacaaatacgtgtgaaaattgaagaaaataataacgtagaaacaaagggtaaatatcgatacaactatttaatatgactgattttcaaatctggatttgttgtctctaggagttggaaggtgggaaggcctgcaaaattttttttattaatttaaaataggac

SEQ ID NO: 96390 - DNA, 601 bp, Human
ctgaagcacactgcttgtcctacatttttggcccccaggctgcatatcacgcaaccctatttttcattaacttctggtctgagggggaaggtactgaaaaaaggaagagctgtacttgaataatgttactgtcacacaaaaaaaggggaaagggagggagggagggaaaagacctggcctccattcccgggtctcagatgaggatgcctggtggtagtttcccttgtaggagggataggcagggtaatcaagggaaggaaagagagagaggcatgtggcgaaaaagggaagtgagagttgrgggattacactagtgctgcatgcaggggaagggacagtaactaacagaggtttggaagtcaggcaacctgacttctaataccacctctaccgctacttatagaatccgagggccttccctgagtatccttggaactgaaaaatgcagacatttgatcagattaattctgaggtcccttctagcttgactgttccacaaacattttgtctctggcagggaatggaggagtatacacagccctgaacgtgtcactgagcttcaagaagacaaagactgtgtctgcctgacacctggatgcct

SEQ ID NO: 96391 - DNA, 601 bp, Human
agcatcaaatagtagcttgtcttgaacaaggtgtccccagtgtgtttcctagactcattgaaaagaagcaaccttacgtatgttaatcccatgtggttaatttctggcctccatgtttaattgatctctcatactagggcctctagccaccgtcctccaaggttgtgcatgaaaccagaaccctacagttttgtctgaagcacactgcttgtcctacatttttggcccccaggctgcatatcacgcaaccctatttttcattaacttctggtctgagggggaaggtactgaaaaaaggaasagctgtacttgaataatgttactgtcacacaaaaaaaggggaaagggagggagggagggaaaagacctggcctccattcccgggtctcagatgaggatgcctggtggtagtttcccttgtaggagggataggcagggtaatcaagggaaggaaagagagagaggcatgtggcgaaaaagggaagtgagagttgagggattacactagtgctgcatgcaggggaagggacagtaactaacagaggtttggaagtcaggcaacctgacttctaataccacctctaccgctacttatagaatc

SEQ ID NO: 96392 - DNA, 601 bp, Human
ggcattagacaaatgaagtgaataggtgacattgatttgctcaaacctcaatagttctaaaatggattttatagggatttatacccatctaactatccacctacccacaaactcttcactaaataatgtgattttggtcacatactgtttaaaccctgaggacaataaaatttaaagaagttaaatgtaatttaatctctctctctgtctctctctctctctctctctctctctcacacacacacacacacacacacacacacacacacgcacaccacagaatgtgttgttacaaattaaycccgtatttttctccctctctccctccctcccagccgtactctaaacaaaggctctacaaagtagcactaaacaagggctactttattcccacactctccaatcagaaatctttgatcttatttgcttgaaggaccttagcatcagcctggctgatacagaaaaatgtcccttggattcgtaggaaatatcatttttaatatttttgtttgctcattttgttcatttgtttgataaaaattcaaggaaaactaagtcatgatctgtacagttttacccaagcaacaagaaccataacaaa

SEQ ID NO: 96393 - DNA, 601 bp, Human
ctgactgttcaccttgatctaaacctaccctaaagttaggtaacaagccctttaatggctcctggaggcattagacaaatgaagtgaataggtgacattgatttgctcaaacctcaatagttctaaaatggattttatagggatttatacccatctaactatccacctacccacaaactcttcactaaataatgtgattttggtcacatactgtttaaaccctgaggacaataaaatttaaagaagttaaatgtaatttaatctctctctctgtctctctctctctctctctctctctctcacacacacacacacacacacacacacacacacacgcacaccacagaatgtgttgttacaaattaaccccgtatttttctccctctctccctccctcccagccgtactctaaacaaaggctctacaaagtagcactaaacaagggctactttattcccacactctccaatcagaaatctttgatcttatttgcttgaaggaccttagcatcagcctggctgatacagaaaaatgtcccttggattcgtaggaaatatcatttttaatatttttgtttgctcattttgttcatttgtttgat

SEQ ID NO: 96394 - DNA, 601 bp, Human
tatcctgttaaccactgtactattttacctctcattccctttagctatatgactttgagaaaatatactatatgagtgcaaaagaaggtttgctttttgtttacacaatttcacaaaataaattcctttaggtactgactggagcttactacaatttcttcataactttgaaagtaagtgggatgatagagccctattttccttgccactatcaaattcagttttcaaaactgccactcattgattctcttgcttaaaattgtgtgactgatttccaatagcctccaacttctttagcctrcctttatctaaaaaatggttcttaacaatctgacgctatcttccattcttcaaatcttcctaataacaaagcacttcttttggtctgttcctctgacattgtgtactctgccattaaaatgtcttcttttccctcaataaaatatctcttttccttatcgacacatataaaactcttcccaatccttcatgttttgggtaataaaagttccacctcctcagagaagattgcttaatccctctggaaggaaataatgattctatctaataaactctagcattaattacctgggctacttca

SEQ ID NO: 96395 - DNA, 601 bp, Human
tagatttcacatttgctcaccactaccactcactcaccgactcacccagagcaactttgagtcctgcaagctccattcatggtaaataccgtatgcagctgtactattttttatcatttgtatactgtatttttacggtacattttctgtgtctagatacacaaatattgttgtgtgacaattgactacagtattcagtaaagtcacatgcagtacaggtttgtagcctaggagcaatatgctgtaccatatagcctggatgtgcagtaggctataccatctatctttgtgtaagtacacyctatgattatacaacaacaaaatcacctaatgacacatttttcagaacatatctcatttgttaagaaatgcatgactatatatgttgctagtaatttggtaattcagaccgaaaagttaagcttctaccctggaaactacaaacactactgagacagtgaagaaaatgtaaacaaatagaggactaccttcttcatgaattagaaagtccaatactgtaaagatatctgccctctcttcaaataatctataaattcaatgcaatctcaatcaaaattgcagcaaccatttcttagtagaa

SEQ ID NO: 96396 - DNA, 601 bp, Human
tccttttatgtattataaaaccatgctcttcatataacatgttccctgtggtgaaagaaaacaaacacattcaattcccttatgtgttaatttagtatctaagcacatcttgacctaatttcacacaagattactttccttattctttcaatctctgaatgttaatttcaaatgtatatgttttaatattaagataagcaaaagtgtctgttttagaaataaacatattaagatggatttcataacacaaaacattttagaaaaattaaagtgttaagcataaaaatagtaagaagaactkgaataaaatattggcgtggggaagccttttagaagcaaaaaaagaatataaaaagattgaatataatatgcgtattcacttataaattaaagccactaatcaaaattaaaacaaatgacaactgggaatatttgcagcatatatcagacacagggtaataattttagcatataaaaaaatcttttaatgagtaaaaaaaggaaaaatctactggaaaactggataaagaacataaaaagaaattgacaaaaatgtaaacagccaataaacaagaaaaaatccagacagttagtaatcaat

SEQ ID NO: 96397 - DNA, 601 bp, Human
ggggggcctcacaatcatggcagaaggcaaaggagaagcaaaaacacattctacatggcagcagggaagagagcttgctcaggggaactcacatttataaaactatcagatcttgtgaaacttactgattatcaggagaacagtatgggggatcctcttccatgattcaattatctgcacctggctccacccttgacatgtggggattaccataattcaaggtgagatttgggtggggacacagccaaaccatgtcaattacttttgtaaaaaattatttaataaggaaaactactgtacyagctcatcttcctaccacaaaatgttgttgagaaattacactttgcatattttaataatgaatcattattattctggtataacatatctaaagccatcagtgaaaaatgctctgaagagttttctttggcaatatcacttaatggttgggtggaaatcaagaacttttaacacatattttttttgtgctcttctgcactttaaaacagtttccaggaatcgagagtattccaaatacttcacggaaaaatataacaggtgtgagtaatgtataacgtggaaaaagattaaggtttgtatc

SEQ ID NO: 96398 - DNA, 601 bp, Human
atgaataataatagagaagattttaaaaataaactagataatataccagtgtgtcacataaacaatgtcacatgctttggaacaattgttttagatacttttaaaataagtcactaatgaacagtacattgtttaattggatgcaagagttaggagatgaaaaagagaaagttgtcgagaaaaaaatcaattaatgtacagaaaaatgaattttaaacaagattgtatacgtaaacaatatgtacagtgaaacgtcttgtaaatgcatgtatatatgttgtgaaaaattcatgagactgtrtaagcaaaggattaacatccagcctgggctgttgcaggtcagtctgggactgaccctaggctcccacagcactgtttccttggaaacactaactttaagatgaatgggaaatgttgggcctggctttgtcgtgtggaactgcacctcatcgcaggagctgtcagttggaatacagtccttggatccacgtgactacaatggtgtaaaagactgatgggaaatacaggtggtggctcctgttgaaggtgacctgcacacttcttgcctctcattcctggcagcctttccctgtgtgggtga

SEQ ID NO: 96399 - DNA, 601 bp, Human
tcattgtctttgatctattttgcatttctttgtaaacgacatgatttttttttttttttttttacctacctgtaaattgatctggatcctgctgtcttacacattttgtccgtccttaccaattttcagtttatttcctttacaatctggctgcgattctccaaattaacatttcaaatttttctcccaccatcctgacttggtgacactgagaactaaaacgtgactgcccatattattactgagataaggactctcttctctaggttgtcttatagctgccatttccccacaatatctraagaagccctgcaagcagaagctggatgacttgctataaactacaaaggactcaccaccacagcaaattatgtatagacaactttcatgcctggagctgctgctttgtaggccatgcaaaaagttcagtaaactccaacctcttccgtgccatgctccaagaaatccatcggattgctactgccatcctcactctaccatctgagaatgcctacagcccagcttctaggaatctttttgacttgctgccctctggactcaaaaactgagtttgcagtctgcttcaaccattaatcttcgt

SEQ ID NO: 96400 - DNA, 601 bp, Human
aacagaacacttcagctgaatctataggtattttacttcaggtaaaatctgatgtcaagttcttgacttgccttcctaaactttggagacttttaaaaaatcaaatctgaggtttcatattttttaaactactttattgaggtatgattgacaaacagaaagctgtacatatttaatgcatagaacttgatgagtttggagataaagtatatatacaaaaccaataccacaatctatgccataaacctatgcgttacctccaaaagtttcctctcaccttatgtaccactgctcctaaaatagagtagtagtattttgtggtaagaacacttaaactctgccctcagcaaatttctaattgtacagtacagtatcgttaactataggcactatgctgtacagtatatctctgaaacttattcagcttgtgattcttcatgaaaacttccagctaatcacacttaaaatagcctatttggtaaattaccatttttgctacccctatataaataaataggccagtcttattttataaacaaggaaagtcttactttgattaacactgatcaaaagggtgatggtagagatagagtttcagtaa

SEQ ID NO: 96401 - DNA, 601 bp, Human
tgtgttgttttaagtattgcaaattgcaagtgcagagcatgtctgaatgtatctgaaatcccaacgtgttattttctaccaacagtcaatgccaccaagggaggtaacttgcaagtttaaaaccttcctcatttaacttccattgtttctgcaccgcgttctgtctgccaatcaaagccatcccctgggcattatagttagtaaaccaggtggtccattcatccacttaagcagaaattgtttgaaaatgattggaagtgttcccatttttctcctccacacagaatcagaaagagatgamacccatgggcagagcagagttttctttagagtacataaaaaaaaaaaactgatagcatggcttctgacgttctctcataacttccttcaaagtattatctaaatttccttctaaaggagtagtgaaggactgctaagtaaaaactaaaattctaatatgcagtaaaagcattatttcaagaaagtataaacatatttagggtgacaaaatgactttttaaggtttatttcaaaagcaagagaatgatctaggagagagtagaactgctttaggagaaaatggtataatattggtgaatgg

SEQ ID NO: 96402 - DNA, 601 bp, Human
agagatctcaggtcatgtataatgcttcctcatctgtcaacccagctgccattttggagaggagcaggaggagagcaaggaaatctaaaagactggtcattatccatgaggtcccaacccataaaaagagactggtgaaatcactatttcagagtgagatgataattttttctcactgcccagtatgggaaagggttatgaagatcactgagaaataaatgaagaagttttcattctgagaatcaatatttgactcccggacatacccatttaacttctcctgcatatttattgtatgcawgaaaatgtatctacttaagaatctatgacagtgcttttcaaactgtggttccacagaccagaaataacagtttcacattaaattttaagaagcatggctctagataggatatagtagaataaggaatggataagtgttagcctcccagattttaattcatttacatacttatggatataacacttatctttaaatgatacgactttgtgaataaacagcttcatgaatatagctttatgagacaatggagaaaggtggccaaattttttaaaaagttatgattagaagaattgtgttgtt

SEQ ID NO: 96403 - DNA, 601 bp, Human
tagagagttctacctgtaaacaccaagttcactccctcctccactaaatgacaatgtaacaagtggcttcaagttgctccaactttttggaaggcatccttatacataatggataatcacgcttgtttttagaggtatcataattacaaatttagaattctaagtgttcttcagcagtaactcagagatttaagaatccctttagtaactgatatagtcagcagagaaccgtatttcctgatgaaaatacaagctcagagccacaaggtcagcagggtagagacttatcaggcagacaagrggcactgttccagagagcagagggtcagaggagactgcaagtacctgcatagagatctcaggtcatgtataatgcttcctcatctgtcaacccagctgccattttggagaggagcaggaggagagcaaggaaatctaaaagactggtcattatccatgaggtcccaacccataaaaagagactggtgaaatcactatttcagagtgagatgataattttttctcactgcccagtatgggaaagggttatgaagatcactgagaaataaatgaagaagttttcattctgagaatcaatatt

SEQ ID NO: 96404 - DNA, 601 bp, Human
agaatcatgttactttatgatatattttcatactgataacatctaagtttattctgaattaggatatatgaagtattacttaaaacccttcagaatgttacatagttttgttagagacatgcatctttaaattattttttagataatatattattatcatttggtaatttttctcaactctcaaatatgagtggaagtttaaattggtatgagttcttgagatggaaactgaagagtgaaatagctttatttaaaatagatacttctcctaatgctaaaacttaaagtataataaaaaaaataaaatagataattcttaaagtgttctttttagtgttcaataatttatatatatgtattatatacattatagttataatggcatatacagtataatgttcaaataacatctgttcagttttgacaaatatatatatttgtctttttctccccattgggaaataaagtaacaaagattatggccacagtttatcttgcttttgtttttcctcacagcacctgatagagagttctacctgtaaacaccaagttcactccctcctccactaaatgacaatgtaacaagtggcttcaagttgct

SEQ ID NO: 96405 - DNA, 601 bp, Human
tgtagtttcatgtttcagtaaggagaattttacttggatcctatacattattgtgagtgcttccatgttttgccttcttaatgcttaccaaaattattaatgtcaagaataccaatcttggccaggcatggtggctcacgcctgtaatcccagcactttcggatgctgaggctgacggatcacttgaggtcaggagtttgagaccagcctggtcaacatggtgaaaccctgtctctactaaaaatacaaaaattagccgggtgtggtggtgggcaccagtaatcctagctacttggcagtytgaggcaggagaatcccttgaacccaggaggcggaggctgcagtgagctgagatcgcagcactgcactccagcctgggtgatggagcaagactccacctcggaaaaaaaaaaaaaaaaaaaaaaaaaaaaagagaataccaatctcattttaatgaccagcatgttacataatcaattattataaatgattttaagctgtttaatgttcaaattaaaacttttcttaaaatagcctaatttaaataattatggatgttttcattaactatattatttgtgccctgttatgttcggtaact

SEQ ID NO: 96406 - DNA, 601 bp, Human
taaatcatcttaattaatctcaatctccattgcagagcctctcagcaatactattaccattttttcagattaaaaaactagagtcacgaaaggtcagaaacttgcctagggcacaacctaacatatggtgaatctgagatttgaaccctagtctttctgaggcaaatcctgcatacataattactatgctacagggtctctggatttaaatattgtaccaataaaaagtaggttttatttgatgaatcctacggctcagaacggaacaaagtagtttcgattaggatgtaatgtgagtttmaatcagggtttctcagcttcagccctattgccatttgggactggataattatttcttgtcgggagctaccctgtgtactgcagggtgttttgcagcatgcctggtcactatgcacaagatgccagtagcactttctcctcccccatgtgtgacaaccacaaatatctccagcaattgccaaattcccctggaatcatctgtggtagagaagcattctattattgaatacatgaaggaacaaatgaaagaatgtctgttcacggtctgtattttcagtgtacatgaattaatatgacatga

SEQ ID NO: 96407 - DNA, 601 bp, Human
cattttatttcaacaggttagctgctctgaaattgggacacgttttataaatgatagcgtgtcatagtctaaaacggcagcacatttttcttggtgaaaaataaaataacaatgcatactctaatcaatggtatcttaaaaacagtaaaatatggaaagtgatcaggcttttcatagtaggtcaggatgaaatgatttagtacatgtaaaggtaatactgctaccatttgttggaaactgactaagtgcaaacactctgctatgcacttaacataaatcatcttaattaatctcaatctcyattgcagagcctctcagcaatactattaccattttttcagattaaaaaactagagtcacgaaaggtcagaaacttgcctagggcacaacctaacatatggtgaatctgagatttgaaccctagtctttctgaggcaaatcctgcatacataattactatgctacagggtctctggatttaaatattgtaccaataaaaagtaggttttatttgatgaatcctacggctcagaacggaacaaagtagtttcgattaggatgtaatgtgagtttcaatcagggtttctcagcttcagcccta

SEQ ID NO: 96408 - DNA, 601 bp, Human
gagaaagtgttcaacttcaaagaacattcagacaagaaagtcgtcatgggatttccaccaaaaagtctcatttctaataacagaacatttccattaaggtttttttttcctccatgccttattcttaatgtcccctccaatgcaagattgtgtaccaggtgttaagatccttatgatacgaggagagtttgattttcttcatagtattgatagttcactacaatgtcaggtataattttaagaaaataacttgtattaattaggtaatagggagtaatggttcaataacagtaggagaatwtcatggtctcttctgaaatccagccctgataggtttttgaaatggagtaactctaagcacctttacttttatttatctcttattaaatggcattactaataatgggcagttgctgatctgacaagcagtgaagcaaagattagtgatgaaaagaggtagaaaaaaaaaacccttgagggtaaaagtagcaagtcagaggcaaattaatatatatttacattttctaataattgatttattcaacatatttctaattctacatcatgccgattgtgtgtgcgtgtgtttaactagaaattt

SEQ ID NO: 96409 - DNA, 601 bp, Human
gtgacagtgggctctattttaggcaatgtgagcacagaagactgctcctctcttcaggaaatggaatgaagtgaagaaatgagtcatgtcaacatactgaagactatttcaggcagagggaaaagcaagttccattgccaaaaggcggtgaggagttttgcttgtataaggatttgaagtagtacaatgctctgttaacataaatatgtacagaatcattcaggtgttatagaggacagaataaagtctctctctctctctctctctctctctctctctctctctctctctctctctctctctctcctcccgtccctctctttctctcaagttgattgtatataccaagagcttagtactttgtaatatttcttggataccaaccctgatttgactcttttaagatgataactctagcggcagattggaggcaagattttaaggataaggggctggtggaagaaacataggaaatgcctttagaggtccgagtacttattgaacaaacaggagcagcacggatgttcaggaagtattattcctatgttgtggataaaggactggcaggacttgatggggaaaaagaaaattttcagaatca

SEQ ID NO: 96410 - DNA, 601 bp, Human
agtgacagtgggctctattttaggcaatgtgagcacagaagactgctcctctcttcaggaaatggaatgaagtgaagaaatgagtcatgtcaacatactgaagactatttcaggcagagggaaaagcaagttccattgccaaaaggcggtgaggagttttgcttgtataaggatttgaagtagtacaatgctctgttaacataaatatgtacagaatcattcaggtgttatagaggacagaataaagtctctctctctctctctctctctctctctctctctctctctctctctctctcttcctctcctcccgtccctctctttctctcaagttgattgtatataccaagagcttagtactttgtaatatttcttggataccaaccctgatttgactcttttaagatgataactctagcggcagattggaggcaagattttaaggataaggggctggtggaagaaacataggaaatgcctttagaggtccgagtacttattgaacaaacaggagcagcacggatgttcaggaagtattattcctatgttgtggataaaggactggcaggacttgatggggaaaaagaaaattttcagaatc

SEQ ID NO: 96411 - DNA, 601 bp, Human
aatagattacagtgtagtgtacacctgacttctatatgtaccaggaaaccaaaaagttcatgtgactcactttattatggtggtctggaactgaaccttcagtgtctcagaggtatgcctgtatatgtgtatacatatatatatatatatgtatatgtgtgtatatatatgtatatgtgtgtatatatatgtatatgtatgctatgaagaaagattaaaaagagtaagtagagagtgacagtgggctctattttaggcaatgtgagcacagaagactgctcctctcttcaggaaatggaaygaagtgaagaaatgagtcatgtcaacatactgaagactatttcaggcagagggaaaagcaagttccattgccaaaaggcggtgaggagttttgcttgtataaggatttgaagtagtacaatgctctgttaacataaatatgtacagaatcattcaggtgttatagaggacagaataaagtctctctctctctctctctctctctctctctctctctctctctctctctctctccctctcctcccgtccctctctttctctcaagttgattgtatataccaagagcttagtactttgtaat

SEQ ID NO: 96412 - DNA, 601 bp, Human
tattgtaaatagtttgcattcttgatttggctctcagcttgaacactgcaataacatatttttaaattaaggcatgtacattagtttttaggcatacactattgtatacttaatagattacagtgtagtgtacacctgacttctatatgtaccaggaaaccaaaaagttcatgtgactcactttattatggtggtctggaactgaaccttcagtgtctcagaggtatgcctgtatatgtgtatacatatatatatatatatgtatatgtgtgtatatatatgtatatgtgtgtatatataagtatatgtatgctatgaagaaagattaaaaagagtaagtagagagtgacagtgggctctattttaggcaatgtgagcacagaagactgctcctctcttcaggaaatggaatgaagtgaagaaatgagtcatgtcaacatactgaagactatttcaggcagagggaaaagcaagttccattgccaaaaggcggtgaggagttttgcttgtataaggatttgaagtagtacaatgctctgttaacataaatatgtacagaatcattcaggtgttatagaggacagaataaagtctctctctc

SEQ ID NO: 96413 - DNA, 601 bp, Human
ccataaggcataaagtctttgaggatcaacaaagagtagatagaaacgtatgcaattgtccatttgtgcactgcatggcttgctacaatgaaagtcaccatattaactgctctgagggctggctttcttcagaacatcaacggaaactctgaaatttgctgctttcaggactttgcctagctcttccaactaaatactgagcacattgttagcttatgaaaaatgattatactgggcttgaactggatacaaactacttttctagatttttggagtggttgcaatatatttctgaataaawgtatgttgatatctacagagaaacctgtgattttcagtgtctggtgtttggacattaagctcaggtgcaaacttcaactctacctaaggaaaagtctcttgtaagctgtaaggaaaacaaacaatcttctagaaatgaagcttgggccaagcgcaagggaaactaagcagcgaccttagagacagaatctaagtcatggtaatgttgtttgcaaggacaaactggttctgtataatgaggttattgacctgaactgttttcaagcagttttaaacatgaggacgaggttcattgtatcca

SEQ ID NO: 96414 - DNA, 601 bp, Human
atcatttcataatatgtatttgaccttttacaggaagtcctcaaagaaaataaagaagttggttagtcagagattttaaaaaagaaaccagaaatataccatctttgaaaataaaagaaatcttaaagaagttgacgaagtgaaggaaagaagaaagaggaaagaaactgagcagggatgaacccagcttccaatcagaactcagcttgggaggtgagcgtaggagctggacagacaggctgtctgatgcagaatgcggaggtgccaatagacaagtcaatttcctaagaaacagaattgytccctgatgtgtctttaattagaatgtttgtaagcggtggacacactaattatgcatttaaatactagatcttgcatatacatcgtgagagattttcattttctttttaaagaatatcattttcttcataattattacagtttccaaatgcacctcccccaaaaaacaaaaacagaaacacaattctctcatgaaaatgtgctgcaggctactcagactcatttcctcttctattaagaggtaacaagacccagagtgaagaagaggcattataaataggacaaattttaaattttgata

SEQ ID NO: 96415 - DNA, 601 bp, Human
tcttcagtaatttctgaagttaagatgaagaaataacatacaaataaataaaagtatgtgtgtagatgggggaggaagggggagagagagagagagagagggagagagggagagagggagagagggagagagggagagagggagagagtggagagggagggagggaaagagagagagagagagagagagacagagagagagaaagagagttgaagtgctaaacaaagatggagaggtatttgatcatacgatcctaagatttttccagttattttgcagcagagattagtactacctataygtcattagtattatcatttcataatatgtatttgaccttttacaggaagtcctcaaagaaaataaagaagttggttagtcagagattttaaaaaagaaaccagaaatataccatctttgaaaataaaagaaatcttaaagaagttgacgaagtgaaggaaagaagaaagaggaaagaaactgagcagggatgaacccagcttccaatcagaactcagcttgggaggtgagcgtaggagctggacagacaggctgtctgatgcagaatgcggaggtgccaatagacaagtcaatttcctaa

SEQ ID NO: 96416 - DNA, 601 bp, Human
atggacttaacagatatttacagaacattcttcctaacaattatagaatatacattcttatcagcagatggaccattctccaagacaggtcatacaagagaccacaaagtcttaataaatttaggaaaatcaaaatcatatcaagtatcttctcagaccacagtggaataaaactaaaaatcaactccaaaaggaaccctcaaaactatacaaacacatggaaattaagaaatctgctcttgaatgattttggggttaacaatgaaattgagatggaaattaaaatattttttgaaatgawtaatagtgacacaatttatcaaaacctctgagatacagcaaaaacagtgctaagaggaaagttcatagtgttaaatactacatcaaaaattctgaaagagcacaaattgacaacctaatgtcacatttcaaggaactagagaaacaagaacaaactaaactcaaatccagcagaagaaaagaaataacaaagatcaaagcagaactaaatgaagttgaaacaaaaaaatacaaaatataaatgaaacaaatagttctttgaaaagataaacaaaattgatagaccattagcaagattaac

SEQ ID NO: 96417 - DNA, 601 bp, Human
ttacaccctagaacaaatggacttaacagatatttacagaacattcttcctaacaattatagaatatacattcttatcagcagatggaccattctccaagacaggtcatacaagagaccacaaagtcttaataaatttaggaaaatcaaaatcatatcaagtatcttctcagaccacagtggaataaaactaaaaatcaactccaaaaggaaccctcaaaactatacaaacacatggaaattaagaaatctgctcttgaatgattttggggttaacaatgaaattgagatggaaattaaamtattttttgaaatgattaatagtgacacaatttatcaaaacctctgagatacagcaaaaacagtgctaagaggaaagttcatagtgttaaatactacatcaaaaattctgaaagagcacaaattgacaacctaatgtcacatttcaaggaactagagaaacaagaacaaactaaactcaaatccagcagaagaaaagaaataacaaagatcaaagcagaactaaatgaagttgaaacaaaaaaatacaaaatataaatgaaacaaatagttctttgaaaagataaacaaaattgatagac

SEQ ID NO: 96418 - DNA, 601 bp, Human
ctcattaaaatagttacgataaaatttttttcagtgctttattaaaggactaggttttagttacctagaaaataacatgtttgtacatgcaatttctcttttattaatacataaactctaaatagtctgtccatttactctaatattatctttcccactcttatttccagataggtaaatgaggggttactataatctctaatgtagaggtggatttttaaaattaaatggcactaccaatgtatcacaaatgtctgaggacactgcaatgggtcaaaggttcaataagctcagaactgtrtaatttccaatcttttataattattagcaaatacttatgaaatgactacagtttttgatttggctgttcacaaaaacaatcttgctactttttcaagagtttggtgtactgtagagttgaaatggattatttatatattatacaagttcttttttgttttgcttcattttgcttttcacttctctggcatttgcccatattttcaattctctcatcattccaattaagctgtaaaattcatttgcataacaaaaaatgtttggctgtagcaactagtcaggtgttcatcatataataaaa

SEQ ID NO: 96419 - DNA, 601 bp, Human
tagccaactgggattagtttagattgtacgacccaaccccggccaatggggggaaagggtacaggggcaggacttgcgtcaggaataaaggctctcatgcccctttgttcaggtgtgctctcatggcaactggccaaggaggcacccctctgtgcagaagtaaaattgctttgctaagaatcctttgttcgagtgttcaatgtcctcaggattttgagcattattcctaacacagtctaccctgtcagcatgtgtctttccagtcagactatgtgcccttcgcaaggcaggactgagtcckctatgccttgtacgatgttttctttatatccagtctagtgcttcctaataagaggagttcagtaaatatttctgaattgaataaaattaaatgaaaattgctacttgaataaaggaaaagagaaagagataaataagtttcttttcccccaacttgacttcaatgtgaactacataccatggatgactttatatatatatgggacttgaaggagcctatgtaggttttccaggcgtgcaatcattttattaggcttattttttcttttgagacagggtctcactctgtcacccaggcggg

SEQ ID NO: 96420 - DNA, 601 bp, Human
ccaggtggaaaaagggcatttcagacagaaggaaaactacgtgcaaaatggcaagaggtatcgagccttaaaaaagaaatgcagtgtgtcctggctatctagactacagtgtttacaagtaatgatacagagctgcaagaatgcaatttattaagaccttgtaatgtgggactattacattctcttctaaaaccacagagtagatggaagtgtttagagaagaagagccatatgatacgattcgtgttttgcattgtggaggctttatcagaagggtgcagagatacaagttgggaggctracatggtaactggagtgggaagtggtcagctggactgaaggctttggccatacagaaaaaggcagaggggtgtgtgtgtgtgtgtgtgtgtgtgtgtgtgtgtgtgtgtgtgtgtgtatttttcttgcctttgatagttgagattttgagctggtaaacgacgaagagaaacttgccatcaaattgtttcttccagttgtgggatatgatgatggtttctcttcaaataatctgatcaatcttttattctttaattcatagtaccccctgatttttctcctttttcctttttacctttgt

SEQ ID NO: 96421 - DNA, 601 bp, Human
aattatatcagagtctcttaaagggaggggctgcagtggacacgggaatatgctactcagagcccccttcaaagaaagactcttgttctagatgatggaaatgatgtcagtagacattcttcaactgtcagtcccttcagggactgcctgagctgcagagagctgccttgtccaagttcatgcctttccccaggcagccctcattcagtgactgatgaaggtgaaagtatagaggcctaatttggctcaaagcaggacaagtttgaagggctacttcagctgcagagctccccgtggcatraggcaagcctgtatatggccagtggtgtgctggtagatgtatatcaactggatctctgatctcagggtgtttaaaaacaccttgtttttagtgtttgccaatttctgtggtgtaaatattcctaccacggttaaatttaaattaccaagaagataacatcaagtggctcaaaaaatgcctggcaatataacagtaggccgtcctgagctggttccacttcactgggcagctagctatacgataatttatagccagcagaatgtgagcagaagtgttgtttgtcagtttggggctgaggct

SEQ ID NO: 96422 - DNA, 601 bp, Human
ggaagtagagtgcaaacattagtgaaaacaaaccaacaaaaaacagttccctctcagcaactagcttaattcttgaagagtatctattgtggttgcatactaaaattatccagataactttaggaaaatcctaatgtactggctcacccccagtcaattatatcagagtctcttaaagggaggggctgcagtggacacgggaatatgctactcagagcccccttcaaagaaagactcttgttctagatgatggaaatgatgtcagtagacattcttcaactgtcagtcccttcagggactrcctgagctgcagagagctgccttgtccaagttcatgcctttccccaggcagccctcattcagtgactgatgaaggtgaaagtatagaggcctaatttggctcaaagcaggacaagtttgaagggctacttcagctgcagagctccccgtggcatgaggcaagcctgtatatggccagtggtgtgctggtagatgtatatcaactggatctctgatctcagggtgtttaaaaacaccttgtttttagtgtttgccaatttctgtggtgtaaatattcctaccacggttaaatttaaattac

SEQ ID NO: 96423 - DNA, 601 bp, Human
gcagcttttctagatgcatggttcaaactatcagcatttctgactattctggggtttggatgatggtggtcctcttctcacagctccactaggcagtgccccagtggggactctgtgtggagctccgaccccacattttccttctgcactgtcccagcagagaggttttccatgagggccctgcccctgcagcaaacttctgcctggacacctaggcttttccatacatcctctgaattctaggcagaggttgcaaacctcaattcttgacttctgtccaaccccaggcccaacaccacakgtaagccactaaggcctgcaccctctgaagcaacagcctgagctgtactttggcttctttgagccacagctggtatgcagggcacgaagtcctgagactccacaaagcagcacggccctgtgcctggcccgtgaaaccatgttttccttttaggcctctgggcttgtgatgggaggggctgccattaagacctctgacatgccctggagacatcttccccattgtcttggcgcttaacatttggctcctttacttaagcaaagttctgcagccagcttgtatttctcagaaaatgggttt

SEQ ID NO: 96424 - DNA, 601 bp, Human
atgtagttgagtcttgttgttttaatccatttggccactctatctttagactggtgaatttaatccatttacattcaaagtaaatattgataggtaggaatttactactgccatttaaaaagttgttttctaattgttttgtagatcctttgttctatatgcctttttttgttgtcttcttttatggtttgactgttttgctcagtagtatactttgattccttactttttaccttttgtatatctactataggtttttgcttttgctactataggtttttgcttttctttacatcttacktaagggttttttaagctggtaataacttaactttgattgcatacaaaactctacacgcttacttccctaatccacattttgtaatttcaatgtcacaacctatatcttctttataatttgtctcttttaaccaattattgtagctataagcacattgggatgtgagagttctttttagtagagatcacacaaattttgcattttaaaatgttacttgaaaataaaattttcaatgaagttatatttaagattcaattattccaaggtaaagttaattacaaagtccagaatggaaaatca

SEQ ID NO: 96425 - DNA, 601 bp, Human
aatattattcctagtatttgtggtgtggttgcattgactccagaataataatatctacaaaaggatcacagctgcatttctccctggtgcctgctcttggctagtgcaaagatacaaaagtctcgcccatttgcctcaatttggtagaactctgaaagaccatcccagctccagtgtccctgtcacatgggctgaagcctcagtagcaactgcagtgtggatgagcttttctctctgcccaatactgcctccttcacttccttataaatagcaacaatacttctcaaaatactttctgtgwgcaactttttgtctcagagactgttgccaaggaatctcatctctgacaccgtatctctggtctatttacgtaatagtttgtttttaatacatagaagtaatatgattttttcaggcattcgatagtagaatattttttaaagttaattataagccaggcgctgtggctcatgcctgtaataccagcactttgggaggctgaggtggtagaacacctgaggtccggagttcaaggccagcctgatcattatggtgaaaccctgtctctactaaaagtacaaaattagccaggcgtggtggt

SEQ ID NO: 96426 - DNA, 601 bp, Human
tctgaaaaataacagggtctcaatcaaaatttgttgttgttttcacaattagaatgaggtgcaagttgcaatgtactaagcagagtccttaagtgtaatctcgttctctctctaaatatatatatgcatatgtatatatagtctaaatatatatatttagagagagacagagaagttatataaattaatataacagagttatgtaactgtgatttacagtttcctcagagtttcaatctagaacttcatcagtgagaaaaaagaggaaccattagtgcaatgtaaatgcgacaatattaawtagtcttaaaatgtagattcttttggttcaaatcaattataatatatttgcacaagatctggacagcataaaaatgcctttttagtcattttctgcattggttcctcatcataccactctggtgtggatagggaaaacatgattactatcaatttatagaacgggaaactaaattcagataaattaaaatacttcttcaagatcaacatttagtaaattagatgaaaggttctgagaaatctgtattttaagaagaaaggctctgaggtgagtaattaataaggaattcaccaaaaacaa

SEQ ID NO: 96427 - DNA, 601 bp, Human
ggtatctttcttacatgtctcattcaatatgcaagaattattaatcactcaaatacttctaagagctatagcttataatatatggtatccatgaaatatatctaatatccattttaatttgggagagaagatcatttgatatagctataaaaatatggattgtaacaatcaagcgcatctggcatccactcacaacttaaatattacccttgagaaatatctccaacctgactttaaacatatccttccttcactaacttgaatagagaaataatcattgccttttcctgttttagttgamatcatctaagtgcccttctataactaacattatatgaattcatctacatgcgctcagtgaaaagcagggtttctcaatctcagcactattgacatttttgtcccagataattttttgtcgtgagtggctgtcctgtgcattgtaggatcagaattgcttgtcagtatctctggccagagctccctcctagatgtacaaccaaaaatgtctcctgacattaccaaatgtctcctgaggaaagaaaaattgcttatggttgagcatgtctcaattaaaaggattttccatctctccctaccc

SEQ ID NO: 96428 - DNA, 601 bp, Human
aggtatctttcttacatgtctcattcaatatgcaagaattattaatcactcaaatacttctaagagctatagcttataatatatggtatccatgaaatatatctaatatccattttaatttgggagagaagatcatttgatatagctataaaaatatggattgtaacaatcaagcgcatctggcatccactcacaacttaaatattacccttgagaaatatctccaacctgactttaaacatatccttccttcactaacttgaatagagaaataatcattgccttttcctgttttagttgraatcatctaagtgcccttctataactaacattatatgaattcatctacatgcgctcagtgaaaagcagggtttctcaatctcagcactattgacatttttgtcccagataattttttgtcgtgagtggctgtcctgtgcattgtaggatcagaattgcttgtcagtatctctggccagagctccctcctagatgtacaaccaaaaatgtctcctgacattaccaaatgtctcctgaggaaagaaaaattgcttatggttgagcatgtctcaattaaaaggattttccatctctccctacc

SEQ ID NO: 96429 - DNA, 601 bp, Human
ctgatgttatgctattaaaggttcctccagtaacagatttgggtgggttttgtttgtttgttttttgctcaatcaccttatgccagaaccagatgtattacaatgtacaaaattaaactgtatatctaggtagacagatagatacacacattgtgtgtgtgtgtgtgtgtgtgtgtgtgtgtgtgtaaagagagacagacagagacagagcaagagagagagagggcatctgaatagtctgaggacatactatgtagcataatacctttctcatgcattcattagaaaattaaaatgactstactaaaattgtggttttccctccatagttaagcagacagaaaatcaagctcaaaatagttgaaatgaattgagtttggcacaccagaatggtagcatgaataacagtaggtgtaatatactattgcaaaccacagctttgctctgagtattttgttaattaaaaggtgttggctttaggaaggaactcttatttttttcaagtgtttgaagaacacttctctagtctgaaaatttaattggtttcaggggtacatgattagtcagactaacagctttacttagagctttaaaggagcta

SEQ ID NO: 96430 - DNA, 601 bp, Human
tttccttagtaaccacaggttgtgtcaccagagtaacagtctgagtaggagctaaaatattttgggtttttgcaaaagggaaaaaagatgaagaagaaaaattagaaacacaagctaaagagccaatttcaataacaataagtcaaatttaattgaagagtaacaatttgagccaaactcttattcatgacattatatatctttttctaacaatgtggatactttgtttagcaatacatggtagaaaatgaaaagattcaaccttttcattaatatacatttaacaattttttaaaaaacrattttgctcattctcatgcctggacaagtaacttaagttaaataagccttctcagtaacaatcatatacattgtggaagtggtaaagaaaacaaaagttttcagaccttgccagggaaataaattttacttattttttttttattcaagaaaaaacaaaggcaaaacaagatgggataagatcttctttctgatttaaaattcccttgaataggaagtaaattaatttgaagctggaccctagggaaatcaaagccaatgaaacgttcttgtcttagctctgtattttatactgggagca

SEQ ID NO: 96431 - DNA, 601 bp, Human
ggagccaagctttgaacccagacaatgtaacttcaaaacctgggctttaaacattataaaatattgtttcctttggtaaataaaagtcctgggagtattatataactcaatatggtattgtaaaagaacgtacctcttgtttctgtatgtatcagtacatagcaaccataaaatgctcagcatagtgtctgacatagactacatctacatctacatacaaatcactaaatagtaactgcagttacagttattaccgcagcaatagtatgtattgcttgcagtacatatattacttgctacrtatactctctgcagtagcaagtaataacacaagcttaggaatcaaatggacttggatttgaatccttgttctgctacttactgggaatttgacatctatgagcctcagttactttttctgaaaaatgtggctataattactttttttaaagcagaagtaaaacaaattttaggtacatatatgtagtatttacatatatttatatacatccatatccataactatattgtgaatgtgaatgtgtactctgtatgctctgtactcagaataggaaacgaagatccagagatggcttgacca

SEQ ID NO: 96432 - DNA, 601 bp, Human
tccacctcagtgaaaagcacagtctgttccctctgcctggattgcccttctcgttttatctagctaggtaattccaactcattctttaatgcctggcttaagtttttccttcttcaggaatatctcactagcatccattctctctcctggcttagttttccctgaagaaagccccaacagcatcacccacacaatatcagagaagttgaaaactatgaggtttaagggagaggactctggaaccaaactgcctgagttcacatctcatcattgtctttcttcctcgatctcaggcaggttmttatccttactgtgcctctctatctacctcacagtaatgttgtaagcattaaagaattcacgtgaagtacttagatcaatgactggcatatcatatgtgttagctattatcctaaaatttatctctatcatagtgttattattttcttccttcaacctcttttacctgcacattctatgttgtacaactttatgtttcccaggtacttagtggcagctcaatagaagttggttaaaataataaaaatggataggtgttagtaaagtttttttcagtttataaagcccttttggaattttg

SEQ ID NO: 96433 - DNA, 601 bp, Human
ccattcatagactttgaaatgtgtagtttagtatagtttataagtttatgtagtttctttaagaaaaaagcatatggtatcattttccataaaaaggtaattaggagacttagaaaatatgattttgtgtgtgtgtgtgtgtgtgtgtgtgtgtgtgtgtgtgtttgcaactctatgacctttttatttaaggggcggtttatttttgttatgaccagagaatataaaataagtcacattactgacactgacatatctttacatccttcgttgaagataatagtggatttggtctcattakgtaaagaaagaaaattatataaatatggatcagtcatccagatggtcgcaagctgtctaccagagacatgtacatttgttggaagataattaaagcacaaaatttgtaaatatcttcagccaaacagattacaacattaatttcttaattaatttcttaattggtatttcttaaacaagtttgtgcagaaatgaaatgatgagatgagaagggctggattgttgatcgatgaaagagaaaaacagaataatcaatctcctcaccctaagatgactgtcacccaacctcgtgaaatccatt

SEQ ID NO: 96434 - DNA, 601 bp, Human
aaaaacaaccatatacctaacattaacattagttaacattaccctaacattaaaggtaataataagaaaaatttacatcataacacactgtaacttcaattacagactttaaggaccaaaagttatggtgaaatggaaagcctaaaaggcaggtcctaaactttagggaacaataacattatataactttcagaaaattaaaaaaaaaccttattacattgctttcctgtaagaaagttagagaagacccagattctacgtatttctatgaaaacaataaaaatcactccatataaaggarccctaactagatccaagaaaggaaatttgtaaatagaattctctaattatttatttatttgagacggagtttcgctcttgttgcccaggctggagtgcaatggtgtgatctcggctcactgcaacatctgcctcccgggttcaagcgattctcctgcctcagcctcaggagtagctggggctacaggcatgcgccaccacgctcggctaattttgtatttttagtagagacggggtttctccatgttggtcaggctggtctcaaactcctgacctcaggtgatacacccgcctcagcctc

SEQ ID NO: 96435 - DNA, 601 bp, Human
agtcttcaacctgactctagagtgctttgtaacatgggtttcaaagacaatttgttgaacgaaggaatgaaaaaaacaaccatatacctaacattaacattagttaacattaccctaacattaaaggtaataataagaaaaatttacatcataacacactgtaacttcaattacagactttaaggaccaaaagttatggtgaaatggaaagcctaaaaggcaggtcctaaactttagggaacaataacattatataactttcagaaaattaaaaaaaaaccttattacattgctttcctgwaagaaagttagagaagacccagattctacgtatttctatgaaaacaataaaaatcactccatataaaggagccctaactagatccaagaaaggaaatttgtaaatagaattctctaattatttatttatttgagacggagtttcgctcttgttgcccaggctggagtgcaatggtgtgatctcggctcactgcaacatctgcctcccgggttcaagcgattctcctgcctcagcctcaggagtagctggggctacaggcatgcgccaccacgctcggctaattttgtatttttagtagag

SEQ ID NO: 96436 - DNA, 601 bp, Human
gaattaacaaaacaacctttacagaaaaggcaggaataaatctcaaaggcttcaagctgtgacataccagtcaactatataatcattatattaatcaactttaaggagtgtgaagaaaccttaagtcattggtatggttaataattggatttggtcagaactcacaccttgaatgtttgcatggtcctcacctacaaagtttccaaatgttaaaataaaatatatcctcatttttatttatttattattttagttttatattttattcttttttagaaatggagttttgttccattgcccwggttggaatccagtggcgctatcatagctcactgcagcctcgaactcctgggcccaagagatcatgtcacctcagcctcctgagtagctaaggctacaagcccacaccatcacagccagctaactttttatttcatttttttgtagagatgaagtctcactctgttgcccaggttgctcttgaacttctggcctcaagggatcctccatcctggcactgatattacaagtgtgagccattgtgtctggacccgtcctcattttcatttagaaaacaattgtactgtaaaatctcattata

SEQ ID NO: 96437 - DNA, 601 bp, Human
actccatctcaaaaaaacaaaacaaaaacaaaaacaaaacaaaacaaaaacgaccagtacatactggaattaacaaaacaacctttacagaaaaggcaggaataaatctcaaaggcttcaagctgtgacataccagtcaactatataatcattatattaatcaactttaaggagtgtgaagaaaccttaagtcattggtatggttaataattggatttggtcagaactcacaccttgaatgtttgcatggtcctcacctacaaagtttccaaatgttaaaataaaatatatcctcattttwatttatttattattttagttttatattttattcttttttagaaatggagttttgttccattgcccaggttggaatccagtggcgctatcatagctcactgcagcctcgaactcctgggcccaagagatcatgtcacctcagcctcctgagtagctaaggctacaagcccacaccatcacagccagctaactttttatttcatttttttgtagagatgaagtctcactctgttgcccaggttgctcttgaacttctggcctcaagggatcctccatcctggcactgatattacaagtgtga

SEQ ID NO: 96438 - DNA, 601 bp, Human
tgcagtgagtcgagatcgcgccactgcactccagcctggcgacagagactccatctcaaaacaaaaacaaaaacaaaaacaacaaaacaaaacaaaaagaaagtctcatgttggagatgactggggttggaggaaaaagttgggacatacggttttggaggtgctgcactgaccctggaacacataattctggaagtcttgctctatgagaaaaagaaactatctggataagccactgtagtgagaatgctgtcacgcatagctaaacacaatcttaacagagtaaactggaaaaaaaaaatcctttaatttctaaaattcttagagtgtctaaaattatgattgtttttgcatcgatgcagtaaatttaattctcaggagactttcattcatcattgaccaaaacaagacatgaatcatattgcatttaacagttaagataaacatatatatgaatatagctctataaaatgttgtcatattccaaatactaagtaaaactagtaatctgtgaagataaagtaaatcaacaatatttataaagcacctagtacatctttagcggctatgtcaaatagaatattacaccttcctttacagg

SEQ ID NO: 96439 - DNA, 601 bp, Human
tctatgccataaacctatgcatcacctccaaaatttttctcttaccttccttatttactattatttttgcatgtacgataataacaggtaaaaaaagatttactctcttagcaaagttttaaatataaaacattgttaactacaagccctaggctgtacagatttgtaggacttattcatctcatatgactgaaacctagttagtattttttttttttttttttttgagatggagtcttgctctgtcgcccaggctggagtgcagtagcctcccgagtagctgggaccacaggcacccacsaccacgcctggctaattttttgtatttttagtagagacgtggtttcaccgtgttagccaggatggtctcaatcttctgacctcgtgatccgcccgcctcatcctcccaaagtgctgggattacaggcgtgagccaccgcgcctggcccctagttagtatcttaatactcattattttccattttaacggcacaaaacagctgagattatgagagacaagagtggttattcttattagaacaaccatagaaggagggcaatatctacaagtttgggccatggggtggtgctgctatgaata

SEQ ID NO: 96440 - DNA, 601 bp, Human
gtacagtcacatgctgtactggtttatagcctaggagcaataggctataccatacaacctagatgtatagtaggatgtaccatctaggtttgtgtaagtacactgtatgatgtttgcacaacaagatcaatcagctaaccatgcatttctccgaatgtatatctgttgttgagcaatgcatgactgtatacccctgtgaaatcatgtccagaatctatgccataaacctatgcatcacctccaaaatttttctcttaccttccttatttactattatttttgcatgtacgataataacagktaaaaaaagatttactctcttagcaaagttttaaatataaaacattgttaactacaagccctaggctgtacagatttgtaggacttattcatctcatatgactgaaacctagttagtattttttttttttttttttttgagatggagtcttgctctgtcgcccaggctggagtgcagtagcctcccgagtagctgggaccacaggcacccaccaccacgcctggctaattttttgtatttttagtagagacgtggtttcaccgtgttagccaggatggtctcaatcttctgacctcgtga

SEQ ID NO: 96441 - DNA, 601 bp, Human
aaccactttattgacataaaaagctatacacatttaatgaacacagcttgatgagtttcgagataattacagttatgtgctgcataaggacattttgatcaatggaccactatcatgtgcacagtctgtatacatgtaggacagtggtcctataagattataatatttttctgtaacttttctatgtttagatgtgattagatacacaaatacttgccatcgtgttccaattgcctgaagtattcagtacagtcacatgctgtactggtttatagcctaggagcaataggctataccatayaacctagatgtatagtaggatgtaccatctaggtttgtgtaagtacactgtatgatgtttgcacaacaagatcaatcagctaaccatgcatttctccgaatgtatatctgttgttgagcaatgcatgactgtatacccctgtgaaatcatgtccagaatctatgccataaacctatgcatcacctccaaaatttttctcttaccttccttatttactattatttttgcatgtacgataataacaggtaaaaaaagatttactctcttagcaaagttttaaatataaaacattgttaacta

SEQ ID NO: 96442 - DNA, 601 bp, Human
tctgaagggtcattccagcttaagaactccctgaacggtcagctgaggcccttactaagactgcgtcagagctcaacttctccctctgcccctacacgttgaccccaagaacactcctaaatagacatactgcatgctcacctcaatctcagggtatgcttcccagtcacccaaactatgatattatctttaagtaagtaaaccctaggcatttgggactgatttctagaatgctcttaatctaaaactctccaaagtgtaggtcaaaacttttccataatagtgtgcatattttctccccattgctcctttatcaagtacttgggaattaaggtaaagaatatttggaagaattaaagtggggtagacttcctgcatatctctcaggggtcaaacacacctgtttgtggccactgactttcgcaaaaccatctcatctttggccttgggcacactctgtcgtctgaacacctctcaacagaaggtgccctcctcactacactccaagacttccctttcaatccaactgaaaaatttgaatctattaagaaaatacgcttttttggaagctcttagaaaacaattacagtgaaacatgttt

SEQ ID NO: 96443 - DNA, 601 bp, Human
gcacttctgaagggtcattccagcttaagaactccctgaacggtcagctgaggcccttactaagactgcgtcagagctcaacttctccctctgcccctacacgttgaccccaagaacactcctaaatagacatactgcatgctcacctcaatctcagggtatgcttcccagtcacccaaactatgatattatctttaagtaagtaaaccctaggcatttgggactgatttctagaatgctcttaatctaaaactctccaaagtgtaggtcaaaacttttccataatagtgtgcatattttytccccattgctcctttatcaagtacttgggaattaaggtaaagaatatttggaagaattaaagtggggtagacttcctgcatatctctcaggggtcaaacacacctgtttgtggccactgactttcgcaaaaccatctcatctttggccttgggcacactctgtcgtctgaacacctctcaacagaaggtgccctcctcactacactccaagacttccctttcaatccaactgaaaaatttgaatctattaagaaaatacgcttttttggaagctcttagaaaacaattacagtgaaaca

SEQ ID NO: 96444 - DNA, 601 bp, Human
ctctctgacatttttatcttggctcttcgacaagttctcagttgcctgctcaagattcatattctctattatttcttccctgggtatctattttcacagaatagttgaagactcataataaagcctattttaatgtatcatttttcctaagcaaatccatttcaatctccactgtttttatttgccaaacatgtcctaaatactaattataaacgcagctcaatgcagtttattatgtttccacgtatttataccatatatgttattcgtgtatgtgtacacacacacacacacacacacrcacgcgcatgcacgcgcacatatggtttgttgccaataaacctgtgatagaatctggcacttatcaatggcattgccttgggcaagtcacttaacctctctgagtttctccctttcaaaacaagaaaaacgccagttagcttgtaccacttttgagaggattagaaatattgaatatgatatgcatagcacaatgcctggtatatactagaaattaatgcatggtaagcatcatgaattttatggtagtatatatgacctaacattttgggccaaaaggaagtgtttgaaggcaatttgg

SEQ ID NO: 96445 - DNA, 601 bp, Human
atccatttatgtaatattccccattactatctactcaaatgttctgctacactttctcgtaaaggtcagtgactctccactgccttacaattcaaactcctacagcgtagcaattactacaacaagagtaataactagttattgtgcttttcctatgtgctagatattgcacatgggatggatttgatttgtaattatgtgctagatattgtacataggaaaagcacaatatatattaacttacagacaccatttgaggtaggttaataatgaccacccctcaatggttctgtacttacasccttttatagacaaggaaaatgaagcacggaatgaagcataatttgcccaaggtcaccaagctaaaaggtggtgaaggtggaataaaatggcccatatcctccttttccagtgtttttctcttttacatcgtaactacaatttcgtaagcagctataatgtagccgaagctgggctagatgctttatagtcatcatttaatcccaacaacaactctacctagctgggtactatattcatttttttacacatgaggaaataagcacagaaaagattaccaacttccccaaagacagccagc

SEQ ID NO: 96446 - DNA, 601 bp, Human
ggcaacagctaattccatgcttttggttcacaaaggaatgctaatacacacaagtaataacaaaacaaactcacagtacatgtgctactgaagaggtgttgggagcattaaatattcgtacaaagggcagcacaaaatgggaggttaaaaaattaagcaacattaggaacctgagagatgcaactaattaaccagtttggccttaataaatatccatgctgtaatattttaatagtaatatctgcccctaatatctatccatttatgtaatattccccattactatctactcaaatgttcygctacactttctcgtaaaggtcagtgactctccactgccttacaattcaaactcctacagcgtagcaattactacaacaagagtaataactagttattgtgcttttcctatgtgctagatattgcacatgggatggatttgatttgtaattatgtgctagatattgtacataggaaaagcacaatatatattaacttacagacaccatttgaggtaggttaataatgaccacccctcaatggttctgtacttacacccttttatagacaaggaaaatgaagcacggaatgaagcataatt

SEQ ID NO: 96447 - DNA, 601 bp, Human
gtcatggacataatgatggcaacaatagaaacggaggactactagagtggggagggagggaaacaagggttgaaaaactaactattggttactatgctcagtacctgggtgacagtatcatttgtactccaaacctcggcatcatgtaatatatcaaggtaataaacctacacatgtactccctgaatctaaaatcaaagttgaaaaaatgtttgtctttttttttttttccacacagggtcttgctctgtcattctggctggagggcactggagtgaacatggcttactgccgccttgamctcctgggctcaagtgatcctcctgtgtcagcctcccatgcagctggcagggctccttacagccatgtgccaccatgcccagttaatttttctacatatatattttaaagacagggtctcactttgtttcccagactggtctcaaacttctgggctaacacgatcctcctgccttggcctcccaaagtgttaggattacaggtgtgagccactgcaccccacaaagtttgccatctcatatgagtgcagttcatgacatctcaaaacaattacaatagtaacatcaaaggtcactgatca

SEQ ID NO: 96448 - DNA, 601 bp, Human
ataaaacttgtcttcttttttcaaggaacttataatctagcaaacaaatactcatgaacaattattttttgtgtaataatacaatgggaagtaatgctaacgacaacaacaatagttgtttattgagtgcataccatatgccaaaagagtctatcacagcatactagttaaaagaatgaactctggagtcaggctttcccaatttgcatactggctgccacctattcggtttactattttcagtatgttacttaaatgctgtctgtatcatttccagcactgtgaaatggagatactgagwctctacctctcagattcattatgagaattaatagagttaatatttgtaaggtgtttagaacatttcccatttcatagtaagaacaataaaagttttaaataaaaactatcagtcaatgtaattatcatattactctgtgaggtgggtactaatattgcccctattttactagtaaagaaaatgaatgaaaaagaagttaaacaatttgtctaggatcacatggtaataagtggcagaacttctaacataggtaagttggccccaaagcccacacacttaagaactataatatagcatgat

SEQ ID NO: 96449 - DNA, 601 bp, Human
tcctggtctggtccagactcacgcattgcttttagttgtcgtatctccttagtcttttttaagttgaaatagttatttgcctttctttgaactttataacacttacagttttgaccaacagaggccaggtattttgtagaatatcccccaaatttgagttatagcaattttttaagtgcttctgttgtgtcactcattgagctaggtgcaggggctgtagcagtgaaggagaaaataattcctgttctcaaagagaaaacaaacgagtagtgatgacaggcaataaaaaagcaattgcaayaacctgaggtattatggtaggggaaacatggagagttatcagagcatatggcaaagatatcacatgaaatataaaggccaaagactgtcttctgaaggaatcaagcttaagtagtcctcagcttttctttatttaaattatacaaaacagttttaaacaccactgctcctcatacccaagtggccaccatgagaatatgcaggccttctattattgggtcttaactgactgaggactcctgttactgcattttgaaatccatgattgcactgcaccaaagccaagcttctcacagacttc

SEQ ID NO: 96450 - DNA, 601 bp, Human
ttaatataaagaattcagaaggtaaaagagtttacggaaccattttatgtattgaagaaaataagcatagaagtcaggaaggtactaaattgtagcctttctagttaccgaaagggttttactggtgaggatgctgtaatctatctagctttcaaccatctcactgagcatcttcttctggcttctattcttgcattcggctgcctctccaaatagagtggccaaatcgaaaaccatcctcattgtcttccacttacttcctcacttctcatttccattttatactggcttggatattgayattttcctacttggtcaaccttccctacttcttttttgaatgttctactagcacctccatcggtaacttcttaagaatcttcataaccaacttcataaatatcttccaactgcagttagccttttttgttctttattcactgaataaatactttataagatgcattttatttttatataatttcaagcttgcagaatatttgcaagataaagaactcccaggtaacccttgcccggattcaccatttgttaacattttgccacattatttttaattatttatcattttatcattctctct

SEQ ID NO: 96451 - DNA, 601 bp, Human
tttggtaatagtaaaataatgcaaaaaacttttccaaacattgtacatctactttaggcactttctcctctctgtattgaaaaattggaggggctaacttttaacaaattttccacatttgtaagctgtgattgctcagaaaaaaaatccaattttcaggtttctaacttttatggtttctttacacaacagagtgtttgaaatatggaacaaattgccaaagacagctattgaagtaagtggcataagtcagctggagagtactgaacaaattttaaagtaggaaccatatagtagcagrtagattttatgaaataagatgttttccagtgttagaatgtgaaactctggtcatctgtgacatgggaagctgaaaggttgctttggaattgcctaccctaaaatgtttgaatatgttcaatagaatttttaaaacggacttacccagaaacctcagatgaagtcaaattttcacctcaaagttaacagagaactttaaatacacagggctggcaaaatacataaattcatttactcatccattcattttaataaatatttttcagcactaggcactattctagggactatgcatgtggca

SEQ ID NO: 96452 - DNA, 601 bp, Human
tatacatttcatttccattttgctcaaatcagcagatcctccaaaagtaaactgaggaacatttcaaatggcctagtatgttgtattctgcaaggatgaggtatgtgaactggaatcagaccaaggtgcttttaaaatctgttatatgtttatgagagattgtactaaaaggactctcaatcccttaagactgaaaattcactacccattgcaaagtctgggtctgtttgctttgggtttcttctggctttttgtttgcttttcaaacaaggcgttttattaacctctttagggtaattcyagtgatgactcatggtcatggagatgatgatggcagcttgtagcctacactagctgccagctcccctgcgagacagtccaatcaatcagtaagtatttatggcattcccgttattttcagaacaagatgttagaattaaaataattcaaatataaaggagtaaccgtttgatgcttactgtccatcagggaggcgaaacatatactacatggagaatgtcctcagagagacacaacaacgttgaaattcctaatctatggcatttgtaacttacagatgtggcaacatgagaaagcaact

SEQ ID NO: 96453 - DNA, 601 bp, Human
ggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagccgagatcccgccactgcactccagcctgggcgacagagcgaaactccgtctcaaaaaaaaaaaaaaaaaaaaattaagagctttctatatacatttcatttccattttgctcaaatcagcagatcctccaaaagtaaactgaggaacatttcaaatggcctagtatgttgtattctgcaaggatgaggtatgtgaactggaatcagaccaaggtgcttttaaaatctgttatatgtttatgagagattgtactaaaaggactctcaatcccttaagactgaaaattcactacccattgcaaagtctgggtctgtttgctttgggtttcttctggctttttgtttgcttttcaaacaaggcgttttattaacct

SEQ ID NO: 96454 - DNA, 601 bp, Human
aattcagtcacagcctccgggaaatgaataaaataatctcactctaggttgatttctttgtgtaaattagatccttactaaatatttgcagacttacacatttataaaaaaaagtcatcagtctcatctattctgtctctattagaaaagggtcaatctatgtttaatttgctgccataagcttgaaggtgaaaatttatttaggaagcatttgatgactgttttctaggtactgttcttaatctaggtatgttaagggatggtgcctatccttaagttgctcacaacttatatgagagakaaatttggaatattcactgctgtacatattgaaggatttattatatttataattaaattctaccaaatcacatatggacataatttaatcttcttgtgttattagcacagtgcactgatatactgaagaatctaatttttcaatgaaataaggatctgtccaatttagcatactaaaatagaataacaattttattaattttcatttcaaatcagcattattatattatcttaagattccctttatttgtattccttaaggatgccaattctggttttacaaaatcaactttatattcaa

SEQ ID NO: 96455 - DNA, 601 bp, Human
taattagaatgttgccctctggagttctgcaatgtagcaagcttgctttaccataccactgtcctactgaacagccagcctctttgataatccttaagaggtaacattccaactacactgcttattgctccaggttaccacacactttgaaaagctcatgtctttgttaattttatttaatatatttttaatttattcacttaatctagtgaatgatgtaatgattgtaatattttcgttcagtgatgactgtaatattttggttccactaaaaaactgactacattaccttcatgtgtaycctgatatgaatccctttatagtcttcctttccttttttcttaaattcataaaatgtataaattgatgaataatcaggacttatgctgtgtaagaataaagacaactttatctgcctttggttctccctttaaatctgttcaagtaggttgttctgttctgttcttgggtgaaaatatgggtaagtttcatgtcttttctggtcatcattaaggaaacaaagtcctgctccatatcgagacattaaaattagaatatccagctcaatatattaatcaatacttcaatctgaactcacata

SEQ ID NO: 96456 - DNA, 601 bp, Human
tcaggtagccaagttagtcaacaaaagtggaagatttccacttaaaatttacaaaaaaaaaatgctaaaagttagaattttggaaaacgactgaacttgaagattgtacatattagccaggcagttactctaaactcatactcttatataattattaaaaggagctcctttactaattaaatctctaacctgattttcttttttccaaatcctgccatctttttttgcttttctatcatttccacaaaaaccactcctctcctctctttcataatctctgagtttatcaacatttttttttggttacgtcagactctagttttcctatattccacggtccatttgaaagcactaacttattacatgtaactagtgccaatggaaaattccagctagcaataaacgcatctatgttagtcactgtaggcagaactaatgttggctccaatgataagaatgctcctatggttttctcttggctggcaagcagttgctatattgctcctgaaaattagaaagagttgtgctgtgaagcagtagaaattacatacactgactaatacgttagctgcaaatttctatatggattctttcaatctga

SEQ ID NO: 96457 - DNA, 601 bp, Human
acctcttgggtggtcactgatactttaccaaagtgattaggacatggctgacaagagattggatgtaaagaaaatgatagaaatgcttgtagagtttattttagctgttaaaaaaaaaaaaaaaagcaaaaccagacaggaaacttaaggaatatgagctacctcattgtggaagcaaagactcagaagaagtagagaacaagaaagtaggaggttgagtaaaatatcaggtagccaagttagtcaacaaaagtggaagatttccacttaaaatttacaaaaaaaaaatgctaaaagttaraattttggaaaacgactgaacttgaagattgtacatattagccaggcagttactctaaactcatactcttatataattattaaaaggagctcctttactaattaaatctctaacctgattttcttttttccaaatcctgccatctttttttgcttttctatcatttccacaaaaaccactcctctcctctctttcataatctctgagtttatcaacatttttttttggttacgtcagactctagttttcctatattccacggtccatttgaaagcactaacttattacatgtaactagtg

SEQ ID NO: 96458 - DNA, 601 bp, Human
ataccttcaataaatgtctgtcaaatgagttgtacatgtagattatttccattatccccactttctctttataatgatataaaaatgccatttctaaagttaacctttgcccagcatcttcagtctttcttcttaagtaaccactatttgtttgttgcatttcaagttttcataatttgaaaatggactcaagactttcccatttccttccttattttcctcttatgcttatgctaatgatctctattccaggcgaacaaatgtcctctgaatttcctttgtttcttatttaatgcctttrtatcaaccacattcatttgtataaaacatctttaatgtcatgtttactagtagaatatctgtgccttatataaaatccataaattaaaagatatgggagggtcaaataattcagtaagccaaaactaatcaatgacctctctttccctaactttcttaaaataactataggttagagagaatctgttggcatatcctattgcctgtgtctatcttcttaatcaaattacagataaataatttagaaacgtccctctatatattgaagccagtggattagggtctcccacatgacctaggg

SEQ ID NO: 96459 - DNA, 601 bp, Human
agaaagaaatacttcagatattttgtaaataagcatcaggactagaaagaccccacaaaactagtgattgtaacatgaaatcaaaaatatagtccccagaataattaaaactcagtaagtggcacacattatagactactgtttttttatcaggtttatttctgtttgggtgtttgctatgtattgcaaaactagtcgacatattatattgcaacttcagttaacatgtcaacctctgtttaaccgtaagtctctctctaatctttgaacgccattgttttgtgtgtctcattgttgttgytccactaggtagtggaacagctttcgtagttgaggccttgtaattgtttagtcttctaattaatctttggtttataaaataaatggtgtaaatgctcttataagaaagctgtataaagtgtaaatgaaaatgtctttaagtgttctgaaatattctgtggatattccaattacaaaccctttttcaacttatcatagcaggctactttagtacacatacttgggactttttctcatatcctactgttatgtaccatgtgtatttgaaaataatacagttgacattccttaaaaatagtct

SEQ ID NO: 96460 - DNA, 601 bp, Human
cctaacctgactaatttggaaatggaagccatttcatccaagaaaatgatacggtttccttcttagatgacataaccaatttgagaatcagatactggtttagcaaaaggccttttctgtcagataaaatatctatagagggttttgatcaagtgcccaatctgatcaacctcctaccatgttacttccctgctcaaaataccctaaagcttaaccattgtttaacatttaagggcttttcaaactgactagtaaatactaagtttgaagggattaaacgcatgcaaagcactatgcatgytgcttgataaaacatagttattaagcaattttcttccttttcctttttcttttatcctgaggaattatagactactaagcagacagatatttgaggaaatttcagaggaaagagaaagaagagaagaatgagctgggctggaggtaagagaatggggggagaaagtgagagtactccttattcctccccaatcctgatacccactcacccccatttcttgatccagggcctccaaataagatatgaaagagtagacctgttactttttctaggaaggaattaagcccgaatggttgactt

SEQ ID NO: 96461 - DNA, 601 bp, Human
tgctttctgtatttccttaatattttttctttcttttctttggattggattatcccatttacctattttcaagtttgctgattctttcttttgcagcttgaatctgacgtcaagtgaaaatttaattttagttattgtgctttccaactccagatattccactgagttcttatttacaatttctatctctttattgatactctctatttgttaagacaagcacatgggcttctagatcccgcaagaacatgtcagaggttgccaaaatcccctatggacacctcattctccagagcttcaytggaagtttttctccagacctatgtttatctcaactagcatcacagccttaggaacctgttatgttaaagaattgctgctaattggtttggaccaacaccctggagctagggcttttcctagaaagttatctctaagtcgggccaaataaaggcaaggccatgtatataggtttattccagggagctgcaagataggtcaaacagtggcaaggttcttggaataaaattggcctttttgaagaattccaatcctggtctacactctctggtggctaaaaggctgctagttttcacagcta

SEQ ID NO: 96462 - DNA, 601 bp, Human
ttgactattctacatcccttgcatttcaatagaaatggtaggatccacttgtcaatttctgaaaaaaaaaaaaaagccagttgtgattttgataatgattccatagagtctgtagatcaattggggggatattgatatcttaataatattaagtcttttgatctgagaacatgtgatatttttctatttttttatctttaatttctttcaacactgctttgtattcttcagtatacaagccttgcatctcttttattcctaagtttttaacattttttgatgccattgtaaatattttctkaatttcacttttagattattcatttttaatgtataaaataattcattttgtatattgatcttgtatcctacaaatttgctgaattattttattatttctaatattttttcatagattcttcaaaattttctaattacaaggtcatgttgtctgcaagtagagataattttacttattcctttctaatctggatgtcttttatttatttttcttgcctaatttccctggcctgaacttccagtacaatactgaatagaagtggtgagaccaggcatccttcactatttcctgatcttaggg

SEQ ID NO: 96463 - DNA, 601 bp, Human
tacatcttcttttgagaaatgtttaagtgttttgcccattttaatcagattatttgttttcttttatgatacatttaagctaatttttgtgtatggtgtgaggtggggccaaatttcattatttttcatgtgtatatccagttattctagcaccaggttgtgaaagactattctttttccattgaattctcttggtacccttgtcaaaaatcagttgaccataaatgcaaaggtttacttttgaactttcaattctatttcattgatctatatgtctattcacattctagtaccacattgwcttaataattgtagctttgtagtagtttttgaaattggaaagttaactcctccaatgttgttcttttttcaaggttgttttgactattctacatcccttgcatttcaatagaaatggtaggatccacttgtcaatttctgaaaaaaaaaaaaaagccagttgtgattttgataatgattccatagagtctgtagatcaattggggggatattgatatcttaataatattaagtcttttgatctgagaacatgtgatatttttctatttttttatctttaatttctttcaacactgctttg

SEQ ID NO: 96464 - DNA, 601 bp, Human
tgcctatatcaaaatatttcctgtatcccataaatatatatacctactgtgtacccacaaaaattaaaaattaaaaaaatatttccaggaacttccaaactgttttcaaagttgtttcaccattttacatttccaccagtaatgtgaaaattccaagcattcttcatcttctcaacacttgttattgtctgtattttttgtattagccatcctagtgggtaaaaagtactatctccttgtggttttcatttgcattttttaaacaatcaatgatgttaaccatcttttcatgtgcttatgragatctatacatctactttggagaaatgcctattcaaactgtttcttcacttgtaattaagtcatttatcctttttgttgttgaattatgagtttttatatattcttgatacaagtatcttatcaaatatatgatttacaaatatttttacccattctgaggattgtcttttccctttctttacaatattgcttgcagtacaaaagttttaattttgttaaagtccaaattgtgtatttttcggttacttttgcttttggtgtcatatctaagaaaacactgcataatccattgtattcc

SEQ ID NO: 96465 - DNA, 601 bp, Human
agctaaccaccaagaggtcgtttgctcttagatccattctctacccatttcctactccactcagtattgagatgtactaactcccataggaggtcagaatttcctgggatttcttgctagctggcttctaactaggttaagtcatgagacacactagtgggagacagaagagcatgagaaagggtgaaacaagataattatcccccttctctctctgtcttggcagtatctcctttgtctccgtttcccactggacggctgctccctctgtaattccattacctgctgtgcagaccttacrttgggtgaattagcacccgatggttctggtttctgggctttggtaaaacttgtcggttccccagcccttgaggtggtaatagtttcctgaagttgctaaactctgggttgcctcactgtcctctgttgggtttgtcagctccttcattcctatggaggagccagtcctctgtattgaatttcctctgtttgaaatatcgaatgtggtttacagactaattcctgacaacacgaactgaaagaaatctcacagtaaatgatcctacctacaattccacagggggaaatttaatatatcaaa

SEQ ID NO: 96466 - DNA, 601 bp, Human
atattcctttggatagagttatcaaagtagactgataaatggctcttctagctataaatcagtattttgctttttgtttaatctcttggttatgtcactacttttgtgacagcgggcaaatgagatcttatgttcctcgtttttaaaatagaagtctgagccaagtccgtgagtttagttggtatttatcgtcttgaaccctcccaagctccagtttagctggattggaaaaacaaatcctcatggtccatccagtttcaccaccccattattacagccaacagtagttttagaaataatrtaattcataccttttatgaatgcttctccaagaggcattgatattctctgttatcatgtggacttttctggtatcatctgcagaataatcccggagaagtttcagggccaagtcatttgccacatctacatttgtctgccactggcggaggtctttggccaactgctatagatttttatgagaaagagaatgaatgtcagttttttttatgaaatctctagttggagtgtcttaaaatacttcgtaaacagcttctgaatcctcaggtcagaatacatatattagattgcttttaaccta

SEQ ID NO: 96467 - DNA, 601 bp, Human
ttaacataccaaatcctctcagtccttaaaatggactacaaggtacatttcgcataagaggaatttaaaatagggtattcaaaattgagagggttgaactggtggctttggggtcatttgtagctttaaatttaatttaattttaagagatggagtctcactacgtcacccaggctggagtacactggcatgatcatagctcactgcagccttgaactgaactcctaggttcaagaaatcctcttgcctcagcttcccaagtagctgggactacaaacttggcttttttttttttttttttatgttttgtagaaatggtatctcactatgttgcccaggctggtctcaaactcttggcctctagtgatcctcccacccccacctcggcctcccaaagtgctgggattatggggacatgtcccaccaggaactttaatattttaaataaaatgtgccacatatatattatgagcaggccccaatgtaataaaggttgtattttaaacaaatatcccgctagcattctatcatatttttgtacatagctttgaaggcagcaaatctttatcctttaaatttttggaaataatccaaagccatt

SEQ ID NO: 96468 - DNA, 601 bp, Human
atatattttggtgcgttggttcagcccagttcaggactgtaggactgggttagaatgaaaatggctacttggctacatcaccaggtaattttccacaccagtaaatcaccaatgacatggttccaaatgtctccctttgtgtgcaatccctgcaagctagaaacattctaattacttgaaaggagatgacataaaatgaagcaggctgttaccactatgaaccttttagatccatatggatcatgacactctctggcccggagccccaagatttcacatcatagatgttatattaccctaytgtagaatgcagagaatttttttttttttttgagacaaagtcttgctctgtcgcccaggctgtagtgcagtggcacaatctcagctcacttaaacctccgaagagttcttatgcttcataatcagttgggaagatttgggtctcagcaatataaaaatgggattgtcttgtaactatacatatgactctctcctgaagagccgaaagacacattttcatactgctaagtgtacctaaaggagttgataatggattgaattttttaacataccaaatcctctcagtccttaaaatggacta

SEQ ID NO: 96469 - DNA, 601 bp, Human
agactaaaatagacttaatcaaagcttattatttacctaccatagctgatgggtaaaatgtaaacccatgtatttttatttatttatttatttgttttgagatgaagtctcactttgtcacccaggctggagtgcagtggcgccacctcggctcactgcaacctctgcctcctgggttcaagcgattctcccacctcagcctcccaagtagctaggattacaggcgcaggtcaccatacccagctaatttttgtatttttagtagagatggggtttcgccatgttggccaggctggtctcgaactcctgacttcaggtgatccacccacctcggcctcccaaagtgctggggttacaggcatgagccaccgcatctggccgggaaacccacatatctattaaaattctggagtagctttatcagcatttataatattttataataaaattttatttatgaaatagcctaagccaaatatattacagtggtacattgtctaaccatacatcgaagagtgagcaaaaaactctacatttgcattgcccttatattctatcacaagccatgggagatatctataaagtctgatactgttccaaa

SEQ ID NO: 96470 - DNA, 601 bp, Human
caatttagtcattactttgtatcattctagataattgtttaatgtaatggcaacatccagaagtaggttttaaaggttttaatacaattaacatgtttacgtatgaatgagacatggttcatgttaccatggtaacatggtccaaaacggtacaacacttaaaatcaaatagctaaactcatattgcattaaattggggtgactggatgaaaaatggattctaattttctgcattcagtctttcttcctgcaggagataaaagaccagtcctgaacatttgtccccattgactcccttttytaaacttttaattattttcattatttcatttcggattttctctgagatctacaggaattcagggtcccaaaatggaaaataataaagtaactaaatatagcaagaagacaatcatgtgagtcttgagtattcctgagcattatagtcagaggttctcactgaacaatagattcatgggtagaacatgctacgttcaattgaactggtatctatcgagggtagagacagtagtattgtgaatgaggatggggtttttatagtatcaatatgagaataaaaggaaaaatgaaaatttccatg

SEQ ID NO: 96471 - DNA, 601 bp, Human
tattaattaatataactttgatccattgacttttaagagcatcctattagatttacatcttcagtttgacttttgtttaatggtaattcataaaattaataaggacctttcacttgaaagctttttcaaagtgctttcatatttattcccttataagatcctcacaaaagctctgcgaggaataaaacacaatggttattggaggctaacaaaattgacttttcagtatgcacagtgtcttcttaccaatgtgggcttttcttttggtttatagatataaaattacaaaatccaatagttratttacaaagttattcaatttagtcattactttgtatcattctagataattgtttaatgtaatggcaacatccagaagtaggttttaaaggttttaatacaattaacatgtttacgtatgaatgagacatggttcatgttaccatggtaacatggtccaaaacggtacaacacttaaaatcaaatagctaaactcatattgcattaaattggggtgactggatgaaaaatggattctaattttctgcattcagtctttcttcctgcaggagataaaagaccagtcctgaacatttgtccc

SEQ ID NO: 96472 - DNA, 601 bp, Human
ttaacaattgaagctttctttaaacaaaatggattttcaacactcacagtaaccaatatttcaagcatagtttcattcacacgtctatttctttctaagtagtttctcacacaaatcaaatgagaattgtgctctcaaggtgatagtgaaataaacaataccaaagtctatttatacatattgacataaaattacatactatatgtatacataaaaataagcctgaaaatagtaataacataatattagctatgtttattgggtgcttaccgtgtgccagaaactgttccatgcacttcartacattaattcgcatcaccctcacaacaacctgaagaggtagctgtcattacttttgatttatgctccataatctgagagcaattcagaaatgcgtctatggtcagtaagccccagaatcacgatttaaactcaggcagtcgggcttcaaagttcacactatgaaacactatccaccccagcctctctctaatgcaatgtcagaagtactaaacgtcatttaaagtgcagagaaatgcctataggaattgagatggagacaagatgtcttccagcttgggggctcagggaaaaagggaag

SEQ ID NO: 96473 - DNA, 601 bp, Human
ttgtactctattataatatagcccttccttccttggctaggtctctctgtcctcctgccccaagccccaccactattaattcctcttttggggtagttccatatcttatcaacttgtatattttcatgcctgtttactgttctgtagaagatcccacttcttaatagctcttcttaaaagtcacattcaggaatccattcaaaaagtacattttccactacgggtatatattgcatgaatttcaaaatttctttcaggtcatggatgaaagatgaatttagggttgtctaatcaatgcaayggttgcatccaaataagaacacttgttttccactccaaaagagaatcaacaatttaccataccaggtgaagaagctacctctactcattgcactttttaaaactgcattgcacagccattttccaaatatttgtaaagctactgcaaaaactaaaaaggatttatggagtaaatcatgggaagaatgcctggtcaagtggttcataaatatccaggtctcattctatttggggtcacagccttgaatttaatccaatattgaattgttgaattgggagcaaagaattgaggtgaaatgtg

SEQ ID NO: 96474 - DNA, 601 bp, Human
ttagacctcagtagaggtatgtgaagcatgtagtaataacaatggctacaatgacacataaatagttatggctgcaatcgctataggtactggaacaacattcctctaggaacaatgacatcaagaagccttgcagagagccaatctcccagaattttgagcaatcaaactccttgtgacattttagaatgcactgcatcttctcttagggttactaaaaactacaactatacctaactcacctagcaacagttcatgccgctaattcattttaaagatacattaacagtagtcttttcawatgtctctttgaattgacttggctgtgtctcttgaaaggctcaaatttgattaggccaaaatgcagaggaaattaatgttattctcttgtgccatttccctaaattcagaaatgtaaagaaataccaatttcaaatacagacaagtctaatgttaaatgaagtctgaacatataaaaagattgtcgtcaagacaaatccattgcctggttttcttcagctgacatctatttttatgtagacggtatgacttagattcagggactaaacatgaagaaattcagaataatccaattattcaa

SEQ ID NO: 96475 - DNA, 601 bp, Human
tgtttgaaagttgttcttcaagtgggaacatgttttcttccattttaaattgcagtcttacagatctgtagttttcttttcatggggacaaaattcgttttaagaactctggtatataaatctctggaagagagcattcacaaataaattccgatcaacagattgcatacatttctcaatcagctgtgcagactgagcattttcacggctccagtcatttcataaagatgattcagaattaatcagtcctactgctacttttattatttatatattcacagtattgacagatttcattttmttcccactctttactcctcctctataggaataacactcatgatgtggtgcgggcagcaggaagacctatcatctgactttctttctttaaggcatcactcaactaatcctgagaacctatgaacaataatggtggatatgcagattcacatcaaacttctgtttggttcttcaagtgttctctccagaatatgaagtccactaattctttagacctcagtagaggtatgtgaagcatgtagtaataacaatggctacaatgacacataaatagttatggctgcaatcgctataggtactg

SEQ ID NO: 96476 - DNA, 601 bp, Human
tctgatttttattgctacagcctctcactgacttttgtctcatttttcatggaggcttttaagttttaacaaaatacaaaattgaagagctttttaaaagaagagatttatgcgatgtatagaaagattttctggagttataaaatcctgatcaccagatatacttaggaaatgattaagaaggctgaatggtaaacatagactctagaaatgtaattatcattttctctcttcttttaattattaaaaatcttgcatttaaggtctgaagtttgccagactaatccaaatttactagtgrgaggcatccttgaattctccttaatctgtttagttacttaaaatgtttaagactttctaatcaagagaagcctacagtctcgaaggcataatgttctctccgaaaccaatttaactttaggttatttaattggaactccaaagaattagaagttcattctatttccttggcattcttcacagcacctggcacagtgttaagtacatattagatgctcaataaatatttttgaaggagtgaacattgcttaagagggaaataagaggaactattaagatagaagatatttaaattcctaaa

SEQ ID NO: 96477 - DNA, 601 bp, Human
atttttattgcctccgtattacagaggagaaaatggtggcacacagtttaagtaatttgccagggtcataaaggtagctggtaaagacttggagggggtttaaacccaagctctgtagctatagaatcttccaactggatactagacaaaacaaaagttcccagagcttcgctgcacattagattgagctgagtagtttgtaagaattatgatgcccaagtcccacagaacaccaataaaataaaactctcaggaaatcttgtgaaaaccaaagtttcaaaagaatgaaactttactcaaytgatgctcaaagtgtattttgttaagatgtacttgaaaatgtcatttgagcctctcttatctgattgtttacagagcaaaaagaaaaaaaatagctaacttctgataaaacccaaaaactatgaagaattccccatgcctcgtcataaaagtagctttttcctcgactttatagattttatttgattttaaattttagtccacattttcatgtgtatttggccctcaaaccaagcatgtaatttaaaaaattgttaactcatactttttcttatgtaattagagttaaaaatcattgtta

SEQ ID NO: 96478 - DNA, 601 bp, Human
aattatttaattatactcatggttttgactcatttgtaaatgcccatctgaggttttattaatcctgctcattactatatgttgacccagtctattgtgatctcatctctaaggttttatgagcacagcctgatattcatgaaattttccaggggtttgtaaaaatttctgggtgatcatattattaaaggtagttatgtctattctcgaaaataaacatatcttttcattacaatgccaaatacatgatcgtgggagggatcaaagaagtgtgtacatgatttagctgctcaactggttkaattactcaacacttttagctatgaagagagtttagaccattataatagtcctagattttttattcttataatttatatccatatttagagcattggttactcatgttgaaatatataaagggttgaagaagttataagggatcatatttctccagattttactccagatgatcttcagagtaagtcaatttgtaaaccgcatatagaaaatctaaaagtggaaatttttattgcctccgtattacagaggagaaaatggtggcacacagtttaagtaatttgccagggtcataaaggta

SEQ ID NO: 96479 - DNA, 601 bp, Human
catcaaaatcatggaagaactttgtagaaatgcaaattatctgtgccctccccagacctccccaattagaagcttaagggtaaaacggtcatctgcatattaacaagttttccaggagattccagtggagctaaagtttgagaaccactgtcctatatcatgcccagcgtttactctgtgtatttataatgtttttaaaaaatttccatattttatggatgcttgaacatcttgaggtccttggaaggccagggagagactgcccctcccagggctagctaattcctaaagatagcaaatracttgtaaacttgctcccttgtggatttgttggattgcttttcgttatacaaaccaactaatccaaagtccgtatccccaactaccttcttcatctaactgttgttacaccaaaccaatatttcccccaccctaactttttcccctcaccctagggcttggtaccagacaaccagagaccacttttacagccaggaaattttggaaattatttgaactatccagtcctaaacttgctcagacttgcctattctacctcactcatttcttttccttggaaaccacaataaagggtttgggc

SEQ ID NO: 96480 - DNA, 601 bp, Human
aaccagtctaagatatttctagttactccttttctcttttttcgccctgtgaacaatttaatatttggcttcttccttttttttttttttttaaatttcttcctccctactcattcccactcccaaaccaaccacaaagctaacctcagctttttttccaaattatcccttttgcttgctatgaacacaagtttgaacctcagctctgttggtgataattttgcccataagaagcttctggcaaaaataaaacaaaataagtctttaggcctcattctttaggaggttttgctggcctaawttgtttttgctttttaatggtattttaattagtgtttcaccaagtgtggttctcaatcagcaacaatagtatcccctgggaatttgatagaaatgcaaattatcaggcccctctcataactaaatgattacactttgtggagtctcttcatctaaatgtcttcagtggcaaaagccaatgaagaaaatctctgtatatagttttttttttggtttgtttgtttttgtttgtttgttttttaatggttctcagggtttggtctctagaccaatgccatcaaaatcaactggaaatttgtga

SEQ ID NO: 96481 - DNA, 601 bp, Human
accatcagcccacaaattagtgaactcaagaagtacctactgttttaagctactgagttttgaggcggtttggtaatggactgatatactattatatataactgatacagacataaaatgatacttttgccaggtaaactattaaaacaaaacaagatttaccatccactgttaccatcatattgttaaggaaggggtatttcaaccacaagaaataatcagaaagacatagtctcagcctaaatggtaggctgtcctaagaaaggaggatgacaagctacaagcttaaataatttctctytctctctctctctctttctgtccttatagttctcatttctctgcttattgaggaaatcttcttcacagatcatctgcatttgagaacctctgccacacacgacttaatgtaatgctttgcacattgtaaaccctcaagaatgttgttaaatgagtaatcacaatgtgaattaagtcattcacaatggaatgctgctaattctggaactgagtaatgtggtcattgcagtatactaagctgcgtgaaaacttctagaaaaaaattatagagaaaagttgccttctcctttattttagcaat

SEQ ID NO: 96482 - DNA, 601 bp, Human
acgtatcttgttgaaaattatgaatagaatgattaacaggacaaaatcattgccttcaataagttcacagctgataaaggctctaaaacagggctttccaatgggtatgctaaggcacatgccctgattgggttataggtacttcagatatcgatccctctcagccctgggatggttaggcagcttagagtcttcggccagcttacctgatatcatgatgaacacatcaacttaatctgttcatcatgatatcaaaaagactgaggaacactgcagagaagtttgggctttcttacagaamagactgactgtatagcttagctgagggagatctggagaccagaagatgtttccaagaagtgtgataaatctcagcttaagccagaagacaggtgagagtctttgtgaacatttcagccagtttaatgagcaatccaacaacattaagacatgtcaagattagcaagcttcagattgtgtgataaaagtgcaaagagttcgctagagccatactgaataatttgtctttctcttctacctttgtctgccaacaattctacccattggccaaatgcttctttctctaataaattcttgttct

SEQ ID NO: 96483 - DNA, 601 bp, Human
caaaccatttgggcacaccccaggtttattcctgacatattgaataccaagtctgtaagtcacagaattcaaattacaaagaccatcagaaagcaagatttttgatgcgctaccagagccacttagactaattcagaaactaagatgaggctggcctataaatgaagcttattggtagatacaactggtactccagggcagcaaagggaagataaataaatctgtgcaatgcgtcaccttggaaaagtcaattgctatttatttaacttcatttcaaccaacaattattattaacaacaaycacgtatcttgttgaaaattatgaatagaatgattaacaggacaaaatcattgccttcaataagttcacagctgataaaggctctaaaacagggctttccaatgggtatgctaaggcacatgccctgattgggttataggtacttcagatatcgatccctctcagccctgggatggttaggcagcttagagtcttcggccagcttacctgatatcatgatgaacacatcaacttaatctgttcatcatgatatcaaaaagactgaggaacactgcagagaagtttgggctttcttacaga

SEQ ID NO: 96484 - DNA, 601 bp, Human
tataattacagtagtttcctacataaacagttttaaatggacccactgcaacatgccaagaaataattagctcctatcatttaatcttatatatttatatgtatcatagcatatgttggcacataacattcacttactaattcaagcatcatcaagtaagtctagatcagaaatatatttagcagttccacctctacatactctttcagactgagctaattagccactagttacagagaaaaagataatactttctaaaatatatatttagatattttctaaaataactttactttgaaayggtttaagaccacaaaacttgcaaatatagtacagagacttctcacgcaccttttacccagcttctcccaatgatagcattttaaatacccatagtacattatcatcaaagctaggaaactgacattggcacaatactattaactcaaatacagacctcatttatatttcaccagttcttacatacatccttctaaataaatatttattttaatctggcttaaatcctaagtcttatggtaggcaagtatgttttatagcggttttaatatcattcaaaattttctaaataatgttcagt

SEQ ID NO: 96485 - DNA, 601 bp, Human
catttcctaattgcattgtttgtttcttgttttaccttgcagttttgagagttctttatatattctagacatccatcttttggctatatggcttgaaaatattttctatcagtctgtagcttgtcttttcatcctccctcacaggtcttttgcagtgcaaaggttttaaatcttgatgcagtccaactgatttttttctgtgtgtggatcatgctttcaatgccaattctagccctagagcctgaagattttctcatttttccctaaattttgatagttttatgttttacatttaagtccmtgatctattttgaattaagtttttacaaggtgtgagatttaggttgaagttctttttttttcccactctagggatgtccaatttctgcaggaccatttgttgaaaaggtgagctttctctattgaattgcttttgcaactttatcaaaaatctgttgggcacatttgcatgggtctgtttttgggttctctattctgtttcatttggtctatgagtctatccctccagcaacatcatactgtattgatagccttactatattgttagccataatattgggtagagaggttactcccactt

SEQ ID NO: 96486 - DNA, 601 bp, Human
gctgacaatactgattggtggtgggtaggggaattgattcgacagtgcatagaggtaggagaaataatttttattttatacctttttgtaaattttcatttttgaatcatcaaaatgatcacctagtggaaaataagtaaaattaaaaacaatcaaataagaccccctaaattatcagctttctttttactatcttaattaaatcagataacttgaacagatcttcttttgtactttctgtgtggaaagttatatcagactgaaacatgttaatacaaagtatttgcatatagacatagayctctatctttcccatttactcagacaacaacttttacaatgttaacatgtgttcaacattgcttgaagtaatatgggagttaaaagaatacaagacatactttctgtattacagaagctcttaactgagtgatggagaaaagaaaaaaagacttaggtgaagcatgaaagtaagtcacttcagtttctttgtgcctgttttctcaacagtaaaataacaaatgagataaatgactgttgaagtcttaaaatttctgaattgttttatttgttttttgaaattacacttttagttttgaga

SEQ ID NO: 96487 - DNA, 601 bp, Human
tacttctcaactcaccaccataagacttcttggctgccgggcgcggtggctcacgcctgtaatcccagcactttgggaggccgagacgggcggatcacgaggtcaggagatcgagaccatcctggctaacacggtgaaaccccgtctctactaaaaatacaaaaattagctgggcatggtggcgcgcgcctgtagtcccagctacacgggaggctgaggcaggagaatggcgtgaacccgggaggcggagcttgcagtgagtcgagatcgcgccactgcactccagcctgggcgacagagsgaaactccgtctcaaaaaaaaaaaaaaaaaaaaaaaaagacttcttggctctggttccagtgtaaattctttgattgcatcatcatgaacctcttacttgaggttagggctcagcgccccgaaccctcacactgtttgagggtcaactgtataacactttccctaattcccaactcaccacaataagacttcttggctctggttccactgtaaattctttgaggcatcatcatgaacctcttacttgctgaaaactccaagaaatagtgttcacacctagctttttcagctgcctggtag

SEQ ID NO: 96488 - DNA, 601 bp, Human
ctgctgggaggatcgggaacagctcatggttgaggagctgcgggagacagtacttcaataattagggtattggcaggcaaagagcacagagaaagccaagaaggccaaggccattatatgacacggaacttagatgtgatcctataaaaggcaagacagtggctcatgtggcctgtaaactcttttgaataaagaccccaaacttctatgggtaattactatgctagaagcaaactgtctcagtatcctctcaccccaaacatcattattaaactgatcatgaggtttcccagggcaacaytggaaacagagtcatctccagtctgggtatacagacttatgcacaactgtctgttttaacaaggaatatgttgtcgtgtgactaatttgcccatttgtctccccaactacactctaggctctagaggccaagggttttatcattttcatccttaaatctagcaattagtacattgtttaacacttagcaagtgctcaattaatgcttattgaatgaaccaacaaatctatcaaacaatagtgcatcaaaatgtttgctccaatctgcttattaataactcagtgtcttggttgccaaagg

SEQ ID NO: 96489 - DNA, 601 bp, Human
agcctcccaaagtactgggattacaggctgcgccactgcaccaggcctggaaattaagtatctttgtttaatgatggcattatgaaaaagactaatatgttctgccactcctcttcccggttacttcagctttttttaaatgagtaaactagaaaatcattttttttcaaactaaatgtcttcatgtttatcatgtaacatttgttatgtaaactcattgtttaaatagaaggactagggcgtgcaacatttggccacaaaagaaaatatgcacacacacaaacataactgatttttttawaaaaaaaaacatgtattactttaaaaatatgccagttaaatgttaaaacttatgtatgaatgtgctaaacaaagagactaacacaaaataatttctggtaacatttttagtatcatgaaggcccataaaaatgaggagggtatggattattgaaattgtgtgaaattagaaaactacatagaaacattcccgtgaatgcaaggagacaaagagagcaaatagttaagtacattggacccctccatatctgctcctttaaaaaatgtatatttcagtcatttacattttatgttaaattat

SEQ ID NO: 96490 - DNA, 601 bp, Human
cagcctcccaaagtactgggattacaggctgcgccactgcaccaggcctggaaattaagtatctttgtttaatgatggcattatgaaaaagactaatatgttctgccactcctcttcccggttacttcagctttttttaaatgagtaaactagaaaatcattttttttcaaactaaatgtcttcatgtttatcatgtaacatttgttatgtaaactcattgtttaaatagaaggactagggcgtgcaacatttggccacaaaagaaaatatgcacacacacaaacataactgatttttttwaaaaaaaaaacatgtattactttaaaaatatgccagttaaatgttaaaacttatgtatgaatgtgctaaacaaagagactaacacaaaataatttctggtaacatttttagtatcatgaaggcccataaaaatgaggagggtatggattattgaaattgtgtgaaattagaaaactacatagaaacattcccgtgaatgcaaggagacaaagagagcaaatagttaagtacattggacccctccatatctgctcctttaaaaaatgtatatttcagtcatttacattttatgttaaatta

SEQ ID NO: 96491 - DNA, 601 bp, Human
tccaattagaatgaaacataccagttctagttggtattctgacagaaaaaattatactgcaggttatatttttacactaaaattttccatcacgtaactggaattaatttattccaagatagtagaaatgtattggtgcagtatgaaatgaaggggatttaaataacataataaaaagaagaacattacaatctgtttaacataacctaaccctgggaagattaatagctttcaattcatacaaagactgaagtctacaatttcatatacacatggtcttattaaaaatgaaagctggttmtaatgaaatgctagcaccacgctaagattggcatggtgtatgaaatagacaaactaacagtgtggcaatagttggaggtggaatttcataggataactttttagttccaaaatggtcaaatcacacaatggctggagatataattaagaattaggctctaaaaacaaattctgaaacagaaggtaattaatatatcttcggggaaagctggatttttaatgaatcagacatgaccgcagagaaaggctcgatgttgccctgtactctcttagtctggttagctaaaaccaccccacacta

SEQ ID NO: 96492 - DNA, 601 bp, Human
aaataagtccagtgtagtaattcacttcattctaataacaaccctatgaggtcattaatcttcactgcggatacaaagaaactgaggtatatagaggtgactcagctagaatgtggcagtcaagttacaggaaatttataccattctttacaactgcctttcctgaagtaatggctgtgtataatattgttaagattgggtcgacaaaaatcaaccagtcaaatattagaagcccaagccccgccaacagatggattcctgtattagatgattttcccgagtcttctaacgacaaaaacarcaatggcagcagcattatctgcaaatatttatgagtacttaattgtgttgtgccacataccatattaagtggtttccatgtgttaaatcaatgtaatcccagtatccagtgggcgtcagcagagctgccttgagctgcaacctctttcattagcaaccagcttagatcccttagtcattttggctgggctactctggtggtgattcataccccagggccttgcctgagctgaagctagaacgtggctttgcaccctggaaacctgcctatattttgccagttttctccccttaaggaact

SEQ ID NO: 96493 - DNA, 601 bp, Human
aaaacttaggaatttaatattcacaaatcgatattctaaaataagtaaaaacaattagaaaagacagattcacacagagtaataaccatttgaatctcaatagatactagttataaaatgatacggacctttaaatcagtacatcttctgatgtctaaaagatgcttatcactactcactagactctttttcacttgctttgcaaatcagtttaaacatacatggtaatcaggagtcattatttttattcacttggaaagtcagaagtaccttttcccagtgagattttgaaggaaaagtmaaacacccttcatttggagattttatgggtgtctaaacatgtgcttttctaaacaggaaatgatttatgacttatcaaaggatatgcctgagtctctcacctaatctctaaacccagctgactttctccatttctctaacactgagcgtagcaaaaggagacgctcttgattagccaagagacactgctgctcatacaccaacctatatttgactcagggttggggaattgtgaaacaacctaaatgcagcacttttagatgaaaattgctctgaggattttccattctgaaaagtagaa

SEQ ID NO: 96494 - DNA, 601 bp, Human
tgaggcactgaacaatgatgtgagtgttttgaaagaggaagtacaaggaacttcttaggggtgggaggggtagccgatgaccccaaatttttgacaattgccactcggaaacagaatatagagatcaatttgtgataactttctgcagctattctgcatccaggctggatatccaaaacaaacactggattgctggaaaacttaggaatttaatattcacaaatcgatattctaaaataagtaaaaacaattagaaaagacagattcacacagagtaataaccatttgaatctcaatagayactagttataaaatgatacggacctttaaatcagtacatcttctgatgtctaaaagatgcttatcactactcactagactctttttcacttgctttgcaaatcagtttaaacatacatggtaatcaggagtcattatttttattcacttggaaagtcagaagtaccttttcccagtgagattttgaaggaaaagtaaaacacccttcatttggagattttatgggtgtctaaacatgtgcttttctaaacaggaaatgatttatgacttatcaaaggatatgcctgagtctctcacctaa

SEQ ID NO: 96495 - DNA, 601 bp, Human
tcttttctaatccttggtaatttgaattttttgtattattgatttatatacaagggctaatgtcctgcgaagtagtagtacatatgtttctgtttttaaaagacattgtttcataaaattctattataatgaaaagcatgggctattacatttttccttcatggagatatttcttatatatcgtaaatctagaaatgtgtattaaattagacatactagaagtcaaagaactgaggtacagctatttagaaatgaatttgtggaagcagagggccatgaacagctgtgcaagttgtacacygagaaaaacaaagaagtaccattcacatcatgagttgtatgtttcacaatctggacggctcttcatggcagtcctgaattgtagtaaaagagaagggttattcgttctcattattttttcctcagactctctcttcatggtgagggatgattattctcgtattcttaaatttcagtctaatagagttattagaattttaaagctggagagtatcttaaacatgaagtagcctagagatgacaaagaggttttacctatgtgctaactctcattagtgagtggtagctacctggagcattg

SEQ ID NO: 96496 - DNA, 601 bp, Human
ggaaaagatatatcacagctaacgggggctgagaggatctttcttcccttggggatgctgaataaactctatgtggtgtgcctgcattttcactgtgacttgtcacatgaggtcagaagtggagttttccatttgtgatgtcatgtcagcattcaaacagttttggaatttggaacatttggatttcaggtttttggatcagggatgttcaacctgtagtagttacttgtttaatttccttcctcccccactaaactacagatcaaagaagatagagatcaaacctatttcctttatttaytgatgtgtctctagtgtctagcctaatgtttggaacatcaataaatattcatgaaagaaatggataaataactgtatgcttgcaccagaagatatcccacagcagtcttttctaatccttggtaatttgaattttttgtattattgatttatatacaagggctaatgtcctgcgaagtagtagtacatatgtttctgtttttaaaagacattgtttcataaaattctattataatgaaaagcatgggctattacatttttccttcatggagatatttcttatatatcgtaaatctagaaa

SEQ ID NO: 96497 - DNA, 601 bp, Human
cgttgtcgcgtctagcccgcacatgtgccatttttcgtaccttttgtgggtttgcttgtatgatggaatctgggtgtgggtggaaaagatatatcacagctaacgggggctgagaggatctttcttcccttggggatgctgaataaactctatgtggtgtgcctgcattttcactgtgacttgtcacatgaggtcagaagtggagttttccatttgtgatgtcatgtcagcattcaaacagttttggaatttggaacatttggatttcaggtttttggatcagggatgttcaacctgtagyagttacttgtttaatttccttcctcccccactaaactacagatcaaagaagatagagatcaaacctatttcctttatttattgatgtgtctctagtgtctagcctaatgtttggaacatcaataaatattcatgaaagaaatggataaataactgtatgcttgcaccagaagatatcccacagcagtcttttctaatccttggtaatttgaattttttgtattattgatttatatacaagggctaatgtcctgcgaagtagtagtacatatgtttctgtttttaaaagacattgtttcat

SEQ ID NO: 96498 - DNA, 601 bp, Human
cctgtaatccaggtgctttgggaggccgaggtaggagtattgcttgaagccaggagtttgagatcagcctgggcaatgtagcatgactcttatctctacaatatgttttaaaaattaaaaataaaaataaaaaaacagttaaaggagtttgagaacagcctggccaacatggcgaaaccctgtctctactaaaaatacaaaaattagcagggcatggtggtgggcacctgtaatcccagctactcaggaggctgaggcaggagaatcgcttgaacccgggaggtggaggttgcagtgagcygagatcgcaccactgcactgcagcttgggtgacagagcgagactccatttcaaaaaaaaaaaaaattaggtgggcatagtggtgcacagctataatcctggctactcagtaggctgaaggaggaggattgcttgagctcaggagtttgaggctgcagtgagctatgatcatgccactccactccagcctgggtgacagagcaagactctgtctctaaaataaataaaataaaataaaataaaatatagtaaagtaaagtaacacaagaataacagggataaactgggacagccggagaca

SEQ ID NO: 96499 - DNA, 601 bp, Human
gagttccaaagttctttctccagcttcctggctggagaagggcagttgctaacagcagcttcaaaagtggtagcgtctagatttcaacctcctggttcctagttcctatttacaaagtatgttcttgaaatcattgcttcagtggtaccccggagatggtagtttcttattggatcagttctatatagttttagaaatctgtcctcgaagccaagtctaaaacctgctactttagcctttccaaaactttgatatgtgtctaacgtacctagagtagtttctcttttctgcagtgaactcygttatattgaccttcagggccacctcctctatttgtttctactacttgcaatatcttcctttagtcattaaaaaaatctacaaacaatacaactttatggttttcttaacatggttctttgtcacagcagagatttcccatcacagaaggataggaattgaggaaggcaagtggatttgtacctatggagagatgtcttgttttatttattttatttctaaagaacatactttacaagacactttaggttgtaacagtgcattaaaatacctaaacagtataccagcatcctttaggaac

SEQ ID NO: 96500 - DNA, 601 bp, Human
aagggcattgacatcaaagctccatataggcacaggtgactcccacctaaaatataccctatcaagcattcctaaactatatgggtgccagttctaaaggacacaatttcctgagaaaaagtgggtagagtaacactgcttcagatatttttaaaaagaagccgtggacccagtggagaactaatgttgatattcatttggctctgcacataaactttaaaaaagaatggcatgccttttaattctggtgttgaaagagaaaacgagtcttaaagacaggctgagttttctttttttaatrctgcatctaaaatccatagaaaatactgtgctgcaatattatttctgatattgctatacagcctcagtgctcataattgggtagcatttcctgcatgagacatctttcagatcagtgccaacagtaatcttgaaagaccttaacatgcaaaccctagattgtacatttaagtcacagagacaaccacatatgaaaagtctacaatgttgaaggtacttttggttttttatattatattttatgtgcaggaatcagtctgtttgaagaaaactacccttatctgagaaagaccagatgggt

SEQ ID NO: 96501 - DNA, 601 bp, Human
tttgtttgatggaacttaaattatcactgactacttacttttcttccttatacctcttggccaacatgtgatgtaataatgcatgtggaatgatagcatatacttttcttgaattaaattatgagataggattatacaatttcaattaaatttcttttctctcaaagacatcttaattactttatataatgccttttaaatcaatcagttctattttaattaagaaaaccaaggtagaaaaattaaacaattttccaggttcataaagtgtgattgcagaactaaaagaataaaattgtaygattgcaagagaactggaagagactgtccatatttctggtcaaactcttcatttcagtgaaggagaaaattgaagtctgaagcagttaagtgacttgatcaagattatatgctaagacagttagtgacagaatagaacagaagggaaactgggttgcccagctgctggcccatgtctttctactctaccatactcacatatttcgagtttgaaatttttgtattcatataagttagctggaggcagtaagcatagccctataaagcaactcttgaacacttgaagaaacatgttatcaag

SEQ ID NO: 96502 - DNA, 601 bp, Human
ttcttatgtaaaacaattgacttgaccacttctcaagttattaatattctaaaattaaaaatgcaaggattgtggatatggaattttagaatgaaaaacactttctttgactaattaccatcttaatattggataacgtcatcagtaactgtgtgtgtatgcatgtgtgtgtacatttaagtaaataattttctctttttctcccacttaaagcagttaatgttttcgttttgtttgatggaacttaaattatcactgactacttacttttcttccttatacctcttggccaacatgtgatgtaataatgcatgtggaatgatagcatatacttttcttgaattaaattatgagataggattatacaatttcaattaaatttcttttctctcaaagacatcttaattactttatataatgccttttaaatcaatcagttctattttaattaagaaaaccaaggtagaaaaattaaacaattttccaggttcataaagtgtgattgcagaactaaaagaataaaattgtacgattgcaagagaactggaagagactgtccatatttctggtcaaactcttcatttcagtgaaggagaaaatt

SEQ ID NO: 96503 - DNA, 601 bp, Human
caagattttagctgtttaatagcatgtaatgtgtaatggttaaacgaattccttggggtgtctggaattcacagcttggtccctttgagagtgaaaagaggctgtcaagcaggacatattgaaaagtaggtggagagaggtagggctcagacatggaaaagcagcaaatggtagaaaagacactgattaaataaatatttattgactgcccctaagtctctaggatacattggggagtagggagagaggaagggaagagagaatataacgatgactaatgtttggcctctgtctgcctggyagaggaaacaaaatatccttgtggcagagaggtctagaggaggatatagtgaagggcaggctgcctatgttaagacctcaagctgcggctttgtttatgtaaggaagtgctaaaattccagttctaggttaaatggtgctgactcattattagtgggtcaatgaacccctttaggtcccctaagagagagcaaaataactgagacctagggaattcagttcttttttttttttttttttggtgagacagagtcttgatctatcacccaggctggagtgcaatggcacgatcttggctcac

SEQ ID NO: 96504 - DNA, 601 bp, Human
tatagcatcatttatgattgataaaacaaaacagaaacaacttaaatattcaatatgagggaattgcttgagaaatgcaaaaccccaacctactgattgttttcaaatgtaatgaaacttgtatatgctttaaatttagaaattaatgaaatttatatatgaatttaattaaatagctcttaatttaaaagggaattattacatatataatggtgcattcatacagtaaaatcctttgcaaggttcaatatgatgacatagccaaatatttatggatatggaaaaggtcatcatcccagtwactaaatgagaaaacaggttacaaaacaaatacattttttgaatttttctaaaacatttgtgtatgtgtatgtatttgtatgcacatgcttgactaggaaaaaattttgtaatgacaaccaggttatccctcagaggtagatttacaggtgatttatttcttaatctttctacttttccaaattgtcaagattttctttctataattgcagtataaacaatatgtccaggaaaaatgaaggcatttccatcaaataagataaattaaattgttccagactctaagggtattatttcccaa

SEQ ID NO: 96505 - DNA, 601 bp, Human
aaggtgattaccttaaaagagtgaatcctatcttttaaccttttgaaatattaacaataaaataacacacgcctgatatttgttttaaaacaatctgggaagagctatagaataaataagatctgacgtgatttgataattgttgatgtcttgatgagtacgagttttattatagcattctgtctacttttgtatatgttcaatatttttcatcatgaaaagcttttttttatatagccaaaagagatggacgatttcttaaagggtattattaacacaaatgtgtttgacatttacagtrtaatggcttagattatttataattgacccttgggtgagaagagtaaaaaagatttctattcaacttaatttcaaacaaaattaattttaaaatagtcactggattactatgtgcttaacatgtgcaaggcacgaggcttaaaaatgtcctaccctatgtacatcgttctgcttctgaactgctggaaagtcgcctccaataggtgcctgccggcttaattcatcatctttcagctgtagccacaccagaagttcctgcagagaaaggtgcagacgcttccactggtcagaactggcttcc

SEQ ID NO: 96506 - DNA, 601 bp, Human
aaacaaaaagtaataaaaagaccaactaaccaaagtaaggtgtgggtctgatttcaatttttatttaaaccaaaaccagaaaaagtttaaaaaatgcataatatgtatgagaaaaatggaaatttgaatatggactggatatttgatatgatgaaattattgatatttcaaaagcattatagtagcaaggtgattaccttaaaagagtgaatcctatcttttaaccttttgaaatattaacaataaaataacacacgcctgatatttgttttaaaacaatctgggaagagctatagaatamataagatctgacgtgatttgataattgttgatgtcttgatgagtacgagttttattatagcattctgtctacttttgtatatgttcaatatttttcatcatgaaaagcttttttttatatagccaaaagagatggacgatttcttaaagggtattattaacacaaatgtgtttgacatttacagtgtaatggcttagattatttataattgacccttgggtgagaagagtaaaaaagatttctattcaacttaatttcaaacaaaattaattttaaaatagtcactggattactatgtgc

SEQ ID NO: 96507 - DNA, 601 bp, Human
atacacagctcatcttgctatttctacaacactcaaaacctgttcttaccattgggcttttgaatttggtgcttcttctgcctagaatcctcttcattcaaggtttttgcatggtttactcactcacacaggttttgtttgtttgtttttttgagacagggtctcactctgccacccaggctagagtgcagtggcacaatcttggttcacttcaacctccgcctcccaagttcaagcgattctggtacctcagcctcctgggtagctgggactacaggcacgtgtcaccacgcccagctartttttggtagaaacgtagtttcactatgttggccaggctggtttcgaactcttgacgtccagggatctgcctgtttcagccacccaaagtgctgggattacaggcatgagccactgcacccggcctcacacaagtctttaccccaaaataacctcctcacataggccagtactcctcaatctttctctattcatgctttgtttattttctcttcatagcacttactacccaacataatttcatatattaatttatgggtttactatgtatttctgtcactaaaatctaaacatccatagg

SEQ ID NO: 96508 - DNA, 601 bp, Human
cagttagaacactagagtgtgttatatgaaggccaagttgatttagatgcaaaacaggcttgcaggggaaagcctggactcatgaatcataagtgaaaaaattaatgctgtaaattgggaaaaatggacagatcttattctaggtctactcatgttccagatccaaagctgagtgtcactgctgagttactgggtggaatttcctcaagaagtggtcccattagcattgccttcttcaacctagtgatttcttaaaggagattttcatgtccaaacactcagaagttccatggtttgaackgctgcttggggctttttctgtagtctgcaggattaggtaggagatgagaggacactagacaggctctgaaatgtaggatgatccaacagttctgttcattcaacaaatggataccgagcaggcatagaacaagatgttaacagtcatatctgtaacttgatctgtatttactagttttgccatcctacgtcatcattcttgttcctgtgttatttctaccttattttttatgtctcctgtattgtttctatgtctgacaagaaagttgctgaatatattctgtcaccaaaaggaccttct

SEQ ID NO: 96509 - DNA, 601 bp, Human
ttccagtacacagcaaggttaacccttactttaaatgttagacatggggtcataaaacattggggtagaagggattttacaagtattagagtcaaatttttaatcttttctttttaaaaattttacctactattttaatgaagagctatgcaattcaacattagaccataggcttcatgaaggcaatgatcaagtctgtttcttttataactacctgtccagcacattatataatgactcataaacagttgttgagtgaataaatgaaggtacctaatgagattcctcatatgttgctggmcctgggctagcagcccaaagatgtacagcatgatccttgctcttagcaacttcactttctctgggagaaaaaaaaatgcataagcaagttgctacaatatatgtgaaatttaagtgtgacaatttagcatgcttggtgatctatgagagtaccaactgtaagcagtttcttctgcttggtgggagttggggggttgtagacactcaggaaagacaacaaagataggtaacattttggctggtccttgagggctgaagggagaattcgccaagtagacaacgtagggggatccagacagag

SEQ ID NO: 96510 - DNA, 601 bp, Human
agccacatttgctaatacaattacagaatgctaaatctcacagaaacacatattacttagtttcttgaataacaagttatttaacacataagatcagaatggagggggggtactatgatagagtgtctaggggtaaggaaaatgaactgatatggatatataaaatgttcttctagctagctgcctagttatcagtgctgtaatccactttgggaggccaaggtgagtggatcacctgaggtcagaagttcgagactagcctggccaacatggtgaaaccccatctctactaaaaaatacaaaaaaaaaaaaatagctgggcatggtggtgggcgcctgtagtcccagctatttgggaggctgaggcggagaactgcttgagcccaggaggtggaggttgcagtgagccgagatagcaccactgcactccagcctgggtgacagagcgagactgtcgcaaaaaaaaaataaaataaaataaaataaaataaaataaaataaaataaaaaaagagaaaccatggtttattagaaaagttccctacagcatgaatcctctgagggcttaaattgctgagtggaaaaatgggaagagtggtttc

SEQ ID NO: 96511 - DNA, 601 bp, Human
aactccaatacaggcttctcctgagagcagaccctctataaatcacaggcacctagacccctgttctcagggtctgcgttcatggaacctgacttaaaatgccatttaactcattagttaagtgactatgcacaaaagcttgaaataatacatgttcaaaattaagagctgctagtcatggaactttggatcacaataatcagatgaacctgcaaaagataaatttgaaatagcaagggtctgctctttttgtctgtgtacataaaagacagaagttgatggaaaaagataaagcctgcamaaactgggcaatcctttatactgtgattctcaacttacgctttcatgtccataggtgaatgtgctgaaagattccttacttcagaatttgaagaaaaagcatcttcatattaaaacatgatgaatccattatggaaaataccataaaattgatgtgagatttaaaaaataaaacaagaacatcaaagaaatttcatgctcatggaaaaaggagataggtaagtggaagcgggagatgtcaggctatgtcttctatgctgttaagataactgaagtaaataagtttaagaatcactgctct

SEQ ID NO: 96512 - DNA, 601 bp, Human
cccgtgcaatatgctgtacctggtttgctttatatggagcacatttatttagttttggttctagggggaaggcactcactactgaaacaaaatggatttttactgatttgatttttcattcaatatattattaacttagaaatactaaggcagaaatgaaccaaagattaatacaaatttttaagagcagtgataaaaataatacacagaagagggctaaaaaggattgcaaaaacgtcctttaatatccaattttactttcagattattgtagttcctaaatgtaattaatgtttttagyctttctaaaatggtcttatttcttgcaaacaaaataaaaaagcaggatgttcaactacttaaagtcaaacgaaaggaacagaaaacgaattttcttcattaaaatctatgcaacatcataatggttcatcttcttttcatcatattctgaggctgaaaagaaagtcttatgtattcatttctgagcaatgtgggccctctggacacattattagttgttatttttacttctgtgaatacatgaggttgtgaaaagtctagcttcttgagtcaagagtttattcagtttgtcatttttctc

SEQ ID NO: 96513 - DNA, 601 bp, Human
acacaattaaaacaaataaaaagatagttcatgagtgtttcacagaggctaaatacaaaatatacacaattaacacaaaaaggcttttaatgagcacaaataagtcatttaagcaggtcatgctttaggttgctaaggaaacagaaaaaataccaatattttctgtctgaaaaattttaattatatgtgacaaaatgaagcaaaatggcagttaatgaaacctattaacttccttaaaagtaagtaataatccataaaccattaaaatatcaaccatgaggatgtttatcttcaaattcaraagttacttcagacagatgaagttttactttttttttgagatagagttttgctcttgtcgccccggctggagtgcaatggtgcgatctgggctcactgcaacctccgcctcgtgggttcaagcgattctcctgcttcaacctcccaagtagctgggattacaggcgcacaccaccaccatgcctggctaatttttctatttttactagagactgggtttcaccttgttggccaggctggtcttgaactcctgacatcagatgatccacccgcctcggcctcccaaagtgctgggattaca

SEQ ID NO: 96514 - DNA, 601 bp, Human
cctcccaaagtgctgggattacaggcctgagccaccgtgccgggcctgcaggagacttcttaagtgaattttcattactaacactatggggctatttcatagctctccaacaaaactgggattgtcaccctttctcgaaagttgagtccctcatttctgccaaattctgagggactgtgtggagctaagacaaaggggatactttgcagactgagcgaatacaaccctctgcctttagtatcacttatgcttctggtagagacattctcgacaataaattatgccattgaaacgtactttaaaaaaaaaaaagggatgtgattgcatttttttccagcaacagtttttattgtgatagcctgaaggcaaaatattatgcagtttcttttcgttgtctccttccgttcagttttcagggcaattcttgtaaactttcatatttgggcatgatcacttttgacgagtaaactgaataacaatataaataatgaaacagactcagaactaatggcctagatttagcataatcagaaacacttaagaaaggttaaagtcaaaaaaaagatcttgggaaaacaatattaagtttgtaggcatgaag

SEQ ID NO: 96515 - DNA, 601 bp, Human
gctcagagacttccatcattatctgtaatttttgacttttcattctggttggttccctgactgctctgatgcccagaatgtaggtacagcttttctttcagatacctactgccttcagccaggtttaagagaagcagagtctgagtgctcttaagaaaaagggagtgagagaagcaggaagacagggcaagaaagttaagttgggatgtggtatgggctggagaccagcatcaatctggccccatgggaattcccagatcacaaattgtacaacagcaggtgccatgatgaggcaaagggrttttccctttgtacccctggtggttttaagagagaaggtgtggtgggacatgccagtcaaggtggcttccttttggctgagggaggttctctggaaaggggtgaaaccatgaggctttagcagctaatactcagagtcactgaggaatgggtgcaccaacccagtgaacgaatctgactggggcaccaacagcatccattacttagattaacttcatctgctttcccaatagcctttacccttgaacttcagttgtcaagcacttatattttgtttttttttttttttcaggagactttt

SEQ ID NO: 96516 - DNA, 601 bp, Human
ctgtatagagcataacactgttgtgtagttcttagataatacaaaacattgtgataatcactctgttgaacttaaagttttaaaaagtggtcattaaaaacattacgttaagcaatcagggggtttcttttggacgataacgaaaatgttctggtattaaacaatggtgatggtggcacaatcttgtgaatatactaaacaccactgaattgtacactttgaaagagtgaattttaaagtatgtgaattatatattaataaaaacaaacaaaagagagccccttctgaccatacacatgcaaaaaaaaaatcatatgtgatgtattcatctgtattcaacttcgtgttagtggaatgtcactggaatcagtgtgaaattcagaaagttttataggggtggatagtaaatattgttccatttccttatgaataaatacatggattaaaagtatcagaataagggcccatggagaaaggtggtttaaatccatatatatgaatacttatctctaaaaggaaatgatccatattaattttgttttgcataatagaaaggttagaaaacagatttcttaaatgtcaatgggggaaacttggacaa

SEQ ID NO: 96517 - DNA, 601 bp, Human
ataaaaggaagatttaaaagttaatatacctaagaatcatttcaaaaaagaagatacatgtaaaaaagtgaagtattttacacctgtattgtccaaaatagttttaaagtattgctttttttttttttttttggaaatggtgtcttgctctgttgcccaggctggagtgcagtggcatgatctcagcttactgcaacatccgcctcccgggttcaagcgattctcctgcctcagcttcccaagtagctgatctacaagcgtgcgccaccacacccagctaatttttgtatttttagtagtgatggggtttcactatgtgttggccaggccggtcttgaactcctgatctcaagtgatccacccgcctcaccctcccaaagtactgggattacaggcgtgagccaccacacccagccattattgctttgttaagtccaaacgtaataggattttgagaagaggagacaaaaagagcatgggaatagcagttcgaaaaacctgactcagatcttgactgatacaagttatgtgactgtgactgtggtacttcatgtttctaagcctcggtttccttacacgtaaaagggaataatgataatag

SEQ ID NO: 96518 - DNA, 601 bp, Human
ctgccaccatgcccggctaatttttttgtatttttagtagagatagggtttcaccatgttggccaggctggtctcgaactcctaacctcaggtgatccacccacctcgacctcccaaagtgctgggatcacaggcgtgagccacgacacccggtcatttttttcttggagttttggcaaaactatttaagtgttggttaaccttatgaagccacaaatttagatgtaagtactacgtcttcagaaattatagtttttttcccctaatttttctcctctggtataactttctgcttattttyatagttttcagtaacattttaacttagttttatgcattcatctattcaagacatttatagaatgcttactatatgaaagacactgccaaatgtcagtagatgtggtattcagggcctctgtccttatggagctcacattcagataggggaaacagactttcattaaacaagccaccaaacacatagctatagattttcgtaagtgctgtgaagaaagcaaacaggatgctctctgtgataatgatgggaaatcttccctagatgtgacttaattatacattaactctgcagtccattact

SEQ ID NO: 96519 - DNA, 601 bp, Human
tagttcagtcgatatttatggatggaaacagaggtgaatatttagaaagactaaatcaaactgagataataaagaaatataagctataattcagaggaatggaatgccaaaagtaaggggagtggaatctgaagttcatgactatgctctcatatttttttcctgccagctgttggtagaaattattattatgatgatgatgattatgattattattattttgagacggagtttcgctcttgttgccccggctggagtgcaatggcgtgatcttggctcacagcaacctccgcctcctggrttcaagccattctcctgcctcagcctcccgagtagctgagattacaggcatgtgccaccacgcccagctaattttgtatttttagtagagatggggtttctccatgttggtcaggctggtctcgaactccggacctcaggtgatccacccgcctcggcctcccaaagtgctgggattacaggcgtgagccactgcgcctggccagaaattattatatgaaactagaagcctgttcaattttaacaaaaggatgcagatatgatgcaactgttgaacataagacaaattaaaatattttct

SEQ ID NO: 96520 - DNA, 601 bp, Human
aatccacctacacttgattttctctgttacaaaaagatagtatattaaaaggtagttcagtcgatatttatggatggaaacagaggtgaatatttagaaagactaaatcaaactgagataataaagaaatataagctataattcagaggaatggaatgccaaaagtaaggggagtggaatctgaagttcatgactatgctctcatatttttttcctgccagctgttggtagaaattattattatgatgatgatgattatgattattattattttgagacggagtttcgctcttgttgcccmggctggagtgcaatggcgtgatcttggctcacagcaacctccgcctcctgggttcaagccattctcctgcctcagcctcccgagtagctgagattacaggcatgtgccaccacgcccagctaattttgtatttttagtagagatggggtttctccatgttggtcaggctggtctcgaactccggacctcaggtgatccacccgcctcggcctcccaaagtgctgggattacaggcgtgagccactgcgcctggccagaaattattatatgaaactagaagcctgttcaattttaacaaaa

SEQ ID NO: 96521 - DNA, 601 bp, Human
gagccaccgcgcctggacaagtcaaggtctttttatatttcctcagtgtcacttacaataatccacctacacttgattttctctgttacaaaaagatagtatattaaaaggtagttcagtcgatatttatggatggaaacagaggtgaatatttagaaagactaaatcaaactgagataataaagaaatataagctataattcagaggaatggaatgccaaaagtaaggggagtggaatctgaagttcatgactatgctctcatatttttttcctgccagctgttggtagaaattattatkatgatgatgatgattatgattattattattttgagacggagtttcgctcttgttgccccggctggagtgcaatggcgtgatcttggctcacagcaacctccgcctcctgggttcaagccattctcctgcctcagcctcccgagtagctgagattacaggcatgtgccaccacgcccagctaattttgtatttttagtagagatggggtttctccatgttggtcaggctggtctcgaactccggacctcaggtgatccacccgcctcggcctcccaaagtgctgggattacaggcgtgagc

SEQ ID NO: 96522 - DNA, 601 bp, Human
tgtacaggagcagcccagatttggtgtgttcctctacacaaggaacaattgcctggagacatgattcacagggaggagggagtgccttcctagaagagctatcataaaaaggtaagtgggaaatggattcagatggctgggaagagggagatggggcagttgctgtctaattagtgtggtcaaattttaagaaggttttttttttttttaagttgagatttgaataagacttgaaggaaatgacagagttagtcacaaagatttctggagaaagaatgttccaggtagaataaagaactasgcatagtgcccggagaaggatgcctgtttagttctctagacgagaaaaacctttctcagaaggtcccttagctgaatgccctttgtattttattacctaaaattgcgtaatatgaccatgtccaattccgaagagggcaatcaagactgcgagagcaccatgaaatagctcaggactatcattatgtattcccttgggttggggcttcccttgatgcacatgatatgcagaggagggtagatcctcaacaagcctggtggctgccagcaaaggagaagggtgtatatggacacatttggg

SEQ ID NO: 96523 - DNA, 601 bp, Human
tttccccagagtgagcattccagaagaccaagacagaagctacaagactccttcttatttagctttgaacttcttgcagaatcaattctacctccttcagtttgttgtacaggagcagcccagatttggtgtgttcctctacacaaggaacaattgcctggagacatgattcacagggaggagggagtgccttcctagaagagctatcataaaaaggtaagtgggaaatggattcagatggctgggaagagggagatggggcagttgctgtctaattagtgtggtcaaattttaagaaggttttttttttttttaagttgagatttgaataagacttgaaggaaatgacagagttagtcacaaagatttctggagaaagaatgttccaggtagaataaagaactacgcatagtgcccggagaaggatgcctgtttagttctctagacgagaaaaacctttctcagaaggtcccttagctgaatgccctttgtattttattacctaaaattgcgtaatatgaccatgtccaattccgaagagggcaatcaagactgcgagagcaccatgaaatagctcaggactatcattatgtattccctt

SEQ ID NO: 96524 - DNA, 601 bp, Human
aaacatctgttagttgcatggtcttcaaaaaaacaaaaacaaccaaaagttgctggcaaaccagtccctgcttcaatcagagaagacggtaaagtatctgtaaacagtcacactgctgtgtgtgactgttagaaacatatagaaaagagaaccccagggcacagtgccagagaccttatgcacaaatggtaaatgccccctctgctggcagaggctctaaaacattttctgctcttttcccggcagtgaacccagaagaaaaaacaaaatcttcacaactaaggaagcagtaggaaaatgycgtcattacactcactgtatgttgaaatgtactaaaattatcaatattctgttgcactttggaaacttccgttttttgcttatccacaccattttcccccatgtgcaattcccatttgccccagggaagggaaatgtctctatggttctagattttaatcgagttacatgatctctgcatagactgtgattggacaaggttgaggggagactggatactgtgtcctaaccatagtttaatgattatggaatgaagggctcagctacatagactagtctttggaaatcaggtttttggttt

SEQ ID NO: 96525 - DNA, 601 bp, Human
aagctggtctcgaactcctggcctcaggtgatctgcctgccttggcctctcaaagtgctgggattataggcatgggccaccgcacctggccagattgcaggtatctttaacaggttggagtgttacctgaattttcatcaatcttgggaaacatatagctgctaacagttttaacttcctactctatgtttaactcgtttaacatattaaaacacgcagacaatattaaactgcagcaacacatggagaagaaaagcatcgtggaaatggggtaagatgggactctagaagtgtttaaaayctcccatgctgaaattttaagtaaatgttgacgggcaatggttaaattgtaaaataaatgaatttgttgtcactgaaatttagaatactcctacctcttcttatgttttgcccttttaagatacaaattaaaatttttaaaaaatagaagagctcagaaataaagtgatggggataatatgcatacctatactaccacacttttcctttcaccagttactttggaaagtatcctatggagttttgattttagtagaattcatgtgaggcaaaagatggcttattatttctattgtgtaaa

SEQ ID NO: 96526 - DNA, 601 bp, Human
catttatttattgtgtcattaccaacttaacccagttttatttatcttctttttgactgcctgttggcaaaaaaatatcaaaacttaagaaaaatgggtgttttctagaaagttgggtaaaaatacactattgttttgttgcttaatttctttatgctgccttgctctgtgaacaaagtagaaaataatacatttattttggaaaataagctcaataaagacaggagttaggaaccgtcccttgactaactactgagggaaagccctttctatagaatagaatttacatcctgtgagttgstcatgtttttagtaagatggattaaattgcatgtatatgtccagagtcaattaatgggaaacatagaaccagaatccaagtcaattttgtccattacttctttctcaagagtaaacaccctcagctggatgacaaataatgattgccaggcaaggtttatgttattacctctacaagtaggaagttgatgcaaagcaaaactctcacctgacatctgttttttttaatcacccttatagcaagttagttttaaagaagtgagaaagacatgcgtgaacaggcaattttgctcccagatca

SEQ ID NO: 96527 - DNA, 601 bp, Human
ctgacctcgggtgatctgcccacctcagcctcccaaagtgccaggattatagacgtgagtcaccgtgtccggcccttaaaccatttttaaagcggcatgcatctttaacctttaatgtaaagaacatgatcatagaaaagtatttaaattttgaccttattcatgcaatgcaatgctttaaactgtagatgtcaactttgcactctatgaccacaaaatatgcacatatcacccttttattatagaactcggtaccactaggtatgatataaatggttactgagaaacagagtttgctgcmtcgtgcttctagtgagaaatagttgcacagtatttaaggagttgttcattatgtaatgggaactttgtgcttagaacagctccacagggagaagcaatagagctagatgtaaaaatgttctccatttcacaatgtagaagtttaatttttgcagtatacttttccttatactatcataattttacatgttgggtaagaatttccatgaattctatgtacaatttggcctcctgtcatctttgttttgccctctccctttctcttatagttggaatgaaacagaggaaggagtagacagta

SEQ ID NO: 96528 - DNA, 601 bp, Human
agattgtacccatacattcaatacagagttgctgaatatctaagtgcaatgtactgtgttagaagccataggaaatatcaatgttttttcaacatggatcctaattttaagatatgtatagtatacttggggataatgaaaatacgagtaggcagaaaagataactattgagtactgggcttaatatctgggtgataaaataatgtgtacaacaaacctccatgacatgtgtttacctatgtaacaaaccttcacatgtaccgtcaaacctaaaataaaagctaaaaaaagaaaatacaastagaaaagtaatattattaatatgagaattaattattttcatatggaggaatcagggaaggctccatgatacagcatggtcttgacattaagagtttgtggaattggtgttccaggtagagaaaataataataatgacaataataataataacagtaaagacagtgatagataacattattgtttctgatacccaataatctttgagttatgtcattttcattctccaaaagcctcacgaagttggtttttaattccattttacagatgaggaaactgaggcacaggaaggactcaaggt

SEQ ID NO: 96529 - DNA, 601 bp, Human
gaatagtgaacaatcagcaataatagatgtaaatcaatttccatttatggatgtaagtgccctttggaaatactttttgaaaagttaagagaccacagtggtaaaccatatactaaaagcaatctatgacaattttctaaggcctctgaaattctatacaggttctcaaaagtactattcagaagtgaaagttccaataatagatgctttcaacgatattaaagcaaaaacacaagaggggaacaatgacagatataaaggttttatacctagaaaagacttaatagctagacgttgtcamaaattactacactaacaaacagtgcatgaatttcagcttttcaacttaacaaaagatgggcaatatagtcaaaccatcatttacatgagctcttgaggcttgaacatattaataccaaattagaaactaagagcagattgtacccatacattcaatacagagttgctgaatatctaagtgcaatgtactgtgttagaagccataggaaatatcaatgttttttcaacatggatcctaattttaagatatgtatagtatacttggggataatgaaaatacgagtaggcagaaaagataact

SEQ ID NO: 96530 - DNA, 601 bp, Human
ttttgtccctttaatagaatgataatttccagcaaaatcaaaagtagtagaaataaacagttcaaaaatcccaacttttaaagaattaccttcatatgacatttgccaaacccctgacaaccatctataattgacaaaaaaaagcgagcataagttgactcaaattaataagaaagagctacaaaatatttagaaagtaggaaaaaatctaatatttaaaaaaattctgcctaaatcacctgtttagccgaagttcagaatagtgaacaatcagcaataatagatgtaaatcaatttccayttatggatgtaagtgccctttggaaatactttttgaaaagttaagagaccacagtggtaaaccatatactaaaagcaatctatgacaattttctaaggcctctgaaattctatacaggttctcaaaagtactattcagaagtgaaagttccaataatagatgctttcaacgatattaaagcaaaaacacaagaggggaacaatgacagatataaaggttttatacctagaaaagacttaatagctagacgttgtcaaaaattactacactaacaaacagtgcatgaatttcagcttttca

SEQ ID NO: 96531 - DNA, 601 bp, Human
gaaacagagcaggatccttggcaaaataccaatgaaatacagttttcaatagtaaggaaaatggagagtgtgaaataatgtcaattagagagaaatgcatgctgctgaagactctcggcactattcctggaagaataaccaccatgcttagaaatccggagagttctgggaaacaatggccacagaaacaagacttattgatttaaattaagatttcagttgtgcttaagaaacatgtaatgactacaattatatcatctgacaagaaaaataatatgtataggcaagagtgatatttaamatgttgtacttaaccattcgtatcagatggatacagaacaatcaggcacaggcaatgaaaaattagaacagaattaaaaggtttaaaatggaaagacatggatgtattggaacatactggctgaatatcagtgcctgagggcaatggttgataaatctgtaagaaatttttcaatgcatatttctgagcacccttttgtccctttaatagaatgataatttccagcaaaatcaaaagtagtagaaataaacagttcaaaaatcccaacttttaaagaattaccttcatatgacatttgcc

SEQ ID NO: 96532 - DNA, 601 bp, Human
tgcatgaacaaagtaacgggtaaacacataaaaaagaacaattgaccttgcgtaagggagagcaaatgtaacttgacttatgtgctaagaataatgcaaagaaaaagaactgagcacttactatgtgcaacacatatagtatgtactgtgttatgtacatgaggattatacgcttcatctcatttaatcctcactacaaccctatgaaaaaagcactactgtattattttcattctactgatgaggaaactgaggcatagtacataacttgattgaggttggcaaagcagacagaatctgrcagaattgcaatttaaatctagagcctctgaactaagccactaaaatggactggctcagagttgaataagaataggaatttccaggtttataagggctttccaggcatagaaagagtattttcaaaggcatgaagctgagaaagacatagcgagagggccagaggccgaagagtaaataaggttgcaagggggtagggtggggagcagggaggaaaaaattctttttgaaaaaatgtgttgtagatatgaagtctcactatgtttcccaggctggtcttgaactcctgggctcaagcaat

SEQ ID NO: 96533 - DNA, 601 bp, Human
aagcactacaaaagggagttgttagtaagtggtgaagttccaattcacaccccacacgttgactcccagactctgaaaattttcagactctaagcttaaaaatatagaaataagcaaatgaataaactagcgttcttatcagcccagaaaggagccttcactttatgcatgttaaacactgttactgttagctaaattgctctttacaacaaggcttacaagatgatgatactatcaacattttgtatatgaggaaactgaagtcttaagataaatctagctagctatggcagagccagamcctgagctctgtttatttttattctaaagctatgtcaatatttgctaatacttggtattggtaatattacaatggctttctttttatgacacatgatatccatctcaaaaatattagattataacatttgtatgcaacttaagaaagatgaagttatttggaaaagggattgagatatgaagattgtgatataagaattgttaggtgactacagctctgatggaaaggtttatgcgcaccagaatctcagctgtagctctgttctctttggagaaacaacttgtaaaaatatgatccttg

SEQ ID NO: 96534 - DNA, 601 bp, Human
catcatatcaacaactagaaattattgaataccaactatacaccaggtgctccactttgcattttgcaagcattgtctcatctaatcctcagacaactctttgagcgagtgctattattactcctattgaacagataaataaatggaagcactacaaaagggagttgttagtaagtggtgaagttccaattcacaccccacacgttgactcccagactctgaaaattttcagactctaagcttaaaaatatagaaataagcaaatgaataaactagcgttcttatcagcccagaaaggagycttcactttatgcatgttaaacactgttactgttagctaaattgctctttacaacaaggcttacaagatgatgatactatcaacattttgtatatgaggaaactgaagtcttaagataaatctagctagctatggcagagccagaccctgagctctgtttatttttattctaaagctatgtcaatatttgctaatacttggtattggtaatattacaatggctttctttttatgacacatgatatccatctcaaaaatattagattataacatttgtatgcaacttaagaaagatgaagt

SEQ ID NO: 96535 - DNA, 601 bp, Human
ttttgaaattttaatatggaaagcaggtcattcttttaaaaaactgaactgcatctaaaatcaattagatctcatgatctacatgttcacctcatcttagggcacagtatagtaaatgatcttaacttgtttaaaatattttttcttggctgggcatggtggctcatgcctgtcatcccagcactttgggaggccgaggcaggtggatcacaagatcaggagttcgagaccagcctggccaaatatggtgaaacccggtctccactaaaaatacaaaaattagccgggcatggtggcggaygcctgtagtcccagctactctggaggctgaggcaggggaattgcttaaacccaggagacagaggttgcagtgagccgagattgcgccactgcactctggcctgggcgacagagtgagactccatctcaaaaaaaaaaaaaaacaaaaaaaaaaaacaaacccaactttttcttaaaatcaaatattccataggatggtgtgatgagcattcacatatcaagagaatacatcatcatcgtcatcatcatatcaacaactagaaattattgaataccaactatacaccaggtgctccacttt

SEQ ID NO: 96536 - DNA, 601 bp, Human
cagcactttaggaggccaaggtgggcggatcacctgaggtcaggagtttgagaccagcctgaccaacatggcaaaatcccgtctctactaaaaatacaaaaattagccaggcatggtggcaggcacttgtaatcccagctgcttgggaggctgaggcaggagaattgcttgaacccgtgaggtggaggttgcagtgagccaagatcacgccactgcactccagcctgggtgacagagtgagactccgtctcaaaaaacaaaacaaaacaaaaccaaaaaacatttgagaccattggaagakctgaatctcagcatcctattaggaaaagttaaacttacagaaaatttgcaaaagtagtatagaaagttcccatatacaatttgtccaacttccaacttcttttactaggaaattagtttgcctgcccaagaaatgtctgcaaggggttttatgactatttcattttgatcctctacatattgaaacttgagatgctccagctgacttattcattatcttgggggagtgtagattatttgtgcaacaggcatattcttattttaagccattttatccaacgtcatcaaatgatttaacaag

SEQ ID NO: 96537 - DNA, 601 bp, Human
aatctacagccatgctttctgtcattttttaaaaggcacattgacctcaaagagcacaatttgagaggaattcagatgaggtgaattctaacccagatatcacattaaatagctgtgtcatcttggccaagtcttaacctttttgaacttgtctagtaagggtgttagactagatgatctcatgatatgtaaattaattctttttttttttgtttgagacagagtctcgctctgtcacccaggctggagtacagtggtgcaatcttggctcactgcatcctctgcctcctgggttcatgtractctcctgcctcagcctcccaagtagccgggactatgggcatgcaccactatgcctggctaagttttgtatttttagtagagacgcggttttgccatgttggccaggctggtcttgaactcctgacctcaggtgatccacccgccttggcctccaaaagtgctgggattacaggtgtgagccaccacacctggcctaattcttttaaatgttatataatcagcttagtcttgcctcaaggactttttatgtgttgccctgtttgggacacaattcctcatgaactttcgggtctccctc

SEQ ID NO: 96538 - DNA, 601 bp, Human
ctaaaaatggtcattgttccatcaaatttggtatgatctgaaatctacagccatgctttctgtcattttttaaaaggcacattgacctcaaagagcacaatttgagaggaattcagatgaggtgaattctaacccagatatcacattaaatagctgtgtcatcttggccaagtcttaacctttttgaacttgtctagtaagggtgttagactagatgatctcatgatatgtaaattaattctttttttttttgtttgagacagagtctcgctctgtcacccaggctggagtacagtggtgyaatcttggctcactgcatcctctgcctcctgggttcatgtgactctcctgcctcagcctcccaagtagccgggactatgggcatgcaccactatgcctggctaagttttgtatttttagtagagacgcggttttgccatgttggccaggctggtcttgaactcctgacctcaggtgatccacccgccttggcctccaaaagtgctgggattacaggtgtgagccaccacacctggcctaattcttttaaatgttatataatcagcttagtcttgcctcaaggactttttatgtgttgccc

SEQ ID NO: 96539 - DNA, 601 bp, Human
acacatgcacacatatgtttattgcggcactgttcacaatagcaaagatttggaaccaacccaaatgtccatcaatgatagactggattaagaaaatgtggcacatatacaccatggaatactatgcagccataaaaaaggatgaattcatatcctttgtagggacatggatgaagctggaaaccatcattctcagcaaactatcacaaggacagaaaaccaaacattgcatgttctcactcataagtgggaattgaacaatgagaacacatggacacaggaaggagaacatcacacaccrgggactgttttggggtgaggggagggaggagggatagcattaggagatatacctaatgtaaatgacgagttaatgggtgcagcacaccaacatggcacatgtatacatatgtaacaaacctgcacgttgtgcacatgtaccctagaacttaaactatagtaataataaaaaaaaaagaagagatgatgttgatgggggttggttttcctatgtctgtgtgaggctgaaaagctggtattttcagttttctgtttttcagaaaatgccttcccctttgggttctgtattatgtaatcatag

SEQ ID NO: 96540 - DNA, 601 bp, Human
ttttatattaagagatgatgttcagagaaatgcaaatcaaaaccacaatgaggtaccatctcacaccagttagaatggctatcattcaaaagtcaggaaacaacagatgccagagaggatgtggagaaatagcacttttacactgttggtgggactgtaaactagttcaaccattgtggaagacagtgtggcaattcctcaaggatctagaactagaaataccatttgacccagccatcccattactgggtatatacccaaaggattataaatcatgctgctatgaagacacatgcacacrtatgtttattgcggcactgttcacaatagcaaagatttggaaccaacccaaatgtccatcaatgatagactggattaagaaaatgtggcacatatacaccatggaatactatgcagccataaaaaaggatgaattcatatcctttgtagggacatggatgaagctggaaaccatcattctcagcaaactatcacaaggacagaaaaccaaacattgcatgttctcactcataagtgggaattgaacaatgagaacacatggacacaggaaggagaacatcacacaccggggactgttttg

SEQ ID NO: 96541 - DNA, 601 bp, Human
aaaatcacaaaagaagtgaaatttaaatggcctgttcctgccttaactgatgacattccaccacaaaagaagtgaaaatggccggtccttgccttaactgatgacattaccttgtgaaattccttctcctggctcttcctggctcaaaagctcccccactgagcaccttgtgatccccactcctgcccaccagaggacaacccccctttgactgtaattttccttaacctacccaaatcttatagaacggccctacccctatctcccttcgctgactcttttcggactcagctcgcctgcrcccaggtgattacaaagctttattgctcacacaaagactgtttggtggtctcttcacacggacgcgagtgaaagttgtaacaattaggttggtgaatagatatgaagtacgtagataatgcttggtatgtagtagttagtattacttctgttgctgctgctactactactactattactactgatagggacaggaggcagggaaattctggacagaagagggcgggtctctggcaagggccccacccttaagcctaaaagcctggaactgtggcccaaagtgagaacttacatccctgtt

SEQ ID NO: 96542 - DNA, 601 bp, Human
tgtcaggcctctgagcccaagctaagccatcatatcccctgtgacctgcacgtatacatccagaaggcctgaagtaactgaaaaatcacaaaagaagtgaaaatggcctgttcctgccttaactgatgacattccaccacaaaagaagtgaaaatggccggtccttgccttaactgatgacattaccttgtgaaattcctttccctggctcatcctggctcaaaaagcttccccactgagcaccttgtgactcccactcctgcccgccagaaaaccaccccccatttgactgtaattttcmtttacctacccaaatcttataaaacggccccacccctgtctccctttgctgactctttttggactcagcccgcctgcatccaggtgattaaaaagttttattgctcacacaaagcctgtttggtggtctcttcacacggacgcgcatgaaatttggtgccatcactcggatcaggggacctcccttgggagatctatcccctgtcctcctgctccttgctctgtgagaaagatccacctacgacctctggtcctcagactaaccagcccaaggaacatcacaccaattttaaatcaggta

SEQ ID NO: 96543 - DNA, 601 bp, Human
gacacaggaaggggaacatcacactctggggactgttgtggggtggggggaggggggagggatagcattaggagatatacctaatgctaaatgacgagttaatgggtgcagcacaccagcatggcacatgtatacacatgtaactaacctgcacattgtgcacatgtaccctaaaacttaaagtataataaaataaataaataaataaataaaatgtatttactctttcagcatctgtagtagacaccgtggcgctccaccctggacctcctctttagggcctttgcatgcatgggccacytgctgccttattggctgctggctcacagctggggccttcattggaatgtgccctcagggaactgcctcacacagctacatcccctccctcagggagagacctagggccaatgactggctgatgcagggattaactcatttatgcctagtgttccattattgggacgctaagcttgtgggagttttttatatcctactgctcaaggtcatcgccaaggtctgacttttcacaaaacatttttgcaacctccagcataaatgggttaaagtcttcacccatttgatttactggggacaactc

SEQ ID NO: 96544 - DNA, 601 bp, Human
gatctgcccacctcaacctcccaaagtactggtattacaggcatgagccaccatgcccggcccgaggtcccttcttgattctgtgatgaggtaacccctcactacaaagccaggtcttaggataggtctcaccatcattaaacctggactcttggagaaggcaaatgtgaataccattaaaaaccagaatctgtgatgttgacagtggaaagtctacatcactcattatttaagaccctgtttgtcatcaataaatgttcatggaaattcaggcactatcttaggtcccactgctgaggcygggatttaatccagaatctgataacaagatttgttggaacttctgccttagggcaggagaaaacaataagaaagactttaaaataaggagagtcacctaatcagatctgcattttaggaggattactataggcgcattgtggaaaagggattcggaagcaagaacaatatcagggagataaattagaggctatgtagcatttgagtcaaaagatattggagtcaagggaggtgtaaataagggaatgaattaagagatggcttggggatagagctgacagaatttggcaatgcatcatgt

SEQ ID NO: 96545 - DNA, 601 bp, Human
ggctgataattctgacaatcaataataataattgtataaacattaacatgtattgagtgcgtgctttgtgccaggcactgcacaaagtgctttataatgattatttcatttgatctttgtaataaccccatgagttaagaatacaaatgctctggcatatcagaattgttcacatttgatggttgactcaatatcgacttttaaaaactgtctagaaacctcccacgacacttactgcactgatggttctccatactcctccaatgacacaaagcctatcctgctttgaattcttgtattrttattattcatatagggagaattcaacaaataaacaggtattctattgacaccaagaagactgacactgccgctgctctgctccactttgaggtttgtagcaaatatgtctggtgcttgcatcacatcttgtcagcccacctgtgattccagtgtcagcagtagtggacggttctgtgcaagttctaactcgtgctgtatagccagcatcccttctcaaaagggatccctgagcctttcagctttctgttctaggttcccctgacccccatgacatgggagcttcctgggtgggcaagca

SEQ ID NO: 96546 - DNA, 601 bp, Human
ctggggctcattggataagtatgagttcaacctggcagctataaaataaccgggggaaaatcttgttcctttcctcctttatagctcggaaatttgtgagtgaccttgcttctttatttctaattatgccctatggaaaaataacgccttttttttcatttatattgtatagtgcctaagatttttgggggcctttaatgaacagcagtacaatttcattttcattttacaggatatgcaatataattttgaaaaattaaactacatgctcgaggaaggattcaacatttccggagaaccyagcattttccctcagaagactaaaattagatcctgttttaatgactgtccctgcaacactgacttctatgtaatgagaatgtttccatgttcctgctgacagaccacctactattctttgctgatgtggggctgataattctgacaatcaataataataattgtataaacattaacatgtattgagtgcgtgctttgtgccaggcactgcacaaagtgctttataatgattatttcatttgatctttgtaataaccccatgagttaagaatacaaatgctctggcatatcagaattgttc

SEQ ID NO: 96547 - DNA, 601 bp, Human
ttttttctccatccatatctctaaattagggggtccctcttccttttctatgcagcagtctgtcttcagcatgatgtcttcacttttctctattgtagtctcttttgtgattggccaatagcaaaatgaaacttactagaatccaatcccaaaagcactttagaaggatggaatcttatcatttactccctgaatcactatcatcagtacagttggtgtagaacggtattccattctggggctcattggataagtatgagttcaacctggcagctataaaataaccgggggaaaatcttgwtcctttcctcctttatagctcggaaatttgtgagtgaccttgcttctttatttctaattatgccctatggaaaaataacgccttttttttcatttatattgtatagtgcctaagatttttgggggcctttaatgaacagcagtacaatttcattttcattttacaggatatgcaatataattttgaaaaattaaactacatgctcgaggaaggattcaacatttccggagaacctagcattttccctcagaagactaaaattagatcctgttttaatgactgtccctgcaacactgactt

SEQ ID NO: 96548 - DNA, 601 bp, Human
tttcttctattcaaagacattttctcctctattatagctttatttaatgtttcccttatgctacagcataagtgcctttttttctccatccatatctctaaattagggggtccctcttccttttctatgcagcagtctgtcttcagcatgatgtcttcacttttctctattgtagtctcttttgtgattggccaatagcaaaatgaaacttactagaatccaatcccaaaagcactttagaaggatggaatcttatcatttactccctgaatcactatcatcagtacagttggtgtagaayggtattccattctggggctcattggataagtatgagttcaacctggcagctataaaataaccgggggaaaatcttgttcctttcctcctttatagctcggaaatttgtgagtgaccttgcttctttatttctaattatgccctatggaaaaataacgccttttttttcatttatattgtatagtgcctaagatttttgggggcctttaatgaacagcagtacaatttcattttcattttacaggatatgcaatataattttgaaaaattaaactacatgctcgaggaaggattcaacatt

SEQ ID NO: 96549 - DNA, 601 bp, Human
cttctttgcacacttctgacctagccctcctcttctctccccctgcctccctcttccctcattccccctcaccccacccccaaggctgtttgtaagctccccaaatgctcataagactttcctgaactatttcagatattttcacttcaactctaaactaaaactattttgtttttccaaatgtggctttacatagtgcagaaaactacagggaaaacatccaaagtacaatgtgatcttttataggagaaacaaaagattgaatttctaggtcatcatggaagtaggtacacttccctgrgcgataatctgaggtactttataagcttctttctttcacgaaagcaagaaatcctaaaatccatcaagatacgtgcactgtgcctcaactctctttttaatcctcaagtgaaatcaacacagtacagtgtaataaaaatgcatatagccccaggctttgtgccttagcaaagagagaaaaaataagcttcctgacttcatatgtctactgtgaataatcagtcactgcgtttttgggattttgctttataatcttaacgtatagcagtgaactccatgtttgtggtgtgacaagaataaa

SEQ ID NO: 96550 - DNA, 601 bp, Human
ccacacatatgcacacaaatgactctccagtctattcacgagtttttgtcctgaagtttttcagtttgtacagtttctgtgtgcatgtgtctgtgttgggggaggaacttcctcgttcattcttactcccaaatcctcacaagtaacactcataaatacgtgcccaaacattatccgggaaacgctcctgagactgattacagtttcagttaaaatccttttaactaatggtaatccctttcagttaaaatccattattattctaattctgattcttttgagttgtaactgaaaaaataawaataaaaaaaaaagtctgagataagttctggtcttgatttcaaactctcctgggcctcccagagtgctgggattacaggcatgagccacctctaccggccatcttctggaatgaagttttgtgataggtatagctctgcggcaaaacaacctgggcttgttgaatgcaaagattaactgaattgtctttcctttgagtttatttctgtgttttcctgacattagggcacttaggagttaaacagtgtttcttgcgtttgacttcaggatagatcacgggaaacaactagtgctaacatgg

SEQ ID NO: 96551 - DNA, 601 bp, Human
aaaccacacatatgcacacaaatgactctccagtctattcacgagtttttgtcctgaagtttttcagtttgtacagtttctgtgtgcatgtgtctgtgttgggggaggaacttcctcgttcattcttactcccaaatcctcacaagtaacactcataaatacgtgcccaaacattatccgggaaacgctcctgagactgattacagtttcagttaaaatccttttaactaatggtaatccctttcagttaaaatccattattattctaattctgattcttttgagttgtaactgaaaaaawaataataaaaaaaaaagtctgagataagttctggtcttgatttcaaactctcctgggcctcccagagtgctgggattacaggcatgagccacctctaccggccatcttctggaatgaagttttgtgataggtatagctctgcggcaaaacaacctgggcttgttgaatgcaaagattaactgaattgtctttcctttgagtttatttctgtgttttcctgacattagggcacttaggagttaaacagtgtttcttgcgtttgacttcaggatagatcacgggaaacaactagtgctaaca

SEQ ID NO: 96552 - DNA, 601 bp, Human
tggattttgatttagttgtgaacagtccatgctaaactaggggttgatcagagcttgcacagagcaatcagaactcagggggtagttcccgtggtgtgcagaattcccgagaggtaaaaatcgatgttaatctcatcagaaaagtggctcaggtagcctggtctcaaaccaactctggccttccaatatcaattaagtgcctagtgtatatccagaacaatctcattttttcactctctccctagacttgcccatttttgcttggcccaaatacgtggataaccaagtggggttcccctayaatgcaggatttactttattttatatacacaaaagcatgagggacatatcaaacctaccttcccaaccttatgaccctgcactcccaaactctacctgctaagcccaccaaaactacctgcctgtcctgcactattccatccaatataactcttgtgcgtggcttcttcatgctgctccttctctcggcaatgctcttaccccacttctctcccagatcaatgctgttagtgtttatatgtttacttcctcatctcccaggttagaattaatggcttcctcagcattctaacagtatatg

SEQ ID NO: 96553 - DNA, 601 bp, Human
ggccaacatggtgaaaacccgtctctactagaaatacaaaaattagtcaggtgtggtggcgcatgcctgtagtcccagctcctagggaggctgaggcaggagggaggctgcagtgagcagagatcacgccactgtactccagcctgggtgacagagtgaaactccacctcaaagaaaaaaatattaagtatcaaagaagtacaggcaaggcttaaatttgggataaaatagggtgggtagtaagataaaactaattttcggaattcagttttcagtggacttggaaattattaagaaatayacctttagggggcatgcagtgaaaactgccattcttttcttcctattaggtttttctataatatattgacacagtgtgctgtcaacttagtgagttctattcttggtggggaagaaaggaataattttacgggtgacatgctatacttacttatttggcattttgccaatccaatataagtggtggctccaggcatcctagctctctaactctggattttgatttagttgtgaacagtccatgctaaactaggggttgatcagagcttgcacagagcaatcagaactcagggggtagttc

SEQ ID NO: 96554 - DNA, 601 bp, Human
ctagttttaatattcacttaccgtatatagtattccagactcgtttttatcaatccaaggccaaacacaaaggatttcctctctcgacaatgttaaaatgagattttggtttttttttacagtcaactcattggcagccacaaatgaactactgcttcaattagtaccataaaaaaatacaaatctttactttcacaaaaacattagggagggtgacatttggtataggtgactacagaatctcagaaatgacatgtcttgtctttaagtcttaggctattgtttttgacaaatttttaargaagcaatattgattaatagataataaatcattgagtgatatttaattattgataattattaattaaccagtggttgattaatatttaattatgggctgggcacagtgactcatgcctgtaatcccagcactttgggaggccaagttggctggatcacttgaggtcataagttcgaggccagcctggccaacatggtgaaaacccgtctctactagaaatacaaaaattagtcaggtgtggtggcgcatgcctgtagtcccagctcctagggaggctgaggcaggagggaggctgcagtg

SEQ ID NO: 96555 - DNA, 601 bp, Human
atttaaagaattatagagtcacagtaacatatattggatgatcatattataattacatgatatcataattattagctttatgaactgaactgataggcagaaattaaaaactcaaaagtatgtttttgcttcagcagcccatatactaacattggaataatgatacagagaatactagcatggctcctgagcaaagtgttccacatttttcaaaaagactcaaaaatattaatatggttaacatttgagaatatagtgcaggaaacaattatgcattagctgaagactggacaaaatgatmcaattggccttcctcttcctaaccttctcaacttatcaaccaagttatatttcaggatgatttatgcttctactgcatctgataaaagattactataattcaactcttaattcttttgttttttcaactgttattcttattaatcaagatgcaataaagttaagtgataaaagctgaaaatgacttactggaaagaaagtgctgagatgctggaccaaagtccctgtgggcttcatgcagctgcctgactcggtcctcgacggccacctgggaggaaaaggagagaaatgatgttctctc

SEQ ID NO: 96556 - DNA, 601 bp, Human
aaagaaaggaaatgatcagaaaatggcaatgaaagaatatggcagaagaatggagatcatacagaattacttcctctctataaaatatataaattaagtaaaattacagtgcgatgcttaaaaacacagactctggagccaacttcttgagtttcaatcctggctccctcatctactagctgtatgaatgtgtgcctcagtttcttcatcattgaaatgggtataataatggtacctaccttaagggattgaagggattgctataaggattaaactagttaaaatctgtaacatttctagrcacaaagtaattgcgttaaaatgatggataaaccctcatatatactcatatatgaccacaaggaaatacatcagaatgctaacagatgttaactccatgtggtaaagtatggctttttaaataccaaaaaactcaacacatatacttttataatcaaataaaaagtggtataaattaacattaatcagaggaaaacaggtgcttgccaatttaatatgcaatattgtataaataggattttctaatacttaaactttcagttaaccaaggttatttctcttagtattaattataaaaaca

SEQ ID NO: 96557 - DNA, 601 bp, Human
ttcaagccattctcctgcctcagcctcctaagcagctgggattacaggcgagtgccaccacgcccagctaatttttgtatttttagtacagatgggggtttcaccaggttggccaggctggtcttgaactcctgacctcaagtgatctgcccacctcagcctcccaaagtgatgggattacaggtgtgagccaccacgcccaacaaatctttaaactcttcaaaagaaaaggacaattttcagactactatgccaaccaatgaatactttagtactttcttaatcacagacatatgaagaractgacaatatacctaccaattatacatatataactataaattagtatataatttaaataatttaaatgataattttattgtaaattatatacatatttgaagtcacactattagaatttctcctttttcttggtttaagttgtagaagtcaattaggagtagcagtgtattaaaactagaagtaaggacaagttagtgtctatcagcggagaagggtcatatttcacaacgcttttctcttctcattttctcttagatctaagataaaagaaaaaatttctttaacatgtagagattgg

SEQ ID NO: 96558 - DNA, 601 bp, Human
tattggcctgggcatttcttcttaacgggtaaggcagtgtgatgtgtggcttggatgtccagaaactgggttccagtcccagtattataactatctttgtgaccttggttatgtcatttgatcgttctgcacctatttcattatctgtaaaataaggaaagggctcgaatgattcaatgtttctcaaactatttcgactgcaacccacagaagaaaaacgttttacactgtgatctggcgtgcgcgcgtgcgtgcgcgcgcgcacacacacacacacacacacacacgcatgtacacacayatctaacaaattaaccaccgccaaaacaacacttaaccttgcttaggtaatgcactctgatattttctaatctgttccattccattccattccataccagtcaaaaattgttggttgtaagtcattaaactgattttaggatttgctaatgagccacacctcagagtttggaaactactggtatagatactttctaagcttatctccagttaggaaactccacagcacaagagggctcctgggtgggagtggggctgggaacttcagtaaagagagggacttgacccttttgcctcataa

SEQ ID NO: 96559 - DNA, 601 bp, Human
aatatacgagagaataatcgttggcaatagcagatagactagacagttattggcctgggcatttcttcttaacgggtaaggcagtgtgatgtgtggcttggatgtccagaaactgggttccagtcccagtattataactatctttgtgaccttggttatgtcatttgatcgttctgcacctatttcattatctgtaaaataaggaaagggctcgaatgattcaatgtttctcaaactatttcgactgcaacccacagaagaaaaacgttttacactgtgatctggcgtgcgcgcgtgcgtgcgcgcgcgcacacacacacacacacacacacacgcatgtacacacacatctaacaaattaaccaccgccaaaacaacacttaaccttgcttaggtaatgcactctgatattttctaatctgttccattccattccattccataccagtcaaaaattgttggttgtaagtcattaaactgattttaggatttgctaatgagccacacctcagagtttggaaactactggtatagatactttctaagcttatctccagttaggaaactccacagcacaagagggctcctgggtgggagtggg

SEQ ID NO: 96560 - DNA, 601 bp, Human
cattggaaaggctgtctttgaatttataggggcattatcagcatcactggtaggtcacatggcatttgtcccaaattcctaacacttgggacaacatgtgactgctgaagaaactggctcaaatcatttcaccctgagattttacttgaaagagaattttagcctgcaaatcatctcacattggacctgcaaaattctttctgacttttatcatgatggcttattttgatgtttttatttttttgagatgcagtttcactcttgttgcccaggctggagtgcaatggcacaatctcggctyactgcaacctctgcctcctgggttcaagtgattctcctgcctcagcctctcgagtagctgggattacagatgcatgccaccacgcccagctaattttgtatttttagtagagacagggtttctccatgttggtcaggctggtcttgaactcctgacctcaggtgatctgcccgcctcggcctcccaaagtgctgggattactggcgtgagccaccgcacccggcctcatgatggcttatttaagccaatctgaagctttaaattattgccccactcatatttcaaattgtctgtcccctg

SEQ ID NO: 96561 - DNA, 601 bp, Human
gctttttatgggcattggaaaggctgtctttgaatttataggggcattatcagcatcactggtaggtcacatggcatttgtcccaaattcctaacacttgggacaacatgtgactgctgaagaaactggctcaaatcatttcaccctgagattttacttgaaagagaattttagcctgcaaatcatctcacattggacctgcaaaattctttctgacttttatcatgatggcttattttgatgtttttatttttttgagatgcagtttcactcttgttgcccaggctggagtgcaatggcrcaatctcggctcactgcaacctctgcctcctgggttcaagtgattctcctgcctcagcctctcgagtagctgggattacagatgcatgccaccacgcccagctaattttgtatttttagtagagacagggtttctccatgttggtcaggctggtcttgaactcctgacctcaggtgatctgcccgcctcggcctcccaaagtgctgggattactggcgtgagccaccgcacccggcctcatgatggcttatttaagccaatctgaagctttaaattattgccccactcatatttcaaatt

SEQ ID NO: 96562 - DNA, 601 bp, Human
tgacagatgggtggggaagtttaaaaagtcggataacaaaggaagaaaatggaagtcataagaaagtagaaactataagtagaaggtgttaggtggagagaagagagaagatatgatactgtaatagtctgaagtctatggcagcaaatgcatatacagaaagaagcaaacatgtttcgtggtgtctgttgttccatgttattcttttctttctttctttttttttttttttgagatggagtctcgccctgttgcctaggctggtgtgcaatggtgtgatcttggctcactgcaacctccrtctcctgggttcaagcgattctcctgcctcagcctcctgagtagctgggattacaggtgtgcgccaccatgcctggctaattttttgtgtctttagtagagacagggtttcaccatgttggccaggttggtctccaactcctgacctcgtgatccgcccgcctcagcctcccaaagtgctgggattataggtgtgagccaccgcgcccggcccatgttattcttcatgcctctctgtatcctgaaaatgttccttatcacctaagcctatccctgtcccttacagccttaaggagacata

SEQ ID NO: 96563 - DNA, 601 bp, Human
ttgggccaaaatggccaggtcattattcccctacactgatcaggaagagctgcccctgtaaggggtatgatcttgggtgaggcagctgatgcaattcctgaagattgtctgctgaggacactccctttcatcgagagactaaagggtccctaaggatgcagaaaagcaacttcaaataattcctcaggcataggtcactgtatttagtgttccacatgactttcattaccacaaattgtgcaggcattggtataaaggagtgattctcaactaggggcaatttcacccaacaggggacataagacaatgtctggagacatttttggttgtcacagctaagggaggggagtgctactggcatgtagtgagtagaggccagagataatgcacaggacagcccccaataatttttgcccacagaggtgtgatcccaccatttctgctgcgcaaagctttgtattctaggacagatgacaaaatgctaccccaggccaaactcacaaatgcctttattttctgagtagtgtaaaaatacacttttcagagccagcattccactaattatctggccccaaatgccaatagtgcccaggtcaagaaa

SEQ ID NO: 96564 - DNA, 601 bp, Human
ggtcgaattctataacatgaactccttcacttttcacctcctgagaataaatcccttctgtccctaactcacaccataaatgagctcatttcattccattcctcttcgaatttttttttccacagacatttcctgctcagactttttctttccctatcaaattgccctcatgttgactaatccttcaattattctctctcgtctgcctatttctatctcattaaaacattagtgctctctaaaacctatatttatattcattatacatacgtaagaaatcccttttctgaacagaagggckgtaaggagactacacacgaaactggaaagggagatattcatctttttttttttttttggatacagagtcttgctccgtcacccaggctggagcgcaatggcgcgatctcggctcactgcaacctccgcctcctgggttcaagcaattctcctgcctcagcctcccaagtagctgggattacaggtgcctgtcaccatgcccagctaacttttgtatttttcagtagagacggggtttcaccatgttggtcaggctggtcttgaactcctgacctcaggtgatccacccaccttggcctcc

SEQ ID NO: 96565 - DNA, 601 bp, Human
cccccgcctttttttttttttttttttttttttgcctgaagataacaaggttgtcatgagcttttgtgttgggttccaggaataactgaagatgcagttcaaaactgaatcttcctctaatagatgtatctgctccagatctcctggaccaagtcttttgaattactttctttcccttgatagctggtctaggtcgaattctataacatgaactccttcacttttcacctcctgagaataaatcccttctgtccctaactcacaccataaatgagctcatttcattccattcctcttcgawtttttttttccacagacatttcctgctcagactttttctttccctatcaaattgccctcatgttgactaatccttcaattattctctctcgtctgcctatttctatctcattaaaacattagtgctctctaaaacctatatttatattcattatacatacgtaagaaatcccttttctgaacagaagggctgtaaggagactacacacgaaactggaaagggagatattcatctttttttttttttttggatacagagtcttgctccgtcacccaggctggagcgcaatggcgcgatctc

SEQ ID NO: 96566 - DNA, 601 bp, Human
gaaaatatttttaaagaattttaaaaatattataaattctagatcaatatgaaatttcaagcttttgtaattgcagttcttaagtgttcatttattttccttaaaaaagctttttgtcttatgtgtagccatcaaataggtccaatggtgagattcagtgtattttttttctgaaagatgtttttcccctttgattcacagtttataaattcacctaagcaactgctttgcagtcattgtttgaaaccttacaattttatgctcaaaaatgtccttgacacaataaaaaaaaaaaaaaaaaggaaaataacaacagcctcccctcattccttccctgccccatcataatcacatacacacacactggaactacttgctttagaaataacacacaattggatgatagttctacggaattgggttcagtgctccttctcaagagattcttaagggttgtcgacaatttcatttggggctgccagatgattctggtcttccatctattcaaaagttgatcaaatatgtggcagtgctcacaagtgtgccacagaattttttcatttcttgtagcagtactgatgccaacaacagctgtttctta

SEQ ID NO: 96567 - DNA, 601 bp, Human
cctcctgccttccctgcttccctttccatctttgcctttctcattctcttcccaactcttctcttgtccttttttcttctgtaggatgcagctctcctgtccaaataagttcacagagtaaataagatctgatttaaaaacatgggctaaggccaggcgtggtggctcacgcctgtaatcccaacactttgggaggctgaggcaggcagatcatctgagttcaggagttcaagaccagcctggccaacatgaggaaacgctatctctactaaaaataccaaaaaaaaaaaaaaaaaaaaaagccgggcatggtggcaggtgcctgtaatcccagctactcgggagactgaggcaggaaaatcacttgaacccaggaggcaaaggatgcagtgagctgaaatcgcaccactgcactccagcctgggcgacaagagcaaaactccaactgaaaaacaaacaaacaaacaaacaaaccatgggctagacttcctgacctatctggtcagagtctgttgttatggaaatattaaaaagctagccctctatagcaggaaacatggtggagagccagaaattatagctcctggctgctcagtgtacc

SEQ ID NO: 96568 - DNA, 601 bp, Human
acatactaggaatttgttttattatgacttcactgtgtattggtcaaatgaatgatctttgcattgtttttttttttttcaggcttaagttgtaggatttcttccctaaagctgaacctctacaaatatattttatatactgtttgatctgatggttttttttctttctttaagacaaaataatcttgttgaggaggcactataacatttcctcaacaatataatcttcctcctgaatatagttttaagacactggagctttaagaaacacagaatattatcagaaacagaaataaaagaygcattcttattaatatctagcaactttatgtgtctatactttttcccctgaattttcattctgctaataatttgaagcacagctgatgctgaccattatttcctcctatgaaaaactcccttttaaattagtctcacagtaaattcactccgcagtgtattgagatgtaagaaaacgtcaaagctaatatatcctcgactacactgtataatatgaaagaacagcttctaataaaagttaacttcacccactgccagacaatttaagcgtaatgaaactccagcttctttgttttatata

SEQ ID NO: 96569 - DNA, 601 bp, Human
tttggtgcctcaaaatgtcagctgaccagtgtgatcttattagaaaaggtgaccaaaagtgagggaatgtctactgatatcagagcgtaataagacttttgttatgagtgatgaatcctatacgtgaaatttcatttcacatactaggaatttgttttattatgacttcactgtgtattggtcaaatgaatgatctttgcattgtttttttttttttcaggcttaagttgtaggatttcttccctaaagctgaacctctacaaatatattttatatactgtttgatctgatggttttttttctttctttaagacaaaataatcttgttgaggaggcactataacatttcctcaacaatataatcttcctcctgaatatagttttaagacactggagctttaagaaacacagaatattatcagaaacagaaataaaagacgcattcttattaatatctagcaactttatgtgtctatactttttcccctgaattttcattctgctaataatttgaagcacagctgatgctgaccattatttcctcctatgaaaaactcccttttaaattagtctcacagtaaattcactccgcagtgtattg

SEQ ID NO: 96570 - DNA, 601 bp, Human
tcagctcataaaggaattggataaaagtgagagctttatgaattggttgaagaagtagcaggtctcaaacatcttagtcggaaataaaaatttgtgaggacaaagacactgatgtaggaaatcactgtctagagtttgaagaaaattgttccataaaatatacagtggatgtaaggtaatatacagtgcatgtctacagcaatatattatttaataaagcatgtgatttaaataggtatttaaaatgtacagttttgagtgactaatgaattaaatataacaataataaaattaaattcakaaaatatgaaaactaaaaagcagaatcaaacatactaaaaaagaattttcaagttaagagatacctcatctggaaaaatgtaataagacaaatggtaaaccgtttcctaaagtatgtatttctcctgaaagagtcaaaagactaccttcactcccatttttctgagttaacaaaatagaggcataaaatcaaatttcttgaggactgtagtaatgaagatctaggactgctgttattgctttagaaccgaattaagaagaattgatggacagtgaaagaataaaaacagattcgataaaa

SEQ ID NO: 96571 - DNA, 601 bp, Human
gaaccagaaataccatttggcccagccatcccattactgggtatacacccaaaggaatataaatcattctactataaagacacatgcatatgtatgtttattgcagcactatttacaatagcaaagacatggaaccaacccaaatgcccatcaatgatagactggataaagaaaatgtggtacatataaaccatggaatactacgcagccataaaaaggaatgagatcacgtcctttgcagggacatgaaactggaagccatcatcctcagcaaactaacacaggaacagaaaaccaaacrctgcatgttctcactcacaagtgagagttgaacattaagaacacatggacacagagagggaaacaatgcacaccagggcctgttggggtttgggggttgaagggagggaacttagacgatgggtcattaggtgcagcagaccaccatggcatacatatacctatgtaacaaacctgcacgttctgcacatgtatctcggttttttggtgtgttttttttttttagaagaaaaaaagaaaaaagaaggggggagatctcattttaattgatttagaccagaatcaaacattttaaaaatta

SEQ ID NO: 96572 - DNA, 601 bp, Human
agggtttctacacggaagagtagctatctagttgacaagcaatttttttttgtttagattaaatgttttcctgttgttgctggaagcaaagtatggctaatgggcaggtattattggagcacagaagctcttcaagccaccctttaagacatctctttaaaaaattatttatttcatttatttgtaattgacaaataatagtttgtatatttatgggatacgatgtgatgttttgatcttggtatatattgtagaaagagttgatcaagctaattaacatatccattacctcaccaacatwtcatttattttttgcggtgagaacattaaaaatctattcttttagcaattttgaaatatatgagacattattattagccatggttaccatgtactgcaatggaacactaaaacttgattttccctaccaaatttgttcctctttaagtacctgttcctgctgaaaccgaggagaacctggattgcctctttctgtcctcctgacctcaatgcatcagcaagacctgtgattgttctaaccatattcctgattcaaccacctcttgtgattccactgctactttatctggtcttatctacg

SEQ ID NO: 96573 - DNA, 601 bp, Human
atcccaatatgatggcatcccaccccatgactctaagaaggatgtatatattgatgattacaaaagttaaagctcttgtcctgacgtcttcccctagcttcagatccaaattttgaactgcacagctagatacccaataagtacctcaaacttaaacatgtctaaacccaggcagctctagggtttctacacggaagagtagctatctagttgacaagcaatttttttttgtttagattaaatgttttcctgttgttgctggaagcaaagtatggctaatgggcaggtattattggagcayagaagctcttcaagccaccctttaagacatctctttaaaaaattatttatttcatttatttgtaattgacaaataatagtttgtatatttatgggatacgatgtgatgttttgatcttggtatatattgtagaaagagttgatcaagctaattaacatatccattacctcaccaacatatcatttattttttgcggtgagaacattaaaaatctattcttttagcaattttgaaatatatgagacattattattagccatggttaccatgtactgcaatggaacactaaaacttgatttt

SEQ ID NO: 96574 - DNA, 601 bp, Human
tgactaaatgagttcaccagaggatctaacagcataaatctattttccatgaattaaattaaaaactcatgaatacacataatacttttagattgaaccaaatattttcatgaatacagactctcttcatccacgtaggaaaccctattggtgagcagcaggttggcaatgagtaaatgctgctcagcaggtcagacgtgtacagctggagaaagatcatgaaatttagctagtatactaggcaaaacacaaatctggaaaggagatgatccacattgcaatttttaaaaaaaattctatrtagacttagaggtctagtacagtacacatacacacaaggaacataaatatcttctgagagagtttctgtaggctttacctttgaagtttttttctttttctttttttgggaaacaaaacacaacaaaacacctcctgttgccctgaatgctaatgatggaagactgttgctatggtgatgctaatttcaacaccgttgcctgtggacttcacatgaactcgctgttttaacttctgcaaatgtcatttacaaaatgaaaacccattaatgattagcgagggcacaatgttccactttaat

SEQ ID NO: 96575 - DNA, 601 bp, Human
acatacacacacacacatacagagtaatagtggtaataccactgccagagactcagttaagataatattgttctctatttgactcctctttaattccgtctaaacatgaatgagaataatcattgacctatatctacaacatgactaaatgagttcaccagaggatctaacagcataaatctattttccatgaattaaattaaaaactcatgaatacacataatacttttagattgaaccaaatattttcatgaatacagactctcttcatccacgtaggaaaccctattggtgagcagcrggttggcaatgagtaaatgctgctcagcaggtcagacgtgtacagctggagaaagatcatgaaatttagctagtatactaggcaaaacacaaatctggaaaggagatgatccacattgcaatttttaaaaaaaattctatgtagacttagaggtctagtacagtacacatacacacaaggaacataaatatcttctgagagagtttctgtaggctttacctttgaagtttttttctttttctttttttgggaaacaaaacacaacaaaacacctcctgttgccctgaatgctaatgatgg

SEQ ID NO: 96576 - DNA, 601 bp, Human
gattcatcttgaaaagtaaaatgtacacacatacctgtctatatccaagcttgggggtaacacttctgggtttgagctatgacatttttgtataataaatgaaaattaaacttcatttgaatttcataattacctactactggtgtgatttagaagcagctggtaggtcaatatggtgctcttttatgcattttagtactgagaaaaacataagtgctagatatgccacttttaaagtttcccagaatattagaattcaaacacacacacacacacacatacacacacacacacacacacctacacacacacacatacagagtaatagtggtaataccactgccagagactcagttaagataatattgttctctatttgactcctctttaattccgtctaaacatgaatgagaataatcattgacctatatctacaacatgactaaatgagttcaccagaggatctaacagcataaatctattttccatgaattaaattaaaaactcatgaatacacataatacttttagattgaaccaaatattttcatgaatacagactctcttcatccacgtaggaaaccctattggtgagcagcagg

SEQ ID NO: 96577 - DNA, 601 bp, Human
cacctgcttggcttgtactgcctctcaacaaagtgatggcagacagaaaacctaaaaaagttcttttctggactagctgtggattaggcctagattggatcgccattagaaaagtggggaatgcatatgcatgtgtgcatacatacaagttctatgggcctacagtcctggagtgcacactgagacatgtggcttctgggggttgctgcctttcaataccacagaatcactgggttacagcccattggctgagtagttcaagttatctatagactcatttattatgtgacagagctgatgrtagcatagatgcatccctgattgaaagccagatagatcctttgcttcattttgctttgttagtgtgggctagcacaggcttgcctttaggtacctgagtggaatgtacaacttctagtccttacatgtaatggagaagactgctatgattcatcttgaaaagtaaaatgtacacacatacctgtctatatccaagcttgggggtaacacttctgggtttgagctatgacatttttgtataataaatgaaaattaaacttcatttgaatttcataattacctactactggtgtgatttaga

SEQ ID NO: 96578 - DNA, 601 bp, Human
ctggttttctagaccagtttagccatgttactaaaattactttccccttttggacttccattttcctatctgtaagatgaagagtttgggttggattatctttgacattctttcttcctcttacatttcacaattttatctcctcacatttgagtaaacgtacttctgcagtctaattagctgactgaatactgatgacccgttatagaggtgtgctttcagagataagttaaaggacaagcttgtaatcttagggtaacagttttgggagaaggagatccattcccttaaatgataatgrcagaaatgaccactaaaggaaggcaagaagtatctggtttatggcattctgaatctatttccccaaatggaaatcagatgtaaaattcttgtgctcagagacgtagtgttgattgaagagtgcagatccacgtgattctcttagtgtcatattcatgtgtgtttcagtagtgtaaactcggaattgaatagttgcctgtgtttgtaagagacattgtaggtttgcttttttatttttattttttcttttgagatggagtctcactctgttgcccaggctgtagtgcagtagcgcgatctc

SEQ ID NO: 96579 - DNA, 601 bp, Human
gttctaaccacatgagatgctgcaggggctgagaatctgctccaagttttagggggtgtcttctctgccagctgttcgtttgggtggctgtttgggagtataccaggaatcactcagcctttttgttttcttccaaatggcatggtgatattgtcacattgcaggaggaaaaacattgctgctaaaagtattgttaaggggagtaacaggtagctcacactactatacacaactgcacgttgcctgtctgaacaaaacacttcaaaacataaactgagaaatgcccttctgcttccatctkgcagtgagacctaattcaaagtccttgctagtgtgctcaggtccacgccaacaaattggcaagtgtgtgcctgacagaatggtcacattttagggctggatggtccccattctatttaatgcttataaattcatcctattaagtgcttggggaaattaatctgaataagtgtccatgaagactgataattatcatgatttttaaaagtattctcatataattgtaggaacattttagacagtctgcagccatgggggtattaagcatattatgagtaaaaataacagctttaagaataaa

SEQ ID NO: 96580 - DNA, 601 bp, Human
ataactcttaaaaattaataaaacccagcactaaggaaatataaatagcataaaactttaagaagcgaggaaaatttagaacacagatttgttttttgttttttgttttgagacggagtctcactctgtcacccaggtcggagagcagtggcacgatctcggctcactgcaaactctgcctcccagcttcaagcaattctcgtgcctcagcctcccaagtagctgggattacaggtgcctgccaccacgcccggctaatttttttgtatttttggtagagacggggtttcaccatgttggycgggctggtgtcgaactcctgacctctagtgatcagcccaccttggcctcccaaagtgtagggattacaggtgtgagccaccatgcccagccagaacacagctttgaagatcacagtgcatgatgtggttatgaaaattttgctatgcatacccaccagaatgagcaagacaaacaacacagggttagaaaggatgtggagcaactacaactctcatgctctgttagtaggagtgcaaactggtacaaccacattggaaaactgtttggaagaatgtacagaagctgaacacacacagac

SEQ ID NO: 96581 - DNA, 601 bp, Human
aggttggacctctgtggggacatcaatcaggctttcctgccgtttggcttccttttgctttcagccaattgggaggcagtgatgaaaggcctacagaaggagaggaaaggacaggaggaaggtgatgtttgggtatttattcttcaggttccctcctactgatctctggcctggcagctgctgagttccttgacctgcagccacaagtcttgttggccagtcctttcctacagcaatagcattccaccagttacgcaaaccattcctccctttatccctttgggcaaaagtttaccattcyttgtttttttttttttctcctagcctgcctagagccttgtaaatagccttttcattatactctcttcaagtgttccgtttgaatgtaccatctgtttctcccaggaccctgaccaaactgagacccatccagccaaagccaccctctggggcaatagacttgatgctgagtggggactactgatagaggagaaagtcagatccccccactctggggctaaaaagcagatgagactcagtcattggataaatattcagagaagcctcctctgtaggcccacaaagagcttctggccttttg

SEQ ID NO: 96582 - DNA, 601 bp, Human
gtgtccaattagaaaactactaagaataatctgttgacaagaaaaaagaatggaataagaaatcactattcagactttttaaaaaaattgacagatggcaatcctcaaaaatacatctttaagttcttttttagactggagttataggcacttgaagacttgttcccaaatcttgacgtcatattataattaaatactgaaagtattaagaaatgacgcgggcatcacagagactgttttgttgttcaattgcagtcagattatgaattttgcttattagaggaaagcatttggaaaagarcataattgatataccttcgtgtcatatgtaaattatgtagtgatgccatgtatgataatatattgtttgtttatagtagatgtttcttcttctcctccttctgattatattattattattattattactgttttgatatgaaccacggacatgaaaagagcctgaagctctgctaccagaacaaacttcagctaaaattttgacttcagaatcagccatgacctacttgttcccagtaccactgtctagaatggtgcaaggattggaattggggaatccagctcgaagactcatgcgctt

SEQ ID NO: 96583 - DNA, 601 bp, Human
taagacatttgtcactctcttcctttcctgttttttgtttgtttgttttacacttttaaattacctgctcaaaattcaggagttctgacacgcttctctataaatgcttaagtctcttttctcagtgtccaattagaaaactactaagaataatctgttgacaagaaaaaagaatggaataagaaatcactattcagactttttaaaaaaattgacagatggcaatcctcaaaaatacatctttaagttcttttttagactggagttataggcacttgaagacttgttcccaaatcttgaygtcatattataattaaatactgaaagtattaagaaatgacgcgggcatcacagagactgttttgttgttcaattgcagtcagattatgaattttgcttattagaggaaagcatttggaaaagaacataattgatataccttcgtgtcatatgtaaattatgtagtgatgccatgtatgataatatattgtttgtttatagtagatgtttcttcttctcctccttctgattatattattattattattattactgttttgatatgaaccacggacatgaaaagagcctgaagctctgctac

SEQ ID NO: 96584 - DNA, 601 bp, Human
caggaacctggaagccacacaccgctctgctaacacctccttaaagcctctagcaagactacttgttgtctaaataaatgacccaggtgcaaatgacctcatcccagataattaagagtgtgggcttggagttttctttttaaaaaataaaagaaaaaaattatatacataattctcactctcccttcctcctcagttgaagattaaagtggccggcgataaggacgtgaaattgccgttaggctcatcctgggctaaaagggattgttaaaaagactttggatttggatttgtgacatarcagcggatctcaaaatgtagaccctgggaacagcagttatcagtatcacctgcgaacttcttagaaatgaaaattccctgggcccggcccagacctattgaaccagaaactctgagcatactaatgtttgagaatcactggtatggactctctaaattaagacaataccaccagtgctgttgcacggtttggtcctttagtattcttttaggaagatctagaaggaacttgtttctaatagaatattttattggaaaagttacagggcctgaacagttcaaataattctaattttagagt

SEQ ID NO: 96585 - DNA, 417 bp, Human
agaaatttcatgactgttggcatacatacattcctgcctttttaaagaatttattttgaaggttaaaattatgaaaagggttttagaaattatttttttttaatccatcagtcctcggcaaaactgaaaatctcctttactggaagaaggaggaaattctaagcccccaattccattgcccatttgtgagttaagatactagtccttgataggtactattctcccagttatctgtgattctgggggacttgaataacatagataaatgaactcctcaaacaattccagaagctaacctttytcaccttcaacacacaaaccttttatttctaagcaaatgcaaagaactatgaaaacagatttagatttcacctttgcagtcttagtttcacttcaattgcaaatcagttctaagca

SEQ ID NO: 96586 - DNA, 480 bp, Human
tttaataaaaccttttttggctaatatctcttctctagtccttggtgtctctatagctgcaattcattttgtgagaatctatgacacaaaagcagtaatagctacgtaccccctgacacacacacaccccacttacgtatacctacacagaatttatgtttaagtaccctgattcccacrgtgttcatcacataaccttaaatccaaagagatcgccttatgtgtttttctatcaatatgtccattcacagaaatgcaggcttgaaaaagtagaaaagacatgacgtttttatattaaaaaaatacataaaaacacagcctgggcaacatagtgagacccatctctacaaaaataaataaaaataaattttaaaaatgagctgggtgtggtggtgcattcctgttgtcccagctactcaggaggctgaggcagaagaaccgccatgagcccaggggttcgaggctgcaataagctataac

SEQ ID NO: 96587 - DNA, 601 bp, Human
accacatctaaagtatggagaaaattttagaaatataatgattaaatgtatatttaatttgtattaaaggagcaaacatgtattcattgatagtccataattagcttttcatcaaacatgtttgcaatttctcattacagagtaattgaaagtggtagagaatactatacaacaaaatggaaatatggccatggtaatacattactttccagtggaaaaaaaaaaaagcaagttataagacagaatgattcaacttctataaaaatatatgtatagaaagacatttttgaagatcctagaytattaaacaccagctaactctaagaagtggggttacgaatgatttgtctcttctttattgttagcctgtctatatttttaaacttcaaaaatatgaataggtattaattctataataataatgattttaaaataagagtgaattaaaatattacaactagaaattactgtaattagagtaggaaatgttagaagtgggctaaatctgtgtaaaccacaggttacgatcaggaggcccacagactaatttaaattagctctttgtggacagatttctagtttttctcttgtacaatcaggg

SEQ ID NO: 96588 - DNA, 601 bp, Human
atgcctgtaatcccagcactttgggaggctgaggcgggcagatcacgaggtcaggagttggagaccagcctggccaacatggtgaaaccccgtctccactaaaaatacaaaaattaaccaggtgtggtggcagacgcctgtaatcccagctactcaggaggctgaggcaggagaattgcttgaacccgggaggtggaggttgcagtgagccaagatcgtaccactgcactccagcctgggtgacagagcaagactccgtcttggaaggaaaaaaaaaaaaggaattatgtgaaatctactytgcctgtgctgtataaatggaaaaacaaagcttggatgacagcgtatctgtttacggcatggtttactgaatatttcaagctcactgtaagacctagtgttcaaaataggtttcctttcaaaatataactgctcactgacaatgcaccttgtcacccaaaagcttggatggagatgtacaaagagattcacgttttcatgcccgcttacacaacatccattctgtagcccaaggattaagaaaaaattgtgactttcaactcttattagttgagaaatattttgtaaggctatagcttga

SEQ ID NO: 96589 - DNA, 601 bp, Human
acaaaagccttaactgacagttagaagcaagaaccttgaaaagaacatgggaactgtacacacaaatgttttgagaagataaaacagtctgctagccattctacctggagagataagttaaaggtaactaaatatttacatatcagttattataaaaattaaaacttacagaaacccatcataaagttgagtttctgtataaaattgcttgctaagaagggcaaagttgttcctgtaattcggaaagtttacaaggatacttgccttgtcaccttgacatcatacatatttggtaaagaarattttatccattaagatatttgtggtagaaaactattgatttaaattcatagctatatttttcataggataaatgttacttatcaactttctgataactgactgtctgtttttgaccacactgactttattctgtaacatcacttatacataagtagcttgttggacagaaggtattataacactttacttggctttcttctcagaagcttgttagtaataagcctccagattcttaaagatttccttccataaattcaacacgaatttgacttttctttgtcacaattttcaaaaattg

SEQ ID NO: 96590 - DNA, 601 bp, Human
cgtttgaccttaatcttatttaagttggtgtacacggtcttgtaacatttattaactgttttattacttcccaattttatttcccccaaaacacagtaacatcttttgtgaagctgacataggcttttttcaaaggatttcttatacaacaggtagaaagatagcaggcaacaataagatatgtgtgtgtgtgtgtgtgtgtgtgtgtgtgtgtgtcatatataaatttgaatgtataagccttcagtcattccaacctaagacatctaaagtaaccttgaaaagcaaaatgggtatacgytggcattaataaacgataccactagcaataagagaagataaaataatatggttgtcatttgggttctacagacagaaaggacttagaataatgtaagtgttccaccaccggccacaagtagacctggtaccatctccttcactctcataggcaaggaattctatcacatcatgaagtccgctgcatgaccagagtcacgccagcttgggcaatgaacagggatcatgccttatacttttgtgcattctattacccagagaaaggttttgaacattctaagtactccatatttatggggga

SEQ ID NO: 96591 - DNA, 601 bp, Human
gagaaatatatgcttatggtatggaagcacatacatttatatgagccaccaaaaataaatttttctaagaagagaaattgtaaataaacccataagtatgtaattcaatcaaattcatatctattccctgttgctccgctcagtttgcaatttcctcttttcctcaatggtatcaccattctctgtgtcaccacgccttcaaattttgaagacatataactccctttttctttaaaacctgtccaatctgtgattaccttctggcaattctaccttgttaagaaaaacctctggagtcacrttcccttttccttcccccattgctatcctaagaccctcatcatgtcaattacctcaaaacaaaacgaaataatctctcccctctctaactgtccttaaactcacccaccaaattcctattccaaaacacagaagacggacttcattatttctcttttctgaagatttaacaatgtttttcccattgccaatcaaatgcaatgtaaatttctcactctataatttaaggcacttagttcaccccaggggcactgaatcagatttcccttttaaaaatctggagtggccaggcgcggtggct

SEQ ID NO: 96592 - DNA, 601 bp, Human
ggctaaatcgctggtttaggagttaaaagtacacgtaaatccctgctttgcaatgtgagaaaattacctattttctctgagcctcatctgcacaatggagatacaaatatcttttacagggtttttgaaaggattaatgagaaatatatgcttatggtatggaagcacatacatttatatgagccaccaaaaataaatttttctaagaagagaaattgtaaataaacccataagtatgtaattcaatcaaattcatatctattccctgttgctccgctcagtttgcaatttcctcttttcytcaatggtatcaccattctctgtgtcaccacgccttcaaattttgaagacatataactccctttttctttaaaacctgtccaatctgtgattaccttctggcaattctaccttgttaagaaaaacctctggagtcacgttcccttttccttcccccattgctatcctaagaccctcatcatgtcaattacctcaaaacaaaacgaaataatctctcccctctctaactgtccttaaactcacccaccaaattcctattccaaaacacagaagacggacttcattatttctcttttctgaa

SEQ ID NO: 96593 - DNA, 601 bp, Human
agtataataaaagtgcaagtaatatttttatcatgctgtggaccaaactctttcttcggttccccttttcaaatggctttagagtatttcctcttcaaaatgccactgtcccctctcaggaagaaagtatagctgaggggctaaatcgctggtttaggagttaaaagtacacgtaaatccctgctttgcaatgtgagaaaattacctattttctctgagcctcatctgcacaatggagatacaaatatcttttacagggtttttgaaaggattaatgagaaatatatgcttatggtatggmagcacatacatttatatgagccaccaaaaataaatttttctaagaagagaaattgtaaataaacccataagtatgtaattcaatcaaattcatatctattccctgttgctccgctcagtttgcaatttcctcttttcctcaatggtatcaccattctctgtgtcaccacgccttcaaattttgaagacatataactccctttttctttaaaacctgtccaatctgtgattaccttctggcaattctaccttgttaagaaaaacctctggagtcacgttcccttttccttcccccattgct

SEQ ID NO: 96594 - DNA, 601 bp, Human
attatttcaatcccattttataaataaggaaaccaaaggcctaagaagtaaaattcaaatccatttgaccctaaagcccttcctcttcatcactatggtctcccaataagcttggtctagtaaccttaactttcctaagcttcattttttttttgttcatttttaaagggaacagtaatagtacctattcctagggctgttgcaaaactaagagagatagtgtatctcaaaagctccaaagaggagatgtatcttggatatatacttgctcagtaaaagttaggaacctttctctgccccttacttcttgttataaagtataataaaagtgcaagtaatatttttatcatgctgtggaccaaactctttcttcggttccccttttcaaatggctttagagtatttcctcttcaaaatgccactgtcccctctcaggaagaaagtatagctgaggggctaaatcgctggtttaggagttaaaagtacacgtaaatccctgctttgcaatgtgagaaaattacctattttctctgagcctcatctgcacaatggagatacaaatatcttttacagggtttttgaaaggattaatgagaaatat

SEQ ID NO: 96595 - DNA, 601 bp, Human
agctgcagttatgataaaataaatcaatggtaggagattttcattagataatggactgcctggccctctgacatagactgaggtgcttttaataaaggatgcctgaagcgttcctgtttaccctctgtgtatctggacaatacatttgaatctggaaccaatattaccggtactccgggaaaatactctttttattttatttttattttttttagacggagtctcattctctcgcccaggctggaatgcagtggcatgatctcggctcactgcaacctctgcctcctgggttcaagtgatkcttgtgcctcagcctcccaagtagctggtattacaggtgcccaccaccacgcccagctaattttcatatttttagtagagatgaggtttcaccatgctggccaggctggtctcgaactcccgacctcaagtgatctgcctgccttggcctcccaaagtgctgagattacaggcgtgaactattgtgcccagccttgaaaagactcttctttatcacctcaaaactatgctgcatttgggagttgcttgatataaagctttaccaatttgaagattcaatccaagaatcgggcagactctg

SEQ ID NO: 96596 - DNA, 601 bp, Human
tttagagttaatgaaatgttcataacttcatctctagtgcaaaatttcctctttatttatagctcttaagataaatgttatttaaaaaaatagttttggtaacttcaactaatcatatgttttgaaagtcaaattaagattcttctctaccctttatctaacagtaaacattttaggttctgagtgaaaatgatttgcatcctccatctgcctctttccatttctctggtgcccaacatcaacacacccccaatatccatgccctctaataatcatcatgaataaaatggatgccaaaatkaaccacagtagaaattaaccttagttaccatgggaaaagcaaactgaccttcttgcaaaaaacatttttgcaacatttctgtcttaggctggtatgcatgctttcacctcattaggaaagatacattgtttgggttttgttgatgttgctgtttgagaggtgcaagaagagaatctgttgagtctttatgcatgaataatgagtccaagatagaacacaattcaagatatttaagcatctaggatcatagtaaactatgcgtatctctgctttttgtatactctagcataacagaagagg

SEQ ID NO: 96597 - DNA, 601 bp, Human
tagacaaagtctgcaaagtgtttagccatttgtttggaatgggacgttcacaagtctgattctgcccagatgtaagataaggattggaatttaaaaacatacaagttacttctctggaaattcacgtgtcaacctataaatgaacacatataatcaactagtttttcattaactctttagagttaatgaaatgttcataacttcatctctagtgcaaaatttcctctttatttatagctcttaagataaatgttatttaaaaaaatagttttggtaacttcaactaatcatatgttttgamagtcaaattaagattcttctctaccctttatctaacagtaaacattttaggttctgagtgaaaatgatttgcatcctccatctgcctctttccatttctctggtgcccaacatcaacacacccccaatatccatgccctctaataatcatcatgaataaaatggatgccaaaattaaccacagtagaaattaaccttagttaccatgggaaaagcaaactgaccttcttgcaaaaaacatttttgcaacatttctgtcttaggctggtatgcatgctttcacctcattaggaaagataca

SEQ ID NO: 96598 - DNA, 601 bp, Human
agggaaaaaagatgagaaaaatgcagacttctgaagaggtcatgttgtgttcacttatccttggcatctagggcaataaatgatggtgctcaataaatgtatttggaataaaattagattctgaaaggaacttccttgcttttaccaggtttaagctgtcgatgacattgattttacatctaatttttcttcaaataatataattttccacttctatggctgaatcactggaattattatttttgcttactccttacaacctgagctggagcttcttttttgaaacacacctcacaaagayatcaagactttcctaaggaataaaggaattgggacaaagagagaaagaaaataaatggtctaaaaagaatgcttatttgcaaggtgaatccgctgtatttaattgtggcagataactgtatgttggctcactcaacaccccttcccaaattctttctccttggtctttctctgctacaaaggctggaggatctcaattccctgatccagccaggggaagctgtgtggacacagttttggccaatgcttgagaagatatctgcaagaaaggatttcccttcccaaatggaaagacaaagag

SEQ ID NO: 96599 - DNA, 601 bp, Human
tcccaggtatttgtgatgtgtcaagcaacacacacatacaaaactctggttatgtgagtgtcaaagaaaaaccagagatggacggtaaagtggtaaaaacagattttattcaggaatattgcaatagtgggaaagagacctcagtatagaactgggctcaactctgaatacagcatggacaagtgggaattgatagccaaggagcagggtggggtttggtggatggaaaactactaagagaaagcatgggggtaagggggattctagctaaaaaaaacttaacaggaaccttgctgaagacacaggccagggtgatcagacgtcacatgggggatggtggaggatgaggaacctgatcagatacataagaggaaggtggttcttgctaaactgatttagcaggattctcgctacagctggatttttacaaagaagtgcacaggtgggcctaggagaaggttcaggagtctggctgaagtttgatcaagtagacaatctttatcatgaggatgcttatgtacatacagaaacatataatgaaaatagaccatcgtgcagtttatatgtcaaccgcaaaggtagtttccaagatgacataagc

SEQ ID NO: 96600 - DNA, 601 bp, Human
ggactccaccttttactaatgcattcaaactaaatgattgtgctgccaaaaatattgccttaatacacttactgttgcagtacaagaacaggtaggaagacaggccaaaatccatgagtctcctgactatatttcattaagtgacaattacttctgcatttaaaatcatcagttgacgcttacttaagcacctattatatgcctaactgtgtactaagcccaggggttaaagattcaggtttctaagatattggggaaaacaaaaagattattcaccctgtaaaaaatcagtacacgtatsccaggtatttgtgatgtgtcaagcaacacacacatacaaaactctggttatgtgagtgtcaaagaaaaaccagagatggacggtaaagtggtaaaaacagattttattcaggaatattgcaatagtgggaaagagacctcagtatagaactgggctcaactctgaatacagcatggacaagtgggaattgatagccaaggagcagggtggggtttggtggatggaaaactactaagagaaagcatgggggtaagggggattctagctaaaaaaaacttaacaggaaccttgctgaagaca

SEQ ID NO: 96601 - DNA, 601 bp, Human
aacctcatcttttgccccttcctgttttaaaaagtcttaacttaattttcctaaaggctaccttttctaccttggccttaccgccgtctcggcttacttatttctctgcccttatctcccaagatttcaacatatgatctttctcccaaaactccatttcaattacttctctggtaaccacagaccagaggtcaccaactggttgaatttagtctgcagactctttttttgtgtgtgtgtgtgtttgattcgttggtcagtttgggctcacataatggtttttgaaattgttgaatgataygccattagttaaaaatctggtgatttcccgttgtcttgcttctctggaagaacctgaagacctgacaatagagactcacattctcatagaacagtcagctgcaacggaggctctgttaccctaacagaagcttttcaggttgccccagttcccacccagtcaccttcagtcattcaaattaccagcttggccccaggaggcatttcttttcagatctttgcctcagcctgaccactcccttgttctcccaaaagcttttacatttacccttcagttacactctttttcaggtccctgtca

SEQ ID NO: 96602 - DNA, 601 bp, Human
atttcctactcctcaattccatatttagtctgctgttttctgttaactcattttaaaaagctcttctacctaagcactttcttttttgccaccttcatctccagaaggaacttcaacttcagcaaggtatgcagccattaaattgttcctcaattatcatccttatatatcatattcttcatgctgcagttacaactactccaaatcaaatcaatgcactttccttgcagtctccctcttgacaggcgacttacagtcacacaggccactctggctgctggaataaacaatactattctcytcctttggctcagaaccttcagtcactgctctctcctgtttttctcagtcacaacatgggtaactcagctacttacagaactctcagaatgacacaaacttataaatttaccccaatctccttcaactctattctcaacctcattaattaacgaatcttaacagtctctcttcataagtgaacacacatcccagattcgccagggcagagccagtttaattaaattttcctctttgttataaaaggtaagactctaaaaatgatcagatgtgacttaattcttatacctttgcaaagcca

SEQ ID NO: 96603 - DNA, 601 bp, Human
caatctcgaagctgcaccacacaccagggcgcatgaggagcagtgaaatttggaagtgggagaaggcactggaaacagagggattacataccagctctgcatcctgaaagaaagtaaatcttcaaattcatttccttcatttcctactcctcaattccatatttagtctgctgttttctgttaactcattttaaaaagctcttctacctaagcactttcttttttgccaccttcatctccagaaggaacttcaacttcagcaaggtatgcagccattaaattgttcctcaattatcatccytatatatcatattcttcatgctgcagttacaactactccaaatcaaatcaatgcactttccttgcagtctccctcttgacaggcgacttacagtcacacaggccactctggctgctggaataaacaatactattctcttcctttggctcagaaccttcagtcactgctctctcctgtttttctcagtcacaacatgggtaactcagctacttacagaactctcagaatgacacaaacttataaatttaccccaatctccttcaactctattctcaacctcattaattaacgaatcttaac

SEQ ID NO: 96604 - DNA, 601 bp, Human
tggcttagaaaatgacctgctggtaaccaacttaggagaccagagaaatcccaagctcaattaatgatgttggggagacaaggagattggggcagggagtgggaggaactaacaagacgcatgccagtttatgtagccaagaagtctcagaaatgaaaggctccaggttcctctgaagactgaaatgtggctgaaaatacaaggactggttgaaagtctttagagccctaaacacctcccccacttggagcctagcatctcagccacctgctgcttcatcctgacagaaggctggaggctyaatctcgaagctgcaccacacaccagggcgcatgaggagcagtgaaatttggaagtgggagaaggcactggaaacagagggattacataccagctctgcatcctgaaagaaagtaaatcttcaaattcatttccttcatttcctactcctcaattccatatttagtctgctgttttctgttaactcattttaaaaagctcttctacctaagcactttcttttttgccaccttcatctccagaaggaacttcaacttcagcaaggtatgcagccattaaattgttcctcaattatcatcct

SEQ ID NO: 96605 - DNA, 601 bp, Human
aagtgggagaggcaagaatgatctgattctttcagggcatgaatattagtgtggaacagtatcagagttcaaactttcttcccttctaaatacttctaactatgacacattctgcctctagttaatcctccctgacatcttttcagcctacccccaacccactgcagtgaataagccttctgctaccagttttccacgcaccaaagtccaatccattctcaaacagtgattcaggcataccagaagaaagtagcagggaatgcctccagctttgttcttttggcttaggactgacttggcratgcgggctcttttttggttccatatgaactttaaagtagttttttccaattctgtgaagaaagtcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacattgtggcattattcacaatagcaaagacttggaaccaacccaaatgtccaacaatgatag

SEQ ID NO: 96606 - DNA, 601 bp, Human
ggtttgcaaaatatgaagattgttgaaaaacatttagaaacactccctgcctttaaattgagtttaagaagaatccagtaggttctccatctttagaaatggtgccctaggctgaattccaaaatgtccagctgtggttcaccggattcttagttgccagaattcagttagatggttgagggaatcctgctgctagaacaatggttttcagacttgagcaaacatcagaatcacctggagtggatagtttaaagatgcagatttcctaggccccacctccagattttctaattcagtaggkatgggaagggcctgggaatctgaatttctagcaagtttccaggtgatgctgatgctgctggtccagggaccacactttgagaaccactctaatagaggactgtggcctgtgtagactgtgagcctctcacaccaagcaccccaaaagacagaactgtgacttcactgtgtctctggcacaggctgtaagattgttttgtacccattggctaataaatgctcctaagtgacagaacttgtactgagacttgctttctttataacctggcagccgagaggtagttaagagggcagtcctcaa

SEQ ID NO: 96607 - DNA, 601 bp, Human
acaaccaggaaggctaagttctgtgaagactaaagtggtatagcctgaagggcattcatgtagtcctgttcccaagaggaaagagatggacaggcattatttttttctagaaagtaatctggatctactgtagtgaatcttttctgcacaagattaaagagaacaagaaatacattatttaaatagctataagaccttaaacaatcaagtggcaatataacattttttctgactgtagaagttatacatgctcactttgggtaacttagacatttaacatatacatatataatcaaataartcatccacaagcccataaactcaaaaataggcacaactggctggattcagtggctcatgcctgtaatcccaacgctttgagaggccaaggtgggaggactgcttgaggccaggagcttaagaccagcttgggcaacatagtgagatcccatctctacaaaaaaagtttatataaaccttttaaataagcactgttaacattttgagtattttttatccaacatatgtgtctatgtgtgtgatatgcatctaaaaatataattaggaataaaataaacatttggctcctatattctaaggc

SEQ ID NO: 96608 - DNA, 601 bp, Human
tgggcatgtgatagaaggcttacgtgctgtatgtttcatctgtcataacattatgtgtttaaaaaaatagctatttgccccattactccgtgtggaaagccattagtgggtggagggacaattgggacagcttgaatcagtgacagatatttaagttgaatttggtgggcctactttcctgagactgaaaagctagaaattggatatggatggctacagaaatttctgtgacatacccaaaccaaagtccttttaggagtgactactattcatatgattttagcctagtcacatttttgtrtctcatgtgtatttcccattaaagctgctatttctcaatggcaacatgtctggtgggccaaggggcatgaatccacttgaaataaaagaaacttctattaggagaattaggaactgggctagagatacctggccaggtagaatttgctttgaatgagaaatgataaactgacgaaaaagacttcctagtgcaagaagcgcacttcaagggcatccaattccaggaggaaggatagggatggcaagctgccaaggttgatagctggagaatggaaccaataattactagaaaacggaacct

SEQ ID NO: 96609 - DNA, 601 bp, Human
gggtgggggactctgctaaaacctcctcctccttgaaagagccaagatgtgagtgggagagtcagccaacctatccaacacactggatgacgagatgggcgttctaactgcgactacaacaccatggagcaatattaatgtggcttttggttagtattcgttaatgtcttttggttcttctttcacaggacatatctgttattaatcagctgtgtcaggaaataacctgagggaatatttacccagtcaaatctgaagaacaatgatttataacaatctcaataaacactgtgtggccatyaattgtgatgatgaaggtttaacaaaggtattgggcatgtgatagaaggcttacgtgctgtatgtttcatctgtcataacattatgtgtttaaaaaaatagctatttgccccattactccgtgtggaaagccattagtgggtggagggacaattgggacagcttgaatcagtgacagatatttaagttgaatttggtgggcctactttcctgagactgaaaagctagaaattggatatggatggctacagaaatttctgtgacatacccaaaccaaagtccttttaggagtgactactat

SEQ ID NO: 96610 - DNA, 601 bp, Human
taataaacaccaaacgtgaaccacactctctttgaaaggtgttttatttttatgcctcgactctaagttgatgagtttgatcagtattcaggatctgaagttgttcttaaatctcactggcattgggtgaagatatgggcaaagatataattcccatccttggattactggggaatatctgagagttaaggggacctagcctgttctacataaacagagtcaattgtcacctgaataagaaaaaaaaaatgttttagcagaaatttttaaagagatccgatgatactttcttgtattagcrttagagaagatctgttagattaatctgtatggctaaggttgtgtaaactctatttctagctatgcatttataatcattaagcgcttttctccttgaaatatcagtcacctcagcatctctctgctaccctaatattaggtgaaaaaaatactctccactaaaattttctataggcaaactaaagtaattgcataatctatccagttttcagacctgaggctcgcttatttctcctttcaccttcaaattgtatttcataatattctttctaagtcctctaacaactttataaggctgagg

SEQ ID NO: 96611 - DNA, 601 bp, Human
ggatttctgtggctagagacttatttcctcccttgctgaacttcttcccctctagcacctcaataactgtggggtccctgctgcagatggagatttcttttccttcctcagcactgtcttctttcccaaaacctagagttccagaagctgcttacttacagaggttccaaatatcccaaatcccatacctactgcctactgaagagctaatatgagaaaacgaagctctgtgggttttttaattaatttctaaaatatgaaagaataaatatgttacctagaaggtgaataacttacaaaytggaagcagctccggacacttggctcaatgttactgcccccaaaggatgcaacttcacccaactgtcttggaatttggatagaatcatgcagaaggaggcccagcctgcgctggtcacaaaatcctgttgaacttgccacttgcttgaaaaggtctacaaaggaagaagaaaattgcaacagtcaaaacacagcacccatggatgccagcagaacctgacatccaactcaattccagtagcaattctcaagagtagccagtatttccacagagtggggttacttctaatttgtgctaatc

SEQ ID NO: 96612 - DNA, 601 bp, Human
aggctccccaaatctaagtaatgaaagcctcgccatacatatggaatttactagcatctgattagaaatactacatttgccagcacttcaaactaattcctcttccccctcaagggtcccctgtcttgttataccttttcttattctatccaggactcaggaaaagtagctgttgtttggccttgggaagctggagagcagaagtatcagaaactacatatttgggaatgaggtagtaaatgtggcggtgggcatactggactaggaatcaaacccttccaccagctgagggactttaagrgcgcaaataaattattcatccacttaaacaataataaaagcaaaatctccaaagcctgactattctgttcccctcaaagacttggtgaggattaaatgagagaattcatgtgaacaaagttttgttagtagcaatggtaacaatattatttataagcataataggtacaaatggtaaggagaagctgtttcatgatagtgaaagcaaactatgggtggttatgaaaccagagtaggaaaggtctgagagttaaatagaggaattaggatttgttcactagacaacagaaagatactgaca

SEQ ID NO: 96613 - DNA, 601 bp, Human
ttattaccgtttacctcaggctggtagaaatagcagcctttgagcacaagcttgctgaaggaaccagcccagcctcattctgaaggtcctatacttcaaacaaagggcagaggacattttcactcctgttatctttccctacagcaaacattgtatttttatgcacgtggcacaatgaaaggcaaggtgaccgccagtgcacctggccgaggaaaagcatgccagggccaggacgtggattcctaagtattcctaagtatttacaatggatccattcaacctgattgcaaattgctaaaaygctgagaggctccccaaatctaagtaatgaaagcctcgccatacatatggaatttactagcatctgattagaaatactacatttgccagcacttcaaactaattcctcttccccctcaagggtcccctgtcttgttataccttttcttattctatccaggactcaggaaaagtagctgttgtttggccttgggaagctggagagcagaagtatcagaaactacatatttgggaatgaggtagtaaatgtggcggtgggcatactggactaggaatcaaacccttccaccagctgagggac

SEQ ID NO: 96614 - DNA, 601 bp, Human
aaggaagagaggcgggagggagggcaggaaggaaggaaggaaaagacagggtgagaggaaggaaggaagaaagaaagatttggtcataacaatgaagtgctactttagaaggatgaagatggaaaacaaaatgacatgtgcttttccttagcagtaagtgtataaacaaaacaggtttcaactacaacacaaacctatcttcaaaattctggtgaagaaaacatccattactccaatagagaagttaatcaaacaaaccacttaaacagatcatcataaagcttaacccacggtagcttawaatttttaaaaataacaactggaaaccaatattaaacttaagacaatactgataatactctgataagggtcttttctgaaaattgcaggaattttaactaactgttcatgagcaggcccagtaagaggtcggtgatatctctcagcttttcatggcagccagctatctctatggaaggctgattggactattagggtctaccttcaattctgggaaaggccacctctttataaataccaaattgtagtaactcttactaattacttagttactagtgagtattcatccgtccaaaagggg

SEQ ID NO: 96615 - DNA, 601 bp, Human
gatcatttacatgaggttgtacacaatggtttttcacatcttgctcttagtgtgtgtttccattcagagaacacttggtctcatgtgaaatgccacactctatgtacaagactgttttctatatcttacagctctgatacaagagttgttacccggaagatcaggtaagactttgctgatcatggccaagctttgaaataagtacaataatccatttccctttcggcctttataacatttagcatagaatcaaagacacttagggataagtaacttttgagataacctgttttaactttaygttacagataagaaaaggcccaaagaggttaaggaaacagcttaagattatctacgattttaatactgaaatatatgcttaaaatagtcttaaaaagacaggacaaaagtgatttcctatgggaaaaagcaaggcgatccccaaaatcttttgaatctttaatttgtttgaaagtactagagtctgatagctaagtaagcaaggcccacttaggacaatttccaggtgaatataaatcttcaactgaattatatgccgataacatggctgcgagagccaatggaaggtgcaagtgaatac

SEQ ID NO: 96616 - DNA, 601 bp, Human
agcaggtctgctagtacaatgtgtatgtgtgtgtgtgtgtgtgtgtgttttgattttacttagtacaggtcataaccatttagagaaaaaataagaactaaatatgcaaatattaaatacatacatatccataaatagaattcctaaacatttttattgacagaaaaaggtaaatttatggaaaacattgtgggcaaaccacagatttttaaaaagggtaatctctcctttgtggctgatatggtttggctgtgtccccacccaaatctcatcttgaattataactcccacaattcccacwtgtcgtgggaggagcctggtgggaggtgattgacttatgggggttggtctttcctgcgccgttctcgtgatagtgaatgagtctcacactatctgatggttttaaaaacgggagtttctctgcacaagctctttttttgcctgctgccatccaggtaagttgtgacttgctcctccttgccttctgccatgattgtgaggcctccccagccacgtggaactgttaagtccaatgaccctctctcttttgtaaattgccccatctcaggtatgtctttatcagcagcgtgaaaacggacta

SEQ ID NO: 96617 - DNA, 601 bp, Human
agacttccctgagagtcctgcaagggcatttaataagccggcaactatcctctacaacacagaaactgggaggctaccataggcctattcaactgccgaaatgccacactcgttcataaactgagggtagagagagcaaaagggaaattaaaagccccaaactagaagtcacaaggaaacacgctaaaattgtagactcagatttgaaatcaagttgcttctcaaactgacaactctatgcagtgtattccaggataaacagttgcagaaatttatttatttaatcatggcagataattaycccaagcaaggtaaagcaggtctgctagtacaatgtgtatgtgtgtgtgtgtgtgtgtgtgttttgattttacttagtacaggtcataaccatttagagaaaaaataagaactaaatatgcaaatattaaatacatacatatccataaatagaattcctaaacatttttattgacagaaaaaggtaaatttatggaaaacattgtgggcaaaccacagatttttaaaaagggtaatctctcctttgtggctgatatggtttggctgtgtccccacccaaatctcatcttgaattataact

SEQ ID NO: 96618 - DNA, 601 bp, Human
cagtctttatctcaggcatgtaaccatgaaccctcctcctttcatgctgccctggctctagttagtttgggactgacaaaaagtgatttcatcctggtatcttttacgggagacatttttggttgtcacaactgggcggggggggggtattggcggttagaagtgctactagcatttagtagatagaggccaggattctgcaaaacatccagcagcacacagggcagcttcccacaacaaagaactagaatgattcgggccaaagcatcagtagcaccaaggttgagaaaccctgccccartgttaacatcttacataaccatatggttcacttgtcaaaactaagaaatccacattgattcatcactattcactaaacaacagacttccctgagagtcctgcaagggcatttaataagccggcaactatcctctacaacacagaaactgggaggctaccataggcctattcaactgccgaaatgccacactcgttcataaactgagggtagagagagcaaaagggaaattaaaagccccaaactagaagtcacaaggaaacacgctaaaattgtagactcagatttgaaatcaagttgct

SEQ ID NO: 96619 - DNA, 601 bp, Human
attataaaatctgtatgaagtcagaattttaaaaagctgcctagtcatcctgaagagcaaaaacatacacttgtaaagattttataaagagcagaagacaaaataagttactttctcaaactgtccaaaatttcctttatcgattacagtaaatgtccttgtgttggtttctatgtgatggtatcacacataaaaggctaacagacttcatctggacttagaaggtatgtacagaatgatctggcttaaaatataggtatacacaaaattcacacttggggcccttgaaaggaactgcacrggcagatagcttttctctaggtcggtggttctcaaccggaaatgatgccgtaccccagaggaaatataacaatgtttggagtgtcgaccaaaaaacatcagagaaaaacatcgccaaatatgttaaatttattttggaattagaaatgaggattacaacccaagatgcatctgaagaggagactgtagagggaaacttttattggtaaaaacagaagtttacataagctgcttggaaacatagttcgtttcagatgctcaacgccagaactggtgtcagtttattagtggggatgccatt

SEQ ID NO: 96620 - DNA, 601 bp, Human
ttttggcaataactccattttccccttctatgtcatgcacacacagaaagcaaagctatcacagctccttccattatgatggtcacagtttggaattatgttgggtttctcctctttttctgttggtcctcacctgccagcaactatccataacagaaaagctaggggaaggaatcagttgtcattactattgctctgttacagcacactggagggtggcttcatacaaatatcacctttatacaaatataacaaggtacacagacaaagaattctcaatatctggaatttctagcaaacmgatttacctatcaatataataagtttaaaagggcattacatggcaagtttggaggtaggagagttgctggggttccgaagaacttttggatttctttgatgttgtgctttctataaatccttggacactgaagggccaaccgcctgccaggaggtccacctgaatactcatttttctctcaaggtaataaaatcaattcatggctacagaagaaatgcaattaagtatttctcagcaagccctgcatcccagctaccatgaacacgtacattgtattttttaggagaaggcaattggcat

SEQ ID NO: 96621 - DNA, 601 bp, Human
accaagtattgcatgttttcacttataagtgggagttaaatgatgagaacacatgggcagatagaggggaaaaacacacactgtggcttatcagaggatggagggtgggaggagggagaagatcaggaaaataactaatgggtattaggcttaatacttgggtgacaaaataatctgtacaacaaacccccatgacacaagtttacctcataagaaacctagacaggtacccctgaacttacaagttaaattttaaaaagctgttgctgagcacttttctctgtgtagagttccatcacagaggtactttgtggaaaaaaaagtttataaagaattatgcaatctaaaaatgaaaaagatcatgcaagtccattcatccttttggcatggcaccacagagctgtaagactttcaggattcactgagtccaaactcagcattcatcgagtccaaactcttacccatgccagtgtgtgcttacagccactacaccacccatgtgagagagctgggaaacatccttagaaggtgatcctgaacacctgtgtccagatacccctgtcaaaagtgctgcatcacattgagctgaaatccatcagca

SEQ ID NO: 96622 - DNA, 601 bp, Human
tattagaaaataaagtaacaaaaccagttcacacgtaactggaaaagagtgtttactttgctgctaagtggattctgcacaggcatagaccatagagctagtttacaactttgtggcttattcatcactatagaaaccttgatgttgattcacacatttaaggacatcgcagtttcagaattaggatttaggattaatgttaagtgagattaattcatttaaaaaaaaatcctgtctccccaaacaggtcagcagggctaaagatttatttggccttgttttccatgatattttaagactmtcagaataacctgctacgtttcctatctctttcacttctaaatgtataaggactggttgttttttagctgctttgtgaatcttccatttacttgcctactttttattcctttagaagttcactgggatactatacaaagaatgtaatcagattcacagataaagaagcaagttctaagatgctgaaaacaattcttgttacttaagggagaaaaaaaaatggtgcaaagtgaatgagagactgagctactattatggttcctcccagaatagaatcatctctcagttttataactgattc

SEQ ID NO: 96623 - DNA, 601 bp, Human
aattcagagaggaccctggtttagcccagtgtccaagtagcgttgaaggacttggttgaaacactaaggagaatgtgtttgtttcttcttacattaaaaaagaaaaagatgcagttaccagtagctaagcttgcattagaaaatgtgccagaaattcatatttcttaatatactacagtaagataattacgacacactatagcaaataactagggaaatggaattcttccctgagagagaaaggtcttatttatgaaaccaatgtcatctaggtcaagtgtaatcataatcaaattgaaakgagttataaagacgtttaaattgtcaagaggaaacaaaacgatgactactcaatttaataagcagatccaaagatttccatgtgaatcttcactatagttttggagagttaatctgttaatcttctagaaccctggcatagcccattattagaaaaatgctaaggtctgttttgaaatcttcactgcagatcaagataaattaatacttggattatttgtattataagaactatcttttggaacagaccagtctttcaattacatatttttttaataagcaaaaagcctaccatcaggga

SEQ ID NO: 96624 - DNA, 601 bp, Human
taatgtaattcagagaggaccctggtttagcccagtgtccaagtagcgttgaaggacttggttgaaacactaaggagaatgtgtttgtttcttcttacattaaaaaagaaaaagatgcagttaccagtagctaagcttgcattagaaaatgtgccagaaattcatatttcttaatatactacagtaagataattacgacacactatagcaaataactagggaaatggaattcttccctgagagagaaaggtcttatttatgaaaccaatgtcatctaggtcaagtgtaatcataatcaaaytgaaatgagttataaagacgtttaaattgtcaagaggaaacaaaacgatgactactcaatttaataagcagatccaaagatttccatgtgaatcttcactatagttttggagagttaatctgttaatcttctagaaccctggcatagcccattattagaaaaatgctaaggtctgttttgaaatcttcactgcagatcaagataaattaatacttggattatttgtattataagaactatcttttggaacagaccagtctttcaattacatatttttttaataagcaaaaagcctaccat

SEQ ID NO: 96625 - DNA, 601 bp, Human
gactttttcttttaattggaatagcacaaaaggtctcttccatttctctgctgacacagaaagcccttaggtaaaggcataaatccaaaagtcaacgataatgtaattcagagaggaccctggtttagcccagtgtccaagtagcgttgaaggacttggttgaaacactaaggagaatgtgtttgtttcttcttacattaaaaaagaaaaagatgcagttaccagtagctaagcttgcattagaaaatgtgccagaaattcatatttcttaatatactacagtaagataattacgacacaytatagcaaataactagggaaatggaattcttccctgagagagaaaggtcttatttatgaaaccaatgtcatctaggtcaagtgtaatcataatcaaattgaaatgagttataaagacgtttaaattgtcaagaggaaacaaaacgatgactactcaatttaataagcagatccaaagatttccatgtgaatcttcactatagttttggagagttaatctgttaatcttctagaaccctggcatagcccattattagaaaaatgctaaggtctgttttgaaatcttcactgcagatcaaga

SEQ ID NO: 96626 - DNA, 601 bp, Human
tggatgcacagtaagctctctaaacattctgccaccaatttttacctttaaaatcttcttcacctcaggcaattatacagggggttttttgtttgtttgtttgtttgtttttttacaactaaaaaagttaaccaaactcttacggatttaacaagcataaaatattttaaaattagtaattcagtttttaggtataaaaatcatctcaaacacaaagaaggtgagacagaaaagtccaaggattaggaaaattaattattctcttctttacagcatatcatgtaaaataaatacacaaacrgaaagctgatgctttcatattctccatataatatagtatcattttttcatatatgaatgtctggtctagcagttttctaaggaggttaaactatttgtaagccaatttagtaaatgtgctcagtataaaaaaacatagcaaggctaccggaaatgtttaaaagccagggttagggaagattattctggactaatgctcttgttggtgaccaaaaacaacatgcagtggaacggcatgcacgttagagggcaagttgattagtaggaatcagacaagtttggggaaaaaaagaaaagattt

SEQ ID NO: 96627 - DNA, 601 bp, Human
tcaataactagttatatatatgccactttgatactatttcttttggcctaatccttatgaaggttcttttctcatctgagcatgactttgtgttgccacaccaactacatatgataaatttaccattcttccctttgtctatattctccaagatgggtgagatatccttactttatcaaactaaaaaggcatcgtaatactttgactagatttcttctctttatgttatttattcacttggcaaatccttattttttccttcatatttgcttcaatgtctgctctctctacctcaagcccyggtcagcatttacttggttcatggcaatgttcctttgtgctctgtattgtgaacactgccctcactctataatgaagcctgtttccctgccatagctgtgttccctgctgctcttagcaccgctctatctccgtccttaaagtttaacagggttggcttatcatcctgctaacaacctgcaacctgaattggtacttctcctctggaaactcttcataagattgcctcactttatttatcttgtgaagatgctaaatcacaaaaatctacttctttggatttctgaaggaaaatgcccaa

SEQ ID NO: 96628 - DNA, 601 bp, Human
atgagtttttgccatccaacattgagtcaaaatggattttatgtcctcagaataagctaaagcttattttaaaataaaacaaaagcagttttaccacctaatttatcacactcattccaaattctgaagttgtactgctagaacttcccatgtttaattataacctagagttgtaactacacttttcttcctgttctcttaggcagtcaatgaatgacagccactgttacgtagatacaactcgaattaatctgaatgtgctagagcttctaataccaaaatcagtgagccaaagaagcasaagctatttacatttggctgattctttggccacacattttactgttgaagtatcttatatattagtaccattaatactttttcccatagctaagaaagataaggcatcacagttatggttggggaaaggcttttttgtttgtttgtttgaaggaactaagtcatatacaaatgactgagggttgacttgattctttattattagcttgatcgtttatgtaccagatgagattatttattctcatgtcttcaataactagttatatatatgccactttgatactatttcttttggcctaat

SEQ ID NO: 96629 - DNA, 601 bp, Human
ttcagcttcaattcatttattcattaatgcattcaacaaatatttattgaatactatgtgcaacaaccaggagaaatggaattctaaaggcagagataagatacctctgagacacttctcaaacagccatcctctgtttttctagggggttgtagggaggtgtcatgaataagaacaattaatggaatttaataaatatctagtcaggaatggggctctccaggcctctctcttttgctgttatttggagataaatcacagctaaaggaacataaaatatatatattaacagatcaataastacacatccaaaggacttggggcaatctcaattttaaatatactttcttattttctctaaaagtatgctcgtatttgtcagattgcgtagcccaatgctgacttaggacatagccagctagacatgcacagagagggcatctaaagaattcctgggttttctcaacaggaaatggcaaattaaaggctccttaagcaacactgaattcaagggtagcgaaggcaaatctagggctctgaagctccttgcgcagaactgcaagaagacaggacagggcagatcaaagaaaacacacgggct

SEQ ID NO: 96630 - DNA, 601 bp, Human
aaattccttacctaccactttgtcttcagaggcagtccttcctctcattcaaggtcacgcctcctcccatactttagttccctaacccttctctctcctgcctcctgtgggaaaatgctcccatcattcccaagctctgccctcctcttcttctggcacatttctccagcatgtgaaaattagagatttttaagtaaaaagagaaaaccagagtgaacactgcacgacactgtgtgaagtaaccccaacaaccataaatatgtttgcaaatatttgcatatgtagagagcatgtttggaasgaaacacaagaaaccaagaaagatggcagcctccagagctggaaacaccacagccaggggagaaggttggagaaggattcacttttctctatatgtctttttgaaccctttggattttgtataataatatacatgtattctctactaaaaataaaagtaattaaatacacactttaatgttcacatcttccggagttctaccaaatccagtgttctccttctgctacatgctcccgggatatataaattcattctcacggtttcaactaccacctgtgagctggcgactcacagtcctaa

SEQ ID NO: 96631 - DNA, 601 bp, Human
gtggtatatccatacaatgaaatgttactcagcattaaagaaagaatgaaatactaatacgggctataatatagataccattttaaaagattacgctatgtgaaagaagccagtcacaaaagactttatattgtattatttcatttacattaacagtccagaataagcaaatccatagagacagaaagtagatcagggattgtctactgctagggctgaaaagagtagttgcaggagaaacgaggagtgacttgaaaatggggatgggatttcttttggggggtgataaaaatgttctaawattgtgcgctgatggttgcacaactctgtaattaataaccagtgattactaatactggttaacctattaactaataatcagtgactaatacactgtaaatgggtaactcctatggtacgagaattatatctcaataaaggtcttataaaaaactaagttctagattcaaaattttatttcttatagcacaaaagatattaccccagtgaaaacaataaaatcttataatgctttctcctactatggaaaaatcaaggtttaacccatgtacataaaagaaaaatggtatgcacatgtctt

SEQ ID NO: 96632 - DNA, 601 bp, Human
aattgcagttttgccataagtttgaaattgttctaaataaaaagctagggagccattatgtcataaacctcaaatgtacatgataaattttttaaaaagcaaaggaacagtttaatttttaaatcaataaaatataaaatgcttcaaaaaacagtaatctggtggaaagttaggagtcatcagagataaggagttgtctggacatcacagatttgtatatggagcccatgagagccaataggggataaacattgttaattgctattttgttctgtatttgcttcctccaatagaatgtacrtttcattagcacattgtctcagtaagaactgtacagaatacaaatggtacatagagactcagtgataagtatttcatggcttgaggaaatatgttgactctttagacacatcacctaatatgacttgtctcatgtttcacttaaaagaaaatcagtcatcggggttgcatatttaaagaatgcagctctatccagaatgtggttcagcagatcccagccttgtatctcaaaccttcaaagcccaagtatatacactgcatttatttaaacacctgtgtgcatccttcaagaagacggtaa

SEQ ID NO: 96633 - DNA, 601 bp, Human
agtgtggatgtggtgaaaacagaacacttttacactgctggtgggaatgtaaactaggacaaccactatggaaaacactatggaggctccttaaagaactaaaatgtagaactaccatttgatccagcagtcccactactggatatctacccaaaggaaaggaagtcattatgtgaaaaatatacttgcataccaagattatagcagcgcaattcataattgcagaaatacggaactagcttaaatgcccatcaaccaacgagtggataaagaaaatgcagtatgtacgtggtgtttatawacacacacacacacacacacacacacacacacacgccatggaatattagtcatgaaaggaatgaaataatggcattcacagcaacctggatggagttggagaccattactctaagtaaagtaactcaggaatagacaaccaaacattgtactttctcacttataagtgggagctaagctatgcggatgcaaaggcatgagaatgataccatggactctggggacttggggggaagggtgggaggggggtgaaggataaaagactacacgttgggtacagtgtacactgctcaggtgatgg

SEQ ID NO: 96634 - DNA, 601 bp, Human
gattttaaacttagttgatggcaatgctttaacacttaaacttgactctactccaaggtgatttccacaaacatgcataaataatagatgtcagtgtggatgtggtgaaaacagaacacttttacactgctggtgggaatgtaaactaggacaaccactatggaaaacactatggaggctccttaaagaactaaaatgtagaactaccatttgatccagcagtcccactactggatatctacccaaaggaaaggaagtcattatgtgaaaaatatacttgcataccaagattatagcagcrcaattcataattgcagaaatacggaactagcttaaatgcccatcaaccaacgagtggataaagaaaatgcagtatgtacgtggtgtttatatacacacacacacacacacacacacacacacacacgccatggaatattagtcatgaaaggaatgaaataatggcattcacagcaacctggatggagttggagaccattactctaagtaaagtaactcaggaatagacaaccaaacattgtactttctcacttataagtgggagctaagctatgcggatgcaaaggcatgagaatgatac

SEQ ID NO: 96635 - DNA, 601 bp, Human
tggagggtatgagttgcacaagtatttgagggaaaagtgctccagacagaaggattggcaaatgcaaagactctgagaggagagtgtgactggcttcctcaagcacagcaagaagtctaatgtagataaagcagagtgaacaagagctgggaaaacagtacttccctggcctggggattcggatttggccacataacctgctttggaaaatggaatgtaagcgggcatgacaaaagtagaggcttagaatgtctttgactggttggggttgcccgcttgtgtttatgtgcacaagaagcayatggcccaggtagcttgctagcccaagaaggatgagagacatgttgaacagacctgaacccaaaccacaacttggtgtcaagtccagctgattgccagcaaaagttcagccaaacaacagatgcgtgaatgagaaatatgcaacttgagaattttgtggttatttgttatgcagcaacagctgactgatacactattatgggcatgaaacaagccagatataatatttatggcttgtctaatcatacactatgtagctacaacataataggtgtattaatccattttcacactgctatag

SEQ ID NO: 96636 - DNA, 601 bp, Human
cacaggcttaacaagtaaataagtaaactatataggtatcttgagtggtgatgaacactctgaggagagggctagcaagggacaatgagagtcatcagaaagtggagtcttggaagtcctcattgatgagatgcagttgagcaaaagctttaagaactggagggtatgagttgcacaagtatttgagggaaaagtgctccagacagaaggattggcaaatgcaaagactctgagaggagagtgtgactggcttcctcaagcacagcaagaagtctaatgtagataaagcagagtgaacaaragctgggaaaacagtacttccctggcctggggattcggatttggccacataacctgctttggaaaatggaatgtaagcgggcatgacaaaagtagaggcttagaatgtctttgactggttggggttgcccgcttgtgtttatgtgcacaagaagcatatggcccaggtagcttgctagcccaagaaggatgagagacatgttgaacagacctgaacccaaaccacaacttggtgtcaagtccagctgattgccagcaaaagttcagccaaacaacagatgcgtgaatgagaaatatgcaa

SEQ ID NO: 96637 - DNA, 601 bp, Human
agggaaatttcttaggtgcaaacaaaattaaactttaaaggtcctttgaaactaacttttcataatatacaatcttccaatagtgaaaataacttctattcaagctctgtttgttttgcacattgtcacttccatctaaaacaagaccttgctttagcaagtcaaccataatgaacttaattagggacaacctcaggtttacatctgacttggaactgcttcggaagccagtgactaaatgacttaaatatgcttctcattccctttggtctatgccacttggattttcatgtttgattakaatcctgcatttattcctttttttttttttaacagcagaagctaaaagaatcattgccaatgctaaccattaagacaaaatcatattctaggtggatgtgaggcttcatatttttattagaatggagggataagaacgtaaggtagataaaaagcctcagactacatgagtctcctggtaacataccacaggaaacctctttgcaatattaagtacaggaaatgggtgctgaagaattaaggtcacaaagcagaaaaggaatagttacaaactctctctctcctctttctctctctcttc

SEQ ID NO: 96638 - DNA, 601 bp, Human
atgaaactttttatccacttgaatttggggagaaaaaggcctgtaagaaagcctgagttagctgaaagtagcaaaacgtgaggaaatgccaagatcatggtattacagaatgataggccagattttccaataccttagctactctcttgtgttttttgtgtatttaattgttttgttttttaagaatgtgaatttattttctcaggccacaagggtaccactgagtaagccggaacttaagttaatggaattggtatcggacaaggcttccttctcccacatttgagaacttaaatcagcmcttaaggcctgaaattcttccgtaagcactaatttagtaaacactatccaggtggcctgaattgagtttcccaagtttccatacaagtaagtaaatcaacatcagagatactgactgctaaataccatatcagaggaggtatatttcttgtcttccaggaagcttctacacccatgtggtatctagctttaaggactctaaaagcgggacacagggagatggtgcaaaggatttcaccttacagctaattagggtggaccagaaactcaggtacaaaaaggagtctaggaagtcaaggct

SEQ ID NO: 96639 - DNA, 601 bp, Human
agtataaaaattttttaacaaagcatatgcaactattcataaagtgggccaatagtttggcagccctcagtgaagaactgaaatcatttttggctttctgtgccataaaaaccacaggaagacgacacagtggggcctttgctgctccttagagctcagagtacaaatatataactgctgctatcaagttggagggcttcccctgtatctatttttggctgtccagcaaccctgggaaatctgcataattattcatgcataaattgaagatagatggactaactgccaatttttaattacyagcgatctttacggttaacaaaatcagtaaaaacaaagtccaggacctttacaacatggtgcctgaatgtaattcgaagtatttctcatggcccacatgtgactatagtatgtagtccacctagtagctagaaaacatattacaaaacatcaacgaaaaggggagaaaactcattttttttcctgtcagcttatcgataatcacaaagtgtctttctttttaggctgtgtgctaggggatgtagatggcagttcaaaatataataaaacaaataaatgcatttatggattatatagccaa

SEQ ID NO: 96640 - DNA, 601 bp, Human
gacatgaacatttaaaaaatggaaaaagtcagtctatagaaattcgtatctctttatctatataactatagtatttatatacttatagacatatagatatatgaaatgaaaactcaagcctgccccactcagctgacagttctcaaatgagcagtgtgtagtagtcatttggtgtggtggtagaggaagtcttatctttaatatgcaaaaaaagaaaaagccatgaatttcatatggatatcacgccaaaaggatgcaaaacaatgcgctgcctcaaagttttgtgtgtgtgtgtgtatgtatgtgtgtgtgtgtgtgtttgttttgtttttaggggtttttataaacaacttttttttataaagcacactttagtttacaatctttctttataactgttataaatttttaaacaacccaaaatgcgttccatataaagaaatggcaagttatttagctatcaagattttacatgtagttttcttataacttttttgtacaattgcatagacgtgtaaaacctgccattgttaacaaaacaataacagacttagaaactactgaaatctacagtataataccactacccttcacaaaaata

SEQ ID NO: 96641 - DNA, 601 bp, Human; identical to SEQ ID NO: 96375

SEQ ID NO: 96642 - DNA, 601 bp, Human; identical to SEQ ID NO: 96376

SEQ ID NO: 96643 - DNA, 601 bp, Human; identical to SEQ ID NO: 96377

SEQ ID NO: 96644 - DNA, 601 bp, Human; identical to SEQ ID NO: 96378

SEQ ID NO: 96645 - DNA, 601 bp, Human; identical to SEQ ID NO: 96379

SEQ ID NO: 96646 - DNA, 601 bp, Human; identical to SEQ ID NO: 96380

SEQ ID NO: 96647 - DNA, 601 bp, Human; identical to SEQ ID NO: 96381

SEQ ID NO: 96648 - DNA, 601 bp, Human; identical to SEQ ID NO: 96382

SEQ ID NO: 96649 - DNA, 601 bp, Human; identical to SEQ ID NO: 96383

SEQ ID NO: 96650 - DNA, 601 bp, Human; identical to SEQ ID NO: 96384

SEQ ID NO: 96651 - DNA, 601 bp, Human; identical to SEQ ID NO: 96385

SEQ ID NO: 96652 - DNA, 601 bp, Human; identical to SEQ ID NO: 96386

SEQ ID NO: 96653 - DNA, 601 bp, Human; identical to SEQ ID NO: 96387

SEQ ID NO: 96654 - DNA, 601 bp, Human; identical to SEQ ID NO: 96388

SEQ ID NO: 96655 - DNA, 601 bp, Human; identical to SEQ ID NO: 96389

SEQ ID NO: 96656 - DNA, 601 bp, Human; identical to SEQ ID NO: 96390

SEQ ID NO: 96657 - DNA, 601 bp, Human; identical to SEQ ID NO: 96391

SEQ ID NO: 96658 - DNA, 601 bp, Human; identical to SEQ ID NO: 96392

SEQ ID NO: 96659 - DNA, 601 bp, Human; identical to SEQ ID NO: 96393

SEQ ID NO: 96660 - DNA, 601 bp, Human; identical to SEQ ID NO: 96394

SEQ ID NO: 96661 - DNA, 601 bp, Human; identical to SEQ ID NO: 96395

SEQ ID NO: 96662 - DNA, 601 bp, Human; identical to SEQ ID NO: 96396

SEQ ID NO: 96663 - DNA, 601 bp, Human; identical to SEQ ID NO: 96397

SEQ ID NO: 96664 - DNA, 601 bp, Human; identical to SEQ ID NO: 96398

SEQ ID NO: 96665 - DNA, 601 bp, Human; identical to SEQ ID NO: 96399

SEQ ID NO: 96666 - DNA, 601 bp, Human; identical to SEQ ID NO: 96400

SEQ ID NO: 96667 - DNA, 601 bp, Human; identical to SEQ ID NO: 96401

SEQ ID NO: 96668 - DNA, 601 bp, Human; identical to SEQ ID NO: 96402

SEQ ID NO: 96669 - DNA, 601 bp, Human; identical to SEQ ID NO: 96403

SEQ ID NO: 96670 - DNA, 601 bp, Human; identical to SEQ ID NO: 96404

SEQ ID NO: 96671 - DNA, 601 bp, Human; identical to SEQ ID NO: 96405

SEQ ID NO: 96672 - DNA, 601 bp, Human; identical to SEQ ID NO: 96406

SEQ ID NO: 96673 - DNA, 601 bp, Human; identical to SEQ ID NO: 96407

SEQ ID NO: 96674 - DNA, 601 bp, Human; identical to SEQ ID NO: 96408

SEQ ID NO: 96675 - DNA, 601 bp, Human; identical to SEQ ID NO: 96409

SEQ ID NO: 96676 - DNA, 601 bp, Human; identical to SEQ ID NO: 96410

SEQ ID NO: 96677 - DNA, 601 bp, Human; identical to SEQ ID NO: 96411

SEQ ID NO: 96678 - DNA, 601 bp, Human; identical to SEQ ID NO: 96412

SEQ ID NO: 96679 - DNA, 601 bp, Human; identical to SEQ ID NO: 96413

SEQ ID NO: 96680 - DNA, 601 bp, Human; identical to SEQ ID NO: 96414

SEQ ID NO: 96681 - DNA, 601 bp, Human; identical to SEQ ID NO: 96415

SEQ ID NO: 96682 - DNA, 601 bp, Human; identical to SEQ ID NO: 96416

SEQ ID NO: 96683 - DNA, 601 bp, Human; identical to SEQ ID NO: 96417

SEQ ID NO: 96684 - DNA, 601 bp, Human; identical to SEQ ID NO: 96418

SEQ ID NO: 96685 - DNA, 601 bp, Human; identical to SEQ ID NO: 96419

SEQ ID NO: 96686 - DNA, 601 bp, Human; identical to SEQ ID NO: 96420

SEQ ID NO: 96687 - DNA, 601 bp, Human; identical to SEQ ID NO: 96421

SEQ ID NO: 96688 - DNA, 601 bp, Human; identical to SEQ ID NO: 96422

SEQ ID NO: 96689 - DNA, 601 bp, Human; identical to SEQ ID NO: 96423

SEQ ID NO: 96690 - DNA, 601 bp, Human; identical to SEQ ID NO: 96424

SEQ ID NO: 96691 - DNA, 601 bp, Human; identical to SEQ ID NO: 96425

SEQ ID NO: 96692 - DNA, 601 bp, Human; identical to SEQ ID NO: 96426

SEQ ID NO: 96693 - DNA, 601 bp, Human; identical to SEQ ID NO: 96427

SEQ ID NO: 96694 - DNA, 601 bp, Human; identical to SEQ ID NO: 96428

SEQ ID NO: 96695 - DNA, 601 bp, Human; identical to SEQ ID NO: 96429

SEQ ID NO: 96696 - DNA, 601 bp, Human; identical to SEQ ID NO: 96430

SEQ ID NO: 96697 - DNA, 601 bp, Human; identical to SEQ ID NO: 96431

SEQ ID NO: 96698 - DNA, 601 bp, Human; identical to SEQ ID NO: 96432

SEQ ID NO: 96699 - DNA, 601 bp, Human; identical to SEQ ID NO: 96433

SEQ ID NO: 96700 - DNA, 601 bp, Human; identical to SEQ ID NO: 96434

SEQ ID NO: 96701 - DNA, 601 bp, Human; identical to SEQ ID NO: 96435

SEQ ID NO: 96702 - DNA, 601 bp, Human; identical to SEQ ID NO: 96436

SEQ ID NO: 96703 - DNA, 601 bp, Human; identical to SEQ ID NO: 96437

SEQ ID NO: 96704 - DNA, 601 bp, Human; identical to SEQ ID NO: 96438

SEQ ID NO: 96705 - DNA, 601 bp, Human; identical to SEQ ID NO: 96439

SEQ ID NO: 96706 - DNA, 601 bp, Human; identical to SEQ ID NO: 96440

SEQ ID NO: 96707 - DNA, 601 bp, Human; identical to SEQ ID NO: 96441

SEQ ID NO: 96708 - DNA, 601 bp, Human; identical to SEQ ID NO: 96442

SEQ ID NO: 96709 - DNA, 601 bp, Human; identical to SEQ ID NO: 96443

SEQ ID NO: 96710 - DNA, 601 bp, Human; identical to SEQ ID NO: 96444

SEQ ID NO: 96711 - DNA, 601 bp, Human; identical to SEQ ID NO: 96445

SEQ ID NO: 96712 - DNA, 601 bp, Human; identical to SEQ ID NO: 96446

SEQ ID NO: 96713 - DNA, 601 bp, Human; identical to SEQ ID NO: 96447

SEQ ID NO: 96714 - DNA, 601 bp, Human; identical to SEQ ID NO: 96448

SEQ ID NO: 96715 - DNA, 601 bp, Human; identical to SEQ ID NO: 96449

SEQ ID NO: 96716 - DNA, 601 bp, Human; identical to SEQ ID NO: 96450

SEQ ID NO: 96717 - DNA, 601 bp, Human; identical to SEQ ID NO: 96451

SEQ ID NO: 96718 - DNA, 601 bp, Human; identical to SEQ ID NO: 96452

SEQ ID NO: 96719 - DNA, 601 bp, Human; identical to SEQ ID NO: 96453

SEQ ID NO: 96720 - DNA, 601 bp, Human; identical to SEQ ID NO: 96454

SEQ ID NO: 96721 - DNA, 601 bp, Human; identical to SEQ ID NO: 96455

SEQ ID NO: 96722 - DNA, 601 bp, Human; identical to SEQ ID NO: 96456

SEQ ID NO: 96723 - DNA, 601 bp, Human; identical to SEQ ID NO: 96457

SEQ ID NO: 96724 - DNA, 601 bp, Human; identical to SEQ ID NO: 96458

SEQ ID NO: 96725 - DNA, 601 bp, Human; identical to SEQ ID NO: 96459

SEQ ID NO: 96726 - DNA, 601 bp, Human; identical to SEQ ID NO: 96460

SEQ ID NO: 96727 - DNA, 601 bp, Human; identical to SEQ ID NO: 96461

SEQ ID NO: 96728 - DNA, 601 bp, Human; identical to SEQ ID NO: 96462

SEQ ID NO: 96729 - DNA, 601 bp, Human; identical to SEQ ID NO: 96463

SEQ ID NO: 96730 - DNA, 601 bp, Human; identical to SEQ ID NO: 96464

SEQ ID NO: 96731 - DNA, 601 bp, Human; identical to SEQ ID NO: 96465

SEQ ID NO: 96732 - DNA, 601 bp, Human; identical to SEQ ID NO: 96466

SEQ ID NO: 96733 - DNA, 601 bp, Human; identical to SEQ ID NO: 96467

SEQ ID NO: 96734 - DNA, 601 bp, Human; identical to SEQ ID NO: 96468

SEQ ID NO: 96735 - DNA, 601 bp, Human; identical to SEQ ID NO: 96469

SEQ ID NO: 96736 - DNA, 601 bp, Human; identical to SEQ ID NO: 96470

SEQ ID NO: 96737 - DNA, 601 bp, Human; identical to SEQ ID NO: 96471

SEQ ID NO: 96738 - DNA, 601 bp, Human; identical to SEQ ID NO: 96472

SEQ ID NO: 96739 - DNA, 601 bp, Human; identical to SEQ ID NO: 96473

SEQ ID NO: 96740 - DNA, 601 bp, Human; identical to SEQ ID NO: 96474

SEQ ID NO: 96741 - DNA, 601 bp, Human; identical to SEQ ID NO: 96475

SEQ ID NO: 96742 - DNA, 601 bp, Human; identical to SEQ ID NO: 96476

SEQ ID NO: 96743 - DNA, 601 bp, Human; identical to SEQ ID NO: 96477

SEQ ID NO: 96744 - DNA, 601 bp, Human; identical to SEQ ID NO: 96478

SEQ ID NO: 96745 - DNA, 601 bp, Human; identical to SEQ ID NO: 96479

SEQ ID NO: 96746 - DNA, 601 bp, Human; identical to SEQ ID NO: 96480

SEQ ID NO: 96747 - DNA, 601 bp, Human; identical to SEQ ID NO: 96481

SEQ ID NO: 96748 - DNA, 601 bp, Human; identical to SEQ ID NO: 96482

SEQ ID NO: 96749 - DNA, 601 bp, Human; identical to SEQ ID NO: 96483

SEQ ID NO: 96750 - DNA, 601 bp, Human; identical to SEQ ID NO: 96484

SEQ ID NO: 96751 - DNA, 601 bp, Human; identical to SEQ ID NO: 96485

SEQ ID NO: 96752 - DNA, 601 bp, Human; identical to SEQ ID NO: 96486

SEQ ID NO: 96753 - DNA, 601 bp, Human; identical to SEQ ID NO: 96487

SEQ ID NO: 96754 - DNA, 601 bp, Human; identical to SEQ ID NO: 96488

SEQ ID NO: 96755 - DNA, 601 bp, Human; identical to SEQ ID NO: 96489

SEQ ID NO: 96756 - DNA, 601 bp, Human; identical to SEQ ID NO: 96490

SEQ ID NO: 96757 - DNA, 601 bp, Human; identical to SEQ ID NO: 96491

SEQ ID NO: 96758 - DNA, 601 bp, Human; identical to SEQ ID NO: 96492

SEQ ID NO: 96759 - DNA, 601 bp, Human; identical to SEQ ID NO: 96493

SEQ ID NO: 96760 - DNA, 601 bp, Human; identical to SEQ ID NO: 96494

SEQ ID NO: 96761 - DNA, 601 bp, Human; identical to SEQ ID NO: 96495

SEQ ID NO: 96762 - DNA, 601 bp, Human; identical to SEQ ID NO: 96496

SEQ ID NO: 96763 - DNA, 601 bp, Human; identical to SEQ ID NO: 96497

SEQ ID NO: 96764 - DNA, 601 bp, Human; identical to SEQ ID NO: 96498

SEQ ID NO: 96765 - DNA, 601 bp, Human; identical to SEQ ID NO: 96499

SEQ ID NO: 96766 - DNA, 601 bp, Human; identical to SEQ ID NO: 96500

SEQ ID NO: 96767 - DNA, 601 bp, Human; identical to SEQ ID NO: 96501

SEQ ID NO: 96768 - DNA, 601 bp, Human; identical to SEQ ID NO: 96502

SEQ ID NO: 96769 - DNA, 601 bp, Human; identical to SEQ ID NO: 96503

SEQ ID NO: 96770 - DNA, 601 bp, Human; identical to SEQ ID NO: 96504

SEQ ID NO: 96771 - DNA, 601 bp, Human; identical to SEQ ID NO: 96505

SEQ ID NO: 96772 - DNA, 601 bp, Human; identical to SEQ ID NO: 96506

SEQ ID NO: 96773 - DNA, 601 bp, Human; identical to SEQ ID NO: 96507

SEQ ID NO: 96774 - DNA, 601 bp, Human; identical to SEQ ID NO: 96508

SEQ ID NO: 96775 - DNA, 601 bp, Human; identical to SEQ ID NO: 96509

SEQ ID NO: 96776 - DNA, 601 bp, Human; identical to SEQ ID NO: 96510

SEQ ID NO: 96777 - DNA, 601 bp, Human; identical to SEQ ID NO: 96511

SEQ ID NO: 96778 - DNA, 601 bp, Human; identical to SEQ ID NO: 96512

SEQ ID NO: 96779 - DNA, 601 bp, Human; identical to SEQ ID NO: 96513

SEQ ID NO: 96780 - DNA, 601 bp, Human; identical to SEQ ID NO: 96514

SEQ ID NO: 96781 - DNA, 601 bp, Human; identical to SEQ ID NO: 96515

SEQ ID NO: 96782 - DNA, 601 bp, Human; identical to SEQ ID NO: 96516

SEQ ID NO: 96783 - DNA, 601 bp, Human; identical to SEQ ID NO: 96517

SEQ ID NO: 96784 - DNA, 601 bp, Human; identical to SEQ ID NO: 96518

SEQ ID NO: 96785 - DNA, 601 bp, Human; identical to SEQ ID NO: 96519

SEQ ID NO: 96786 - DNA, 601 bp, Human; identical to SEQ ID NO: 96520

SEQ ID NO: 96787 - DNA, 601 bp, Human; identical to SEQ ID NO: 96521

SEQ ID NO: 96788 - DNA, 601 bp, Human; identical to SEQ ID NO: 96522

SEQ ID NO: 96789 - DNA, 601 bp, Human; identical to SEQ ID NO: 96523

SEQ ID NO: 96790 - DNA, 601 bp, Human; identical to SEQ ID NO: 96524

SEQ ID NO: 96791 - DNA, 601 bp, Human; identical to SEQ ID NO: 96525

SEQ ID NO: 96792 - DNA, 601 bp, Human; identical to SEQ ID NO: 96526

SEQ ID NO: 96793 - DNA, 601 bp, Human; identical to SEQ ID NO: 96527

SEQ ID NO: 96794 - DNA, 601 bp, Human; identical to SEQ ID NO: 96528

SEQ ID NO: 96795 - DNA, 601 bp, Human; identical to SEQ ID NO: 96529

SEQ ID NO: 96796 - DNA, 601 bp, Human; identical to SEQ ID NO: 96530

SEQ ID NO: 96797 - DNA, 601 bp, Human; identical to SEQ ID NO: 96531

SEQ ID NO: 96798 - DNA, 601 bp, Human; identical to SEQ ID NO: 96532

SEQ ID NO: 96799 - DNA, 601 bp, Human; identical to SEQ ID NO: 96533

SEQ ID NO: 96800 - DNA, 601 bp, Human; identical to SEQ ID NO: 96534

SEQ ID NO: 96801 - DNA, 601 bp, Human; identical to SEQ ID NO: 96535

SEQ ID NO: 96802 - DNA, 601 bp, Human; identical to SEQ ID NO: 96536

SEQ ID NO: 96803 - DNA, 601 bp, Human; identical to SEQ ID NO: 96537

SEQ ID NO: 96804 - DNA, 601 bp, Human; identical to SEQ ID NO: 96538

SEQ ID NO: 96805 - DNA, 601 bp, Human; identical to SEQ ID NO: 96539

SEQ ID NO: 96806 - DNA, 601 bp, Human; identical to SEQ ID NO: 96540

SEQ ID NO: 96807 - DNA, 601 bp, Human; identical to SEQ ID NO: 96541

SEQ ID NO: 96808 - DNA, 601 bp, Human; identical to SEQ ID NO: 96542

SEQ ID NO: 96809 - DNA, 601 bp, Human; identical to SEQ ID NO: 96543

SEQ ID NO: 96810 - DNA, 601 bp, Human; identical to SEQ ID NO: 96544

SEQ ID NO: 96811 - DNA, 601 bp, Human; identical to SEQ ID NO: 96545

SEQ ID NO: 96812 - DNA, 601 bp, Human; identical to SEQ ID NO: 96546

SEQ ID NO: 96813 - DNA, 601 bp, Human; identical to SEQ ID NO: 96547

SEQ ID NO: 96814 - DNA, 601 bp, Human; identical to SEQ ID NO: 96548

SEQ ID NO: 96815 - DNA, 601 bp, Human; identical to SEQ ID NO: 96549

SEQ ID NO: 96816 - DNA, 601 bp, Human; identical to SEQ ID NO: 96550

SEQ ID NO: 96817 - DNA, 601 bp, Human; identical to SEQ ID NO: 96551

SEQ ID NO: 96818 - DNA, 601 bp, Human; identical to SEQ ID NO: 96552

SEQ ID NO: 96819 - DNA, 601 bp, Human; identical to SEQ ID NO: 96553

SEQ ID NO: 96820 - DNA, 601 bp, Human; identical to SEQ ID NO: 96554

SEQ ID NO: 96821 - DNA, 601 bp, Human; identical to SEQ ID NO: 96555

SEQ ID NO: 96822 - DNA, 601 bp, Human; identical to SEQ ID NO: 96556

SEQ ID NO: 96823 - DNA, 601 bp, Human; identical to SEQ ID NO: 96557

SEQ ID NO: 96824 - DNA, 601 bp, Human; identical to SEQ ID NO: 96558

SEQ ID NO: 96825 - DNA, 601 bp, Human; identical to SEQ ID NO: 96559

SEQ ID NO: 96826 - DNA, 601 bp, Human; identical to SEQ ID NO: 96560

SEQ ID NO: 96827 - DNA, 601 bp, Human; identical to SEQ ID NO: 96561

SEQ ID NO: 96828 - DNA, 601 bp, Human; identical to SEQ ID NO: 96562

SEQ ID NO: 96829 - DNA, 601 bp, Human; identical to SEQ ID NO: 96563

SEQ ID NO: 96830 - DNA, 601 bp, Human; identical to SEQ ID NO: 96564

SEQ ID NO: 96831 - DNA, 601 bp, Human; identical to SEQ ID NO: 96565

SEQ ID NO: 96832 - DNA, 601 bp, Human; identical to SEQ ID NO: 96566

SEQ ID NO: 96833 - DNA, 601 bp, Human; identical to SEQ ID NO: 96567

SEQ ID NO: 96834 - DNA, 601 bp, Human; identical to SEQ ID NO: 96568

SEQ ID NO: 96835 - DNA, 601 bp, Human; identical to SEQ ID NO: 96569

SEQ ID NO: 96836 - DNA, 601 bp, Human; identical to SEQ ID NO: 96570

SEQ ID NO: 96837 - DNA, 601 bp, Human; identical to SEQ ID NO: 96571

SEQ ID NO: 96838 - DNA, 601 bp, Human; identical to SEQ ID NO: 96572

SEQ ID NO: 96839 - DNA, 601 bp, Human; identical to SEQ ID NO: 96573

SEQ ID NO: 96840 - DNA, 601 bp, Human; identical to SEQ ID NO: 96574

SEQ ID NO: 96841 - DNA, 601 bp, Human; identical to SEQ ID NO: 96575

SEQ ID NO: 96842 - DNA, 601 bp, Human; identical to SEQ ID NO: 96576

SEQ ID NO: 96843 - DNA, 601 bp, Human; identical to SEQ ID NO: 96577

SEQ ID NO: 96844 - DNA, 601 bp, Human; identical to SEQ ID NO: 96578

SEQ ID NO: 96845 - DNA, 601 bp, Human; identical to SEQ ID NO: 96579

SEQ ID NO: 96846 - DNA, 601 bp, Human; identical to SEQ ID NO: 96580

SEQ ID NO: 96847 - DNA, 601 bp, Human; identical to SEQ ID NO: 96581

SEQ ID NO: 96848 - DNA, 601 bp, Human; identical to SEQ ID NO: 96582

SEQ ID NO: 96849 - DNA, 601 bp, Human; identical to SEQ ID NO: 96583

SEQ ID NO: 96850 - DNA, 601 bp, Human; identical to SEQ ID NO: 96584

SEQ ID NO: 96851 - DNA, 417 bp, Human; identical to SEQ ID NO: 96585

SEQ ID NO: 96852 - DNA, 480 bp, Human; identical to SEQ ID NO: 96586

SEQ ID NO: 96853 - DNA, 601 bp, Human; identical to SEQ ID NO: 96587

SEQ ID NO: 96854 - DNA, 601 bp, Human; identical to SEQ ID NO: 96588

SEQ ID NO: 96855 - DNA, 601 bp, Human; identical to SEQ ID NO: 96589

SEQ ID NO: 96856 - DNA, 601 bp, Human; identical to SEQ ID NO: 96590

SEQ ID NO: 96857 - DNA, 601 bp, Human; identical to SEQ ID NO: 96591

SEQ ID NO: 96858 - DNA, 601 bp, Human; identical to SEQ ID NO: 96592

SEQ ID NO: 96859 - DNA, 601 bp, Human; identical to SEQ ID NO: 96593

SEQ ID NO: 96860 - DNA, 601 bp, Human; identical to SEQ ID NO: 96594

SEQ ID NO: 96861 - DNA, 601 bp, Human; identical to SEQ ID NO: 96595

SEQ ID NO: 96862 - DNA, 601 bp, Human; identical to SEQ ID NO: 96596

SEQ ID NO: 96863 - DNA, 601 bp, Human; identical to SEQ ID NO: 96597

SEQ ID NO: 96864 - DNA, 601 bp, Human; identical to SEQ ID NO: 96598

SEQ ID NO: 96865 - DNA, 601 bp, Human; identical to SEQ ID NO: 96599

SEQ ID NO: 96866 - DNA, 601 bp, Human; identical to SEQ ID NO: 96600

SEQ ID NO: 96867 - DNA, 601 bp, Human; identical to SEQ ID NO: 96601

SEQ ID NO: 96868 - DNA, 601 bp, Human; identical to SEQ ID NO: 96602

SEQ ID NO: 96869 - DNA, 601 bp, Human; identical to SEQ ID NO: 96603

SEQ ID NO: 96870 - DNA, 601 bp, Human; identical to SEQ ID NO: 96604

SEQ ID NO: 96871 - DNA, 601 bp, Human; identical to SEQ ID NO: 96605

SEQ ID NO: 96872 - DNA, 601 bp, Human; identical to SEQ ID NO: 96606

SEQ ID NO: 96873 - DNA, 601 bp, Human; identical to SEQ ID NO: 96607

SEQ ID NO: 96874 - DNA, 601 bp, Human; identical to SEQ ID NO: 96608

SEQ ID NO: 96875 - DNA, 601 bp, Human; identical to SEQ ID NO: 96609

SEQ ID NO: 96876 - DNA, 601 bp, Human; identical to SEQ ID NO: 96610

SEQ ID NO: 96877 - DNA, 601 bp, Human; identical to SEQ ID NO: 96611

SEQ ID NO: 96878 - DNA, 601 bp, Human; identical to SEQ ID NO: 96612

SEQ ID NO: 96879 - DNA, 601 bp, Human; identical to SEQ ID NO: 96613

SEQ ID NO: 96880 - DNA, 601 bp, Human; identical to SEQ ID NO: 96614

SEQ ID NO: 96881 - DNA, 601 bp, Human; identical to SEQ ID NO: 96615

SEQ ID NO: 96882 - DNA, 601 bp, Human; identical to SEQ ID NO: 96616

SEQ ID NO: 96883 - DNA, 601 bp, Human; identical to SEQ ID NO: 96617

SEQ ID NO: 96884 - DNA, 601 bp, Human; identical to SEQ ID NO: 96618

SEQ ID NO: 96885 - DNA, 601 bp, Human; identical to SEQ ID NO: 96619

SEQ ID NO: 96886 - DNA, 601 bp, Human; identical to SEQ ID NO: 96620

SEQ ID NO: 96887 - DNA, 601 bp, Human; identical to SEQ ID NO: 96621

SEQ ID NO: 96888 - DNA, 601 bp, Human; identical to SEQ ID NO: 96622

SEQ ID NO: 96889 - DNA, 601 bp, Human; identical to SEQ ID NO: 96623

SEQ ID NO: 96890 - DNA, 601 bp, Human; identical to SEQ ID NO: 96624

SEQ ID NO: 96891 - DNA, 601 bp, Human; identical to SEQ ID NO: 96625

SEQ ID NO: 96892 - DNA, 601 bp, Human; identical to SEQ ID NO: 96626

SEQ ID NO: 96893 - DNA, 601 bp, Human; identical to SEQ ID NO: 96627

SEQ ID NO: 96894 - DNA, 601 bp, Human; identical to SEQ ID NO: 96628

SEQ ID NO: 96895 - DNA, 601 bp, Human; identical to SEQ ID NO: 96629

SEQ ID NO: 96896 - DNA, 601 bp, Human; identical to SEQ ID NO: 96630

SEQ ID NO: 96897 - DNA, 601 bp, Human; identical to SEQ ID NO: 96631

SEQ ID NO: 96898 - DNA, 601 bp, Human; identical to SEQ ID NO: 96632

SEQ ID NO: 96899 - DNA, 601 bp, Human; identical to SEQ ID NO: 96633

SEQ ID NO: 96900 - DNA, 601 bp, Human; identical to SEQ ID NO: 96634

SEQ ID NO: 96901 - DNA, 601 bp, Human; identical to SEQ ID NO: 96635

SEQ ID NO: 96902 - DNA, 601 bp, Human; identical to SEQ ID NO: 96636

SEQ ID NO: 96903 - DNA, 601 bp, Human; identical to SEQ ID NO: 96637

SEQ ID NO: 96904 - DNA, 601 bp, Human; identical to SEQ ID NO: 96638

SEQ ID NO: 96905 - DNA, 601 bp, Human; identical to SEQ ID NO: 96639

SEQ ID NO: 96906 - DNA, 601 bp, Human; identical to SEQ ID NO: 96640

SEQ ID NO: 96907 - DNA, 601 bp, Human; identical to SEQ ID NO: 96375

SEQ ID NO: 96908 - DNA, 601 bp, Human; identical to SEQ ID NO: 96376

SEQ ID NO: 96909 - DNA, 601 bp, Human; identical to SEQ ID NO: 96377

SEQ ID NO: 96910 - DNA, 601 bp, Human; identical to SEQ ID NO: 96378

SEQ ID NO: 96911 - DNA, 601 bp, Human; identical to SEQ ID NO: 96379

SEQ ID NO: 96912 - DNA, 601 bp, Human; identical to SEQ ID NO: 96380

SEQ ID NO: 96913 - DNA, 601 bp, Human; identical to SEQ ID NO: 96381

SEQ ID NO: 96914 - DNA, 601 bp, Human; identical to SEQ ID NO: 96382

SEQ ID NO: 96915 - DNA, 601 bp, Human; identical to SEQ ID NO: 96383

SEQ ID NO: 96916 - DNA, 601 bp, Human; identical to SEQ ID NO: 96384

SEQ ID NO: 96917 - DNA, 601 bp, Human; identical to SEQ ID NO: 96385

SEQ ID NO: 96918 - DNA, 601 bp, Human; identical to SEQ ID NO: 96386

SEQ ID NO: 96919 - DNA, 601 bp, Human; identical to SEQ ID NO: 96387

SEQ ID NO: 96920 - DNA, 601 bp, Human; identical to SEQ ID NO: 96388

SEQ ID NO: 96921 - DNA, 601 bp, Human; identical to SEQ ID NO: 96389

SEQ ID NO: 96922 - DNA, 601 bp, Human; identical to SEQ ID NO: 96390

SEQ ID NO: 96923 - DNA, 601 bp, Human; identical to SEQ ID NO: 96391

SEQ ID NO: 96924 - DNA, 601 bp, Human; identical to SEQ ID NO: 96392

SEQ ID NO: 96925 - DNA, 601 bp, Human; identical to SEQ ID NO: 96393

SEQ ID NO: 96926 - DNA, 601 bp, Human; identical to SEQ ID NO: 96394

SEQ ID NO: 96927 - DNA, 601 bp, Human; identical to SEQ ID NO: 96395

SEQ ID NO: 96928 - DNA, 601 bp, Human; identical to SEQ ID NO: 96396

SEQ ID NO: 96929 - DNA, 601 bp, Human; identical to SEQ ID NO: 96397

SEQ ID NO: 96930 - DNA, 601 bp, Human; identical to SEQ ID NO: 96398

SEQ ID NO: 96931 - DNA, 601 bp, Human; identical to SEQ ID NO: 96399

SEQ ID NO: 96932 - DNA, 601 bp, Human; identical to SEQ ID NO: 96400

SEQ ID NO: 96933 - DNA, 601 bp, Human; identical to SEQ ID NO: 96401

SEQ ID NO: 96934 - DNA, 601 bp, Human; identical to SEQ ID NO: 96402

SEQ ID NO: 96935 - DNA, 601 bp, Human; identical to SEQ ID NO: 96403

SEQ ID NO: 96936 - DNA, 601 bp, Human; identical to SEQ ID NO: 96404

SEQ ID NO: 96937 - DNA, 601 bp, Human; identical to SEQ ID NO: 96405

SEQ ID NO: 96938 - DNA, 601 bp, Human; identical to SEQ ID NO: 96406

SEQ ID NO: 96939 - DNA, 601 bp, Human; identical to SEQ ID NO: 96407

SEQ ID NO: 96940 - DNA, 601 bp, Human; identical to SEQ ID NO: 96408

SEQ ID NO: 96941 - DNA, 601 bp, Human; identical to SEQ ID NO: 96409

SEQ ID NO: 96942 - DNA, 601 bp, Human; identical to SEQ ID NO: 96410

SEQ ID NO: 96943 - DNA, 601 bp, Human; identical to SEQ ID NO: 96411

SEQ ID NO: 96944 - DNA, 601 bp, Human; identical to SEQ ID NO: 96412

SEQ ID NO: 96945 - DNA, 601 bp, Human; identical to SEQ ID NO: 96413

SEQ ID NO: 96946 - DNA, 601 bp, Human; identical to SEQ ID NO: 96414

SEQ ID NO: 96947 - DNA, 601 bp, Human; identical to SEQ ID NO: 96415

SEQ ID NO: 96948 - DNA, 601 bp, Human; identical to SEQ ID NO: 96416

SEQ ID NO: 96949 - DNA, 601 bp, Human; identical to SEQ ID NO: 96417

SEQ ID NO: 96950 - DNA, 601 bp, Human; identical to SEQ ID NO: 96418

SEQ ID NO: 96951 - DNA, 601 bp, Human; identical to SEQ ID NO: 96419

SEQ ID NO: 96952 - DNA, 601 bp, Human; identical to SEQ ID NO: 96420

SEQ ID NO: 96953 - DNA, 601 bp, Human; identical to SEQ ID NO: 96421

SEQ ID NO: 96954 - DNA, 601 bp, Human; identical to SEQ ID NO: 96422

SEQ ID NO: 96955 - DNA, 601 bp, Human; identical to SEQ ID NO: 96423

SEQ ID NO: 96956 - DNA, 601 bp, Human; identical to SEQ ID NO: 96424

SEQ ID NO: 96957 - DNA, 601 bp, Human; identical to SEQ ID NO: 96425

SEQ ID NO: 96958 - DNA, 601 bp, Human; identical to SEQ ID NO: 96426

SEQ ID NO: 96959 - DNA, 601 bp, Human; identical to SEQ ID NO: 96427

SEQ ID NO: 96960 - DNA, 601 bp, Human; identical to SEQ ID NO: 96428

SEQ ID NO: 96961 - DNA, 601 bp, Human; identical to SEQ ID NO: 96429

SEQ ID NO: 96962 - DNA, 601 bp, Human; identical to SEQ ID NO: 96430

SEQ ID NO: 96963 - DNA, 601 bp, Human; identical to SEQ ID NO: 96431

SEQ ID NO: 96964 - DNA, 601 bp, Human; identical to SEQ ID NO: 96432

SEQ ID NO: 96965 - DNA, 601 bp, Human; identical to SEQ ID NO: 96433

SEQ ID NO: 96966 - DNA, 601 bp, Human; identical to SEQ ID NO: 96434

SEQ ID NO: 96967 - DNA, 601 bp, Human; identical to SEQ ID NO: 96435

SEQ ID NO: 96968 - DNA, 601 bp, Human; identical to SEQ ID NO: 96436

SEQ ID NO: 96969 - DNA, 601 bp, Human; identical to SEQ ID NO: 96437

SEQ ID NO: 96970 - DNA, 601 bp, Human; identical to SEQ ID NO: 96438

SEQ ID NO: 96971 - DNA, 601 bp, Human; identical to SEQ ID NO: 96439

SEQ ID NO: 96972 - DNA, 601 bp, Human; identical to SEQ ID NO: 96440

SEQ ID NO: 96973 - DNA, 601 bp, Human; identical to SEQ ID NO: 96441

SEQ ID NO: 96974 - DNA, 601 bp, Human; identical to SEQ ID NO: 96442

SEQ ID NO: 96975 - DNA, 601 bp, Human; identical to SEQ ID NO: 96443

SEQ ID NO: 96976 - DNA, 601 bp, Human; identical to SEQ ID NO: 96444

SEQ ID NO: 96977 - DNA, 601 bp, Human; identical to SEQ ID NO: 96445

SEQ ID NO: 96978 - DNA, 601 bp, Human; identical to SEQ ID NO: 96446

SEQ ID NO: 96979 - DNA, 601 bp, Human; identical to SEQ ID NO: 96447

SEQ ID NO: 96980 - DNA, 601 bp, Human; identical to SEQ ID NO: 96448

SEQ ID NO: 96981 - DNA, 601 bp, Human; identical to SEQ ID NO: 96449

SEQ ID NO: 96982 - DNA, 601 bp, Human; identical to SEQ ID NO: 96450

SEQ ID NO: 96983 - DNA, 601 bp, Human; identical to SEQ ID NO: 96451

SEQ ID NO: 96984 - DNA, 601 bp, Human; identical to SEQ ID NO: 96452

SEQ ID NO: 96985 - DNA, 601 bp, Human; identical to SEQ ID NO: 96453

SEQ ID NO: 96986 - DNA, 601 bp, Human; identical to SEQ ID NO: 96454

SEQ ID NO: 96987 - DNA, 601 bp, Human; identical to SEQ ID NO: 96455

SEQ ID NO: 96988 - DNA, 601 bp, Human; identical to SEQ ID NO: 96456

SEQ ID NO: 96989 - DNA, 601 bp, Human; identical to SEQ ID NO: 96457

SEQ ID NO: 96990 - DNA, 601 bp, Human; identical to SEQ ID NO: 96458

SEQ ID NO: 96991 - DNA, 601 bp, Human; identical to SEQ ID NO: 96459

SEQ ID NO: 96992 - DNA, 601 bp, Human; identical to SEQ ID NO: 96460

SEQ ID NO: 96993 - DNA, 601 bp, Human; identical to SEQ ID NO: 96461

SEQ ID NO: 96994 - DNA, 601 bp, Human; identical to SEQ ID NO: 96462

SEQ ID NO: 96995 - DNA, 601 bp, Human; identical to SEQ ID NO: 96463

SEQ ID NO: 96996 - DNA, 601 bp, Human; identical to SEQ ID NO: 96464

SEQ ID NO: 96997 - DNA, 601 bp, Human; identical to SEQ ID NO: 96465

SEQ ID NO: 96998 - DNA, 601 bp, Human; identical to SEQ ID NO: 96466

SEQ ID NO: 96999 - DNA, 601 bp, Human; identical to SEQ ID NO: 96467

SEQ ID NO: 97000 - DNA, 601 bp, Human; identical to SEQ ID NO: 96468

SEQ ID NO: 97001 - DNA, 601 bp, Human; identical to SEQ ID NO: 96469

SEQ ID NO: 97002 - DNA, 601 bp, Human; identical to SEQ ID NO: 96470

SEQ ID NO: 97003 - DNA, 601 bp, Human; identical to SEQ ID NO: 96471

SEQ ID NO: 97004 - DNA, 601 bp, Human; identical to SEQ ID NO: 96472

SEQ ID NO: 97005 - DNA, 601 bp, Human; identical to SEQ ID NO: 96473

SEQ ID NO: 97006 - DNA, 601 bp, Human; identical to SEQ ID NO: 96474

SEQ ID NO: 97007 - DNA, 601 bp, Human; identical to SEQ ID NO: 96475

SEQ ID NO: 97008 - DNA, 601 bp, Human; identical to SEQ ID NO: 96476

SEQ ID NO: 97009 - DNA, 601 bp, Human; identical to SEQ ID NO: 96477

SEQ ID NO: 97010 - DNA, 601 bp, Human; identical to SEQ ID NO: 96478

SEQ ID NO: 97011 - DNA, 601 bp, Human; identical to SEQ ID NO: 96479

SEQ ID NO: 97012 - DNA, 601 bp, Human; identical to SEQ ID NO: 96480

SEQ ID NO: 97013 - DNA, 601 bp, Human; identical to SEQ ID NO: 96481

SEQ ID NO: 97014 - DNA, 601 bp, Human; identical to SEQ ID NO: 96482

SEQ ID NO: 97015 - DNA, 601 bp, Human; identical to SEQ ID NO: 96483

SEQ ID NO: 97016 - DNA, 601 bp, Human; identical to SEQ ID NO: 96484

SEQ ID NO: 97017 - DNA, 601 bp, Human; identical to SEQ ID NO: 96485

SEQ ID NO: 97018 - DNA, 601 bp, Human; identical to SEQ ID NO: 96486

SEQ ID NO: 97019 - DNA, 601 bp, Human; identical to SEQ ID NO: 96487

SEQ ID NO: 97020 - DNA, 601 bp, Human; identical to SEQ ID NO: 96488

SEQ ID NO: 97021 - DNA, 601 bp, Human; identical to SEQ ID NO: 96489

SEQ ID NO: 97022 - DNA, 601 bp, Human; identical to SEQ ID NO: 96490

SEQ ID NO: 97023 - DNA, 601 bp, Human; identical to SEQ ID NO: 96491

SEQ ID NO: 97024 - DNA, 601 bp, Human; identical to SEQ ID NO: 96492

SEQ ID NO: 97025 - DNA, 601 bp, Human; identical to SEQ ID NO: 96493

SEQ ID NO: 97026 - DNA, 601 bp, Human; identical to SEQ ID NO: 96494

SEQ ID NO: 97027 - DNA, 601 bp, Human; identical to SEQ ID NO: 96495

SEQ ID NO: 97028 - DNA, 601 bp, Human; identical to SEQ ID NO: 96496

SEQ ID NO: 97029 - DNA, 601 bp, Human; identical to SEQ ID NO: 96497

SEQ ID NO: 97030 - DNA, 601 bp, Human; identical to SEQ ID NO: 96498

SEQ ID NO: 97031 - DNA, 601 bp, Human; identical to SEQ ID NO: 96499

SEQ ID NO: 97032 - DNA, 601 bp, Human; identical to SEQ ID NO: 96500

SEQ ID NO: 97033 - DNA, 601 bp, Human; identical to SEQ ID NO: 96501

SEQ ID NO: 97034 - DNA, 601 bp, Human; identical to SEQ ID NO: 96502

SEQ ID NO: 97035 - DNA, 601 bp, Human; identical to SEQ ID NO: 96503

SEQ ID NO: 97036 - DNA, 601 bp, Human; identical to SEQ ID NO: 96504

SEQ ID NO: 97037 - DNA, 601 bp, Human; identical to SEQ ID NO: 96505

SEQ ID NO: 97038 - DNA, 601 bp, Human; identical to SEQ ID NO: 96506

SEQ ID NO: 97039 - DNA, 601 bp, Human; identical to SEQ ID NO: 96507

SEQ ID NO: 97040 - DNA, 601 bp, Human; identical to SEQ ID NO: 96508

SEQ ID NO: 97041 - DNA, 601 bp, Human; identical to SEQ ID NO: 96509

SEQ ID NO: 97042 - DNA, 601 bp, Human; identical to SEQ ID NO: 96510

SEQ ID NO: 97043 - DNA, 601 bp, Human; identical to SEQ ID NO: 96511

SEQ ID NO: 97044 - DNA, 601 bp, Human; identical to SEQ ID NO: 96512

SEQ ID NO: 97045 - DNA, 601 bp, Human; identical to SEQ ID NO: 96513

SEQ ID NO: 97046 - DNA, 601 bp, Human; identical to SEQ ID NO: 96514

SEQ ID NO: 97047 - DNA, 601 bp, Human; identical to SEQ ID NO: 96515

SEQ ID NO: 97048 - DNA, 601 bp, Human; identical to SEQ ID NO: 96516

SEQ ID NO: 97049 - DNA, 601 bp, Human; identical to SEQ ID NO: 96517

SEQ ID NO: 97050 - DNA, 601 bp, Human; identical to SEQ ID NO: 96518

SEQ ID NO: 97051 - DNA, 601 bp, Human; identical to SEQ ID NO: 96519

SEQ ID NO: 97052 - DNA, 601 bp, Human; identical to SEQ ID NO: 96520

SEQ ID NO: 97053 - DNA, 601 bp, Human; identical to SEQ ID NO: 96521

SEQ ID NO: 97054 - DNA, 601 bp, Human; identical to SEQ ID NO: 96522

SEQ ID NO: 97055 - DNA, 601 bp, Human; identical to SEQ ID NO: 96523

SEQ ID NO: 97056 - DNA, 601 bp, Human; identical to SEQ ID NO: 96524

SEQ ID NO: 97057 - DNA, 601 bp, Human; identical to SEQ ID NO: 96525

SEQ ID NO: 97058 - DNA, 601 bp, Human; identical to SEQ ID NO: 96526

SEQ ID NO: 97059 - DNA, 601 bp, Human; identical to SEQ ID NO: 96527

SEQ ID NO: 97060 - DNA, 601 bp, Human; identical to SEQ ID NO: 96528

SEQ ID NO: 97061 - DNA, 601 bp, Human; identical to SEQ ID NO: 96529

SEQ ID NO: 97062 - DNA, 601 bp, Human; identical to SEQ ID NO: 96530

SEQ ID NO: 97063 - DNA, 601 bp, Human; identical to SEQ ID NO: 96531

SEQ ID NO: 97064 - DNA, 601 bp, Human; identical to SEQ ID NO: 96532

SEQ ID NO: 97065 - DNA, 601 bp, Human; identical to SEQ ID NO: 96533

SEQ ID NO: 97066 - DNA, 601 bp, Human; identical to SEQ ID NO: 96534

SEQ ID NO: 97067 - DNA, 601 bp, Human; identical to SEQ ID NO: 96535

SEQ ID NO: 97068 - DNA, 601 bp, Human; identical to SEQ ID NO: 96536

SEQ ID NO: 97069 - DNA, 601 bp, Human; identical to SEQ ID NO: 96537

SEQ ID NO: 97070 - DNA, 601 bp, Human; identical to SEQ ID NO: 96538

SEQ ID NO: 97071 - DNA, 601 bp, Human; identical to SEQ ID NO: 96539

SEQ ID NO: 97072 - DNA, 601 bp, Human; identical to SEQ ID NO: 96540

SEQ ID NO: 97073 - DNA, 601 bp, Human; identical to SEQ ID NO: 96541

SEQ ID NO: 97074 - DNA, 601 bp, Human; identical to SEQ ID NO: 96542

SEQ ID NO: 97075 - DNA, 601 bp, Human; identical to SEQ ID NO: 96543

SEQ ID NO: 97076 - DNA, 601 bp, Human; identical to SEQ ID NO: 96544

SEQ ID NO: 97077 - DNA, 601 bp, Human; identical to SEQ ID NO: 96545

SEQ ID NO: 97078 - DNA, 601 bp, Human; identical to SEQ ID NO: 96546

SEQ ID NO: 97079 - DNA, 601 bp, Human; identical to SEQ ID NO: 96547

SEQ ID NO: 97080 - DNA, 601 bp, Human; identical to SEQ ID NO: 96548

SEQ ID NO: 97081 - DNA, 601 bp, Human; identical to SEQ ID NO: 96549

SEQ ID NO: 97082 - DNA, 601 bp, Human; identical to SEQ ID NO: 96550

SEQ ID NO: 97083 - DNA, 601 bp, Human; identical to SEQ ID NO: 96551

SEQ ID NO: 97084 - DNA, 601 bp, Human; identical to SEQ ID NO: 96552

SEQ ID NO: 97085 - DNA, 601 bp, Human; identical to SEQ ID NO: 96553

SEQ ID NO: 97086 - DNA, 601 bp, Human; identical to SEQ ID NO: 96554

SEQ ID NO: 97087 - DNA, 601 bp, Human; identical to SEQ ID NO: 96555

SEQ ID NO: 97088 - DNA, 601 bp, Human; identical to SEQ ID NO: 96556

SEQ ID NO: 97089 - DNA, 601 bp, Human; identical to SEQ ID NO: 96557

SEQ ID NO: 97090 - DNA, 601 bp, Human; identical to SEQ ID NO: 96558

SEQ ID NO: 97091 - DNA, 601 bp, Human; identical to SEQ ID NO: 96559

SEQ ID NO: 97092 - DNA, 601 bp, Human; identical to SEQ ID NO: 96560

SEQ ID NO: 97093 - DNA, 601 bp, Human; identical to SEQ ID NO: 96561

SEQ ID NO: 97094 - DNA, 601 bp, Human; identical to SEQ ID NO: 96562

SEQ ID NO: 97095 - DNA, 601 bp, Human; identical to SEQ ID NO: 96563

SEQ ID NO: 97096 - DNA, 601 bp, Human; identical to SEQ ID NO: 96564

SEQ ID NO: 97097 - DNA, 601 bp, Human; identical to SEQ ID NO: 96565

SEQ ID NO: 97098 - DNA, 601 bp, Human; identical to SEQ ID NO: 96566

SEQ ID NO: 97099 - DNA, 601 bp, Human; identical to SEQ ID NO: 96567

SEQ ID NO: 97100 - DNA, 601 bp, Human; identical to SEQ ID NO: 96568

SEQ ID NO: 97101 - DNA, 601 bp, Human; identical to SEQ ID NO: 96569

SEQ ID NO: 97102 - DNA, 601 bp, Human; identical to SEQ ID NO: 96570

SEQ ID NO: 97103 - DNA, 601 bp, Human; identical to SEQ ID NO: 96571

SEQ ID NO: 97104 - DNA, 601 bp, Human; identical to SEQ ID NO: 96572

SEQ ID NO: 97105 - DNA, 601 bp, Human; identical to SEQ ID NO: 96573

SEQ ID NO: 97106 - DNA, 601 bp, Human; identical to SEQ ID NO: 96574

SEQ ID NO: 97107 - DNA, 601 bp, Human; identical to SEQ ID NO: 96575

SEQ ID NO: 97108 - DNA, 601 bp, Human; identical to SEQ ID NO: 96576

SEQ ID NO: 97109 - DNA, 601 bp, Human; identical to SEQ ID NO: 96577

SEQ ID NO: 97110 - DNA, 601 bp, Human; identical to SEQ ID NO: 96578

SEQ ID NO: 97111 - DNA, 601 bp, Human; identical to SEQ ID NO: 96579

SEQ ID NO: 97112 - DNA, 601 bp, Human; identical to SEQ ID NO: 96580

SEQ ID NO: 97113 - DNA, 601 bp, Human; identical to SEQ ID NO: 96581

SEQ ID NO: 97114 - DNA, 601 bp, Human; identical to SEQ ID NO: 96582

SEQ ID NO: 97115 - DNA, 601 bp, Human; identical to SEQ ID NO: 96583

SEQ ID NO: 97116 - DNA, 601 bp, Human; identical to SEQ ID NO: 96584

SEQ ID NO: 97117 - DNA, 417 bp, Human; identical to SEQ ID NO: 96585

SEQ ID NO: 97118 - DNA, 480 bp, Human; identical to SEQ ID NO: 96586

SEQ ID NO: 97119 - DNA, 601 bp, Human; identical to SEQ ID NO: 96587

SEQ ID NO: 97120 - DNA, 601 bp, Human; identical to SEQ ID NO: 96588

SEQ ID NO: 97121 - DNA, 601 bp, Human; identical to SEQ ID NO: 96589

SEQ ID NO: 97122 - DNA, 601 bp, Human; identical to SEQ ID NO: 96590

SEQ ID NO: 97123 - DNA, 601 bp, Human; identical to SEQ ID NO: 96591

SEQ ID NO: 97124 - DNA, 601 bp, Human; identical to SEQ ID NO: 96592

SEQ ID NO: 97125 - DNA, 601 bp, Human; identical to SEQ ID NO: 96593

SEQ ID NO: 97126 - DNA, 601 bp, Human; identical to SEQ ID NO: 96594

SEQ ID NO: 97127 - DNA, 601 bp, Human; identical to SEQ ID NO: 96595

SEQ ID NO: 97128 - DNA, 601 bp, Human; identical to SEQ ID NO: 96596

SEQ ID NO: 97129 - DNA, 601 bp, Human; identical to SEQ ID NO: 96597

SEQ ID NO: 97130 - DNA, 601 bp, Human; identical to SEQ ID NO: 96598

SEQ ID NO: 97131 - DNA, 601 bp, Human; identical to SEQ ID NO: 96599

SEQ ID NO: 97132 - DNA, 601 bp, Human; identical to SEQ ID NO: 96600

SEQ ID NO: 97133 - DNA, 601 bp, Human; identical to SEQ ID NO: 96601

SEQ ID NO: 97134 - DNA, 601 bp, Human; identical to SEQ ID NO: 96602

SEQ ID NO: 97135 - DNA, 601 bp, Human; identical to SEQ ID NO: 96603

SEQ ID NO: 97136 - DNA, 601 bp, Human; identical to SEQ ID NO: 96604

SEQ ID NO: 97137 - DNA, 601 bp, Human; identical to SEQ ID NO: 96605

SEQ ID NO: 97138 - DNA, 601 bp, Human; identical to SEQ ID NO: 96606

SEQ ID NO: 97139 - DNA, 601 bp, Human; identical to SEQ ID NO: 96607

SEQ ID NO: 97140 - DNA, 601 bp, Human; identical to SEQ ID NO: 96608

SEQ ID NO: 97141 - DNA, 601 bp, Human; identical to SEQ ID NO: 96609

SEQ ID NO: 97142 - DNA, 601 bp, Human; identical to SEQ ID NO: 96610

SEQ ID NO: 97143 - DNA, 601 bp, Human; identical to SEQ ID NO: 96611

SEQ ID NO: 97144 - DNA, 601 bp, Human; identical to SEQ ID NO: 96612

SEQ ID NO: 97145 - DNA, 601 bp, Human; identical to SEQ ID NO: 96613

SEQ ID NO: 97146 - DNA, 601 bp, Human; identical to SEQ ID NO: 96614

SEQ ID NO: 97147 - DNA, 601 bp, Human; identical to SEQ ID NO: 96615

SEQ ID NO: 97148 - DNA, 601 bp, Human; identical to SEQ ID NO: 96616

SEQ ID NO: 97149 - DNA, 601 bp, Human; identical to SEQ ID NO: 96617

SEQ ID NO: 97150 - DNA, 601 bp, Human; identical to SEQ ID NO: 96618

SEQ ID NO: 97151 - DNA, 601 bp, Human; identical to SEQ ID NO: 96619

SEQ ID NO: 97152 - DNA, 601 bp, Human; identical to SEQ ID NO: 96620

SEQ ID NO: 97153 - DNA, 601 bp, Human; identical to SEQ ID NO: 96621

SEQ ID NO: 97154 - DNA, 601 bp, Human; identical to SEQ ID NO: 96622

SEQ ID NO: 97155 - DNA, 601 bp, Human; identical to SEQ ID NO: 96623

SEQ ID NO: 97156 - DNA, 601 bp, Human; identical to SEQ ID NO: 96624

SEQ ID NO: 97157 - DNA, 601 bp, Human; identical to SEQ ID NO: 96625

SEQ ID NO: 97158 - DNA, 601 bp, Human; identical to SEQ ID NO: 96626

SEQ ID NO: 97159 - DNA, 601 bp, Human; identical to SEQ ID NO: 96627

SEQ ID NO: 97160 - DNA, 601 bp, Human; identical to SEQ ID NO: 96628

SEQ ID NO: 97161 - DNA, 601 bp, Human; identical to SEQ ID NO: 96629

SEQ ID NO: 97162 - DNA, 601 bp, Human; identical to SEQ ID NO: 96630

SEQ ID NO: 97163 - DNA, 601 bp, Human; identical to SEQ ID NO: 96631

SEQ ID NO: 97164 - DNA, 601 bp, Human; identical to SEQ ID NO: 96632

SEQ ID NO: 97165 - DNA, 601 bp, Human; identical to SEQ ID NO: 96633

SEQ ID NO: 97166 - DNA, 601 bp, Human; identical to SEQ ID NO: 96634

SEQ ID NO: 97167 - DNA, 601 bp, Human; identical to SEQ ID NO: 96635

SEQ ID NO: 97168 - DNA, 601 bp, Human; identical to SEQ ID NO: 96636

SEQ ID NO: 97169 - DNA, 601 bp, Human; identical to SEQ ID NO: 96637

SEQ ID NO: 97170 - DNA, 601 bp, Human; identical to SEQ ID NO: 96638

SEQ ID NO: 97171 - DNA, 601 bp, Human; identical to SEQ ID NO: 96639

SEQ ID NO: 97172 - DNA, 601 bp, Human; identical to SEQ ID NO: 96640

SEQ ID NO: 97173 - DNA, 601 bp, Human; identical to SEQ ID NO: 96375

SEQ ID NO: 97174 - DNA, 601 bp, Human; identical to SEQ ID NO: 96376

SEQ ID NO: 97175 - DNA, 601 bp, Human; identical to SEQ ID NO: 96377

SEQ ID NO: 97176 - DNA, 601 bp, Human; identical to SEQ ID NO: 96378

SEQ ID NO: 97177 - DNA, 601 bp, Human; identical to SEQ ID NO: 96379

SEQ ID NO: 97178 - DNA, 601 bp, Human; identical to SEQ ID NO: 96380

SEQ ID NO: 97179 - DNA, 601 bp, Human; identical to SEQ ID NO: 96381

SEQ ID NO: 97180 - DNA, 601 bp, Human; identical to SEQ ID NO: 96382

SEQ ID NO: 97181 - DNA, 601 bp, Human; identical to SEQ ID NO: 96383

SEQ ID NO: 97182 - DNA, 601 bp, Human; identical to SEQ ID NO: 96384

SEQ ID NO: 97183 - DNA, 601 bp, Human; identical to SEQ ID NO: 96385

SEQ ID NO: 97184 - DNA, 601 bp, Human; identical to SEQ ID NO: 96386

SEQ ID NO: 97185 - DNA, 601 bp, Human; identical to SEQ ID NO: 96387

SEQ ID NO: 97186 - DNA, 601 bp, Human; identical to SEQ ID NO: 96388

SEQ ID NO: 97187 - DNA, 601 bp, Human; identical to SEQ ID NO: 96389

SEQ ID NO: 97188 - DNA, 601 bp, Human; identical to SEQ ID NO: 96390

SEQ ID NO: 97189 - DNA, 601 bp, Human; identical to SEQ ID NO: 96391

SEQ ID NO: 97190 - DNA, 601 bp, Human; identical to SEQ ID NO: 96392

SEQ ID NO: 97191 - DNA, 601 bp, Human; identical to SEQ ID NO: 96393

SEQ ID NO: 97192 - DNA, 601 bp, Human; identical to SEQ ID NO: 96394

SEQ ID NO: 97193 - DNA, 601 bp, Human; identical to SEQ ID NO: 96395

SEQ ID NO: 97194 - DNA, 601 bp, Human; identical to SEQ ID NO: 96396

SEQ ID NO: 97195 - DNA, 601 bp, Human; identical to SEQ ID NO: 96397

SEQ ID NO: 97196 - DNA, 601 bp, Human; identical to SEQ ID NO: 96398

SEQ ID NO: 97197 - DNA, 601 bp, Human; identical to SEQ ID NO: 96399

SEQ ID NO: 97198 - DNA, 601 bp, Human; identical to SEQ ID NO: 96400

SEQ ID NO: 97199 - DNA, 601 bp, Human; identical to SEQ ID NO: 96401

SEQ ID NO: 97200 - DNA, 601 bp, Human; identical to SEQ ID NO: 96402

SEQ ID NO: 97201 - DNA, 601 bp, Human; identical to SEQ ID NO: 96403

SEQ ID NO: 97202 - DNA, 601 bp, Human; identical to SEQ ID NO: 96404

SEQ ID NO: 97203 - DNA, 601 bp, Human; identical to SEQ ID NO: 96405

SEQ ID NO: 97204 - DNA, 601 bp, Human; identical to SEQ ID NO: 96406

SEQ ID NO: 97205 - DNA, 601 bp, Human; identical to SEQ ID NO: 96407

SEQ ID NO: 97206 - DNA, 601 bp, Human; identical to SEQ ID NO: 96408

SEQ ID NO: 97207 - DNA, 601 bp, Human; identical to SEQ ID NO: 96409

SEQ ID NO: 97208 - DNA, 601 bp, Human; identical to SEQ ID NO: 96410

SEQ ID NO: 97209 - DNA, 601 bp, Human; identical to SEQ ID NO: 96411

SEQ ID NO: 97210 - DNA, 601 bp, Human; identical to SEQ ID NO: 96412

SEQ ID NO: 97211 - DNA, 601 bp, Human; identical to SEQ ID NO: 96413

SEQ ID NO: 97212 - DNA, 601 bp, Human; identical to SEQ ID NO: 96414

SEQ ID NO: 97213 - DNA, 601 bp, Human; identical to SEQ ID NO: 96415

SEQ ID NO: 97214 - DNA, 601 bp, Human; identical to SEQ ID NO: 96416

SEQ ID NO: 97215 - DNA, 601 bp, Human; identical to SEQ ID NO: 96417

SEQ ID NO: 97216 - DNA, 601 bp, Human; identical to SEQ ID NO: 96418

SEQ ID NO: 97217 - DNA, 601 bp, Human; identical to SEQ ID NO: 96419

SEQ ID NO: 97218 - DNA, 601 bp, Human; identical to SEQ ID NO: 96420

SEQ ID NO: 97219 - DNA, 601 bp, Human; identical to SEQ ID NO: 96421

SEQ ID NO: 97220 - DNA, 601 bp, Human; identical to SEQ ID NO: 96422

SEQ ID NO: 97221 - DNA, 601 bp, Human; identical to SEQ ID NO: 96423

SEQ ID NO: 97222 - DNA, 601 bp, Human; identical to SEQ ID NO: 96424

SEQ ID NO: 97223 - DNA, 601 bp, Human; identical to SEQ ID NO: 96425

SEQ ID NO: 97224 - DNA, 601 bp, Human; identical to SEQ ID NO: 96426

SEQ ID NO: 97225 - DNA, 601 bp, Human; identical to SEQ ID NO: 96427

SEQ ID NO: 97226 - DNA, 601 bp, Human; identical to SEQ ID NO: 96428

SEQ ID NO: 97227 - DNA, 601 bp, Human; identical to SEQ ID NO: 96429

SEQ ID NO: 97228 - DNA, 601 bp, Human; identical to SEQ ID NO: 96430

SEQ ID NO: 97229 - DNA, 601 bp, Human; identical to SEQ ID NO: 96431

SEQ ID NO: 97230 - DNA, 601 bp, Human; identical to SEQ ID NO: 96432

SEQ ID NO: 97231 - DNA, 601 bp, Human; identical to SEQ ID NO: 96433

SEQ ID NO: 97232 - DNA, 601 bp, Human; identical to SEQ ID NO: 96434

SEQ ID NO: 97233 - DNA, 601 bp, Human; identical to SEQ ID NO: 96435

SEQ ID NO: 97234 - DNA, 601 bp, Human; identical to SEQ ID NO: 96436

SEQ ID NO: 97235 - DNA, 601 bp, Human; identical to SEQ ID NO: 96437

SEQ ID NO: 97236 - DNA, 601 bp, Human; identical to SEQ ID NO: 96438

SEQ ID NO: 97237 - DNA, 601 bp, Human; identical to SEQ ID NO: 96439

SEQ ID NO: 97238 - DNA, 601 bp, Human; identical to SEQ ID NO: 96440

SEQ ID NO: 97239 - DNA, 601 bp, Human; identical to SEQ ID NO: 96441

SEQ ID NO: 97240 - DNA, 601 bp, Human; identical to SEQ ID NO: 96442

SEQ ID NO: 97241 - DNA, 601 bp, Human; identical to SEQ ID NO: 96443

SEQ ID NO: 97242 - DNA, 601 bp, Human; identical to SEQ ID NO: 96444

SEQ ID NO: 97243 - DNA, 601 bp, Human; identical to SEQ ID NO: 96445

SEQ ID NO: 97244 - DNA, 601 bp, Human; identical to SEQ ID NO: 96446

SEQ ID NO: 97245 - DNA, 601 bp, Human; identical to SEQ ID NO: 96447

SEQ ID NO: 97246 - DNA, 601 bp, Human; identical to SEQ ID NO: 96448

SEQ ID NO: 97247 - DNA, 601 bp, Human; identical to SEQ ID NO: 96449

SEQ ID NO: 97248 - DNA, 601 bp, Human; identical to SEQ ID NO: 96450

SEQ ID NO: 97249 - DNA, 601 bp, Human; identical to SEQ ID NO: 96451

SEQ ID NO: 97250 - DNA, 601 bp, Human; identical to SEQ ID NO: 96452

SEQ ID NO: 97251 - DNA, 601 bp, Human; identical to SEQ ID NO: 96453

SEQ ID NO: 97252 - DNA, 601 bp, Human; identical to SEQ ID NO: 96454

SEQ ID NO: 97253 - DNA, 601 bp, Human; identical to SEQ ID NO: 96455

SEQ ID NO: 97254 - DNA, 601 bp, Human; identical to SEQ ID NO: 96456

SEQ ID NO: 97255 - DNA, 601 bp, Human; identical to SEQ ID NO: 96457

SEQ ID NO: 97256 - DNA, 601 bp, Human; identical to SEQ ID NO: 96458

SEQ ID NO: 97257 - DNA, 601 bp, Human; identical to SEQ ID NO: 96459

SEQ ID NO: 97258 - DNA, 601 bp, Human; identical to SEQ ID NO: 96460

SEQ ID NO: 97259 - DNA, 601 bp, Human; identical to SEQ ID NO: 96461

SEQ ID NO: 97260 - DNA, 601 bp, Human; identical to SEQ ID NO: 96462

SEQ ID NO: 97261 - DNA, 601 bp, Human; identical to SEQ ID NO: 96463

SEQ ID NO: 97262 - DNA, 601 bp, Human; identical to SEQ ID NO: 96464

SEQ ID NO: 97263 - DNA, 601 bp, Human; identical to SEQ ID NO: 96465

SEQ ID NO: 97264 - DNA, 601 bp, Human; identical to SEQ ID NO: 96466

SEQ ID NO: 97265 - DNA, 601 bp, Human; identical to SEQ ID NO: 96467

SEQ ID NO: 97266 - DNA, 601 bp, Human; identical to SEQ ID NO: 96468

SEQ ID NO: 97267 - DNA, 601 bp, Human; identical to SEQ ID NO: 96469

SEQ ID NO: 97268 - DNA, 601 bp, Human; identical to SEQ ID NO: 96470

SEQ ID NO: 97269 - DNA, 601 bp, Human; identical to SEQ ID NO: 96471

SEQ ID NO: 97270 - DNA, 601 bp, Human; identical to SEQ ID NO: 96472

SEQ ID NO: 97271 - DNA, 601 bp, Human; identical to SEQ ID NO: 96473

SEQ ID NO: 97272 - DNA, 601 bp, Human; identical to SEQ ID NO: 96474

SEQ ID NO: 97273 - DNA, 601 bp, Human; identical to SEQ ID NO: 96475

SEQ ID NO: 97274 - DNA, 601 bp, Human; identical to SEQ ID NO: 96476

SEQ ID NO: 97275 - DNA, 601 bp, Human; identical to SEQ ID NO: 96477

SEQ ID NO: 97276 - DNA, 601 bp, Human; identical to SEQ ID NO: 96478

SEQ ID NO: 97277 - DNA, 601 bp, Human; identical to SEQ ID NO: 96479

SEQ ID NO: 97278 - DNA, 601 bp, Human; identical to SEQ ID NO: 96480

SEQ ID NO: 97279 - DNA, 601 bp, Human; identical to SEQ ID NO: 96481

SEQ ID NO: 97280 - DNA, 601 bp, Human; identical to SEQ ID NO: 96482

SEQ ID NO: 97281 - DNA, 601 bp, Human; identical to SEQ ID NO: 96483

SEQ ID NO: 97282 - DNA, 601 bp, Human; identical to SEQ ID NO: 96484

SEQ ID NO: 97283 - DNA, 601 bp, Human; identical to SEQ ID NO: 96485

SEQ ID NO: 97284 - DNA, 601 bp, Human; identical to SEQ ID NO: 96486

SEQ ID NO: 97285 - DNA, 601 bp, Human; identical to SEQ ID NO: 96487

SEQ ID NO: 97286 - DNA, 601 bp, Human; identical to SEQ ID NO: 96488

SEQ ID NO: 97287 - DNA, 601 bp, Human; identical to SEQ ID NO: 96489

SEQ ID NO: 97288 - DNA, 601 bp, Human; identical to SEQ ID NO: 96490

SEQ ID NO: 97289 - DNA, 601 bp, Human; identical to SEQ ID NO: 96491

SEQ ID NO: 97290 - DNA, 601 bp, Human; identical to SEQ ID NO: 96492

SEQ ID NO: 97291 - DNA, 601 bp, Human; identical to SEQ ID NO: 96493

SEQ ID NO: 97292 - DNA, 601 bp, Human; identical to SEQ ID NO: 96494

SEQ ID NO: 97293 - DNA, 601 bp, Human; identical to SEQ ID NO: 96495

SEQ ID NO: 97294 - DNA, 601 bp, Human; identical to SEQ ID NO: 96496

SEQ ID NO: 97295 - DNA, 601 bp, Human; identical to SEQ ID NO: 96497

SEQ ID NO: 97296 - DNA, 601 bp, Human; identical to SEQ ID NO: 96498

SEQ ID NO: 97297 - DNA, 601 bp, Human; identical to SEQ ID NO: 96499

SEQ ID NO: 97298 - DNA, 601 bp, Human; identical to SEQ ID NO: 96500

SEQ ID NO: 97299 - DNA, 601 bp, Human; identical to SEQ ID NO: 96501

SEQ ID NO: 97300 - DNA, 601 bp, Human; identical to SEQ ID NO: 96502

SEQ ID NO: 97301 - DNA, 601 bp, Human; identical to SEQ ID NO: 96503

SEQ ID NO: 97302 - DNA, 601 bp, Human; identical to SEQ ID NO: 96504

SEQ ID NO: 97303 - DNA, 601 bp, Human; identical to SEQ ID NO: 96505

SEQ ID NO: 97304 - DNA, 601 bp, Human; identical to SEQ ID NO: 96506

SEQ ID NO: 97305 - DNA, 601 bp, Human; identical to SEQ ID NO: 96507

SEQ ID NO: 97306 - DNA, 601 bp, Human; identical to SEQ ID NO: 96508

SEQ ID NO: 97307 - DNA, 601 bp, Human; identical to SEQ ID NO: 96509

SEQ ID NO: 97308 - DNA, 601 bp, Human; identical to SEQ ID NO: 96510

SEQ ID NO: 97309 - DNA, 601 bp, Human; identical to SEQ ID NO: 96511

SEQ ID NO: 97310 - DNA, 601 bp, Human; identical to SEQ ID NO: 96512

SEQ ID NO: 97311 - DNA, 601 bp, Human; identical to SEQ ID NO: 96513

SEQ ID NO: 97312 - DNA, 601 bp, Human; identical to SEQ ID NO: 96514

SEQ ID NO: 97313 - DNA, 601 bp, Human; identical to SEQ ID NO: 96515

SEQ ID NO: 97314 - DNA, 601 bp, Human; identical to SEQ ID NO: 96516

SEQ ID NO: 97315 - DNA, 601 bp, Human; identical to SEQ ID NO: 96517

SEQ ID NO: 97316 - DNA, 601 bp, Human; identical to SEQ ID NO: 96518

SEQ ID NO: 97317 - DNA, 601 bp, Human; identical to SEQ ID NO: 96519

SEQ ID NO: 97318 - DNA, 601 bp, Human; identical to SEQ ID NO: 96520

SEQ ID NO: 97319 - DNA, 601 bp, Human; identical to SEQ ID NO: 96521

SEQ ID NO: 97320 - DNA, 601 bp, Human; identical to SEQ ID NO: 96522

SEQ ID NO: 97321 - DNA, 601 bp, Human; identical to SEQ ID NO: 96523

SEQ ID NO: 97322 - DNA, 601 bp, Human; identical to SEQ ID NO: 96524

SEQ ID NO: 97323 - DNA, 601 bp, Human; identical to SEQ ID NO: 96525

SEQ ID NO: 97324 - DNA, 601 bp, Human; identical to SEQ ID NO: 96526

SEQ ID NO: 97325 - DNA, 601 bp, Human; identical to SEQ ID NO: 96527

SEQ ID NO: 97326 - DNA, 601 bp, Human; identical to SEQ ID NO: 96528

SEQ ID NO: 97327 - DNA, 601 bp, Human; identical to SEQ ID NO: 96529

SEQ ID NO: 97328 - DNA, 601 bp, Human; identical to SEQ ID NO: 96530

SEQ ID NO: 97329 - DNA, 601 bp, Human; identical to SEQ ID NO: 96531

SEQ ID NO: 97330 - DNA, 601 bp, Human; identical to SEQ ID NO: 96532

SEQ ID NO: 97331 - DNA, 601 bp, Human; identical to SEQ ID NO: 96533

SEQ ID NO: 97332 - DNA, 601 bp, Human; identical to SEQ ID NO: 96534

SEQ ID NO: 97333 - DNA, 601 bp, Human; identical to SEQ ID NO: 96535

SEQ ID NO: 97334 - DNA, 601 bp, Human; identical to SEQ ID NO: 96536

SEQ ID NO: 97335 - DNA, 601 bp, Human; identical to SEQ ID NO: 96537

SEQ ID NO: 97336 - DNA, 601 bp, Human; identical to SEQ ID NO: 96538

SEQ ID NO: 97337 - DNA, 601 bp, Human; identical to SEQ ID NO: 96539

SEQ ID NO: 97338 - DNA, 601 bp, Human; identical to SEQ ID NO: 96540

SEQ ID NO: 97339 - DNA, 601 bp, Human; identical to SEQ ID NO: 96541

SEQ ID NO: 97340 - DNA, 601 bp, Human; identical to SEQ ID NO: 96542

SEQ ID NO: 97341 - DNA, 601 bp, Human; identical to SEQ ID NO: 96543

SEQ ID NO: 97342 - DNA, 601 bp, Human; identical to SEQ ID NO: 96544

SEQ ID NO: 97343 - DNA, 601 bp, Human; identical to SEQ ID NO: 96545

SEQ ID NO: 97344 - DNA, 601 bp, Human; identical to SEQ ID NO: 96546

SEQ ID NO: 97345 - DNA, 601 bp, Human; identical to SEQ ID NO: 96547

SEQ ID NO: 97346 - DNA, 601 bp, Human; identical to SEQ ID NO: 96548

SEQ ID NO: 97347 - DNA, 601 bp, Human; identical to SEQ ID NO: 96549

SEQ ID NO: 97348 - DNA, 601 bp, Human; identical to SEQ ID NO: 96550

SEQ ID NO: 97349 - DNA, 601 bp, Human; identical to SEQ ID NO: 96551

SEQ ID NO: 97350 - DNA, 601 bp, Human; identical to SEQ ID NO: 96552

SEQ ID NO: 97351 - DNA, 601 bp, Human; identical to SEQ ID NO: 96553

SEQ ID NO: 97352 - DNA, 601 bp, Human; identical to SEQ ID NO: 96554

SEQ ID NO: 97353 - DNA, 601 bp, Human; identical to SEQ ID NO: 96555

SEQ ID NO: 97354 - DNA, 601 bp, Human; identical to SEQ ID NO: 96556

SEQ ID NO: 97355 - DNA, 601 bp, Human; identical to SEQ ID NO: 96557

SEQ ID NO: 97356 - DNA, 601 bp, Human; identical to SEQ ID NO: 96558

SEQ ID NO: 97357 - DNA, 601 bp, Human; identical to SEQ ID NO: 96559

SEQ ID NO: 97358 - DNA, 601 bp, Human; identical to SEQ ID NO: 96560

SEQ ID NO: 97359 - DNA, 601 bp, Human; identical to SEQ ID NO: 96561

SEQ ID NO: 97360 - DNA, 601 bp, Human; identical to SEQ ID NO: 96562

SEQ ID NO: 97361 - DNA, 601 bp, Human; identical to SEQ ID NO: 96563

SEQ ID NO: 97362 - DNA, 601 bp, Human; identical to SEQ ID NO: 96564

SEQ ID NO: 97363 - DNA, 601 bp, Human; identical to SEQ ID NO: 96565

SEQ ID NO: 97364 - DNA, 601 bp, Human; identical to SEQ ID NO: 96566

SEQ ID NO: 97365 - DNA, 601 bp, Human; identical to SEQ ID NO: 96567

SEQ ID NO: 97366 - DNA, 601 bp, Human; identical to SEQ ID NO: 96568

SEQ ID NO: 97367 - DNA, 601 bp, Human; identical to SEQ ID NO: 96569

SEQ ID NO: 97368 - DNA, 601 bp, Human; identical to SEQ ID NO: 96570

SEQ ID NO: 97369 - DNA, 601 bp, Human; identical to SEQ ID NO: 96571

SEQ ID NO: 97370 - DNA, 601 bp, Human; identical to SEQ ID NO: 96572

SEQ ID NO: 97371 - DNA, 601 bp, Human; identical to SEQ ID NO: 96573

SEQ ID NO: 97372 - DNA, 601 bp, Human; identical to SEQ ID NO: 96574

SEQ ID NO: 97373 - DNA, 601 bp, Human; identical to SEQ ID NO: 96575

SEQ ID NO: 97374 - DNA, 601 bp, Human; identical to SEQ ID NO: 96576

SEQ ID NO: 97375 - DNA, 601 bp, Human; identical to SEQ ID NO: 96577

SEQ ID NO: 97376 - DNA, 601 bp, Human; identical to SEQ ID NO: 96578

SEQ ID NO: 97377 - DNA, 601 bp, Human; identical to SEQ ID NO: 96579

SEQ ID NO: 97378 - DNA, 601 bp, Human; identical to SEQ ID NO: 96580

SEQ ID NO: 97379 - DNA, 601 bp, Human; identical to SEQ ID NO: 96581

SEQ ID NO: 97380 - DNA, 601 bp, Human; identical to SEQ ID NO: 96582

SEQ ID NO: 97381 - DNA, 601 bp, Human; identical to SEQ ID NO: 96583

SEQ ID NO: 97382 - DNA, 601 bp, Human; identical to SEQ ID NO: 96584

SEQ ID NO: 97383 - DNA, 417 bp, Human; identical to SEQ ID NO: 96585

SEQ ID NO: 97384 - DNA, 480 bp, Human; identical to SEQ ID NO: 96586

SEQ ID NO: 97385 - DNA, 601 bp, Human; identical to SEQ ID NO: 96587

SEQ ID NO: 97386 - DNA, 601 bp, Human; identical to SEQ ID NO: 96588

SEQ ID NO: 97387 - DNA, 601 bp, Human; identical to SEQ ID NO: 96589

SEQ ID NO: 97388 - DNA, 601 bp, Human; identical to SEQ ID NO: 96590

SEQ ID NO: 97389 - DNA, 601 bp, Human; identical to SEQ ID NO: 96591

SEQ ID NO: 97390 - DNA, 601 bp, Human; identical to SEQ ID NO: 96592

SEQ ID NO: 97391 - DNA, 601 bp, Human; identical to SEQ ID NO: 96593

SEQ ID NO: 97392 - DNA, 601 bp, Human; identical to SEQ ID NO: 96594

SEQ ID NO: 97393 - DNA, 601 bp, Human; identical to SEQ ID NO: 96595

SEQ ID NO: 97394 - DNA, 601 bp, Human; identical to SEQ ID NO: 96596

SEQ ID NO: 97395 - DNA, 601 bp, Human; identical to SEQ ID NO: 96597

SEQ ID NO: 97396 - DNA, 601 bp, Human; identical to SEQ ID NO: 96598

SEQ ID NO: 97397 - DNA, 601 bp, Human; identical to SEQ ID NO: 96599

SEQ ID NO: 97398 - DNA, 601 bp, Human; identical to SEQ ID NO: 96600

SEQ ID NO: 97399 - DNA, 601 bp, Human; identical to SEQ ID NO: 96601

SEQ ID NO: 97400 - DNA, 601 bp, Human; identical to SEQ ID NO: 96602

SEQ ID NO: 97401 - DNA, 601 bp, Human; identical to SEQ ID NO: 96603

SEQ ID NO: 97402 - DNA, 601 bp, Human; identical to SEQ ID NO: 96604

SEQ ID NO: 97403 - DNA, 601 bp, Human; identical to SEQ ID NO: 96605

SEQ ID NO: 97404 - DNA, 601 bp, Human; identical to SEQ ID NO: 96606

SEQ ID NO: 97405 - DNA, 601 bp, Human; identical to SEQ ID NO: 96607

SEQ ID NO: 97406 - DNA, 601 bp, Human; identical to SEQ ID NO: 96608

SEQ ID NO: 97407 - DNA, 601 bp, Human; identical to SEQ ID NO: 96609

SEQ ID NO: 97408 - DNA, 601 bp, Human; identical to SEQ ID NO: 96610

SEQ ID NO: 97409 - DNA, 601 bp, Human; identical to SEQ ID NO: 96611

SEQ ID NO: 97410 - DNA, 601 bp, Human; identical to SEQ ID NO: 96612

SEQ ID NO: 97411 - DNA, 601 bp, Human; identical to SEQ ID NO: 96613

SEQ ID NO: 97412 - DNA, 601 bp, Human; identical to SEQ ID NO: 96614

SEQ ID NO: 97413 - DNA, 601 bp, Human; identical to SEQ ID NO: 96615

SEQ ID NO: 97414 - DNA, 601 bp, Human; identical to SEQ ID NO: 96616

SEQ ID NO: 97415 - DNA, 601 bp, Human; identical to SEQ ID NO: 96617

SEQ ID NO: 97416 - DNA, 601 bp, Human; identical to SEQ ID NO: 96618

SEQ ID NO: 97417 - DNA, 601 bp, Human; identical to SEQ ID NO: 96619

SEQ ID NO: 97418 - DNA, 601 bp, Human; identical to SEQ ID NO: 96620

SEQ ID NO: 97419 - DNA, 601 bp, Human; identical to SEQ ID NO: 96621

SEQ ID NO: 97420 - DNA, 601 bp, Human; identical to SEQ ID NO: 96622

SEQ ID NO: 97421 - DNA, 601 bp, Human; identical to SEQ ID NO: 96623

SEQ ID NO: 97422 - DNA, 601 bp, Human; identical to SEQ ID NO: 96624

SEQ ID NO: 97423 - DNA, 601 bp, Human; identical to SEQ ID NO: 96625

SEQ ID NO: 97424 - DNA, 601 bp, Human; identical to SEQ ID NO: 96626

SEQ ID NO: 97425 - DNA, 601 bp, Human; identical to SEQ ID NO: 96627

SEQ ID NO: 97426 - DNA, 601 bp, Human; identical to SEQ ID NO: 96628

SEQ ID NO: 97427 - DNA, 601 bp, Human; identical to SEQ ID NO: 96629

SEQ ID NO: 97428 - DNA, 601 bp, Human; identical to SEQ ID NO: 96630

SEQ ID NO: 97429 - DNA, 601 bp, Human; identical to SEQ ID NO: 96631

SEQ ID NO: 97430 - DNA, 601 bp, Human; identical to SEQ ID NO: 96632

SEQ ID NO: 97431 - DNA, 601 bp, Human; identical to SEQ ID NO: 96633

SEQ ID NO: 97432 - DNA, 601 bp, Human; identical to SEQ ID NO: 96634

SEQ ID NO: 97433 - DNA, 601 bp, Human; identical to SEQ ID NO: 96635

SEQ ID NO: 97434 - DNA, 601 bp, Human; identical to SEQ ID NO: 96636

SEQ ID NO: 97435 - DNA, 601 bp, Human; identical to SEQ ID NO: 96637

SEQ ID NO: 97436 - DNA, 601 bp, Human; identical to SEQ ID NO: 96638

SEQ ID NO: 97437 - DNA, 601 bp, Human; identical to SEQ ID NO: 96639

SEQ ID NO: 97438 - DNA, 601 bp, Human; identical to SEQ ID NO: 96640

SEQ ID NO: 97439 - DNA, 601 bp, Human; identical to SEQ ID NO: 96375

SEQ ID NO: 97440 - DNA, 601 bp, Human; identical to SEQ ID NO: 96376

SEQ ID NO: 97441 - DNA, 601 bp, Human; identical to SEQ ID NO: 96377

SEQ ID NO: 97442 - DNA, 601 bp, Human; identical to SEQ ID NO: 96378

SEQ ID NO: 97443 - DNA, 601 bp, Human; identical to SEQ ID NO: 96379

SEQ ID NO: 97444 - DNA, 601 bp, Human; identical to SEQ ID NO: 96380

SEQ ID NO: 97445 - DNA, 601 bp, Human; identical to SEQ ID NO: 96381

SEQ ID NO: 97446 - DNA, 601 bp, Human; identical to SEQ ID NO: 96382

SEQ ID NO: 97447 - DNA, 601 bp, Human; identical to SEQ ID NO: 96383

SEQ ID NO: 97448 - DNA, 601 bp, Human; identical to SEQ ID NO: 96384

SEQ ID NO: 97449 - DNA, 601 bp, Human; identical to SEQ ID NO: 96385

SEQ ID NO: 97450 - DNA, 601 bp, Human; identical to SEQ ID NO: 96386

SEQ ID NO: 97451 - DNA, 601 bp, Human; identical to SEQ ID NO: 96387

SEQ ID NO: 97452 - DNA, 601 bp, Human; identical to SEQ ID NO: 96388

SEQ ID NO: 97453 - DNA, 601 bp, Human; identical to SEQ ID NO: 96389

SEQ ID NO: 97454 - DNA, 601 bp, Human; identical to SEQ ID NO: 96390

SEQ ID NO: 97455 - DNA, 601 bp, Human; identical to SEQ ID NO: 96391

SEQ ID NO: 97456 - DNA, 601 bp, Human; identical to SEQ ID NO: 96392

SEQ ID NO: 97457 - DNA, 601 bp, Human; identical to SEQ ID NO: 96393

SEQ ID NO: 97458 - DNA, 601 bp, Human; identical to SEQ ID NO: 96394

SEQ ID NO: 97459 - DNA, 601 bp, Human; identical to SEQ ID NO: 96395

SEQ ID NO: 97460 - DNA, 601 bp, Human; identical to SEQ ID NO: 96396

SEQ ID NO: 97461 - DNA, 601 bp, Human; identical to SEQ ID NO: 96397

SEQ ID NO: 97462 - DNA, 601 bp, Human; identical to SEQ ID NO: 96398

SEQ ID NO: 97463 - DNA, 601 bp, Human; identical to SEQ ID NO: 96399

SEQ ID NO: 97464 - DNA, 601 bp, Human; identical to SEQ ID NO: 96400

SEQ ID NO: 97465 - DNA, 601 bp, Human; identical to SEQ ID NO: 96401

SEQ ID NO: 97466 - DNA, 601 bp, Human; identical to SEQ ID NO: 96402

SEQ ID NO: 97467 - DNA, 601 bp, Human; identical to SEQ ID NO: 96403

SEQ ID NO: 97468 - DNA, 601 bp, Human; identical to SEQ ID NO: 96404

SEQ ID NO: 97469 - DNA, 601 bp, Human; identical to SEQ ID NO: 96405

SEQ ID NO: 97470 - DNA, 601 bp, Human; identical to SEQ ID NO: 96406

SEQ ID NO: 97471 - DNA, 601 bp, Human; identical to SEQ ID NO: 96407

SEQ ID NO: 97472 - DNA, 601 bp, Human; identical to SEQ ID NO: 96408

SEQ ID NO: 97473 - DNA, 601 bp, Human; identical to SEQ ID NO: 96409

SEQ ID NO: 97474 - DNA, 601 bp, Human; identical to SEQ ID NO: 96410

SEQ ID NO: 97475 - DNA, 601 bp, Human; identical to SEQ ID NO: 96411

SEQ ID NO: 97476 - DNA, 601 bp, Human; identical to SEQ ID NO: 96412

SEQ ID NO: 97477 - DNA, 601 bp, Human; identical to SEQ ID NO: 96413

SEQ ID NO: 97478 - DNA, 601 bp, Human; identical to SEQ ID NO: 96414

SEQ ID NO: 97479 - DNA, 601 bp, Human; identical to SEQ ID NO: 96415

SEQ ID NO: 97480 - DNA, 601 bp, Human; identical to SEQ ID NO: 96416

SEQ ID NO: 97481 - DNA, 601 bp, Human; identical to SEQ ID NO: 96417

SEQ ID NO: 97482 - DNA, 601 bp, Human; identical to SEQ ID NO: 96418

SEQ ID NO: 97483 - DNA, 601 bp, Human; identical to SEQ ID NO: 96419

SEQ ID NO: 97484 - DNA, 601 bp, Human; identical to SEQ ID NO: 96420

SEQ ID NO: 97485 - DNA, 601 bp, Human; identical to SEQ ID NO: 96421

SEQ ID NO: 97486 - DNA, 601 bp, Human; identical to SEQ ID NO: 96422

SEQ ID NO: 97487 - DNA, 601 bp, Human; identical to SEQ ID NO: 96423

SEQ ID NO: 97488 - DNA, 601 bp, Human; identical to SEQ ID NO: 96424

SEQ ID NO: 97489 - DNA, 601 bp, Human; identical to SEQ ID NO: 96425

SEQ ID NO: 97490 - DNA, 601 bp, Human; identical to SEQ ID NO: 96426

SEQ ID NO: 97491 - DNA, 601 bp, Human; identical to SEQ ID NO: 96427

SEQ ID NO: 97492 - DNA, 601 bp, Human; identical to SEQ ID NO: 96428

SEQ ID NO: 97493 - DNA, 601 bp, Human; identical to SEQ ID NO: 96429

SEQ ID NO: 97494 - DNA, 601 bp, Human; identical to SEQ ID NO: 96430

SEQ ID NO: 97495 - DNA, 601 bp, Human; identical to SEQ ID NO: 96431

SEQ ID NO: 97496 - DNA, 601 bp, Human; identical to SEQ ID NO: 96432

SEQ ID NO: 97497 - DNA, 601 bp, Human; identical to SEQ ID NO: 96433

SEQ ID NO: 97498 - DNA, 601 bp, Human; identical to SEQ ID NO: 96434

SEQ ID NO: 97499 - DNA, 601 bp, Human; identical to SEQ ID NO: 96435

SEQ ID NO: 97500 - DNA, 601 bp, Human; identical to SEQ ID NO: 96436

SEQ ID NO: 97501 - DNA, 601 bp, Human; identical to SEQ ID NO: 96437

SEQ ID NO: 97502 - DNA, 601 bp, Human; identical to SEQ ID NO: 96438

SEQ ID NO: 97503 - DNA, 601 bp, Human; identical to SEQ ID NO: 96439

SEQ ID NO: 97504 - DNA, 601 bp, Human; identical to SEQ ID NO: 96440

SEQ ID NO: 97505 - DNA, 601 bp, Human; identical to SEQ ID NO: 96441

SEQ ID NO: 97506 - DNA, 601 bp, Human; identical to SEQ ID NO: 96442

SEQ ID NO: 97507 - DNA, 601 bp, Human; identical to SEQ ID NO: 96443

SEQ ID NO: 97508 - DNA, 601 bp, Human; identical to SEQ ID NO: 96444

SEQ ID NO: 97509 - DNA, 601 bp, Human; identical to SEQ ID NO: 96445

SEQ ID NO: 97510 - DNA, 601 bp, Human; identical to SEQ ID NO: 96446

SEQ ID NO: 97511 - DNA, 601 bp, Human; identical to SEQ ID NO: 96447

SEQ ID NO: 97512 - DNA, 601 bp, Human; identical to SEQ ID NO: 96448

SEQ ID NO: 97513 - DNA, 601 bp, Human; identical to SEQ ID NO: 96449

SEQ ID NO: 97514 - DNA, 601 bp, Human; identical to SEQ ID NO: 96450

SEQ ID NO: 97515 - DNA, 601 bp, Human; identical to SEQ ID NO: 96451

SEQ ID NO: 97516 - DNA, 601 bp, Human; identical to SEQ ID NO: 96452

SEQ ID NO: 97517 - DNA, 601 bp, Human; identical to SEQ ID NO: 96453

SEQ ID NO: 97518 - DNA, 601 bp, Human; identical to SEQ ID NO: 96454

SEQ ID NO: 97519 - DNA, 601 bp, Human; identical to SEQ ID NO: 96455

SEQ ID NO: 97520 - DNA, 601 bp, Human; identical to SEQ ID NO: 96456

SEQ ID NO: 97521 - DNA, 601 bp, Human; identical to SEQ ID NO: 96457

SEQ ID NO: 97522 - DNA, 601 bp, Human; identical to SEQ ID NO: 96458

SEQ ID NO: 97523 - DNA, 601 bp, Human; identical to SEQ ID NO: 96459

SEQ ID NO: 97524 - DNA, 601 bp, Human; identical to SEQ ID NO: 96460

SEQ ID NO: 97525 - DNA, 601 bp, Human; identical to SEQ ID NO: 96461

SEQ ID NO: 97526 - DNA, 601 bp, Human; identical to SEQ ID NO: 96462

SEQ ID NO: 97527 - DNA, 601 bp, Human; identical to SEQ ID NO: 96463

SEQ ID NO: 97528 - DNA, 601 bp, Human; identical to SEQ ID NO: 96464

SEQ ID NO: 97529 - DNA, 601 bp, Human; identical to SEQ ID NO: 96465

SEQ ID NO: 97530 - DNA, 601 bp, Human; identical to SEQ ID NO: 96466

SEQ ID NO: 97531 - DNA, 601 bp, Human; identical to SEQ ID NO: 96467

SEQ ID NO: 97532 - DNA, 601 bp, Human; identical to SEQ ID NO: 96468

SEQ ID NO: 97533 - DNA, 601 bp, Human; identical to SEQ ID NO: 96469

SEQ ID NO: 97534 - DNA, 601 bp, Human; identical to SEQ ID NO: 96470

SEQ ID NO: 97535 - DNA, 601 bp, Human; identical to SEQ ID NO: 96471

SEQ ID NO: 97536 - DNA, 601 bp, Human; identical to SEQ ID NO: 96472

SEQ ID NO: 97537 - DNA, 601 bp, Human; identical to SEQ ID NO: 96473

SEQ ID NO: 97538 - DNA, 601 bp, Human; identical to SEQ ID NO: 96474

SEQ ID NO: 97539 - DNA, 601 bp, Human; identical to SEQ ID NO: 96475

SEQ ID NO: 97540 - DNA, 601 bp, Human; identical to SEQ ID NO: 96476

SEQ ID NO: 97541 - DNA, 601 bp, Human; identical to SEQ ID NO: 96477

SEQ ID NO: 97542 - DNA, 601 bp, Human; identical to SEQ ID NO: 96478

SEQ ID NO: 97543 - DNA, 601 bp, Human; identical to SEQ ID NO: 96479

SEQ ID NO: 97544 - DNA, 601 bp, Human; identical to SEQ ID NO: 96480

SEQ ID NO: 97545 - DNA, 601 bp, Human; identical to SEQ ID NO: 96481

SEQ ID NO: 97546 - DNA, 601 bp, Human; identical to SEQ ID NO: 96482

SEQ ID NO: 97547 - DNA, 601 bp, Human; identical to SEQ ID NO: 96483

SEQ ID NO: 97548 - DNA, 601 bp, Human; identical to SEQ ID NO: 96484

SEQ ID NO: 97549 - DNA, 601 bp, Human; identical to SEQ ID NO: 96485

SEQ ID NO: 97550 - DNA, 601 bp, Human; identical to SEQ ID NO: 96486

SEQ ID NO: 97551 - DNA, 601 bp, Human; identical to SEQ ID NO: 96487

SEQ ID NO: 97552 - DNA, 601 bp, Human; identical to SEQ ID NO: 96488

SEQ ID NO: 97553 - DNA, 601 bp, Human; identical to SEQ ID NO: 96489

SEQ ID NO: 97554 - DNA, 601 bp, Human; identical to SEQ ID NO: 96490

SEQ ID NO: 97555 - DNA, 601 bp, Human; identical to SEQ ID NO: 96491

SEQ ID NO: 97556 - DNA, 601 bp, Human; identical to SEQ ID NO: 96492

SEQ ID NO: 97557 - DNA, 601 bp, Human; identical to SEQ ID NO: 96493

SEQ ID NO: 97558 - DNA, 601 bp, Human; identical to SEQ ID NO: 96494

SEQ ID NO: 97559 - DNA, 601 bp, Human; identical to SEQ ID NO: 96495

SEQ ID NO: 97560 - DNA, 601 bp, Human; identical to SEQ ID NO: 96496

SEQ ID NO: 97561 - DNA, 601 bp, Human; identical to SEQ ID NO: 96497

SEQ ID NO: 97562 - DNA, 601 bp, Human; identical to SEQ ID NO: 96498

SEQ ID NO: 97563 - DNA, 601 bp, Human; identical to SEQ ID NO: 96499

SEQ ID NO: 97564 - DNA, 601 bp, Human; identical to SEQ ID NO: 96500

SEQ ID NO: 97565 - DNA, 601 bp, Human; identical to SEQ ID NO: 96501

SEQ ID NO: 97566 - DNA, 601 bp, Human; identical to SEQ ID NO: 96502

SEQ ID NO: 97567 - DNA, 601 bp, Human; identical to SEQ ID NO: 96503

SEQ ID NO: 97568 - DNA, 601 bp, Human; identical to SEQ ID NO: 96504

SEQ ID NO: 97569 - DNA, 601 bp, Human; identical to SEQ ID NO: 96505

SEQ ID NO: 97570 - DNA, 601 bp, Human; identical to SEQ ID NO: 96506

SEQ ID NO: 97571 - DNA, 601 bp, Human; identical to SEQ ID NO: 96507

SEQ ID NO: 97572 - DNA, 601 bp, Human; identical to SEQ ID NO: 96508

SEQ ID NO: 97573 - DNA, 601 bp, Human; identical to SEQ ID NO: 96509

SEQ ID NO: 97574 - DNA, 601 bp, Human; identical to SEQ ID NO: 96510

SEQ ID NO: 97575 - DNA, 601 bp, Human; identical to SEQ ID NO: 96511

SEQ ID NO: 97576 - DNA, 601 bp, Human; identical to SEQ ID NO: 96512

SEQ ID NO: 97577 - DNA, 601 bp, Human; identical to SEQ ID NO: 96513

SEQ ID NO: 97578 - DNA, 601 bp, Human; identical to SEQ ID NO: 96514

SEQ ID NO: 97579 - DNA, 601 bp, Human; identical to SEQ ID NO: 96515

SEQ ID NO: 97580 - DNA, 601 bp, Human; identical to SEQ ID NO: 96516

SEQ ID NO: 97581 - DNA, 601 bp, Human; identical to SEQ ID NO: 96517

SEQ ID NO: 97582 - DNA, 601 bp, Human; identical to SEQ ID NO: 96518

SEQ ID NO: 97583 - DNA, 601 bp, Human; identical to SEQ ID NO: 96519

SEQ ID NO: 97584 - DNA, 601 bp, Human; identical to SEQ ID NO: 96520

SEQ ID NO: 97585 - DNA, 601 bp, Human; identical to SEQ ID NO: 96521

SEQ ID NO: 97586 - DNA, 601 bp, Human; identical to SEQ ID NO: 96522

SEQ ID NO: 97587 - DNA, 601 bp, Human; identical to SEQ ID NO: 96523

SEQ ID NO: 97588 - DNA, 601 bp, Human; identical to SEQ ID NO: 96524

SEQ ID NO: 97589 - DNA, 601 bp, Human; identical to SEQ ID NO: 96525

SEQ ID NO: 97590 - DNA, 601 bp, Human; identical to SEQ ID NO: 96526

SEQ ID NO: 97591 - DNA, 601 bp, Human; identical to SEQ ID NO: 96527

SEQ ID NO: 97592 - DNA, 601 bp, Human; identical to SEQ ID NO: 96528

SEQ ID NO: 97593 - DNA, 601 bp, Human; identical to SEQ ID NO: 96529

SEQ ID NO: 97594 - DNA, 601 bp, Human; identical to SEQ ID NO: 96530

SEQ ID NO: 97595 - DNA, 601 bp, Human; identical to SEQ ID NO: 96531

SEQ ID NO: 97596 - DNA, 601 bp, Human; identical to SEQ ID NO: 96532

SEQ ID NO: 97597 - DNA, 601 bp, Human; identical to SEQ ID NO: 96533

SEQ ID NO: 97598 - DNA, 601 bp, Human; identical to SEQ ID NO: 96534

SEQ ID NO: 97599 - DNA, 601 bp, Human; identical to SEQ ID NO: 96535

SEQ ID NO: 97600 - DNA, 601 bp, Human; identical to SEQ ID NO: 96536

SEQ ID NO: 97601 - DNA, 601 bp, Human; identical to SEQ ID NO: 96537

SEQ ID NO: 97602 - DNA, 601 bp, Human; identical to SEQ ID NO: 96538

SEQ ID NO: 97603 - DNA, 601 bp, Human; identical to SEQ ID NO: 96539

SEQ ID NO: 97604 - DNA, 601 bp, Human; identical to SEQ ID NO: 96540

SEQ ID NO: 97605 - DNA, 601 bp, Human; identical to SEQ ID NO: 96541

SEQ ID NO: 97606 - DNA, 601 bp, Human; identical to SEQ ID NO: 96542

SEQ ID NO: 97607 - DNA, 601 bp, Human; identical to SEQ ID NO: 96543

SEQ ID NO: 97608 - DNA, 601 bp, Human; identical to SEQ ID NO: 96544

SEQ ID NO: 97609 - DNA, 601 bp, Human; identical to SEQ ID NO: 96545

SEQ ID NO: 97610 - DNA, 601 bp, Human; identical to SEQ ID NO: 96546

SEQ ID NO: 97611 - DNA, 601 bp, Human; identical to SEQ ID NO: 96547

SEQ ID NO: 97612 - DNA, 601 bp, Human; identical to SEQ ID NO: 96548

SEQ ID NO: 97613 - DNA, 601 bp, Human; identical to SEQ ID NO: 96549

SEQ ID NO: 97614 - DNA, 601 bp, Human; identical to SEQ ID NO: 96550

SEQ ID NO: 97615 - DNA, 601 bp, Human; identical to SEQ ID NO: 96551

SEQ ID NO: 97616 - DNA, 601 bp, Human; identical to SEQ ID NO: 96552

SEQ ID NO: 97617 - DNA, 601 bp, Human; identical to SEQ ID NO: 96553

SEQ ID NO: 97618 - DNA, 601 bp, Human; identical to SEQ ID NO: 96554

SEQ ID NO: 97619 - DNA, 601 bp, Human; identical to SEQ ID NO: 96555

SEQ ID NO: 97620 - DNA, 601 bp, Human; identical to SEQ ID NO: 96556

SEQ ID NO: 97621 - DNA, 601 bp, Human; identical to SEQ ID NO: 96557

SEQ ID NO: 97622 - DNA, 601 bp, Human; identical to SEQ ID NO: 96558

SEQ ID NO: 97623 - DNA, 601 bp, Human; identical to SEQ ID NO: 96559

SEQ ID NO: 97624 - DNA, 601 bp, Human; identical to SEQ ID NO: 96560

SEQ ID NO: 97625 - DNA, 601 bp, Human; identical to SEQ ID NO: 96561

SEQ ID NO: 97626 - DNA, 601 bp, Human; identical to SEQ ID NO: 96562

SEQ ID NO: 97627 - DNA, 601 bp, Human; identical to SEQ ID NO: 96563

SEQ ID NO: 97628 - DNA, 601 bp, Human; identical to SEQ ID NO: 96564

SEQ ID NO: 97629 - DNA, 601 bp, Human; identical to SEQ ID NO: 96565

SEQ ID NO: 97630 - DNA, 601 bp, Human; identical to SEQ ID NO: 96566

SEQ ID NO: 97631 - DNA, 601 bp, Human; identical to SEQ ID NO: 96567

SEQ ID NO: 97632 - DNA, 601 bp, Human; identical to SEQ ID NO: 96568

SEQ ID NO: 97633 - DNA, 601 bp, Human; identical to SEQ ID NO: 96569

SEQ ID NO: 97634 - DNA, 601 bp, Human; identical to SEQ ID NO: 96570

SEQ ID NO: 97635 - DNA, 601 bp, Human; identical to SEQ ID NO: 96571

SEQ ID NO: 97636 - DNA, 601 bp, Human; identical to SEQ ID NO: 96572

SEQ ID NO: 97637 - DNA, 601 bp, Human; identical to SEQ ID NO: 96573

SEQ ID NO: 97638 - DNA, 601 bp, Human; identical to SEQ ID NO: 96574

SEQ ID NO: 97639 - DNA, 601 bp, Human; identical to SEQ ID NO: 96575

SEQ ID NO: 97640 - DNA, 601 bp, Human; identical to SEQ ID NO: 96576

SEQ ID NO: 97641 - DNA, 601 bp, Human; identical to SEQ ID NO: 96577

SEQ ID NO: 97642 - DNA, 601 bp, Human; identical to SEQ ID NO: 96578

SEQ ID NO: 97643 - DNA, 601 bp, Human; identical to SEQ ID NO: 96579

SEQ ID NO: 97644 - DNA, 601 bp, Human; identical to SEQ ID NO: 96580

SEQ ID NO: 97645 - DNA, 601 bp, Human; identical to SEQ ID NO: 96581

SEQ ID NO: 97646 - DNA, 601 bp, Human; identical to SEQ ID NO: 96582

SEQ ID NO: 97647 - DNA, 601 bp, Human; identical to SEQ ID NO: 96583

SEQ ID NO: 97648 - DNA, 601 bp, Human; identical to SEQ ID NO: 96584

SEQ ID NO: 97649 - DNA, 417 bp, Human; identical to SEQ ID NO: 96585

SEQ ID NO: 97650 - DNA, 480 bp, Human; identical to SEQ ID NO: 96586

SEQ ID NO: 97651 - DNA, 601 bp, Human; identical to SEQ ID NO: 96587

SEQ ID NO: 97652 - DNA, 601 bp, Human; identical to SEQ ID NO: 96588

SEQ ID NO: 97653 - DNA, 601 bp, Human; identical to SEQ ID NO: 96589

SEQ ID NO: 97654 - DNA, 601 bp, Human; identical to SEQ ID NO: 96590

SEQ ID NO: 97655 - DNA, 601 bp, Human; identical to SEQ ID NO: 96591

SEQ ID NO: 97656 - DNA, 601 bp, Human; identical to SEQ ID NO: 96592

SEQ ID NO: 97657 - DNA, 601 bp, Human; identical to SEQ ID NO: 96593

SEQ ID NO: 97658 - DNA, 601 bp, Human; identical to SEQ ID NO: 96594

SEQ ID NO: 97659 - DNA, 601 bp, Human; identical to SEQ ID NO: 96595

SEQ ID NO: 97660 - DNA, 601 bp, Human; identical to SEQ ID NO: 96596

SEQ ID NO: 97661 - DNA, 601 bp, Human; identical to SEQ ID NO: 96597

SEQ ID NO: 97662 - DNA, 601 bp, Human; identical to SEQ ID NO: 96598

SEQ ID NO: 97663 - DNA, 601 bp, Human; identical to SEQ ID NO: 96599

SEQ ID NO: 97664 - DNA, 601 bp, Human; identical to SEQ ID NO: 96600

SEQ ID NO: 97665 - DNA, 601 bp, Human; identical to SEQ ID NO: 96601

SEQ ID NO: 97666 - DNA, 601 bp, Human; identical to SEQ ID NO: 96602

SEQ ID NO: 97667 - DNA, 601 bp, Human; identical to SEQ ID NO: 96603

SEQ ID NO: 97668 - DNA, 601 bp, Human; identical to SEQ ID NO: 96604

SEQ ID NO: 97669 - DNA, 601 bp, Human; identical to SEQ ID NO: 96605

SEQ ID NO: 97670 - DNA, 601 bp, Human; identical to SEQ ID NO: 96606

SEQ ID NO: 97671 - DNA, 601 bp, Human; identical to SEQ ID NO: 96607

SEQ ID NO: 97672 - DNA, 601 bp, Human; identical to SEQ ID NO: 96608

SEQ ID NO: 97673 - DNA, 601 bp, Human; identical to SEQ ID NO: 96609

SEQ ID NO: 97674 - DNA, 601 bp, Human; identical to SEQ ID NO: 96610

SEQ ID NO: 97675 - DNA, 601 bp, Human; identical to SEQ ID NO: 96611

SEQ ID NO: 97676 - DNA, 601 bp, Human; identical to SEQ ID NO: 96612

SEQ ID NO: 97677 - DNA, 601 bp, Human; identical to SEQ ID NO: 96613

SEQ ID NO: 97678 - DNA, 601 bp, Human; identical to SEQ ID NO: 96614

SEQ ID NO: 97679 - DNA, 601 bp, Human; identical to SEQ ID NO: 96615

SEQ ID NO: 97680 - DNA, 601 bp, Human; identical to SEQ ID NO: 96616

SEQ ID NO: 97681 - DNA, 601 bp, Human; identical to SEQ ID NO: 96617

SEQ ID NO: 97682 - DNA, 601 bp, Human; identical to SEQ ID NO: 96618

SEQ ID NO: 97683 - DNA, 601 bp, Human; identical to SEQ ID NO: 96619

SEQ ID NO: 97684 - DNA, 601 bp, Human; identical to SEQ ID NO: 96620

SEQ ID NO: 97685 - DNA, 601 bp, Human; identical to SEQ ID NO: 96621

SEQ ID NO: 97686 - DNA, 601 bp, Human; identical to SEQ ID NO: 96622

SEQ ID NO: 97687 - DNA, 601 bp, Human; identical to SEQ ID NO: 96623

SEQ ID NO: 97688 - DNA, 601 bp, Human; identical to SEQ ID NO: 96624

SEQ ID NO: 97689 - DNA, 601 bp, Human; identical to SEQ ID NO: 96625

SEQ ID NO: 97690 - DNA, 601 bp, Human; identical to SEQ ID NO: 96626

SEQ ID NO: 97691 - DNA, 601 bp, Human; identical to SEQ ID NO: 96627

SEQ ID NO: 97692 - DNA, 601 bp, Human; identical to SEQ ID NO: 96628

SEQ ID NO: 97693 - DNA, 601 bp, Human; identical to SEQ ID NO: 96629

SEQ ID NO: 97694 - DNA, 601 bp, Human; identical to SEQ ID NO: 96630

SEQ ID NO: 97695 - DNA, 601 bp, Human; identical to SEQ ID NO: 96631

SEQ ID NO: 97696 - DNA, 601 bp, Human; identical to SEQ ID NO: 96632

SEQ ID NO: 97697 - DNA, 601 bp, Human; identical to SEQ ID NO: 96633

SEQ ID NO: 97698 - DNA, 601 bp, Human; identical to SEQ ID NO: 96634

SEQ ID NO: 97699 - DNA, 601 bp, Human; identical to SEQ ID NO: 96635

SEQ ID NO: 97700 - DNA, 601 bp, Human; identical to SEQ ID NO: 96636

SEQ ID NO: 97701 - DNA, 601 bp, Human; identical to SEQ ID NO: 96637

SEQ ID NO: 97702 - DNA, 601 bp, Human; identical to SEQ ID NO: 96638

SEQ ID NO: 97703 - DNA, 601 bp, Human; identical to SEQ ID NO: 96639

SEQ ID NO: 97704 - DNA, 601 bp, Human; identical to SEQ ID NO: 96640

SEQ ID NO: 97705 - DNA, 601 bp, Human; identical to SEQ ID NO: 96375

SEQ ID NO: 97706 - DNA, 601 bp, Human; identical to SEQ ID NO: 96376

SEQ ID NO: 97707 - DNA, 601 bp, Human; identical to SEQ ID NO: 96377

SEQ ID NO: 97708 - DNA, 601 bp, Human; identical to SEQ ID NO: 96378

SEQ ID NO: 97709 - DNA, 601 bp, Human; identical to SEQ ID NO: 96379

SEQ ID NO: 97710 - DNA, 601 bp, Human; identical to SEQ ID NO: 96380

SEQ ID NO: 97711 - DNA, 601 bp, Human; identical to SEQ ID NO: 96381

SEQ ID NO: 97712 - DNA, 601 bp, Human; identical to SEQ ID NO: 96382

SEQ ID NO: 97713 - DNA, 601 bp, Human; identical to SEQ ID NO: 96383

SEQ ID NO: 97714 - DNA, 601 bp, Human; identical to SEQ ID NO: 96384

SEQ ID NO: 97715 - DNA, 601 bp, Human; identical to SEQ ID NO: 96385

SEQ ID NO: 97716 - DNA, 601 bp, Human; identical to SEQ ID NO: 96386

SEQ ID NO: 97717 - DNA, 601 bp, Human; identical to SEQ ID NO: 96387

SEQ ID NO: 97718 - DNA, 601 bp, Human; identical to SEQ ID NO: 96388

SEQ ID NO: 97719 - DNA, 601 bp, Human; identical to SEQ ID NO: 96389

SEQ ID NO: 97720 - DNA, 601 bp, Human; identical to SEQ ID NO: 96390

SEQ ID NO: 97721 - DNA, 601 bp, Human; identical to SEQ ID NO: 96391

SEQ ID NO: 97722 - DNA, 601 bp, Human; identical to SEQ ID NO: 96392

SEQ ID NO: 97723 - DNA, 601 bp, Human; identical to SEQ ID NO: 96393

SEQ ID NO: 97724 - DNA, 601 bp, Human; identical to SEQ ID NO: 96394

SEQ ID NO: 97725 - DNA, 601 bp, Human; identical to SEQ ID NO: 96395

SEQ ID NO: 97726 - DNA, 601 bp, Human; identical to SEQ ID NO: 96396

SEQ ID NO: 97727 - DNA, 601 bp, Human; identical to SEQ ID NO: 96397

SEQ ID NO: 97728 - DNA, 601 bp, Human; identical to SEQ ID NO: 96398

SEQ ID NO: 97729 - DNA, 601 bp, Human; identical to SEQ ID NO: 96399

SEQ ID NO: 97730 - DNA, 601 bp, Human; identical to SEQ ID NO: 96400

SEQ ID NO: 97731 - DNA, 601 bp, Human; identical to SEQ ID NO: 96401

SEQ ID NO: 97732 - DNA, 601 bp, Human; identical to SEQ ID NO: 96402

SEQ ID NO: 97733 - DNA, 601 bp, Human; identical to SEQ ID NO: 96403

SEQ ID NO: 97734 - DNA, 601 bp, Human; identical to SEQ ID NO: 96404

SEQ ID NO: 97735 - DNA, 601 bp, Human; identical to SEQ ID NO: 96405

SEQ ID NO: 97736 - DNA, 601 bp, Human; identical to SEQ ID NO: 96406

SEQ ID NO: 97737 - DNA, 601 bp, Human; identical to SEQ ID NO: 96407

SEQ ID NO: 97738 - DNA, 601 bp, Human; identical to SEQ ID NO: 96408

SEQ ID NO: 97739 - DNA, 601 bp, Human; identical to SEQ ID NO: 96409

SEQ ID NO: 97740 - DNA, 601 bp, Human; identical to SEQ ID NO: 96410

SEQ ID NO: 97741 - DNA, 601 bp, Human; identical to SEQ ID NO: 96411

SEQ ID NO: 97742 - DNA, 601 bp, Human; identical to SEQ ID NO: 96412

SEQ ID NO: 97743 - DNA, 601 bp, Human; identical to SEQ ID NO: 96413

SEQ ID NO: 97744 - DNA, 601 bp, Human; identical to SEQ ID NO: 96414

SEQ ID NO: 97745 - DNA, 601 bp, Human; identical to SEQ ID NO: 96415

SEQ ID NO: 97746 - DNA, 601 bp, Human; identical to SEQ ID NO: 96416

SEQ ID NO: 97747 - DNA, 601 bp, Human; identical to SEQ ID NO: 96417

SEQ ID NO: 97748 - DNA, 601 bp, Human; identical to SEQ ID NO: 96418

SEQ ID NO: 97749 - DNA, 601 bp, Human; identical to SEQ ID NO: 96419

SEQ ID NO: 97750 - DNA, 601 bp, Human; identical to SEQ ID NO: 96420

SEQ ID NO: 97751 - DNA, 601 bp, Human; identical to SEQ ID NO: 96421

SEQ ID NO: 97752 - DNA, 601 bp, Human; identical to SEQ ID NO: 96422

SEQ ID NO: 97753 - DNA, 601 bp, Human; identical to SEQ ID NO: 96423

SEQ ID NO: 97754 - DNA, 601 bp, Human; identical to SEQ ID NO: 96424

SEQ ID NO: 97755 - DNA, 601 bp, Human; identical to SEQ ID NO: 96425

SEQ ID NO: 97756 - DNA, 601 bp, Human; identical to SEQ ID NO: 96426

SEQ ID NO: 97757 - DNA, 601 bp, Human; identical to SEQ ID NO: 96427

SEQ ID NO: 97758 - DNA, 601 bp, Human; identical to SEQ ID NO: 96428

SEQ ID NO: 97759 - DNA, 601 bp, Human; identical to SEQ ID NO: 96429

SEQ ID NO: 97760 - DNA, 601 bp, Human; identical to SEQ ID NO: 96430

SEQ ID NO: 97761 - DNA, 601 bp, Human; identical to SEQ ID NO: 96431

SEQ ID NO: 97762 - DNA, 601 bp, Human; identical to SEQ ID NO: 96432

SEQ ID NO: 97763 - DNA, 601 bp, Human; identical to SEQ ID NO: 96433

SEQ ID NO: 97764 - DNA, 601 bp, Human; identical to SEQ ID NO: 96434

SEQ ID NO: 97765 - DNA, 601 bp, Human; identical to SEQ ID NO: 96435

SEQ ID NO: 97766 - DNA, 601 bp, Human; identical to SEQ ID NO: 96436

SEQ ID NO: 97767 - DNA, 601 bp, Human; identical to SEQ ID NO: 96437

SEQ ID NO: 97768 - DNA, 601 bp, Human; identical to SEQ ID NO: 96438

SEQ ID NO: 97769 - DNA, 601 bp, Human; identical to SEQ ID NO: 96439

SEQ ID NO: 97770 - DNA, 601 bp, Human; identical to SEQ ID NO: 96440

SEQ ID NO: 97771 - DNA, 601 bp, Human; identical to SEQ ID NO: 96441

SEQ ID NO: 97772 - DNA, 601 bp, Human; identical to SEQ ID NO: 96442

SEQ ID NO: 97773 - DNA, 601 bp, Human; identical to SEQ ID NO: 96443

SEQ ID NO: 97774 - DNA, 601 bp, Human; identical to SEQ ID NO: 96444

SEQ ID NO: 97775 - DNA, 601 bp, Human; identical to SEQ ID NO: 96445

SEQ ID NO: 97776 - DNA, 601 bp, Human; identical to SEQ ID NO: 96446

SEQ ID NO: 97777 - DNA, 601 bp, Human; identical to SEQ ID NO: 96447

SEQ ID NO: 97778 - DNA, 601 bp, Human; identical to SEQ ID NO: 96448

SEQ ID NO: 97779 - DNA, 601 bp, Human; identical to SEQ ID NO: 96449

SEQ ID NO: 97780 - DNA, 601 bp, Human; identical to SEQ ID NO: 96450

SEQ ID NO: 97781 - DNA, 601 bp, Human; identical to SEQ ID NO: 96451

SEQ ID NO: 97782 - DNA, 601 bp, Human; identical to SEQ ID NO: 96452

SEQ ID NO: 97783 - DNA, 601 bp, Human; identical to SEQ ID NO: 96453

SEQ ID NO: 97784 - DNA, 601 bp, Human; identical to SEQ ID NO: 96454

SEQ ID NO: 97785 - DNA, 601 bp, Human; identical to SEQ ID NO: 96455

SEQ ID NO: 97786 - DNA, 601 bp, Human; identical to SEQ ID NO: 96456

SEQ ID NO: 97787 - DNA, 601 bp, Human; identical to SEQ ID NO: 96457

SEQ ID NO: 97788 - DNA, 601 bp, Human; identical to SEQ ID NO: 96458

SEQ ID NO: 97789 - DNA, 601 bp, Human; identical to SEQ ID NO: 96459

SEQ ID NO: 97790 - DNA, 601 bp, Human; identical to SEQ ID NO: 96460

SEQ ID NO: 97791 - DNA, 601 bp, Human; identical to SEQ ID NO: 96461

SEQ ID NO: 97792 - DNA, 601 bp, Human; identical to SEQ ID NO: 96462

SEQ ID NO: 97793 - DNA, 601 bp, Human; identical to SEQ ID NO: 96463

SEQ ID NO: 97794 - DNA, 601 bp, Human; identical to SEQ ID NO: 96464

SEQ ID NO: 97795 - DNA, 601 bp, Human; identical to SEQ ID NO: 96465

SEQ ID NO: 97796 - DNA, 601 bp, Human; identical to SEQ ID NO: 96466

SEQ ID NO: 97797 - DNA, 601 bp, Human; identical to SEQ ID NO: 96467

SEQ ID NO: 97798 - DNA, 601 bp, Human; identical to SEQ ID NO: 96468

SEQ ID NO: 97799 - DNA, 601 bp, Human; identical to SEQ ID NO: 96469

SEQ ID NO: 97800 - DNA, 601 bp, Human; identical to SEQ ID NO: 96470

SEQ ID NO: 97801 - DNA, 601 bp, Human; identical to SEQ ID NO: 96471

SEQ ID NO: 97802 - DNA, 601 bp, Human; identical to SEQ ID NO: 96472

SEQ ID NO: 97803 - DNA, 601 bp, Human; identical to SEQ ID NO: 96473

SEQ ID NO: 97804 - DNA, 601 bp, Human; identical to SEQ ID NO: 96474

SEQ ID NO: 97805 - DNA, 601 bp, Human; identical to SEQ ID NO: 96475

SEQ ID NO: 97806 - DNA, 601 bp, Human; identical to SEQ ID NO: 96476

SEQ ID NO: 97807 - DNA, 601 bp, Human; identical to SEQ ID NO: 96477

SEQ ID NO: 97808 - DNA, 601 bp, Human; identical to SEQ ID NO: 96478

SEQ ID NO: 97809 - DNA, 601 bp, Human; identical to SEQ ID NO: 96479

SEQ ID NO: 97810 - DNA, 601 bp, Human; identical to SEQ ID NO: 96480

SEQ ID NO: 97811 - DNA, 601 bp, Human; identical to SEQ ID NO: 96481

SEQ ID NO: 97812 - DNA, 601 bp, Human; identical to SEQ ID NO: 96482

SEQ ID NO: 97813 - DNA, 601 bp, Human; identical to SEQ ID NO: 96483

SEQ ID NO: 97814 - DNA, 601 bp, Human; identical to SEQ ID NO: 96484

SEQ ID NO: 97815 - DNA, 601 bp, Human; identical to SEQ ID NO: 96485

SEQ ID NO: 97816 - DNA, 601 bp, Human; identical to SEQ ID NO: 96486

SEQ ID NO: 97817 - DNA, 601 bp, Human; identical to SEQ ID NO: 96487

SEQ ID NO: 97818 - DNA, 601 bp, Human; identical to SEQ ID NO: 96488

SEQ ID NO: 97819 - DNA, 601 bp, Human; identical to SEQ ID NO: 96489

SEQ ID NO: 97820 - DNA, 601 bp, Human; identical to SEQ ID NO: 96490

SEQ ID NO: 97821 - DNA, 601 bp, Human; identical to SEQ ID NO: 96491

SEQ ID NO: 97822 - DNA, 601 bp, Human; identical to SEQ ID NO: 96492

SEQ ID NO: 97823 - DNA, 601 bp, Human; identical to SEQ ID NO: 96493

SEQ ID NO: 97824 - DNA, 601 bp, Human; identical to SEQ ID NO: 96494

SEQ ID NO: 97825 - DNA, 601 bp, Human; identical to SEQ ID NO: 96495

SEQ ID NO: 97826 - DNA, 601 bp, Human; identical to SEQ ID NO: 96496

SEQ ID NO: 97827 - DNA, 601 bp, Human; identical to SEQ ID NO: 96497

SEQ ID NO: 97828 - DNA, 601 bp, Human; identical to SEQ ID NO: 96498

SEQ ID NO: 97829 - DNA, 601 bp, Human; identical to SEQ ID NO: 96499

SEQ ID NO: 97830 - DNA, 601 bp, Human; identical to SEQ ID NO: 96500

SEQ ID NO: 97831 - DNA, 601 bp, Human; identical to SEQ ID NO: 96501

SEQ ID NO: 97832 - DNA, 601 bp, Human; identical to SEQ ID NO: 96502

SEQ ID NO: 97833 - DNA, 601 bp, Human; identical to SEQ ID NO: 96503

SEQ ID NO: 97834 - DNA, 601 bp, Human; identical to SEQ ID NO: 96504

SEQ ID NO: 97835 - DNA, 601 bp, Human; identical to SEQ ID NO: 96505

SEQ ID NO: 97836 - DNA, 601 bp, Human; identical to SEQ ID NO: 96506

SEQ ID NO: 97837 - DNA, 601 bp, Human; identical to SEQ ID NO: 96507

SEQ ID NO: 97838 - DNA, 601 bp, Human; identical to SEQ ID NO: 96508

SEQ ID NO: 97839 - DNA, 601 bp, Human; identical to SEQ ID NO: 96509

SEQ ID NO: 97840 - DNA, 601 bp, Human; identical to SEQ ID NO: 96510

SEQ ID NO: 97841 - DNA, 601 bp, Human; identical to SEQ ID NO: 96511

SEQ ID NO: 97842 - DNA, 601 bp, Human; identical to SEQ ID NO: 96512

SEQ ID NO: 97843 - DNA, 601 bp, Human; identical to SEQ ID NO: 96513

SEQ ID NO: 97844 - DNA, 601 bp, Human; identical to SEQ ID NO: 96514

SEQ ID NO: 97845 - DNA, 601 bp, Human; identical to SEQ ID NO: 96515

SEQ ID NO: 97846 - DNA, 601 bp, Human; identical to SEQ ID NO: 96516

SEQ ID NO: 97847 - DNA, 601 bp, Human; identical to SEQ ID NO: 96517

SEQ ID NO: 97848 - DNA, 601 bp, Human; identical to SEQ ID NO: 96518

SEQ ID NO: 97849 - DNA, 601 bp, Human; identical to SEQ ID NO: 96519

SEQ ID NO: 97850 - DNA, 601 bp, Human; identical to SEQ ID NO: 96520

SEQ ID NO: 97851 - DNA, 601 bp, Human; identical to SEQ ID NO: 96521

SEQ ID NO: 97852 - DNA, 601 bp, Human; identical to SEQ ID NO: 96522

SEQ ID NO: 97853 - DNA, 601 bp, Human; identical to SEQ ID NO: 96523

SEQ ID NO: 97854 - DNA, 601 bp, Human; identical to SEQ ID NO: 96524

SEQ ID NO: 97855 - DNA, 601 bp, Human; identical to SEQ ID NO: 96525

SEQ ID NO: 97856 - DNA, 601 bp, Human; identical to SEQ ID NO: 96526

SEQ ID NO: 97857 - DNA, 601 bp, Human; identical to SEQ ID NO: 96527

SEQ ID NO: 97858 - DNA, 601 bp, Human; identical to SEQ ID NO: 96528

SEQ ID NO: 97859 - DNA, 601 bp, Human; identical to SEQ ID NO: 96529

SEQ ID NO: 97860 - DNA, 601 bp, Human; identical to SEQ ID NO: 96530

SEQ ID NO: 97861 - DNA, 601 bp, Human; identical to SEQ ID NO: 96531

SEQ ID NO: 97862 - DNA, 601 bp, Human; identical to SEQ ID NO: 96532

SEQ ID NO: 97863 - DNA, 601 bp, Human; identical to SEQ ID NO: 96533

SEQ ID NO: 97864 - DNA, 601 bp, Human; identical to SEQ ID NO: 96534

SEQ ID NO: 97865 - DNA, 601 bp, Human; identical to SEQ ID NO: 96535

SEQ ID NO: 97866 - DNA, 601 bp, Human; identical to SEQ ID NO: 96536

SEQ ID NO: 97867 - DNA, 601 bp, Human; identical to SEQ ID NO: 96537

SEQ ID NO: 97868 - DNA, 601 bp, Human; identical to SEQ ID NO: 96538

SEQ ID NO: 97869 - DNA, 601 bp, Human; identical to SEQ ID NO: 96539

SEQ ID NO: 97870 - DNA, 601 bp, Human; identical to SEQ ID NO: 96540

SEQ ID NO: 97871 - DNA, 601 bp, Human; identical to SEQ ID NO: 96541

SEQ ID NO: 97872 - DNA, 601 bp, Human; identical to SEQ ID NO: 96542

SEQ ID NO: 97873 - DNA, 601 bp, Human; identical to SEQ ID NO: 96543

SEQ ID NO: 97874 - DNA, 601 bp, Human; identical to SEQ ID NO: 96544

SEQ ID NO: 97875 - DNA, 601 bp, Human; identical to SEQ ID NO: 96545

SEQ ID NO: 97876 - DNA, 601 bp, Human; identical to SEQ ID NO: 96546

SEQ ID NO: 97877 - DNA, 601 bp, Human; identical to SEQ ID NO: 96547

SEQ ID NO: 97878 - DNA, 601 bp, Human; identical to SEQ ID NO: 96548

SEQ ID NO: 97879 - DNA, 601 bp, Human; identical to SEQ ID NO: 96549

SEQ ID NO: 97880 - DNA, 601 bp, Human; identical to SEQ ID NO: 96550

SEQ ID NO: 97881 - DNA, 601 bp, Human; identical to SEQ ID NO: 96551

SEQ ID NO: 97882 - DNA, 601 bp, Human; identical to SEQ ID NO: 96552

SEQ ID NO: 97883 - DNA, 601 bp, Human; identical to SEQ ID NO: 96553

SEQ ID NO: 97884 - DNA, 601 bp, Human; identical to SEQ ID NO: 96554

SEQ ID NO: 97885 - DNA, 601 bp, Human; identical to SEQ ID NO: 96555

SEQ ID NO: 97886 - DNA, 601 bp, Human; identical to SEQ ID NO: 96556

SEQ ID NO: 97887 - DNA, 601 bp, Human; identical to SEQ ID NO: 96557

SEQ ID NO: 97888 - DNA, 601 bp, Human; identical to SEQ ID NO: 96558

SEQ ID NO: 97889 - DNA, 601 bp, Human; identical to SEQ ID NO: 96559

SEQ ID NO: 97890 - DNA, 601 bp, Human; identical to SEQ ID NO: 96560

SEQ ID NO: 97891 - DNA, 601 bp, Human; identical to SEQ ID NO: 96561

SEQ ID NO: 97892 - DNA, 601 bp, Human; identical to SEQ ID NO: 96562

SEQ ID NO: 97893 - DNA, 601 bp, Human; identical to SEQ ID NO: 96563

SEQ ID NO: 97894 - DNA, 601 bp, Human; identical to SEQ ID NO: 96564

SEQ ID NO: 97895 - DNA, 601 bp, Human; identical to SEQ ID NO: 96565

SEQ ID NO: 97896 - DNA, 601 bp, Human; identical to SEQ ID NO: 96566

SEQ ID NO: 97897 - DNA, 601 bp, Human; identical to SEQ ID NO: 96567

SEQ ID NO: 97898 - DNA, 601 bp, Human; identical to SEQ ID NO: 96568

SEQ ID NO: 97899 - DNA, 601 bp, Human; identical to SEQ ID NO: 96569

SEQ ID NO: 97900 - DNA, 601 bp, Human; identical to SEQ ID NO: 96570

SEQ ID NO: 97901 - DNA, 601 bp, Human; identical to SEQ ID NO: 96571

SEQ ID NO: 97902 - DNA, 601 bp, Human; identical to SEQ ID NO: 96572

SEQ ID NO: 97903 - DNA, 601 bp, Human; identical to SEQ ID NO: 96573

SEQ ID NO: 97904 - DNA, 601 bp, Human; identical to SEQ ID NO: 96574

SEQ ID NO: 97905 - DNA, 601 bp, Human; identical to SEQ ID NO: 96575

SEQ ID NO: 97906 - DNA, 601 bp, Human; identical to SEQ ID NO: 96576

SEQ ID NO: 97907 - DNA, 601 bp, Human; identical to SEQ ID NO: 96577

SEQ ID NO: 97908 - DNA, 601 bp, Human; identical to SEQ ID NO: 96578

SEQ ID NO: 97909 - DNA, 601 bp, Human; identical to SEQ ID NO: 96579

SEQ ID NO: 97910 - DNA, 601 bp, Human; identical to SEQ ID NO: 96580

SEQ ID NO: 97911 - DNA, 601 bp, Human; identical to SEQ ID NO: 96581

SEQ ID NO: 97912 - DNA, 601 bp, Human; identical to SEQ ID NO: 96582

SEQ ID NO: 97913 - DNA, 601 bp, Human; identical to SEQ ID NO: 96583

SEQ ID NO: 97914 - DNA, 601 bp, Human; identical to SEQ ID NO: 96584

SEQ ID NO: 97915 - DNA, 417 bp, Human; identical to SEQ ID NO: 96585

SEQ ID NO: 97916 - DNA, 480 bp, Human; identical to SEQ ID NO: 96586

SEQ ID NO: 97917 - DNA, 601 bp, Human; identical to SEQ ID NO: 96587

SEQ ID NO: 97918 - DNA, 601 bp, Human; identical to SEQ ID NO: 96588

SEQ ID NO: 97919 - DNA, 601 bp, Human; identical to SEQ ID NO: 96589

SEQ ID NO: 97920 - DNA, 601 bp, Human; identical to SEQ ID NO: 96590

SEQ ID NO: 97921 - DNA, 601 bp, Human; identical to SEQ ID NO: 96591

SEQ ID NO: 97922 - DNA, 601 bp, Human; identical to SEQ ID NO: 96592

SEQ ID NO: 97923 - DNA, 601 bp, Human; identical to SEQ ID NO: 96593

SEQ ID NO: 97924 - DNA, 601 bp, Human; identical to SEQ ID NO: 96594

SEQ ID NO: 97925 - DNA, 601 bp, Human; identical to SEQ ID NO: 96595

SEQ ID NO: 97926 - DNA, 601 bp, Human; identical to SEQ ID NO: 96596

SEQ ID NO: 97927 - DNA, 601 bp, Human; identical to SEQ ID NO: 96597

SEQ ID NO: 97928 - DNA, 601 bp, Human; identical to SEQ ID NO: 96598

SEQ ID NO: 97929 - DNA, 601 bp, Human; identical to SEQ ID NO: 96599

SEQ ID NO: 97930 - DNA, 601 bp, Human; identical to SEQ ID NO: 96600

SEQ ID NO: 97931 - DNA, 601 bp, Human; identical to SEQ ID NO: 96601

SEQ ID NO: 97932 - DNA, 601 bp, Human; identical to SEQ ID NO: 96602

SEQ ID NO: 97933 - DNA, 601 bp, Human; identical to SEQ ID NO: 96603

SEQ ID NO: 97934 - DNA, 601 bp, Human; identical to SEQ ID NO: 96604

SEQ ID NO: 97935 - DNA, 601 bp, Human; identical to SEQ ID NO: 96605

SEQ ID NO: 97936 - DNA, 601 bp, Human; identical to SEQ ID NO: 96606

SEQ ID NO: 97937 - DNA, 601 bp, Human; identical to SEQ ID NO: 96607

SEQ ID NO: 97938 - DNA, 601 bp, Human; identical to SEQ ID NO: 96608

SEQ ID NO: 97939 - DNA, 601 bp, Human; identical to SEQ ID NO: 96609

SEQ ID NO: 97940 - DNA, 601 bp, Human; identical to SEQ ID NO: 96610

SEQ ID NO: 97941 - DNA, 601 bp, Human; identical to SEQ ID NO: 96611

SEQ ID NO: 97942 - DNA, 601 bp, Human; identical to SEQ ID NO: 96612

SEQ ID NO: 97943 - DNA, 601 bp, Human; identical to SEQ ID NO: 96613

SEQ ID NO: 97944 - DNA, 601 bp, Human; identical to SEQ ID NO: 96614

SEQ ID NO: 97945 - DNA, 601 bp, Human; identical to SEQ ID NO: 96615

SEQ ID NO: 97946 - DNA, 601 bp, Human; identical to SEQ ID NO: 96616

SEQ ID NO: 97947 - DNA, 601 bp, Human; identical to SEQ ID NO: 96617

SEQ ID NO: 97948 - DNA, 601 bp, Human; identical to SEQ ID NO: 96618

SEQ ID NO: 97949 - DNA, 601 bp, Human; identical to SEQ ID NO: 96619

SEQ ID NO: 97950 - DNA, 601 bp, Human; identical to SEQ ID NO: 96620

SEQ ID NO: 97951 - DNA, 601 bp, Human; identical to SEQ ID NO: 96621

SEQ ID NO: 97952 - DNA, 601 bp, Human; identical to SEQ ID NO: 96622

SEQ ID NO: 97953 - DNA, 601 bp, Human; identical to SEQ ID NO: 96623

SEQ ID NO: 97954 - DNA, 601 bp, Human; identical to SEQ ID NO: 96624

SEQ ID NO: 97955 - DNA, 601 bp, Human; identical to SEQ ID NO: 96625

SEQ ID NO: 97956 - DNA, 601 bp, Human; identical to SEQ ID NO: 96626

SEQ ID NO: 97957 - DNA, 601 bp, Human; identical to SEQ ID NO: 96627

SEQ ID NO: 97958 - DNA, 601 bp, Human; identical to SEQ ID NO: 96628

SEQ ID NO: 97959 - DNA, 601 bp, Human; identical to SEQ ID NO: 96629

SEQ ID NO: 97960 - DNA, 601 bp, Human; identical to SEQ ID NO: 96630

SEQ ID NO: 97961 - DNA, 601 bp, Human; identical to SEQ ID NO: 96631

SEQ ID NO: 97962 - DNA, 601 bp, Human; identical to SEQ ID NO: 96632

SEQ ID NO: 97963 - DNA, 601 bp, Human; identical to SEQ ID NO: 96633

SEQ ID NO: 97964 - DNA, 601 bp, Human; identical to SEQ ID NO: 96634

SEQ ID NO: 97965 - DNA, 601 bp, Human; identical to SEQ ID NO: 96635

SEQ ID NO: 97966 - DNA, 601 bp, Human; identical to SEQ ID NO: 96636

SEQ ID NO: 97967 - DNA, 601 bp, Human; identical to SEQ ID NO: 96637

SEQ ID NO: 97968 - DNA, 601 bp, Human; identical to SEQ ID NO: 96638

SEQ ID NO: 97969 - DNA, 601 bp, Human; identical to SEQ ID NO: 96639

SEQ ID NO: 97970 - DNA, 601 bp, Human; identical to SEQ ID NO: 96640

SEQ ID NO: 97971 - DNA, 601 bp, Human; identical to SEQ ID NO: 96375

SEQ ID NO: 97972 - DNA, 601 bp, Human; identical to SEQ ID NO: 96376

SEQ ID NO: 97973 - DNA, 601 bp, Human; identical to SEQ ID NO: 96377

SEQ ID NO: 97974 - DNA, 601 bp, Human; identical to SEQ ID NO: 96378

SEQ ID NO: 97975 - DNA, 601 bp, Human; identical to SEQ ID NO: 96379

SEQ ID NO: 97976 - DNA, 601 bp, Human; identical to SEQ ID NO: 96380

SEQ ID NO: 97977 - DNA, 601 bp, Human; identical to SEQ ID NO: 96381

SEQ ID NO: 97978 - DNA, 601 bp, Human; identical to SEQ ID NO: 96382

SEQ ID NO: 97979 - DNA, 601 bp, Human; identical to SEQ ID NO: 96383

SEQ ID NO: 97980 - DNA, 601 bp, Human; identical to SEQ ID NO: 96384

SEQ ID NO: 97981 - DNA, 601 bp, Human; identical to SEQ ID NO: 96385

SEQ ID NO: 97982 - DNA, 601 bp, Human; identical to SEQ ID NO: 96386

SEQ ID NO: 97983 - DNA, 601 bp, Human; identical to SEQ ID NO: 96387

SEQ ID NO: 97984 - DNA, 601 bp, Human; identical to SEQ ID NO: 96388

SEQ ID NO: 97985 - DNA, 601 bp, Human; identical to SEQ ID NO: 96389

SEQ ID NO: 97986 - DNA, 601 bp, Human; identical to SEQ ID NO: 96390

SEQ ID NO: 97987 - DNA, 601 bp, Human; identical to SEQ ID NO: 96391

SEQ ID NO: 97988 - DNA, 601 bp, Human; identical to SEQ ID NO: 96392

SEQ ID NO: 97989 - DNA, 601 bp, Human; identical to SEQ ID NO: 96393

SEQ ID NO: 97990 - DNA, 601 bp, Human; identical to SEQ ID NO: 96394

SEQ ID NO: 97991 - DNA, 601 bp, Human; identical to SEQ ID NO: 96395

SEQ ID NO: 97992 - DNA, 601 bp, Human; identical to SEQ ID NO: 96396

SEQ ID NO: 97993 - DNA, 601 bp, Human; identical to SEQ ID NO: 96397

SEQ ID NO: 97994 - DNA, 601 bp, Human; identical to SEQ ID NO: 96398

SEQ ID NO: 97995 - DNA, 601 bp, Human; identical to SEQ ID NO: 96399

SEQ ID NO: 97996 - DNA, 601 bp, Human; identical to SEQ ID NO: 96400

SEQ ID NO: 97997 - DNA, 601 bp, Human; identical to SEQ ID NO: 96401

SEQ ID NO: 97998 - DNA, 601 bp, Human; identical to SEQ ID NO: 96402

SEQ ID NO: 97999 - DNA, 601 bp, Human; identical to SEQ ID NO: 96403

SEQ ID NO: 98000 - DNA, 601 bp, Human; identical to SEQ ID NO: 96404

SEQ ID NO: 98001 - DNA, 601 bp, Human; identical to SEQ ID NO: 96405

SEQ ID NO: 98002 - DNA, 601 bp, Human; identical to SEQ ID NO: 96406

SEQ ID NO: 98003 - DNA, 601 bp, Human; identical to SEQ ID NO: 96407

SEQ ID NO: 98004 - DNA, 601 bp, Human; identical to SEQ ID NO: 96408

SEQ ID NO: 98005 - DNA, 601 bp, Human; identical to SEQ ID NO: 96409

SEQ ID NO: 98006 - DNA, 601 bp, Human; identical to SEQ ID NO: 96410

SEQ ID NO: 98007 - DNA, 601 bp, Human; identical to SEQ ID NO: 96411

SEQ ID NO: 98008 - DNA, 601 bp, Human; identical to SEQ ID NO: 96412

SEQ ID NO: 98009 - DNA, 601 bp, Human; identical to SEQ ID NO: 96413

SEQ ID NO: 98010 - DNA, 601 bp, Human; identical to SEQ ID NO: 96414

SEQ ID NO: 98011 - DNA, 601 bp, Human; identical to SEQ ID NO: 96415

SEQ ID NO: 98012 - DNA, 601 bp, Human; identical to SEQ ID NO: 96416

SEQ ID NO: 98013 - DNA, 601 bp, Human; identical to SEQ ID NO: 96417

SEQ ID NO: 98014 - DNA, 601 bp, Human; identical to SEQ ID NO: 96418

SEQ ID NO: 98015 - DNA, 601 bp, Human; identical to SEQ ID NO: 96419

SEQ ID NO: 98016 - DNA, 601 bp, Human; identical to SEQ ID NO: 96420

SEQ ID NO: 98017 - DNA, 601 bp, Human; identical to SEQ ID NO: 96421

SEQ ID NO: 98018 - DNA, 601 bp, Human; identical to SEQ ID NO: 96422

SEQ ID NO: 98019 - DNA, 601 bp, Human; identical to SEQ ID NO: 96423

SEQ ID NO: 98020 - DNA, 601 bp, Human; identical to SEQ ID NO: 96424

SEQ ID NO: 98021 - DNA, 601 bp, Human; identical to SEQ ID NO: 96425

SEQ ID NO: 98022 - DNA, 601 bp, Human; identical to SEQ ID NO: 96426

SEQ ID NO: 98023 - DNA, 601 bp, Human; identical to SEQ ID NO: 96427

SEQ ID NO: 98024 - DNA, 601 bp, Human; identical to SEQ ID NO: 96428

SEQ ID NO: 98025 - DNA, 601 bp, Human; identical to SEQ ID NO: 96429

SEQ ID NO: 98026 - DNA, 601 bp, Human; identical to SEQ ID NO: 96430

SEQ ID NO: 98027 - DNA, 601 bp, Human; identical to SEQ ID NO: 96431

SEQ ID NO: 98028 - DNA, 601 bp, Human; identical to SEQ ID NO: 96432

SEQ ID NO: 98029 - DNA, 601 bp, Human; identical to SEQ ID NO: 96433

SEQ ID NO: 98030 - DNA, 601 bp, Human; identical to SEQ ID NO: 96434

SEQ ID NO: 98031 - DNA, 601 bp, Human; identical to SEQ ID NO: 96435

SEQ ID NO: 98032 - DNA, 601 bp, Human; identical to SEQ ID NO: 96436

SEQ ID NO: 98033 - DNA, 601 bp, Human; identical to SEQ ID NO: 96437

SEQ ID NO: 98034 - DNA, 601 bp, Human; identical to SEQ ID NO: 96438

SEQ ID NO: 98035 - DNA, 601 bp, Human; identical to SEQ ID NO: 96439

SEQ ID NO: 98036 - DNA, 601 bp, Human; identical to SEQ ID NO: 96440

SEQ ID NO: 98037 - DNA, 601 bp, Human; identical to SEQ ID NO: 96441

SEQ ID NO: 98038 - DNA, 601 bp, Human; identical to SEQ ID NO: 96442

SEQ ID NO: 98039 - DNA, 601 bp, Human; identical to SEQ ID NO: 96443

SEQ ID NO: 98040 - DNA, 601 bp, Human; identical to SEQ ID NO: 96444

SEQ ID NO: 98041 - DNA, 601 bp, Human; identical to SEQ ID NO: 96445

SEQ ID NO: 98042 - DNA, 601 bp, Human; identical to SEQ ID NO: 96446

SEQ ID NO: 98043 - DNA, 601 bp, Human; identical to SEQ ID NO: 96447

SEQ ID NO: 98044 - DNA, 601 bp, Human; identical to SEQ ID NO: 96448

SEQ ID NO: 98045 - DNA, 601 bp, Human; identical to SEQ ID NO: 96449

SEQ ID NO: 98046 - DNA, 601 bp, Human; identical to SEQ ID NO: 96450

SEQ ID NO: 98047 - DNA, 601 bp, Human; identical to SEQ ID NO: 96451

SEQ ID NO: 98048 - DNA, 601 bp, Human; identical to SEQ ID NO: 96452

SEQ ID NO: 98049 - DNA, 601 bp, Human; identical to SEQ ID NO: 96453

SEQ ID NO: 98050 - DNA, 601 bp, Human; identical to SEQ ID NO: 96454

SEQ ID NO: 98051 - DNA, 601 bp, Human; identical to SEQ ID NO: 96455

SEQ ID NO: 98052 - DNA, 601 bp, Human; identical to SEQ ID NO: 96456

SEQ ID NO: 98053 - DNA, 601 bp, Human; identical to SEQ ID NO: 96457

SEQ ID NO: 98054 - DNA, 601 bp, Human; identical to SEQ ID NO: 96458

SEQ ID NO: 98055 - DNA, 601 bp, Human; identical to SEQ ID NO: 96459

SEQ ID NO: 98056 - DNA, 601 bp, Human; identical to SEQ ID NO: 96460

SEQ ID NO: 98057 - DNA, 601 bp, Human; identical to SEQ ID NO: 96461

SEQ ID NO: 98058 - DNA, 601 bp, Human; identical to SEQ ID NO: 96462

SEQ ID NO: 98059 - DNA, 601 bp, Human; identical to SEQ ID NO: 96463

SEQ ID NO: 98060 - DNA, 601 bp, Human; identical to SEQ ID NO: 96464

SEQ ID NO: 98061 - DNA, 601 bp, Human; identical to SEQ ID NO: 96465

SEQ ID NO: 98062 - DNA, 601 bp, Human; identical to SEQ ID NO: 96466

SEQ ID NO: 98063 - DNA, 601 bp, Human; identical to SEQ ID NO: 96467

SEQ ID NO: 98064 - DNA, 601 bp, Human; identical to SEQ ID NO: 96468

SEQ ID NO: 98065 - DNA, 601 bp, Human; identical to SEQ ID NO: 96469

SEQ ID NO: 98066 - DNA, 601 bp, Human; identical to SEQ ID NO: 96470

SEQ ID NO: 98067 - DNA, 601 bp, Human; identical to SEQ ID NO: 96471

SEQ ID NO: 98068 - DNA, 601 bp, Human; identical to SEQ ID NO: 96472

SEQ ID NO: 98069 - DNA, 601 bp, Human; identical to SEQ ID NO: 96473

SEQ ID NO: 98070 - DNA, 601 bp, Human; identical to SEQ ID NO: 96474

SEQ ID NO: 98071 - DNA, 601 bp, Human; identical to SEQ ID NO: 96475

SEQ ID NO: 98072 - DNA, 601 bp, Human; identical to SEQ ID NO: 96476

SEQ ID NO: 98073 - DNA, 601 bp, Human; identical to SEQ ID NO: 96477

SEQ ID NO: 98074 - DNA, 601 bp, Human; identical to SEQ ID NO: 96478

SEQ ID NO: 98075 - DNA, 601 bp, Human; identical to SEQ ID NO: 96479

SEQ ID NO: 98076 - DNA, 601 bp, Human; identical to SEQ ID NO: 96480

SEQ ID NO: 98077 - DNA, 601 bp, Human; identical to SEQ ID NO: 96481

SEQ ID NO: 98078 - DNA, 601 bp, Human; identical to SEQ ID NO: 96482

SEQ ID NO: 98079 - DNA, 601 bp, Human; identical to SEQ ID NO: 96483

SEQ ID NO: 98080 - DNA, 601 bp, Human; identical to SEQ ID NO: 96484

SEQ ID NO: 98081 - DNA, 601 bp, Human; identical to SEQ ID NO: 96485

SEQ ID NO: 98082 - DNA, 601 bp, Human; identical to SEQ ID NO: 96486

SEQ ID NO: 98083 - DNA, 601 bp, Human; identical to SEQ ID NO: 96487

SEQ ID NO: 98084 - DNA, 601 bp, Human; identical to SEQ ID NO: 96488

SEQ ID NO: 98085 - DNA, 601 bp, Human; identical to SEQ ID NO: 96489

SEQ ID NO: 98086 - DNA, 601 bp, Human; identical to SEQ ID NO: 96490

SEQ ID NO: 98087 - DNA, 601 bp, Human; identical to SEQ ID NO: 96491

SEQ ID NO: 98088 - DNA, 601 bp, Human; identical to SEQ ID NO: 96492

SEQ ID NO: 98089 - DNA, 601 bp, Human; identical to SEQ ID NO: 96493

SEQ ID NO: 98090 - DNA, 601 bp, Human; identical to SEQ ID NO: 96494

SEQ ID NO: 98091 - DNA, 601 bp, Human; identical to SEQ ID NO: 96495

SEQ ID NO: 98092 - DNA, 601 bp, Human; identical to SEQ ID NO: 96496

SEQ ID NO: 98093 - DNA, 601 bp, Human; identical to SEQ ID NO: 96497

SEQ ID NO: 98094 - DNA, 601 bp, Human; identical to SEQ ID NO: 96498

SEQ ID NO: 98095 - DNA, 601 bp, Human; identical to SEQ ID NO: 96499

SEQ ID NO: 98096 - DNA, 601 bp, Human; identical to SEQ ID NO: 96500

SEQ ID NO: 98097 - DNA, 601 bp, Human; identical to SEQ ID NO: 96501

SEQ ID NO: 98098 - DNA, 601 bp, Human; identical to SEQ ID NO: 96502

SEQ ID NO: 98099 - DNA, 601 bp, Human; identical to SEQ ID NO: 96503

SEQ ID NO: 98100 - DNA, 601 bp, Human; identical to SEQ ID NO: 96504

SEQ ID NO: 98101 - DNA, 601 bp, Human; identical to SEQ ID NO: 96505

SEQ ID NO: 98102 - DNA, 601 bp, Human; identical to SEQ ID NO: 96506

SEQ ID NO: 98103 - DNA, 601 bp, Human; identical to SEQ ID NO: 96507

SEQ ID NO: 98104 - DNA, 601 bp, Human; identical to SEQ ID NO: 96508

SEQ ID NO: 98105 - DNA, 601 bp, Human; identical to SEQ ID NO: 96509

SEQ ID NO: 98106 - DNA, 601 bp, Human; identical to SEQ ID NO: 96510

SEQ ID NO: 98107 - DNA, 601 bp, Human; identical to SEQ ID NO: 96511

SEQ ID NO: 98108 - DNA, 601 bp, Human; identical to SEQ ID NO: 96512

SEQ ID NO: 98109 - DNA, 601 bp, Human; identical to SEQ ID NO: 96513

SEQ ID NO: 98110 - DNA, 601 bp, Human; identical to SEQ ID NO: 96514

SEQ ID NO: 98111 - DNA, 601 bp, Human; identical to SEQ ID NO: 96515

SEQ ID NO: 98112 - DNA, 601 bp, Human; identical to SEQ ID NO: 96516

SEQ ID NO: 98113 - DNA, 601 bp, Human; identical to SEQ ID NO: 96517

SEQ ID NO: 98114 - DNA, 601 bp, Human; identical to SEQ ID NO: 96518

SEQ ID NO: 98115 - DNA, 601 bp, Human; identical to SEQ ID NO: 96519

SEQ ID NO: 98116 - DNA, 601 bp, Human; identical to SEQ ID NO: 96520

SEQ ID NO: 98117 - DNA, 601 bp, Human; identical to SEQ ID NO: 96521

SEQ ID NO: 98118 - DNA, 601 bp, Human; identical to SEQ ID NO: 96522

SEQ ID NO: 98119 - DNA, 601 bp, Human; identical to SEQ ID NO: 96523

SEQ ID NO: 98120 - DNA, 601 bp, Human; identical to SEQ ID NO: 96524

SEQ ID NO: 98121 - DNA, 601 bp, Human; identical to SEQ ID NO: 96525

SEQ ID NO: 98122 - DNA, 601 bp, Human; identical to SEQ ID NO: 96526

SEQ ID NO: 98123 - DNA, 601 bp, Human; identical to SEQ ID NO: 96527

SEQ ID NO: 98124 - DNA, 601 bp, Human; identical to SEQ ID NO: 96528

SEQ ID NO: 98125 - DNA, 601 bp, Human; identical to SEQ ID NO: 96529

SEQ ID NO: 98126 - DNA, 601 bp, Human; identical to SEQ ID NO: 96530

SEQ ID NO: 98127 - DNA, 601 bp, Human; identical to SEQ ID NO: 96531

SEQ ID NO: 98128 - DNA, 601 bp, Human; identical to SEQ ID NO: 96532

SEQ ID NO: 98129 - DNA, 601 bp, Human; identical to SEQ ID NO: 96533

SEQ ID NO: 98130 - DNA, 601 bp, Human; identical to SEQ ID NO: 96534

SEQ ID NO: 98131 - DNA, 601 bp, Human; identical to SEQ ID NO: 96535

SEQ ID NO: 98132 - DNA, 601 bp, Human; identical to SEQ ID NO: 96536

SEQ ID NO: 98133 - DNA, 601 bp, Human; identical to SEQ ID NO: 96537

SEQ ID NO: 98134 - DNA, 601 bp, Human; identical to SEQ ID NO: 96538

SEQ ID NO: 98135 - DNA, 601 bp, Human; identical to SEQ ID NO: 96539

SEQ ID NO: 98136 - DNA, 601 bp, Human; identical to SEQ ID NO: 96540

SEQ ID NO: 98137 - DNA, 601 bp, Human; identical to SEQ ID NO: 96541

SEQ ID NO: 98138 - DNA, 601 bp, Human; identical to SEQ ID NO: 96542

SEQ ID NO: 98139 - DNA, 601 bp, Human; identical to SEQ ID NO: 96543

SEQ ID NO: 98140 - DNA, 601 bp, Human; identical to SEQ ID NO: 96544

SEQ ID NO: 98141 - DNA, 601 bp, Human; identical to SEQ ID NO: 96545

SEQ ID NO: 98142 - DNA, 601 bp, Human; identical to SEQ ID NO: 96546

SEQ ID NO: 98143 - DNA, 601 bp, Human; identical to SEQ ID NO: 96547

SEQ ID NO: 98144 - DNA, 601 bp, Human; identical to SEQ ID NO: 96548

SEQ ID NO: 98145 - DNA, 601 bp, Human; identical to SEQ ID NO: 96549

SEQ ID NO: 98146 - DNA, 601 bp, Human; identical to SEQ ID NO: 96550

SEQ ID NO: 98147 - DNA, 601 bp, Human; identical to SEQ ID NO: 96551

SEQ ID NO: 98148 - DNA, 601 bp, Human; identical to SEQ ID NO: 96552

SEQ ID NO: 98149 - DNA, 601 bp, Human; identical to SEQ ID NO: 96553

SEQ ID NO: 98150 - DNA, 601 bp, Human; identical to SEQ ID NO: 96554

SEQ ID NO: 98151 - DNA, 601 bp, Human; identical to SEQ ID NO: 96555

SEQ ID NO: 98152 - DNA, 601 bp, Human; identical to SEQ ID NO: 96556

SEQ ID NO: 98153 - DNA, 601 bp, Human; identical to SEQ ID NO: 96557

SEQ ID NO: 98154 - DNA, 601 bp, Human; identical to SEQ ID NO: 96558

SEQ ID NO: 98155 - DNA, 601 bp, Human; identical to SEQ ID NO: 96559

SEQ ID NO: 98156 - DNA, 601 bp, Human; identical to SEQ ID NO: 96560

SEQ ID NO: 98157 - DNA, 601 bp, Human; identical to SEQ ID NO: 96561

SEQ ID NO: 98158 - DNA, 601 bp, Human; identical to SEQ ID NO: 96562

SEQ ID NO: 98159 - DNA, 601 bp, Human; identical to SEQ ID NO: 96563

SEQ ID NO: 98160 - DNA, 601 bp, Human; identical to SEQ ID NO: 96564

SEQ ID NO: 98161 - DNA, 601 bp, Human; identical to SEQ ID NO: 96565

SEQ ID NO: 98162 - DNA, 601 bp, Human; identical to SEQ ID NO: 96566

SEQ ID NO: 98163 - DNA, 601 bp, Human; identical to SEQ ID NO: 96567

SEQ ID NO: 98164 - DNA, 601 bp, Human; identical to SEQ ID NO: 96568

SEQ ID NO: 98165 - DNA, 601 bp, Human; identical to SEQ ID NO: 96569

SEQ ID NO: 98166 - DNA, 601 bp, Human; identical to SEQ ID NO: 96570

SEQ ID NO: 98167 - DNA, 601 bp, Human; identical to SEQ ID NO: 96571

SEQ ID NO: 98168 - DNA, 601 bp, Human; identical to SEQ ID NO: 96572

SEQ ID NO: 98169 - DNA, 601 bp, Human; identical to SEQ ID NO: 96573

SEQ ID NO: 98170 - DNA, 601 bp, Human; identical to SEQ ID NO: 96574

SEQ ID NO: 98171 - DNA, 601 bp, Human; identical to SEQ ID NO: 96575

SEQ ID NO: 98172 - DNA, 601 bp, Human; identical to SEQ ID NO: 96576

SEQ ID NO: 98173 - DNA, 601 bp, Human; identical to SEQ ID NO: 96577

SEQ ID NO: 98174 - DNA, 601 bp, Human; identical to SEQ ID NO: 96578

SEQ ID NO: 98175 - DNA, 601 bp, Human; identical to SEQ ID NO: 96579

SEQ ID NO: 98176 - DNA, 601 bp, Human; identical to SEQ ID NO: 96580

SEQ ID NO: 98177 - DNA, 601 bp, Human; identical to SEQ ID NO: 96581

SEQ ID NO: 98178 - DNA, 601 bp, Human; identical to SEQ ID NO: 96582

SEQ ID NO: 98179 - DNA, 601 bp, Human; identical to SEQ ID NO: 96583

SEQ ID NO: 98180 - DNA, 601 bp, Human; identical to SEQ ID NO: 96584

SEQ ID NO: 98181 - DNA, 417 bp, Human; identical to SEQ ID NO: 96585

SEQ ID NO: 98182 - DNA, 480 bp, Human; identical to SEQ ID NO: 96586

SEQ ID NO: 98183 - DNA, 601 bp, Human; identical to SEQ ID NO: 96587

SEQ ID NO: 98184 - DNA, 601 bp, Human; identical to SEQ ID NO: 96588

SEQ ID NO: 98185 - DNA, 601 bp, Human; identical to SEQ ID NO: 96589

SEQ ID NO: 98186 - DNA, 601 bp, Human; identical to SEQ ID NO: 96590

SEQ ID NO: 98187 - DNA, 601 bp, Human; identical to SEQ ID NO: 96591

SEQ ID NO: 98188 - DNA, 601 bp, Human; identical to SEQ ID NO: 96592

SEQ ID NO: 98189 - DNA, 601 bp, Human; identical to SEQ ID NO: 96593

SEQ ID NO: 98190 - DNA, 601 bp, Human; identical to SEQ ID NO: 96594

SEQ ID NO: 98191 - DNA, 601 bp, Human; identical to SEQ ID NO: 96595

SEQ ID NO: 98192 - DNA, 601 bp, Human; identical to SEQ ID NO: 96596

SEQ ID NO: 98193 - DNA, 601 bp, Human; identical to SEQ ID NO: 96597

SEQ ID NO: 98194 - DNA, 601 bp, Human; identical to SEQ ID NO: 96598

SEQ ID NO: 98195 - DNA, 601 bp, Human; identical to SEQ ID NO: 96599

SEQ ID NO: 98196 - DNA, 601 bp, Human; identical to SEQ ID NO: 96600

SEQ ID NO: 98197 - DNA, 601 bp, Human; identical to SEQ ID NO: 96601

SEQ ID NO: 98198 - DNA, 601 bp, Human; identical to SEQ ID NO: 96602

SEQ ID NO: 98199 - DNA, 601 bp, Human; identical to SEQ ID NO: 96603

SEQ ID NO: 98200 - DNA, 601 bp, Human; identical to SEQ ID NO: 96604

SEQ ID NO: 98201 - DNA, 601 bp, Human; identical to SEQ ID NO: 96605

SEQ ID NO: 98202 - DNA, 601 bp, Human; identical to SEQ ID NO: 96606

SEQ ID NO: 98203 - DNA, 601 bp, Human; identical to SEQ ID NO: 96607

SEQ ID NO: 98204 - DNA, 601 bp, Human; identical to SEQ ID NO: 96608

SEQ ID NO: 98205 - DNA, 601 bp, Human; identical to SEQ ID NO: 96609

SEQ ID NO: 98206 - DNA, 601 bp, Human; identical to SEQ ID NO: 96610

SEQ ID NO: 98207 - DNA, 601 bp, Human; identical to SEQ ID NO: 96611

SEQ ID NO: 98208 - DNA, 601 bp, Human; identical to SEQ ID NO: 96612

SEQ ID NO: 98209 - DNA, 601 bp, Human; identical to SEQ ID NO: 96613

SEQ ID NO: 98210 - DNA, 601 bp, Human; identical to SEQ ID NO: 96614

SEQ ID NO: 98211 - DNA, 601 bp, Human; identical to SEQ ID NO: 96615

SEQ ID NO: 98212 - DNA, 601 bp, Human; identical to SEQ ID NO: 96616

SEQ ID NO: 98213 - DNA, 601 bp, Human; identical to SEQ ID NO: 96617

SEQ ID NO: 98214 - DNA, 601 bp, Human; identical to SEQ ID NO: 96618

SEQ ID NO: 98215 - DNA, 601 bp, Human; identical to SEQ ID NO: 96619

SEQ ID NO: 98216 - DNA, 601 bp, Human; identical to SEQ ID NO: 96620

SEQ ID NO: 98217 - DNA, 601 bp, Human; identical to SEQ ID NO: 96621

SEQ ID NO: 98218 - DNA, 601 bp, Human; identical to SEQ ID NO: 96622

SEQ ID NO: 98219 - DNA, 601 bp, Human; identical to SEQ ID NO: 96623

SEQ ID NO: 98220 - DNA, 601 bp, Human; identical to SEQ ID NO: 96624

SEQ ID NO: 98221 - DNA, 601 bp, Human; identical to SEQ ID NO: 96625

SEQ ID NO: 98222 - DNA, 601 bp, Human; identical to SEQ ID NO: 96626

SEQ ID NO: 98223 - DNA, 601 bp, Human; identical to SEQ ID NO: 96627

SEQ ID NO: 98224 - DNA, 601 bp, Human; identical to SEQ ID NO: 96628

SEQ ID NO: 98225 - DNA, 601 bp, Human; identical to SEQ ID NO: 96629

SEQ ID NO: 98226 - DNA, 601 bp, Human; identical to SEQ ID NO: 96630

SEQ ID NO: 98227 - DNA, 601 bp, Human; identical to SEQ ID NO: 96631

SEQ ID NO: 98228 - DNA, 601 bp, Human; identical to SEQ ID NO: 96632

SEQ ID NO: 98229 - DNA, 601 bp, Human; identical to SEQ ID NO: 96633

SEQ ID NO: 98230 - DNA, 601 bp, Human; identical to SEQ ID NO: 96634

SEQ ID NO: 98231 - DNA, 601 bp, Human; identical to SEQ ID NO: 96635

SEQ ID NO: 98232 - DNA, 601 bp, Human; identical to SEQ ID NO: 96636

SEQ ID NO: 98233 - DNA, 601 bp, Human; identical to SEQ ID NO: 96637

SEQ ID NO: 98234 - DNA, 601 bp, Human; identical to SEQ ID NO: 96638

SEQ ID NO: 98235 - DNA, 601 bp, Human; identical to SEQ ID NO: 96639

SEQ ID NO: 98236 - DNA, 601 bp, Human; identical to SEQ ID NO: 96640

SEQ ID NO: 98237 - DNA, 601 bp, Human; identical to SEQ ID NO: 96375

SEQ ID NO: 98238 - DNA, 601 bp, Human; identical to SEQ ID NO: 96376

SEQ ID NO: 98239 - DNA, 601 bp, Human; identical to SEQ ID NO: 96377

SEQ ID NO: 98240 - DNA, 601 bp, Human; identical to SEQ ID NO: 96378

SEQ ID NO: 98241 - DNA, 601 bp, Human; identical to SEQ ID NO: 96379

SEQ ID NO: 98242 - DNA, 601 bp, Human; identical to SEQ ID NO: 96380

SEQ ID NO: 98243 - DNA, 601 bp, Human; identical to SEQ ID NO: 96381

SEQ ID NO: 98244 - DNA, 601 bp, Human; identical to SEQ ID NO: 96382

SEQ ID NO: 98245 - DNA, 601 bp, Human; identical to SEQ ID NO: 96383

SEQ ID NO: 98246 - DNA, 601 bp, Human; identical to SEQ ID NO: 96384

SEQ ID NO: 98247 - DNA, 601 bp, Human; identical to SEQ ID NO: 96385

SEQ ID NO: 98248 - DNA, 601 bp, Human; identical to SEQ ID NO: 96386

SEQ ID NO: 98249 - DNA, 601 bp, Human; identical to SEQ ID NO: 96387

SEQ ID NO: 98250 - DNA, 601 bp, Human; identical to SEQ ID NO: 96388

SEQ ID NO: 98251 - DNA, 601 bp, Human; identical to SEQ ID NO: 96389

SEQ ID NO: 98252 - DNA, 601 bp, Human; identical to SEQ ID NO: 96390

SEQ ID NO: 98253 - DNA, 601 bp, Human; identical to SEQ ID NO: 96391

SEQ ID NO: 98254 - DNA, 601 bp, Human; identical to SEQ ID NO: 96392

SEQ ID NO: 98255 - DNA, 601 bp, Human; identical to SEQ ID NO: 96393

SEQ ID NO: 98256 - DNA, 601 bp, Human; identical to SEQ ID NO: 96394

SEQ ID NO: 98257 - DNA, 601 bp, Human; identical to SEQ ID NO: 96395

SEQ ID NO: 98258 - DNA, 601 bp, Human; identical to SEQ ID NO: 96396

SEQ ID NO: 98259 - DNA, 601 bp, Human; identical to SEQ ID NO: 96397

SEQ ID NO: 98260 - DNA, 601 bp, Human; identical to SEQ ID NO: 96398

SEQ ID NO: 98261 - DNA, 601 bp, Human; identical to SEQ ID NO: 96399

SEQ ID NO: 98262 - DNA, 601 bp, Human; identical to SEQ ID NO: 96400

SEQ ID NO: 98263 - DNA, 601 bp, Human; identical to SEQ ID NO: 96401

SEQ ID NO: 98264 - DNA, 601 bp, Human; identical to SEQ ID NO: 96402

SEQ ID NO: 98265 - DNA, 601 bp, Human; identical to SEQ ID NO: 96403

SEQ ID NO: 98266 - DNA, 601 bp, Human; identical to SEQ ID NO: 96404

SEQ ID NO: 98267 - DNA, 601 bp, Human; identical to SEQ ID NO: 96405

SEQ ID NO: 98268 - DNA, 601 bp, Human; identical to SEQ ID NO: 96406

SEQ ID NO: 98269 - DNA, 601 bp, Human; identical to SEQ ID NO: 96407

SEQ ID NO: 98270 - DNA, 601 bp, Human; identical to SEQ ID NO: 96408

SEQ ID NO: 98271 - DNA, 601 bp, Human; identical to SEQ ID NO: 96409

SEQ ID NO: 98272 - DNA, 601 bp, Human; identical to SEQ ID NO: 96410

SEQ ID NO: 98273 - DNA, 601 bp, Human; identical to SEQ ID NO: 96411

SEQ ID NO: 98274 - DNA, 601 bp, Human; identical to SEQ ID NO: 96412

SEQ ID NO: 98275 - DNA, 601 bp, Human; identical to SEQ ID NO: 96413

SEQ ID NO: 98276 - DNA, 601 bp, Human; identical to SEQ ID NO: 96414

SEQ ID NO: 98277 - DNA, 601 bp, Human; identical to SEQ ID NO: 96415

SEQ ID NO: 98278 - DNA, 601 bp, Human; identical to SEQ ID NO: 96416

SEQ ID NO: 98279 - DNA, 601 bp, Human; identical to SEQ ID NO: 96417

SEQ ID NO: 98280 - DNA, 601 bp, Human; identical to SEQ ID NO: 96418

SEQ ID NO: 98281 - DNA, 601 bp, Human; identical to SEQ ID NO: 96419

SEQ ID NO: 98282 - DNA, 601 bp, Human; identical to SEQ ID NO: 96420

SEQ ID NO: 98283 - DNA, 601 bp, Human; identical to SEQ ID NO: 96421

SEQ ID NO: 98284 - DNA, 601 bp, Human; identical to SEQ ID NO: 96422

SEQ ID NO: 98285 - DNA, 601 bp, Human; identical to SEQ ID NO: 96423

SEQ ID NO: 98286 - DNA, 601 bp, Human; identical to SEQ ID NO: 96424

SEQ ID NO: 98287 - DNA, 601 bp, Human; identical to SEQ ID NO: 96425

SEQ ID NO: 98288 - DNA, 601 bp, Human; identical to SEQ ID NO: 96426

SEQ ID NO: 98289 - DNA, 601 bp, Human; identical to SEQ ID NO: 96427

SEQ ID NO: 98290 - DNA, 601 bp, Human; identical to SEQ ID NO: 96428

SEQ ID NO: 98291 - DNA, 601 bp, Human; identical to SEQ ID NO: 96429

SEQ ID NO: 98292 - DNA, 601 bp, Human; identical to SEQ ID NO: 96430

SEQ ID NO: 98293 - DNA, 601 bp, Human; identical to SEQ ID NO: 96431

SEQ ID NO: 98294 - DNA, 601 bp, Human; identical to SEQ ID NO: 96432

SEQ ID NO: 98295 - DNA, 601 bp, Human; identical to SEQ ID NO: 96433

SEQ ID NO: 98296 - DNA, 601 bp, Human; identical to SEQ ID NO: 96434

SEQ ID NO: 98297 - DNA, 601 bp, Human; identical to SEQ ID NO: 96435

SEQ ID NO: 98298 - DNA, 601 bp, Human; identical to SEQ ID NO: 96436

SEQ ID NO: 98299 - DNA, 601 bp, Human; identical to SEQ ID NO: 96437

SEQ ID NO: 98300 - DNA, 601 bp, Human; identical to SEQ ID NO: 96438

SEQ ID NO: 98301 - DNA, 601 bp, Human; identical to SEQ ID NO: 96439

SEQ ID NO: 98302 - DNA, 601 bp, Human; identical to SEQ ID NO: 96440

SEQ ID NO: 98303 - DNA, 601 bp, Human; identical to SEQ ID NO: 96441

SEQ ID NO: 98304 - DNA, 601 bp, Human; identical to SEQ ID NO: 96442

SEQ ID NO: 98305 - DNA, 601 bp, Human; identical to SEQ ID NO: 96443

SEQ ID NO: 98306 - DNA, 601 bp, Human; identical to SEQ ID NO: 96444

SEQ ID NO: 98307 - DNA, 601 bp, Human; identical to SEQ ID NO: 96445

SEQ ID NO: 98308 - DNA, 601 bp, Human; identical to SEQ ID NO: 96446

SEQ ID NO: 98309 - DNA, 601 bp, Human; identical to SEQ ID NO: 96447

SEQ ID NO: 98310 - DNA, 601 bp, Human; identical to SEQ ID NO: 96448

SEQ ID NO: 98311 - DNA, 601 bp, Human; identical to SEQ ID NO: 96449

SEQ ID NO: 98312 - DNA, 601 bp, Human; identical to SEQ ID NO: 96450

SEQ ID NO: 98313 - DNA, 601 bp, Human; identical to SEQ ID NO: 96451

SEQ ID NO: 98314 - DNA, 601 bp, Human; identical to SEQ ID NO: 96452

SEQ ID NO: 98315 - DNA, 601 bp, Human; identical to SEQ ID NO: 96453

SEQ ID NO: 98316 - DNA, 601 bp, Human; identical to SEQ ID NO: 96454

SEQ ID NO: 98317 - DNA, 601 bp, Human; identical to SEQ ID NO: 96455

SEQ ID NO: 98318 - DNA, 601 bp, Human; identical to SEQ ID NO: 96456

SEQ ID NO: 98319 - DNA, 601 bp, Human; identical to SEQ ID NO: 96457

SEQ ID NO: 98320 - DNA, 601 bp, Human; identical to SEQ ID NO: 96458

SEQ ID NO: 98321 - DNA, 601 bp, Human; identical to SEQ ID NO: 96459

SEQ ID NO: 98322 - DNA, 601 bp, Human; identical to SEQ ID NO: 96460

SEQ ID NO: 98323 - DNA, 601 bp, Human; identical to SEQ ID NO: 96461

SEQ ID NO: 98324 - DNA, 601 bp, Human; identical to SEQ ID NO: 96462

SEQ ID NO: 98325 - DNA, 601 bp, Human; identical to SEQ ID NO: 96463

SEQ ID NO: 98326 - DNA, 601 bp, Human; identical to SEQ ID NO: 96464

SEQ ID NO: 98327 - DNA, 601 bp, Human; identical to SEQ ID NO: 96465

SEQ ID NO: 98328 - DNA, 601 bp, Human; identical to SEQ ID NO: 96466

SEQ ID NO: 98329 - DNA, 601 bp, Human; identical to SEQ ID NO: 96467

SEQ ID NO: 98330 - DNA, 601 bp, Human; identical to SEQ ID NO: 96468

SEQ ID NO: 98331 - DNA, 601 bp, Human; identical to SEQ ID NO: 96469

SEQ ID NO: 98332 - DNA, 601 bp, Human; identical to SEQ ID NO: 96470

SEQ ID NO: 98333 - DNA, 601 bp, Human; identical to SEQ ID NO: 96471

SEQ ID NO: 98334 - DNA, 601 bp, Human; identical to SEQ ID NO: 96472

SEQ ID NO: 98335 - DNA, 601 bp, Human; identical to SEQ ID NO: 96473

SEQ ID NO: 98336 - DNA, 601 bp, Human; identical to SEQ ID NO: 96474

SEQ ID NO: 98337 - DNA, 601 bp, Human; identical to SEQ ID NO: 96475

SEQ ID NO: 98338 - DNA, 601 bp, Human; identical to SEQ ID NO: 96476

SEQ ID NO: 98339 - DNA, 601 bp, Human; identical to SEQ ID NO: 96477

SEQ ID NO: 98340 - DNA, 601 bp, Human; identical to SEQ ID NO: 96478

SEQ ID NO: 98341 - DNA, 601 bp, Human; identical to SEQ ID NO: 96479

SEQ ID NO: 98342 - DNA, 601 bp, Human; identical to SEQ ID NO: 96480

SEQ ID NO: 98343 - DNA, 601 bp, Human; identical to SEQ ID NO: 96481

SEQ ID NO: 98344 - DNA, 601 bp, Human; identical to SEQ ID NO: 96482

SEQ ID NO: 98345 - DNA, 601 bp, Human; identical to SEQ ID NO: 96483

SEQ ID NO: 98346 - DNA, 601 bp, Human; identical to SEQ ID NO: 96484

SEQ ID NO: 98347 - DNA, 601 bp, Human; identical to SEQ ID NO: 96485

SEQ ID NO: 98348 - DNA, 601 bp, Human; identical to SEQ ID NO: 96486

SEQ ID NO: 98349 - DNA, 601 bp, Human; identical to SEQ ID NO: 96487

SEQ ID NO: 98350 - DNA, 601 bp, Human; identical to SEQ ID NO: 96488

SEQ ID NO: 98351 - DNA, 601 bp, Human; identical to SEQ ID NO: 96489

SEQ ID NO: 98352 - DNA, 601 bp, Human; identical to SEQ ID NO: 96490

SEQ ID NO: 98353 - DNA, 601 bp, Human; identical to SEQ ID NO: 96491

SEQ ID NO: 98354 - DNA, 601 bp, Human; identical to SEQ ID NO: 96492

SEQ ID NO: 98355 - DNA, 601 bp, Human; identical to SEQ ID NO: 96493

SEQ ID NO: 98356 - DNA, 601 bp, Human; identical to SEQ ID NO: 96494

SEQ ID NO: 98357 - DNA, 601 bp, Human; identical to SEQ ID NO: 96495

SEQ ID NO: 98358 - DNA, 601 bp, Human; identical to SEQ ID NO: 96496

SEQ ID NO: 98359 - DNA, 601 bp, Human; identical to SEQ ID NO: 96497

SEQ ID NO: 98360 - DNA, 601 bp, Human; identical to SEQ ID NO: 96498

SEQ ID NO: 98361 - DNA, 601 bp, Human; identical to SEQ ID NO: 96499

SEQ ID NO: 98362 - DNA, 601 bp, Human; identical to SEQ ID NO: 96500

SEQ ID NO: 98363 - DNA, 601 bp, Human; identical to SEQ ID NO: 96501

SEQ ID NO: 98364 - DNA, 601 bp, Human; identical to SEQ ID NO: 96502

SEQ ID NO: 98365 - DNA, 601 bp, Human; identical to SEQ ID NO: 96503

SEQ ID NO: 98366 - DNA, 601 bp, Human; identical to SEQ ID NO: 96504

SEQ ID NO: 98367 - DNA, 601 bp, Human; identical to SEQ ID NO: 96505

SEQ ID NO: 98368 - DNA, 601 bp, Human; identical to SEQ ID NO: 96506

SEQ ID NO: 98369 - DNA, 601 bp, Human; identical to SEQ ID NO: 96507

SEQ ID NO: 98370 - DNA, 601 bp, Human; identical to SEQ ID NO: 96508

SEQ ID NO: 98371 - DNA, 601 bp, Human; identical to SEQ ID NO: 96509

SEQ ID NO: 98372 - DNA, 601 bp, Human; identical to SEQ ID NO: 96510

SEQ ID NO: 98373 - DNA, 601 bp, Human; identical to SEQ ID NO: 96511

SEQ ID NO: 98374 - DNA, 601 bp, Human; identical to SEQ ID NO: 96512

SEQ ID NO: 98375 - DNA, 601 bp, Human; identical to SEQ ID NO: 96513

SEQ ID NO: 98376 - DNA, 601 bp, Human; identical to SEQ ID NO: 96514

SEQ ID NO: 98377 - DNA, 601 bp, Human; identical to SEQ ID NO: 96515

SEQ ID NO: 98378 - DNA, 601 bp, Human; identical to SEQ ID NO: 96516

SEQ ID NO: 98379 - DNA, 601 bp, Human; identical to SEQ ID NO: 96517

SEQ ID NO: 98380 - DNA, 601 bp, Human; identical to SEQ ID NO: 96518

SEQ ID NO: 98381 - DNA, 601 bp, Human; identical to SEQ ID NO: 96519

SEQ ID NO: 98382 - DNA, 601 bp, Human; identical to SEQ ID NO: 96520

SEQ ID NO: 98383 - DNA, 601 bp, Human; identical to SEQ ID NO: 96521

SEQ ID NO: 98384 - DNA, 601 bp, Human; identical to SEQ ID NO: 96522

SEQ ID NO: 98385 - DNA, 601 bp, Human; identical to SEQ ID NO: 96523

SEQ ID NO: 98386 - DNA, 601 bp, Human; identical to SEQ ID NO: 96524

SEQ ID NO: 98387 - DNA, 601 bp, Human; identical to SEQ ID NO: 96525

SEQ ID NO: 98388 - DNA, 601 bp, Human; identical to SEQ ID NO: 96526

SEQ ID NO: 98389 - DNA, 601 bp, Human; identical to SEQ ID NO: 96527

SEQ ID NO: 98390 - DNA, 601 bp, Human; identical to SEQ ID NO: 96528

SEQ ID NO: 98391 - DNA, 601 bp, Human; identical to SEQ ID NO: 96529

SEQ ID NO: 98392 - DNA, 601 bp, Human; identical to SEQ ID NO: 96530

SEQ ID NO: 98393 - DNA, 601 bp, Human; identical to SEQ ID NO: 96531

SEQ ID NO: 98394 - DNA, 601 bp, Human; identical to SEQ ID NO: 96532

SEQ ID NO: 98395 - DNA, 601 bp, Human; identical to SEQ ID NO: 96533

SEQ ID NO: 98396 - DNA, 601 bp, Human; identical to SEQ ID NO: 96534

SEQ ID NO: 98397 - DNA, 601 bp, Human; identical to SEQ ID NO: 96535

SEQ ID NO: 98398 - DNA, 601 bp, Human; identical to SEQ ID NO: 96536

SEQ ID NO: 98399 - DNA, 601 bp, Human; identical to SEQ ID NO: 96537

SEQ ID NO: 98400 - DNA, 601 bp, Human; identical to SEQ ID NO: 96538

SEQ ID NO: 98401 - DNA, 601 bp, Human; identical to SEQ ID NO: 96539

SEQ ID NO: 98402 - DNA, 601 bp, Human; identical to SEQ ID NO: 96540

SEQ ID NO: 98403 - DNA, 601 bp, Human; identical to SEQ ID NO: 96541

SEQ ID NO: 98404 - DNA, 601 bp, Human; identical to SEQ ID NO: 96542

SEQ ID NO: 98405 - DNA, 601 bp, Human; identical to SEQ ID NO: 96543

SEQ ID NO: 98406 - DNA, 601 bp, Human; identical to SEQ ID NO: 96544

SEQ ID NO: 98407 - DNA, 601 bp, Human; identical to SEQ ID NO: 96545

SEQ ID NO: 98408 - DNA, 601 bp, Human; identical to SEQ ID NO: 96546

SEQ ID NO: 98409 - DNA, 601 bp, Human; identical to SEQ ID NO: 96547

SEQ ID NO: 98410 - DNA, 601 bp, Human; identical to SEQ ID NO: 96548

SEQ ID NO: 98411 - DNA, 601 bp, Human; identical to SEQ ID NO: 96549

SEQ ID NO: 98412 - DNA, 601 bp, Human; identical to SEQ ID NO: 96550

SEQ ID NO: 98413 - DNA, 601 bp, Human; identical to SEQ ID NO: 96551

SEQ ID NO: 98414 - DNA, 601 bp, Human; identical to SEQ ID NO: 96552

SEQ ID NO: 98415 - DNA, 601 bp, Human; identical to SEQ ID NO: 96553

SEQ ID NO: 98416 - DNA, 601 bp, Human; identical to SEQ ID NO: 96554

SEQ ID NO: 98417 - DNA, 601 bp, Human; identical to SEQ ID NO: 96555

SEQ ID NO: 98418 - DNA, 601 bp, Human; identical to SEQ ID NO: 96556

SEQ ID NO: 98419 - DNA, 601 bp, Human; identical to SEQ ID NO: 96557

SEQ ID NO: 98420 - DNA, 601 bp, Human; identical to SEQ ID NO: 96558

SEQ ID NO: 98421 - DNA, 601 bp, Human; identical to SEQ ID NO: 96559

SEQ ID NO: 98422 - DNA, 601 bp, Human; identical to SEQ ID NO: 96560

SEQ ID NO: 98423 - DNA, 601 bp, Human; identical to SEQ ID NO: 96561

SEQ ID NO: 98424 - DNA, 601 bp, Human; identical to SEQ ID NO: 96562

SEQ ID NO: 98425 - DNA, 601 bp, Human; identical to SEQ ID NO: 96563

SEQ ID NO: 98426 - DNA, 601 bp, Human; identical to SEQ ID NO: 96564

SEQ ID NO: 98427 - DNA, 601 bp, Human; identical to SEQ ID NO: 96565

SEQ ID NO: 98428 - DNA, 601 bp, Human; identical to SEQ ID NO: 96566

SEQ ID NO: 98429 - DNA, 601 bp, Human; identical to SEQ ID NO: 96567

SEQ ID NO: 98430 - DNA, 601 bp, Human; identical to SEQ ID NO: 96568

SEQ ID NO: 98431 - DNA, 601 bp, Human; identical to SEQ ID NO: 96569

SEQ ID NO: 98432 - DNA, 601 bp, Human; identical to SEQ ID NO: 96570

SEQ ID NO: 98433 - DNA, 601 bp, Human; identical to SEQ ID NO: 96571

SEQ ID NO: 98434 - DNA, 601 bp, Human; identical to SEQ ID NO: 96572

SEQ ID NO: 98435 - DNA, 601 bp, Human; identical to SEQ ID NO: 96573

SEQ ID NO: 98436 - DNA, 601 bp, Human; identical to SEQ ID NO: 96574

SEQ ID NO: 98437 - DNA, 601 bp, Human; identical to SEQ ID NO: 96575

SEQ ID NO: 98438 - DNA, 601 bp, Human; identical to SEQ ID NO: 96576

SEQ ID NO: 98439 - DNA, 601 bp, Human; identical to SEQ ID NO: 96577

SEQ ID NO: 98440 - DNA, 601 bp, Human; identical to SEQ ID NO: 96578

SEQ ID NO: 98441 - DNA, 601 bp, Human; identical to SEQ ID NO: 96579

SEQ ID NO: 98442 - DNA, 601 bp, Human; identical to SEQ ID NO: 96580

SEQ ID NO: 98443 - DNA, 601 bp, Human; identical to SEQ ID NO: 96581

SEQ ID NO: 98444 - DNA, 601 bp, Human; identical to SEQ ID NO: 96582

SEQ ID NO: 98445 - DNA, 601 bp, Human; identical to SEQ ID NO: 96583

SEQ ID NO: 98446 - DNA, 601 bp, Human; identical to SEQ ID NO: 96584

SEQ ID NO: 98447 - DNA, 417 bp, Human; identical to SEQ ID NO: 96585

SEQ ID NO: 98448 - DNA, 480 bp, Human; identical to SEQ ID NO: 96586

SEQ ID NO: 98449 - DNA, 601 bp, Human; identical to SEQ ID NO: 96587

SEQ ID NO: 98450 - DNA, 601 bp, Human; identical to SEQ ID NO: 96588

SEQ ID NO: 98451 - DNA, 601 bp, Human; identical to SEQ ID NO: 96589

SEQ ID NO: 98452 - DNA, 601 bp, Human; identical to SEQ ID NO: 96590

SEQ ID NO: 98453 - DNA, 601 bp, Human; identical to SEQ ID NO: 96591

SEQ ID NO: 98454 - DNA, 601 bp, Human; identical to SEQ ID NO: 96592

SEQ ID NO: 98455 - DNA, 601 bp, Human; identical to SEQ ID NO: 96593

SEQ ID NO: 98456 - DNA, 601 bp, Human; identical to SEQ ID NO: 96594

SEQ ID NO: 98457 - DNA, 601 bp, Human; identical to SEQ ID NO: 96595

SEQ ID NO: 98458 - DNA, 601 bp, Human; identical to SEQ ID NO: 96596

SEQ ID NO: 98459 - DNA, 601 bp, Human; identical to SEQ ID NO: 96597

SEQ ID NO: 98460 - DNA, 601 bp, Human; identical to SEQ ID NO: 96598

SEQ ID NO: 98461 - DNA, 601 bp, Human; identical to SEQ ID NO: 96599

SEQ ID NO: 98462 - DNA, 601 bp, Human; identical to SEQ ID NO: 96600

SEQ ID NO: 98463 - DNA, 601 bp, Human; identical to SEQ ID NO: 96601

SEQ ID NO: 98464 - DNA, 601 bp, Human; identical to SEQ ID NO: 96602

SEQ ID NO: 98465 - DNA, 601 bp, Human; identical to SEQ ID NO: 96603

SEQ ID NO: 98466 - DNA, 601 bp, Human; identical to SEQ ID NO: 96604

SEQ ID NO: 98467 - DNA, 601 bp, Human; identical to SEQ ID NO: 96605

SEQ ID NO: 98468 - DNA, 601 bp, Human; identical to SEQ ID NO: 96606

SEQ ID NO: 98469 - DNA, 601 bp, Human; identical to SEQ ID NO: 96607

SEQ ID NO: 98470 - DNA, 601 bp, Human; identical to SEQ ID NO: 96608

SEQ ID NO: 98471 - DNA, 601 bp, Human; identical to SEQ ID NO: 96609

SEQ ID NO: 98472 - DNA, 601 bp, Human; identical to SEQ ID NO: 96610

SEQ ID NO: 98473 - DNA, 601 bp, Human; identical to SEQ ID NO: 96611

SEQ ID NO: 98474 - DNA, 601 bp, Human; identical to SEQ ID NO: 96612

SEQ ID NO: 98475 - DNA, 601 bp, Human; identical to SEQ ID NO: 96613

SEQ ID NO: 98476 - DNA, 601 bp, Human; identical to SEQ ID NO: 96614

SEQ ID NO: 98477 - DNA, 601 bp, Human; identical to SEQ ID NO: 96615

SEQ ID NO: 98478 - DNA, 601 bp, Human; identical to SEQ ID NO: 96616

SEQ ID NO: 98479 - DNA, 601 bp, Human; identical to SEQ ID NO: 96617

SEQ ID NO: 98480 - DNA, 601 bp, Human; identical to SEQ ID NO: 96618

SEQ ID NO: 98481 - DNA, 601 bp, Human; identical to SEQ ID NO: 96619

SEQ ID NO: 98482 - DNA, 601 bp, Human; identical to SEQ ID NO: 96620

SEQ ID NO: 98483 - DNA, 601 bp, Human; identical to SEQ ID NO: 96621

SEQ ID NO: 98484 - DNA, 601 bp, Human; identical to SEQ ID NO: 96622

SEQ ID NO: 98485 - DNA, 601 bp, Human; identical to SEQ ID NO: 96623

SEQ ID NO: 98486 - DNA, 601 bp, Human; identical to SEQ ID NO: 96624

SEQ ID NO: 98487 - DNA, 601 bp, Human; identical to SEQ ID NO: 96625

SEQ ID NO: 98488 - DNA, 601 bp, Human; identical to SEQ ID NO: 96626

SEQ ID NO: 98489 - DNA, 601 bp, Human; identical to SEQ ID NO: 96627

SEQ ID NO: 98490 - DNA, 601 bp, Human; identical to SEQ ID NO: 96628

SEQ ID NO: 98491 - DNA, 601 bp, Human; identical to SEQ ID NO: 96629

SEQ ID NO: 98492 - DNA, 601 bp, Human; identical to SEQ ID NO: 96630

SEQ ID NO: 98493 - DNA, 601 bp, Human; identical to SEQ ID NO: 96631

SEQ ID NO: 98494 - DNA, 601 bp, Human; identical to SEQ ID NO: 96632

SEQ ID NO: 98495 - DNA, 601 bp, Human; identical to SEQ ID NO: 96633

SEQ ID NO: 98496 - DNA, 601 bp, Human; identical to SEQ ID NO: 96634

SEQ ID NO: 98497 - DNA, 601 bp, Human; identical to SEQ ID NO: 96635

SEQ ID NO: 98498 - DNA, 601 bp, Human; identical to SEQ ID NO: 96636

SEQ ID NO: 98499 - DNA, 601 bp, Human; identical to SEQ ID NO: 96637

SEQ ID NO: 98500 - DNA, 601 bp, Human; identical to SEQ ID NO: 96638

SEQ ID NO: 98501 - DNA, 601 bp, Human; identical to SEQ ID NO: 96639

SEQ ID NO: 98502 - DNA, 601 bp, Human; identical to SEQ ID NO: 96640

SEQ ID NO: 98503 - DNA, 601 bp, Human; identical to SEQ ID NO: 96375

SEQ ID NO: 98504 - DNA, 601 bp, Human; identical to SEQ ID NO: 96376

SEQ ID NO: 98505 - DNA, 601 bp, Human; identical to SEQ ID NO: 96377

SEQ ID NO: 98506 - DNA, 601 bp, Human; identical to SEQ ID NO: 96378

SEQ ID NO: 98507 - DNA, 601 bp, Human; identical to SEQ ID NO: 96379

SEQ ID NO: 98508 - DNA, 601 bp, Human; identical to SEQ ID NO: 96380

SEQ ID NO: 98509 - DNA, 601 bp, Human; identical to SEQ ID NO: 96381

SEQ ID NO: 98510 - DNA, 601 bp, Human; identical to SEQ ID NO: 96382

SEQ ID NO: 98511 - DNA, 601 bp, Human; identical to SEQ ID NO: 96383

SEQ ID NO: 98512 - DNA, 601 bp, Human; identical to SEQ ID NO: 96384

SEQ ID NO: 98513 - DNA, 601 bp, Human; identical to SEQ ID NO: 96385

SEQ ID NO: 98514 - DNA, 601 bp, Human; identical to SEQ ID NO: 96386

SEQ ID NO: 98515 - DNA, 601 bp, Human; identical to SEQ ID NO: 96387

SEQ ID NO: 98516 - DNA, 601 bp, Human; identical to SEQ ID NO: 96388

SEQ ID NO: 98517 - DNA, 601 bp, Human; identical to SEQ ID NO: 96389

SEQ ID NO: 98518 - DNA, 601 bp, Human; identical to SEQ ID NO: 96390

SEQ ID NO: 98519 - DNA, 601 bp, Human; identical to SEQ ID NO: 96391

SEQ ID NO: 98520 - DNA, 601 bp, Human; identical to SEQ ID NO: 96392

SEQ ID NO: 98521 - DNA, 601 bp, Human; identical to SEQ ID NO: 96393

SEQ ID NO: 98522 - DNA, 601 bp, Human; identical to SEQ ID NO: 96394

SEQ ID NO: 98523 - DNA, 601 bp, Human; identical to SEQ ID NO: 96395

SEQ ID NO: 98524 - DNA, 601 bp, Human; identical to SEQ ID NO: 96396

SEQ ID NO: 98525 - DNA, 601 bp, Human; identical to SEQ ID NO: 96397

SEQ ID NO: 98526 - DNA, 601 bp, Human; identical to SEQ ID NO: 96398

SEQ ID NO: 98527 - DNA, 601 bp, Human; identical to SEQ ID NO: 96399

SEQ ID NO: 98528 - DNA, 601 bp, Human; identical to SEQ ID NO: 96400

SEQ ID NO: 98529 - DNA, 601 bp, Human; identical to SEQ ID NO: 96401

SEQ ID NO: 98530 - DNA, 601 bp, Human; identical to SEQ ID NO: 96402

SEQ ID NO: 98531 - DNA, 601 bp, Human; identical to SEQ ID NO: 96403

SEQ ID NO: 98532 - DNA, 601 bp, Human; identical to SEQ ID NO: 96404

SEQ ID NO: 98533 - DNA, 601 bp, Human; identical to SEQ ID NO: 96405

SEQ ID NO: 98534 - DNA, 601 bp, Human; identical to SEQ ID NO: 96406

SEQ ID NO: 98535 - DNA, 601 bp, Human; identical to SEQ ID NO: 96407

SEQ ID NO: 98536 - DNA, 601 bp, Human; identical to SEQ ID NO: 96408

SEQ ID NO: 98537 - DNA, 601 bp, Human; identical to SEQ ID NO: 96409

SEQ ID NO: 98538 - DNA, 601 bp, Human; identical to SEQ ID NO: 96410

SEQ ID NO: 98539 - DNA, 601 bp, Human; identical to SEQ ID NO: 96411

SEQ ID NO: 98540 - DNA, 601 bp, Human; identical to SEQ ID NO: 96412

SEQ ID NO: 98541 - DNA, 601 bp, Human; identical to SEQ ID NO: 96413

SEQ ID NO: 98542 - DNA, 601 bp, Human; identical to SEQ ID NO: 96414

SEQ ID NO: 98543 - DNA, 601 bp, Human; identical to SEQ ID NO: 96415

SEQ ID NO: 98544 - DNA, 601 bp, Human; identical to SEQ ID NO: 96416

SEQ ID NO: 98545 - DNA, 601 bp, Human; identical to SEQ ID NO: 96417

SEQ ID NO: 98546 - DNA, 601 bp, Human; identical to SEQ ID NO: 96418

SEQ ID NO: 98547 - DNA, 601 bp, Human; identical to SEQ ID NO: 96419

SEQ ID NO: 98548 - DNA, 601 bp, Human; identical to SEQ ID NO: 96420

SEQ ID NO: 98549 - DNA, 601 bp, Human; identical to SEQ ID NO: 96421

SEQ ID NO: 98550 - DNA, 601 bp, Human; identical to SEQ ID NO: 96422

SEQ ID NO: 98551 - DNA, 601 bp, Human; identical to SEQ ID NO: 96423

SEQ ID NO: 98552 - DNA, 601 bp, Human; identical to SEQ ID NO: 96424

SEQ ID NO: 98553 - DNA, 601 bp, Human; identical to SEQ ID NO: 96425

SEQ ID NO: 98554 - DNA, 601 bp, Human; identical to SEQ ID NO: 96426

SEQ ID NO: 98555 - DNA, 601 bp, Human; identical to SEQ ID NO: 96427

SEQ ID NO: 98556 - DNA, 601 bp, Human; identical to SEQ ID NO: 96428

SEQ ID NO: 98557 - DNA, 601 bp, Human; identical to SEQ ID NO: 96429

SEQ ID NO: 98558 - DNA, 601 bp, Human; identical to SEQ ID NO: 96430

SEQ ID NO: 98559 - DNA, 601 bp, Human; identical to SEQ ID NO: 96431

SEQ ID NO: 98560 - DNA, 601 bp, Human; identical to SEQ ID NO: 96432

SEQ ID NO: 98561 - DNA, 601 bp, Human; identical to SEQ ID NO: 96433

SEQ ID NO: 98562 - DNA, 601 bp, Human; identical to SEQ ID NO: 96434

SEQ ID NO: 98563 - DNA, 601 bp, Human; identical to SEQ ID NO: 96435

SEQ ID NO: 98564 - DNA, 601 bp, Human; identical to SEQ ID NO: 96436

SEQ ID NO: 98565 - DNA, 601 bp, Human; identical to SEQ ID NO: 96437

SEQ ID NO: 98566 - DNA, 601 bp, Human; identical to SEQ ID NO: 96438

SEQ ID NO: 98567 - DNA, 601 bp, Human; identical to SEQ ID NO: 96439

SEQ ID NO: 98568 - DNA, 601 bp, Human; identical to SEQ ID NO: 96440

SEQ ID NO: 98569 - DNA, 601 bp, Human; identical to SEQ ID NO: 96441

SEQ ID NO: 98570 - DNA, 601 bp, Human; identical to SEQ ID NO: 96442

SEQ ID NO: 98571 - DNA, 601 bp, Human; identical to SEQ ID NO: 96443

SEQ ID NO: 98572 - DNA, 601 bp, Human; identical to SEQ ID NO: 96444

SEQ ID NO: 98573 - DNA, 601 bp, Human; identical to SEQ ID NO: 96445

SEQ ID NO: 98574 - DNA, 601 bp, Human; identical to SEQ ID NO: 96446

SEQ ID NO: 98575 - DNA, 601 bp, Human; identical to SEQ ID NO: 96447

SEQ ID NO: 98576 - DNA, 601 bp, Human; identical to SEQ ID NO: 96448

SEQ ID NO: 98577 - DNA, 601 bp, Human; identical to SEQ ID NO: 96449

SEQ ID NO: 98578 - DNA, 601 bp, Human; identical to SEQ ID NO: 96450

SEQ ID NO: 98579 - DNA, 601 bp, Human; identical to SEQ ID NO: 96451

SEQ ID NO: 98580 - DNA, 601 bp, Human; identical to SEQ ID NO: 96452

SEQ ID NO: 98581 - DNA, 601 bp, Human; identical to SEQ ID NO: 96453

SEQ ID NO: 98582 - DNA, 601 bp, Human; identical to SEQ ID NO: 96454

SEQ ID NO: 98583 - DNA, 601 bp, Human; identical to SEQ ID NO: 96455

SEQ ID NO: 98584 - DNA, 601 bp, Human; identical to SEQ ID NO: 96456

SEQ ID NO: 98585 - DNA, 601 bp, Human; identical to SEQ ID NO: 96457

SEQ ID NO: 98586 - DNA, 601 bp, Human; identical to SEQ ID NO: 96458

SEQ ID NO: 98587 - DNA, 601 bp, Human; identical to SEQ ID NO: 96459

SEQ ID NO: 98588 - DNA, 601 bp, Human; identical to SEQ ID NO: 96460

SEQ ID NO: 98589 - DNA, 601 bp, Human; identical to SEQ ID NO: 96461

SEQ ID NO: 98590 - DNA, 601 bp, Human; identical to SEQ ID NO: 96462

SEQ ID NO: 98591 - DNA, 601 bp, Human; identical to SEQ ID NO: 96463

SEQ ID NO: 98592 - DNA, 601 bp, Human; identical to SEQ ID NO: 96464

SEQ ID NO: 98593 - DNA, 601 bp, Human; identical to SEQ ID NO: 96465

SEQ ID NO: 98594 - DNA, 601 bp, Human; identical to SEQ ID NO: 96466

SEQ ID NO: 98595 - DNA, 601 bp, Human; identical to SEQ ID NO: 96467

SEQ ID NO: 98596 - DNA, 601 bp, Human; identical to SEQ ID NO: 96468

SEQ ID NO: 98597 - DNA, 601 bp, Human; identical to SEQ ID NO: 96469

SEQ ID NO: 98598 - DNA, 601 bp, Human; identical to SEQ ID NO: 96470

SEQ ID NO: 98599 - DNA, 601 bp, Human; identical to SEQ ID NO: 96471

SEQ ID NO: 98600 - DNA, 601 bp, Human; identical to SEQ ID NO: 96472

SEQ ID NO: 98601 - DNA, 601 bp, Human; identical to SEQ ID NO: 96473

SEQ ID NO: 98602 - DNA, 601 bp, Human; identical to SEQ ID NO: 96474

SEQ ID NO: 98603 - DNA, 601 bp, Human; identical to SEQ ID NO: 96475

SEQ ID NO: 98604 - DNA, 601 bp, Human; identical to SEQ ID NO: 96476

SEQ ID NO: 98605 - DNA, 601 bp, Human; identical to SEQ ID NO: 96477

SEQ ID NO: 98606 - DNA, 601 bp, Human; identical to SEQ ID NO: 96478

SEQ ID NO: 98607 - DNA, 601 bp, Human; identical to SEQ ID NO: 96479

SEQ ID NO: 98608 - DNA, 601 bp, Human; identical to SEQ ID NO: 96480

SEQ ID NO: 98609 - DNA, 601 bp, Human; identical to SEQ ID NO: 96481

SEQ ID NO: 98610 - DNA, 601 bp, Human; identical to SEQ ID NO: 96482

SEQ ID NO: 98611 - DNA, 601 bp, Human; identical to SEQ ID NO: 96483

SEQ ID NO: 98612 - DNA, 601 bp, Human; identical to SEQ ID NO: 96484

SEQ ID NO: 98613 - DNA, 601 bp, Human; identical to SEQ ID NO: 96485

SEQ ID NO: 98614 - DNA, 601 bp, Human; identical to SEQ ID NO: 96486

SEQ ID NO: 98615 - DNA, 601 bp, Human; identical to SEQ ID NO: 96487

SEQ ID NO: 98616 - DNA, 601 bp, Human; identical to SEQ ID NO: 96488

SEQ ID NO: 98617 - DNA, 601 bp, Human; identical to SEQ ID NO: 96489

SEQ ID NO: 98618 - DNA, 601 bp, Human; identical to SEQ ID NO: 96490

SEQ ID NO: 98619 - DNA, 601 bp, Human; identical to SEQ ID NO: 96491

SEQ ID NO: 98620 - DNA, 601 bp, Human; identical to SEQ ID NO: 96492

SEQ ID NO: 98621 - DNA, 601 bp, Human; identical to SEQ ID NO: 96493

SEQ ID NO: 98622 - DNA, 601 bp, Human; identical to SEQ ID NO: 96494

SEQ ID NO: 98623 - DNA, 601 bp, Human; identical to SEQ ID NO: 96495

SEQ ID NO: 98624 - DNA, 601 bp, Human; identical to SEQ ID NO: 96496

SEQ ID NO: 98625 - DNA, 601 bp, Human; identical to SEQ ID NO: 96497

SEQ ID NO: 98626 - DNA, 601 bp, Human; identical to SEQ ID NO: 96498

SEQ ID NO: 98627 - DNA, 601 bp, Human; identical to SEQ ID NO: 96499

SEQ ID NO: 98628 - DNA, 601 bp, Human; identical to SEQ ID NO: 96500

SEQ ID NO: 98629 - DNA, 601 bp, Human; identical to SEQ ID NO: 96501

SEQ ID NO: 98630 - DNA, 601 bp, Human; identical to SEQ ID NO: 96502

SEQ ID NO: 98631 - DNA, 601 bp, Human; identical to SEQ ID NO: 96503

SEQ ID NO: 98632 - DNA, 601 bp, Human; identical to SEQ ID NO: 96504

SEQ ID NO: 98633 - DNA, 601 bp, Human; identical to SEQ ID NO: 96505

SEQ ID NO: 98634 - DNA, 601 bp, Human; identical to SEQ ID NO: 96506

SEQ ID NO: 98635 - DNA, 601 bp, Human; identical to SEQ ID NO: 96507

SEQ ID NO: 98636 - DNA, 601 bp, Human; identical to SEQ ID NO: 96508

SEQ ID NO: 98637 - DNA, 601 bp, Human; identical to SEQ ID NO: 96509

SEQ ID NO: 98638 - DNA, 601 bp, Human; identical to SEQ ID NO: 96510

SEQ ID NO: 98639 - DNA, 601 bp, Human; identical to SEQ ID NO: 96511

SEQ ID NO: 98640 - DNA, 601 bp, Human; identical to SEQ ID NO: 96512

SEQ ID NO: 98641 - DNA, 601 bp, Human; identical to SEQ ID NO: 96513

SEQ ID NO: 98642 - DNA, 601 bp, Human; identical to SEQ ID NO: 96514

SEQ ID NO: 98643 - DNA, 601 bp, Human; identical to SEQ ID NO: 96515

SEQ ID NO: 98644 - DNA, 601 bp, Human; identical to SEQ ID NO: 96516

SEQ ID NO: 98645 - DNA, 601 bp, Human; identical to SEQ ID NO: 96517

SEQ ID NO: 98646 - DNA, 601 bp, Human; identical to SEQ ID NO: 96518

SEQ ID NO: 98647 - DNA, 601 bp, Human; identical to SEQ ID NO: 96519

SEQ ID NO: 98648 - DNA, 601 bp, Human; identical to SEQ ID NO: 96520

SEQ ID NO: 98649 - DNA, 601 bp, Human; identical to SEQ ID NO: 96521

SEQ ID NO: 98650 - DNA, 601 bp, Human; identical to SEQ ID NO: 96522

SEQ ID NO: 98651 - DNA, 601 bp, Human; identical to SEQ ID NO: 96523

SEQ ID NO: 98652 - DNA, 601 bp, Human; identical to SEQ ID NO: 96524

SEQ ID NO: 98653 - DNA, 601 bp, Human; identical to SEQ ID NO: 96525

SEQ ID NO: 98654 - DNA, 601 bp, Human; identical to SEQ ID NO: 96526

SEQ ID NO: 98655 - DNA, 601 bp, Human; identical to SEQ ID NO: 96527

SEQ ID NO: 98656 - DNA, 601 bp, Human; identical to SEQ ID NO: 96528

SEQ ID NO: 98657 - DNA, 601 bp, Human; identical to SEQ ID NO: 96529

SEQ ID NO: 98658 - DNA, 601 bp, Human; identical to SEQ ID NO: 96530

SEQ ID NO: 98659 - DNA, 601 bp, Human; identical to SEQ ID NO: 96531

SEQ ID NO: 98660 - DNA, 601 bp, Human; identical to SEQ ID NO: 96532

SEQ ID NO: 98661 - DNA, 601 bp, Human; identical to SEQ ID NO: 96533

SEQ ID NO: 98662 - DNA, 601 bp, Human; identical to SEQ ID NO: 96534

SEQ ID NO: 98663 - DNA, 601 bp, Human; identical to SEQ ID NO: 96535

SEQ ID NO: 98664 - DNA, 601 bp, Human; identical to SEQ ID NO: 96536

SEQ ID NO: 98665 - DNA, 601 bp, Human; identical to SEQ ID NO: 96537

SEQ ID NO: 98666 - DNA, 601 bp, Human; identical to SEQ ID NO: 96538

SEQ ID NO: 98667 - DNA, 601 bp, Human; identical to SEQ ID NO: 96539

SEQ ID NO: 98668 - DNA, 601 bp, Human; identical to SEQ ID NO: 96540

SEQ ID NO: 98669 - DNA, 601 bp, Human; identical to SEQ ID NO: 96541

SEQ ID NO: 98670 - DNA, 601 bp, Human; identical to SEQ ID NO: 96542

SEQ ID NO: 98671 - DNA, 601 bp, Human; identical to SEQ ID NO: 96543

SEQ ID NO: 98672 - DNA, 601 bp, Human; identical to SEQ ID NO: 96544

SEQ ID NO: 98673 - DNA, 601 bp, Human; identical to SEQ ID NO: 96545

SEQ ID NO: 98674 - DNA, 601 bp, Human; identical to SEQ ID NO: 96546

SEQ ID NO: 98675 - DNA, 601 bp, Human; identical to SEQ ID NO: 96547

SEQ ID NO: 98676 - DNA, 601 bp, Human; identical to SEQ ID NO: 96548

SEQ ID NO: 98677 - DNA, 601 bp, Human; identical to SEQ ID NO: 96549

SEQ ID NO: 98678 - DNA, 601 bp, Human; identical to SEQ ID NO: 96550

SEQ ID NO: 98679 - DNA, 601 bp, Human; identical to SEQ ID NO: 96551

SEQ ID NO: 98680 - DNA, 601 bp, Human; identical to SEQ ID NO: 96552

SEQ ID NO: 98681 - DNA, 601 bp, Human; identical to SEQ ID NO: 96553

SEQ ID NO: 98682 - DNA, 601 bp, Human; identical to SEQ ID NO: 96554

SEQ ID NO: 98683 - DNA, 601 bp, Human; identical to SEQ ID NO: 96555

SEQ ID NO: 98684 - DNA, 601 bp, Human; identical to SEQ ID NO: 96556

SEQ ID NO: 98685 - DNA, 601 bp, Human; identical to SEQ ID NO: 96557

SEQ ID NO: 98686 - DNA, 601 bp, Human; identical to SEQ ID NO: 96558

SEQ ID NO: 98687 - DNA, 601 bp, Human; identical to SEQ ID NO: 96559

SEQ ID NO: 98688 - DNA, 601 bp, Human; identical to SEQ ID NO: 96560

SEQ ID NO: 98689 - DNA, 601 bp, Human; identical to SEQ ID NO: 96561

SEQ ID NO: 98690 - DNA, 601 bp, Human; identical to SEQ ID NO: 96562

SEQ ID NO: 98691 - DNA, 601 bp, Human; identical to SEQ ID NO: 96563

SEQ ID NO: 98692 - DNA, 601 bp, Human; identical to SEQ ID NO: 96564

SEQ ID NO: 98693 - DNA, 601 bp, Human; identical to SEQ ID NO: 96565

SEQ ID NO: 98694 - DNA, 601 bp, Human; identical to SEQ ID NO: 96566

SEQ ID NO: 98695 - DNA, 601 bp, Human; identical to SEQ ID NO: 96567

SEQ ID NO: 98696 - DNA, 601 bp, Human; identical to SEQ ID NO: 96568

SEQ ID NO: 98697 - DNA, 601 bp, Human; identical to SEQ ID NO: 96569

SEQ ID NO: 98698 - DNA, 601 bp, Human; identical to SEQ ID NO: 96570

SEQ ID NO: 98699 - DNA, 601 bp, Human; identical to SEQ ID NO: 96571

SEQ ID NO: 98700 - DNA, 601 bp, Human; identical to SEQ ID NO: 96572

SEQ ID NO: 98701 - DNA, 601 bp, Human; identical to SEQ ID NO: 96573

SEQ ID NO: 98702 - DNA, 601 bp, Human; identical to SEQ ID NO: 96574

SEQ ID NO: 98703 - DNA, 601 bp, Human; identical to SEQ ID NO: 96575

SEQ ID NO: 98704 - DNA, 601 bp, Human; identical to SEQ ID NO: 96576

SEQ ID NO: 98705 - DNA, 601 bp, Human; identical to SEQ ID NO: 96577

SEQ ID NO: 98706 - DNA, 601 bp, Human; identical to SEQ ID NO: 96578

SEQ ID NO: 98707 - DNA, 601 bp, Human; identical to SEQ ID NO: 96579

SEQ ID NO: 98708 - DNA, 601 bp, Human; identical to SEQ ID NO: 96580

SEQ ID NO: 98709 - DNA, 601 bp, Human; identical to SEQ ID NO: 96581

SEQ ID NO: 98710 - DNA, 601 bp, Human; identical to SEQ ID NO: 96582

SEQ ID NO: 98711 - DNA, 601 bp, Human; identical to SEQ ID NO: 96583

SEQ ID NO: 98712 - DNA, 601 bp, Human; identical to SEQ ID NO: 96584

SEQ ID NO: 98713 - DNA, 417 bp, Human; identical to SEQ ID NO: 96585

SEQ ID NO: 98714 - DNA, 480 bp, Human; identical to SEQ ID NO: 96586

SEQ ID NO: 98715 - DNA, 601 bp, Human; identical to SEQ ID NO: 96587

SEQ ID NO: 98716 - DNA, 601 bp, Human; identical to SEQ ID NO: 96588

SEQ ID NO: 98717 - DNA, 601 bp, Human; identical to SEQ ID NO: 96589

SEQ ID NO: 98718 - DNA, 601 bp, Human; identical to SEQ ID NO: 96590

SEQ ID NO: 98719 - DNA, 601 bp, Human; identical to SEQ ID NO: 96591

SEQ ID NO: 98720 - DNA, 601 bp, Human; identical to SEQ ID NO: 96592

SEQ ID NO: 98721 - DNA, 601 bp, Human; identical to SEQ ID NO: 96593

SEQ ID NO: 98722 - DNA, 601 bp, Human; identical to SEQ ID NO: 96594

SEQ ID NO: 98723 - DNA, 601 bp, Human; identical to SEQ ID NO: 96595

SEQ ID NO: 98724 - DNA, 601 bp, Human; identical to SEQ ID NO: 96596

SEQ ID NO: 98725 - DNA, 601 bp, Human; identical to SEQ ID NO: 96597

SEQ ID NO: 98726 - DNA, 601 bp, Human; identical to SEQ ID NO: 96598

SEQ ID NO: 98727 - DNA, 601 bp, Human; identical to SEQ ID NO: 96599

SEQ ID NO: 98728 - DNA, 601 bp, Human; identical to SEQ ID NO: 96600

SEQ ID NO: 98729 - DNA, 601 bp, Human; identical to SEQ ID NO: 96601

SEQ ID NO: 98730 - DNA, 601 bp, Human; identical to SEQ ID NO: 96602

SEQ ID NO: 98731 - DNA, 601 bp, Human; identical to SEQ ID NO: 96603

SEQ ID NO: 98732 - DNA, 601 bp, Human; identical to SEQ ID NO: 96604

SEQ ID NO: 98733 - DNA, 601 bp, Human; identical to SEQ ID NO: 96605

SEQ ID NO: 98734 - DNA, 601 bp, Human; identical to SEQ ID NO: 96606

SEQ ID NO: 98735 - DNA, 601 bp, Human; identical to SEQ ID NO: 96607

SEQ ID NO: 98736 - DNA, 601 bp, Human; identical to SEQ ID NO: 96608

SEQ ID NO: 98737 - DNA, 601 bp, Human; identical to SEQ ID NO: 96609

SEQ ID NO: 98738 - DNA, 601 bp, Human; identical to SEQ ID NO: 96610

SEQ ID NO: 98739 - DNA, 601 bp, Human; identical to SEQ ID NO: 96611

SEQ ID NO: 98740 - DNA, 601 bp, Human; identical to SEQ ID NO: 96612

SEQ ID NO: 98741 - DNA, 601 bp, Human; identical to SEQ ID NO: 96613

SEQ ID NO: 98742 - DNA, 601 bp, Human; identical to SEQ ID NO: 96614

SEQ ID NO: 98743 - DNA, 601 bp, Human; identical to SEQ ID NO: 96615

SEQ ID NO: 98744 - DNA, 601 bp, Human; identical to SEQ ID NO: 96616

SEQ ID NO: 98745 - DNA, 601 bp, Human; identical to SEQ ID NO: 96617

SEQ ID NO: 98746 - DNA, 601 bp, Human; identical to SEQ ID NO: 96618

SEQ ID NO: 98747 - DNA, 601 bp, Human; identical to SEQ ID NO: 96619

SEQ ID NO: 98748 - DNA, 601 bp, Human; identical to SEQ ID NO: 96620

SEQ ID NO: 98749 - DNA, 601 bp, Human; identical to SEQ ID NO: 96621

SEQ ID NO: 98750 - DNA, 601 bp, Human; identical to SEQ ID NO: 96622

SEQ ID NO: 98751 - DNA, 601 bp, Human; identical to SEQ ID NO: 96623

SEQ ID NO: 98752 - DNA, 601 bp, Human; identical to SEQ ID NO: 96624

SEQ ID NO: 98753 - DNA, 601 bp, Human; identical to SEQ ID NO: 96625

SEQ ID NO: 98754 - DNA, 601 bp, Human; identical to SEQ ID NO: 96626

SEQ ID NO: 98755 - DNA, 601 bp, Human; identical to SEQ ID NO: 96627

SEQ ID NO: 98756 - DNA, 601 bp, Human; identical to SEQ ID NO: 96628

SEQ ID NO: 98757 - DNA, 601 bp, Human; identical to SEQ ID NO: 96629

SEQ ID NO: 98758 - DNA, 601 bp, Human; identical to SEQ ID NO: 96630

SEQ ID NO: 98759 - DNA, 601 bp, Human; identical to SEQ ID NO: 96631

SEQ ID NO: 98760 - DNA, 601 bp, Human; identical to SEQ ID NO: 96632

SEQ ID NO: 98761 - DNA, 601 bp, Human; identical to SEQ ID NO: 96633

SEQ ID NO: 98762 - DNA, 601 bp, Human; identical to SEQ ID NO: 96634

SEQ ID NO: 98763 - DNA, 601 bp, Human; identical to SEQ ID NO: 96635

SEQ ID NO: 98764 - DNA, 601 bp, Human; identical to SEQ ID NO: 96636

SEQ ID NO: 98765 - DNA, 601 bp, Human; identical to SEQ ID NO: 96637

SEQ ID NO: 98766 - DNA, 601 bp, Human; identical to SEQ ID NO: 96638

SEQ ID NO: 98767 - DNA, 601 bp, Human; identical to SEQ ID NO: 96639

SEQ ID NO: 98768 - DNA, 601 bp, Human; identical to SEQ ID NO: 96640

SEQ ID NO: 98769 - DNA, 601 bp, Human; identical to SEQ ID NO: 96375

SEQ ID NO: 98770 - DNA, 601 bp, Human; identical to SEQ ID NO: 96376

SEQ ID NO: 98771 - DNA, 601 bp, Human; identical to SEQ ID NO: 96377

SEQ ID NO: 98772 - DNA, 601 bp, Human; identical to SEQ ID NO: 96378

SEQ ID NO: 98773 - DNA, 601 bp, Human; identical to SEQ ID NO: 96379

SEQ ID NO: 98774 - DNA, 601 bp, Human; identical to SEQ ID NO: 96380

SEQ ID NO: 98775 - DNA, 601 bp, Human; identical to SEQ ID NO: 96381

SEQ ID NO: 98776 - DNA, 601 bp, Human; identical to SEQ ID NO: 96382

SEQ ID NO: 98777 - DNA, 601 bp, Human; identical to SEQ ID NO: 96383

SEQ ID NO: 98778 - DNA, 601 bp, Human; identical to SEQ ID NO: 96384

SEQ ID NO: 98779 - DNA, 601 bp, Human; identical to SEQ ID NO: 96385

SEQ ID NO: 98780 - DNA, 601 bp, Human; identical to SEQ ID NO: 96386

SEQ ID NO: 98781 - DNA, 601 bp, Human; identical to SEQ ID NO: 96387

SEQ ID NO: 98782 - DNA, 601 bp, Human; identical to SEQ ID NO: 96388

SEQ ID NO: 98783 - DNA, 601 bp, Human; identical to SEQ ID NO: 96389

SEQ ID NO: 98784 - DNA, 601 bp, Human; identical to SEQ ID NO: 96390

SEQ ID NO: 98785 - DNA, 601 bp, Human; identical to SEQ ID NO: 96391

SEQ ID NO: 98786 - DNA, 601 bp, Human; identical to SEQ ID NO: 96392

SEQ ID NO: 98787 - DNA, 601 bp, Human; identical to SEQ ID NO: 96393

SEQ ID NO: 98788 - DNA, 601 bp, Human; identical to SEQ ID NO: 96394

SEQ ID NO: 98789 - DNA, 601 bp, Human; identical to SEQ ID NO: 96395

SEQ ID NO: 98790 - DNA, 601 bp, Human; identical to SEQ ID NO: 96396

SEQ ID NO: 98791 - DNA, 601 bp, Human; identical to SEQ ID NO: 96397

SEQ ID NO: 98792 - DNA, 601 bp, Human; identical to SEQ ID NO: 96398

SEQ ID NO: 98793 - DNA, 601 bp, Human; identical to SEQ ID NO: 96399

SEQ ID NO: 98794 - DNA, 601 bp, Human; identical to SEQ ID NO: 96400

SEQ ID NO: 98795 - DNA, 601 bp, Human; identical to SEQ ID NO: 96401

SEQ ID NO: 98796 - DNA, 601 bp, Human; identical to SEQ ID NO: 96402

SEQ ID NO: 98797 - DNA, 601 bp, Human; identical to SEQ ID NO: 96403

SEQ ID NO: 98798 - DNA, 601 bp, Human; identical to SEQ ID NO: 96404

SEQ ID NO: 98799 - DNA, 601 bp, Human; identical to SEQ ID NO: 96405

SEQ ID NO: 98800 - DNA, 601 bp, Human; identical to SEQ ID NO: 96406

SEQ ID NO: 98801 - DNA, 601 bp, Human; identical to SEQ ID NO: 96407

SEQ ID NO: 98802 - DNA, 601 bp, Human; identical to SEQ ID NO: 96408

SEQ ID NO: 98803 - DNA, 601 bp, Human; identical to SEQ ID NO: 96409

SEQ ID NO: 98804 - DNA, 601 bp, Human; identical to SEQ ID NO: 96410

SEQ ID NO: 98805 - DNA, 601 bp, Human; identical to SEQ ID NO: 96411

SEQ ID NO: 98806 - DNA, 601 bp, Human; identical to SEQ ID NO: 96412

SEQ ID NO: 98807 - DNA, 601 bp, Human; identical to SEQ ID NO: 96413

SEQ ID NO: 98808 - DNA, 601 bp, Human; identical to SEQ ID NO: 96414

SEQ ID NO: 98809 - DNA, 601 bp, Human; identical to SEQ ID NO: 96415

SEQ ID NO: 98810 - DNA, 601 bp, Human; identical to SEQ ID NO: 96416

SEQ ID NO: 98811 - DNA, 601 bp, Human; identical to SEQ ID NO: 96417

SEQ ID NO: 98812 - DNA, 601 bp, Human; identical to SEQ ID NO: 96418

SEQ ID NO: 98813 - DNA, 601 bp, Human; identical to SEQ ID NO: 96419

SEQ ID NO: 98814 - DNA, 601 bp, Human; identical to SEQ ID NO: 96420

SEQ ID NO: 98815 - DNA, 601 bp, Human; identical to SEQ ID NO: 96421

SEQ ID NO: 98816 - DNA, 601 bp, Human; identical to SEQ ID NO: 96422

SEQ ID NO: 98817 - DNA, 601 bp, Human; identical to SEQ ID NO: 96423

SEQ ID NO: 98818 - DNA, 601 bp, Human; identical to SEQ ID NO: 96424

SEQ ID NO: 98819 - DNA, 601 bp, Human; identical to SEQ ID NO: 96425

SEQ ID NO: 98820 - DNA, 601 bp, Human; identical to SEQ ID NO: 96426

SEQ ID NO: 98821 - DNA, 601 bp, Human; identical to SEQ ID NO: 96427

SEQ ID NO: 98822 - DNA, 601 bp, Human; identical to SEQ ID NO: 96428

SEQ ID NO: 98823 - DNA, 601 bp, Human; identical to SEQ ID NO: 96429

SEQ ID NO: 98824 - DNA, 601 bp, Human; identical to SEQ ID NO: 96430

SEQ ID NO: 98825 - DNA, 601 bp, Human; identical to SEQ ID NO: 96431

SEQ ID NO: 98826 - DNA, 601 bp, Human; identical to SEQ ID NO: 96432

SEQ ID NO: 98827 - DNA, 601 bp, Human; identical to SEQ ID NO: 96433

SEQ ID NO: 98828 - DNA, 601 bp, Human; identical to SEQ ID NO: 96434

SEQ ID NO: 98829 - DNA, 601 bp, Human; identical to SEQ ID NO: 96435

SEQ ID NO: 98830 - DNA, 601 bp, Human; identical to SEQ ID NO: 96436

SEQ ID NO: 98831 - DNA, 601 bp, Human; identical to SEQ ID NO: 96437

SEQ ID NO: 98832 - DNA, 601 bp, Human; identical to SEQ ID NO: 96438

SEQ ID NO: 98833 - DNA, 601 bp, Human; identical to SEQ ID NO: 96439

SEQ ID NO: 98834 - DNA, 601 bp, Human; identical to SEQ ID NO: 96440

SEQ ID NO: 98835 - DNA, 601 bp, Human; identical to SEQ ID NO: 96441

SEQ ID NO: 98836 - DNA, 601 bp, Human; identical to SEQ ID NO: 96442

SEQ ID NO: 98837 - DNA, 601 bp, Human; identical to SEQ ID NO: 96443

SEQ ID NO: 98838 - DNA, 601 bp, Human; identical to SEQ ID NO: 96444

SEQ ID NO: 98839 - DNA, 601 bp, Human; identical to SEQ ID NO: 96445

SEQ ID NO: 98840 - DNA, 601 bp, Human; identical to SEQ ID NO: 96446

SEQ ID NO: 98841 - DNA, 601 bp, Human; identical to SEQ ID NO: 96447

SEQ ID NO: 98842 - DNA, 601 bp, Human; identical to SEQ ID NO: 96448

SEQ ID NO: 98843 - DNA, 601 bp, Human; identical to SEQ ID NO: 96449

SEQ ID NO: 98844 - DNA, 601 bp, Human; identical to SEQ ID NO: 96450

SEQ ID NO: 98845 - DNA, 601 bp, Human; identical to SEQ ID NO: 96451

SEQ ID NO: 98846 - DNA, 601 bp, Human; identical to SEQ ID NO: 96452

SEQ ID NO: 98847 - DNA, 601 bp, Human; identical to SEQ ID NO: 96453

SEQ ID NO: 98848 - DNA, 601 bp, Human; identical to SEQ ID NO: 96454

SEQ ID NO: 98849 - DNA, 601 bp, Human; identical to SEQ ID NO: 96455

SEQ ID NO: 98850 - DNA, 601 bp, Human; identical to SEQ ID NO: 96456

SEQ ID NO: 98851 - DNA, 601 bp, Human; identical to SEQ ID NO: 96457

SEQ ID NO: 98852 - DNA, 601 bp, Human; identical to SEQ ID NO: 96458

SEQ ID NO: 98853 - DNA, 601 bp, Human; identical to SEQ ID NO: 96459

SEQ ID NO: 98854 - DNA, 601 bp, Human; identical to SEQ ID NO: 96460

SEQ ID NO: 98855 - DNA, 601 bp, Human; identical to SEQ ID NO: 96461

SEQ ID NO: 98856 - DNA, 601 bp, Human; identical to SEQ ID NO: 96462

SEQ ID NO: 98857 - DNA, 601 bp, Human; identical to SEQ ID NO: 96463

SEQ ID NO: 98858 - DNA, 601 bp, Human; identical to SEQ ID NO: 96464

SEQ ID NO: 98859 - DNA, 601 bp, Human; identical to SEQ ID NO: 96465

SEQ ID NO: 98860 - DNA, 601 bp, Human; identical to SEQ ID NO: 96466

SEQ ID NO: 98861 - DNA, 601 bp, Human; identical to SEQ ID NO: 96467

SEQ ID NO: 98862 - DNA, 601 bp, Human; identical to SEQ ID NO: 96468

SEQ ID NO: 98863 - DNA, 601 bp, Human; identical to SEQ ID NO: 96469

SEQ ID NO: 98864 - DNA, 601 bp, Human; identical to SEQ ID NO: 96470

SEQ ID NO: 98865 - DNA, 601 bp, Human; identical to SEQ ID NO: 96471

SEQ ID NO: 98866 - DNA, 601 bp, Human; identical to SEQ ID NO: 96472

SEQ ID NO: 98867 - DNA, 601 bp, Human; identical to SEQ ID NO: 96473

SEQ ID NO: 98868 - DNA, 601 bp, Human; identical to SEQ ID NO: 96474

SEQ ID NO: 98869 - DNA, 601 bp, Human; identical to SEQ ID NO: 96475

SEQ ID NO: 98870 - DNA, 601 bp, Human; identical to SEQ ID NO: 96476

SEQ ID NO: 98871 - DNA, 601 bp, Human; identical to SEQ ID NO: 96477

SEQ ID NO: 98872 - DNA, 601 bp, Human; identical to SEQ ID NO: 96478

SEQ ID NO: 98873 - DNA, 601 bp, Human; identical to SEQ ID NO: 96479

SEQ ID NO: 98874 - DNA, 601 bp, Human; identical to SEQ ID NO: 96480

SEQ ID NO: 98875 - DNA, 601 bp, Human; identical to SEQ ID NO: 96481

SEQ ID NO: 98876 - DNA, 601 bp, Human; identical to SEQ ID NO: 96482

SEQ ID NO: 98877 - DNA, 601 bp, Human; identical to SEQ ID NO: 96483

SEQ ID NO: 98878 - DNA, 601 bp, Human; identical to SEQ ID NO: 96484

SEQ ID NO: 98879 - DNA, 601 bp, Human; identical to SEQ ID NO: 96485

SEQ ID NO: 98880 - DNA, 601 bp, Human; identical to SEQ ID NO: 96486

SEQ ID NO: 98881 - DNA, 601 bp, Human; identical to SEQ ID NO: 96487

SEQ ID NO: 98882 - DNA, 601 bp, Human; identical to SEQ ID NO: 96488

SEQ ID NO: 98883 - DNA, 601 bp, Human; identical to SEQ ID NO: 96489

SEQ ID NO: 98884 - DNA, 601 bp, Human; identical to SEQ ID NO: 96490

SEQ ID NO: 98885 - DNA, 601 bp, Human; identical to SEQ ID NO: 96491

SEQ ID NO: 98886 - DNA, 601 bp, Human; identical to SEQ ID NO: 96492

SEQ ID NO: 98887 - DNA, 601 bp, Human; identical to SEQ ID NO: 96493

SEQ ID NO: 98888 - DNA, 601 bp, Human; identical to SEQ ID NO: 96494

SEQ ID NO: 98889 - DNA, 601 bp, Human; identical to SEQ ID NO: 96495

SEQ ID NO: 98890 - DNA, 601 bp, Human; identical to SEQ ID NO: 96496

SEQ ID NO: 98891 - DNA, 601 bp, Human; identical to SEQ ID NO: 96497

SEQ ID NO: 98892 - DNA, 601 bp, Human; identical to SEQ ID NO: 96498

SEQ ID NO: 98893 - DNA, 601 bp, Human; identical to SEQ ID NO: 96499

SEQ ID NO: 98894 - DNA, 601 bp, Human; identical to SEQ ID NO: 96500

SEQ ID NO: 98895 - DNA, 601 bp, Human; identical to SEQ ID NO: 96501

SEQ ID NO: 98896 - DNA, 601 bp, Human; identical to SEQ ID NO: 96502

SEQ ID NO: 98897 - DNA, 601 bp, Human; identical to SEQ ID NO: 96503

SEQ ID NO: 98898 - DNA, 601 bp, Human; identical to SEQ ID NO: 96504

SEQ ID NO: 98899 - DNA, 601 bp, Human; identical to SEQ ID NO: 96505

SEQ ID NO: 98900 - DNA, 601 bp, Human; identical to SEQ ID NO: 96506

SEQ ID NO: 98901 - DNA, 601 bp, Human; identical to SEQ ID NO: 96507

SEQ ID NO: 98902 - DNA, 601 bp, Human; identical to SEQ ID NO: 96508

SEQ ID NO: 98903 - DNA, 601 bp, Human; identical to SEQ ID NO: 96509

SEQ ID NO: 98904 - DNA, 601 bp, Human; identical to SEQ ID NO: 96510

SEQ ID NO: 98905 - DNA, 601 bp, Human; identical to SEQ ID NO: 96511

SEQ ID NO: 98906 - DNA, 601 bp, Human; identical to SEQ ID NO: 96512

SEQ ID NO: 98907 - DNA, 601 bp, Human; identical to SEQ ID NO: 96513

SEQ ID NO: 98908 - DNA, 601 bp, Human; identical to SEQ ID NO: 96514

SEQ ID NO: 98909 - DNA, 601 bp, Human; identical to SEQ ID NO: 96515

SEQ ID NO: 98910 - DNA, 601 bp, Human; identical to SEQ ID NO: 96516

SEQ ID NO: 98911 - DNA, 601 bp, Human; identical to SEQ ID NO: 96517

SEQ ID NO: 98912 - DNA, 601 bp, Human; identical to SEQ ID NO: 96518

SEQ ID NO: 98913 - DNA, 601 bp, Human; identical to SEQ ID NO: 96519

SEQ ID NO: 98914 - DNA, 601 bp, Human; identical to SEQ ID NO: 96520

SEQ ID NO: 98915 - DNA, 601 bp, Human; identical to SEQ ID NO: 96521

SEQ ID NO: 98916 - DNA, 601 bp, Human; identical to SEQ ID NO: 96522

SEQ ID NO: 98917 - DNA, 601 bp, Human; identical to SEQ ID NO: 96523

SEQ ID NO: 98918 - DNA, 601 bp, Human; identical to SEQ ID NO: 96524

SEQ ID NO: 98919 - DNA, 601 bp, Human; identical to SEQ ID NO: 96525

SEQ ID NO: 98920 - DNA, 601 bp, Human; identical to SEQ ID NO: 96526

SEQ ID NO: 98921 - DNA, 601 bp, Human; identical to SEQ ID NO: 96527

SEQ ID NO: 98922 - DNA, 601 bp, Human; identical to SEQ ID NO: 96528

SEQ ID NO: 98923 - DNA, 601 bp, Human; identical to SEQ ID NO: 96529

SEQ ID NO: 98924 - DNA, 601 bp, Human; identical to SEQ ID NO: 96530

SEQ ID NO: 98925 - DNA, 601 bp, Human; identical to SEQ ID NO: 96531

SEQ ID NO: 98926 - DNA, 601 bp, Human; identical to SEQ ID NO: 96532

SEQ ID NO: 98927 - DNA, 601 bp, Human; identical to SEQ ID NO: 96533

SEQ ID NO: 98928 - DNA, 601 bp, Human; identical to SEQ ID NO: 96534

SEQ ID NO: 98929 - DNA, 601 bp, Human; identical to SEQ ID NO: 96535

SEQ ID NO: 98930 - DNA, 601 bp, Human; identical to SEQ ID NO: 96536

SEQ ID NO: 98931 - DNA, 601 bp, Human; identical to SEQ ID NO: 96537

SEQ ID NO: 98932 - DNA, 601 bp, Human; identical to SEQ ID NO: 96538

SEQ ID NO: 98933 - DNA, 601 bp, Human; identical to SEQ ID NO: 96539

SEQ ID NO: 98934 - DNA, 601 bp, Human; identical to SEQ ID NO: 96540

SEQ ID NO: 98935 - DNA, 601 bp, Human; identical to SEQ ID NO: 96541

SEQ ID NO: 98936 - DNA, 601 bp, Human; identical to SEQ ID NO: 96542

SEQ ID NO: 98937 - DNA, 601 bp, Human; identical to SEQ ID NO: 96543

SEQ ID NO: 98938 - DNA, 601 bp, Human; identical to SEQ ID NO: 96544

SEQ ID NO: 98939 - DNA, 601 bp, Human; identical to SEQ ID NO: 96545

SEQ ID NO: 98940 - DNA, 601 bp, Human; identical to SEQ ID NO: 96546

SEQ ID NO: 98941 - DNA, 601 bp, Human; identical to SEQ ID NO: 96547

SEQ ID NO: 98942 - DNA, 601 bp, Human; identical to SEQ ID NO: 96548

SEQ ID NO: 98943 - DNA, 601 bp, Human; identical to SEQ ID NO: 96549

SEQ ID NO: 98944 - DNA, 601 bp, Human; identical to SEQ ID NO: 96550

SEQ ID NO: 98945 - DNA, 601 bp, Human; identical to SEQ ID NO: 96551

SEQ ID NO: 98946 - DNA, 601 bp, Human; identical to SEQ ID NO: 96552

SEQ ID NO: 98947 - DNA, 601 bp, Human; identical to SEQ ID NO: 96553

SEQ ID NO: 98948 - DNA, 601 bp, Human; identical to SEQ ID NO: 96554

SEQ ID NO: 98949 - DNA, 601 bp, Human; identical to SEQ ID NO: 96555

SEQ ID NO: 98950 - DNA, 601 bp, Human; identical to SEQ ID NO: 96556

SEQ ID NO: 98951 - DNA, 601 bp, Human; identical to SEQ ID NO: 96557

SEQ ID NO: 98952 - DNA, 601 bp, Human; identical to SEQ ID NO: 96558

SEQ ID NO: 98953 - DNA, 601 bp, Human; identical to SEQ ID NO: 96559

SEQ ID NO: 98954 - DNA, 601 bp, Human; identical to SEQ ID NO: 96560

SEQ ID NO: 98955 - DNA, 601 bp, Human; identical to SEQ ID NO: 96561

SEQ ID NO: 98956 - DNA, 601 bp, Human; identical to SEQ ID NO: 96562

SEQ ID NO: 98957 - DNA, 601 bp, Human; identical to SEQ ID NO: 96563

SEQ ID NO: 98958 - DNA, 601 bp, Human; identical to SEQ ID NO: 96564

SEQ ID NO: 98959 - DNA, 601 bp, Human; identical to SEQ ID NO: 96565

SEQ ID NO: 98960 - DNA, 601 bp, Human; identical to SEQ ID NO: 96566

SEQ ID NO: 98961 - DNA, 601 bp, Human; identical to SEQ ID NO: 96567

SEQ ID NO: 98962 - DNA, 601 bp, Human; identical to SEQ ID NO: 96568

SEQ ID NO: 98963 - DNA, 601 bp, Human; identical to SEQ ID NO: 96569

SEQ ID NO: 98964 - DNA, 601 bp, Human; identical to SEQ ID NO: 96570

SEQ ID NO: 98965 - DNA, 601 bp, Human; identical to SEQ ID NO: 96571

SEQ ID NO: 98966 - DNA, 601 bp, Human; identical to SEQ ID NO: 96572

SEQ ID NO: 98967 - DNA, 601 bp, Human; identical to SEQ ID NO: 96573

SEQ ID NO: 98968 - DNA, 601 bp, Human; identical to SEQ ID NO: 96574

SEQ ID NO: 98969 - DNA, 601 bp, Human; identical to SEQ ID NO: 96575

SEQ ID NO: 98970 - DNA, 601 bp, Human; identical to SEQ ID NO: 96576

SEQ ID NO: 98971 - DNA, 601 bp, Human; identical to SEQ ID NO: 96577

SEQ ID NO: 98972 - DNA, 601 bp, Human; identical to SEQ ID NO: 96578

SEQ ID NO: 98973 - DNA, 601 bp, Human; identical to SEQ ID NO: 96579

SEQ ID NO: 98974 - DNA, 601 bp, Human; identical to SEQ ID NO: 96580

SEQ ID NO: 98975 - DNA, 601 bp, Human; identical to SEQ ID NO: 96581

SEQ ID NO: 98976 - DNA, 601 bp, Human; identical to SEQ ID NO: 96582

SEQ ID NO: 98977 - DNA, 601 bp, Human; identical to SEQ ID NO: 96583

SEQ ID NO: 98978 - DNA, 601 bp, Human; identical to SEQ ID NO: 96584

SEQ ID NO: 98979 - DNA, 417 bp, Human; identical to SEQ ID NO: 96585

SEQ ID NO: 98980 - DNA, 480 bp, Human; identical to SEQ ID NO: 96586

SEQ ID NO: 98981 - DNA, 601 bp, Human; identical to SEQ ID NO: 96587

SEQ ID NO: 98982 - DNA, 601 bp, Human; identical to SEQ ID NO: 96588

SEQ ID NO: 98983 - DNA, 601 bp, Human; identical to SEQ ID NO: 96589

SEQ ID NO: 98984 - DNA, 601 bp, Human; identical to SEQ ID NO: 96590

SEQ ID NO: 98985 - DNA, 601 bp, Human; identical to SEQ ID NO: 96591

SEQ ID NO: 98986 - DNA, 601 bp, Human; identical to SEQ ID NO: 96592

SEQ ID NO: 98987 - DNA, 601 bp, Human; identical to SEQ ID NO: 96593

SEQ ID NO: 98988 - DNA, 601 bp, Human; identical to SEQ ID NO: 96594

SEQ ID NO: 98989 - DNA, 601 bp, Human; identical to SEQ ID NO: 96595

SEQ ID NO: 98990 - DNA, 601 bp, Human; identical to SEQ ID NO: 96596

SEQ ID NO: 98991 - DNA, 601 bp, Human; identical to SEQ ID NO: 96597

SEQ ID NO: 98992 - DNA, 601 bp, Human; identical to SEQ ID NO: 96598

SEQ ID NO: 98993 - DNA, 601 bp, Human; identical to SEQ ID NO: 96599

SEQ ID NO: 98994 - DNA, 601 bp, Human; identical to SEQ ID NO: 96600

SEQ ID NO: 98995 - DNA, 601 bp, Human; identical to SEQ ID NO: 96601

SEQ ID NO: 98996 - DNA, 601 bp, Human; identical to SEQ ID NO: 96602

SEQ ID NO: 98997 - DNA, 601 bp, Human; identical to SEQ ID NO: 96603

SEQ ID NO: 98998 - DNA, 601 bp, Human; identical to SEQ ID NO: 96604

SEQ ID NO: 98999 - DNA, 601 bp, Human; identical to SEQ ID NO: 96605

SEQ ID NO: 99000 - DNA, 601 bp, Human; identical to SEQ ID NO: 96606

SEQ ID NO: 99001 - DNA, 601 bp, Human; identical to SEQ ID NO: 96607

SEQ ID NO: 99002 - DNA, 601 bp, Human; identical to SEQ ID NO: 96608

SEQ ID NO: 99003 - DNA, 601 bp, Human; identical to SEQ ID NO: 96609

SEQ ID NO: 99004 - DNA, 601 bp, Human; identical to SEQ ID NO: 96610

SEQ ID NO: 99005 - DNA, 601 bp, Human; identical to SEQ ID NO: 96611

SEQ ID NO: 99006 - DNA, 601 bp, Human; identical to SEQ ID NO: 96612

SEQ ID NO: 99007 - DNA, 601 bp, Human; identical to SEQ ID NO: 96613

SEQ ID NO: 99008 - DNA, 601 bp, Human; identical to SEQ ID NO: 96614

SEQ ID NO: 99009 - DNA, 601 bp, Human; identical to SEQ ID NO: 96615

SEQ ID NO: 99010 - DNA, 601 bp, Human; identical to SEQ ID NO: 96616

SEQ ID NO: 99011 - DNA, 601 bp, Human; identical to SEQ ID NO: 96617

SEQ ID NO: 99012 - DNA, 601 bp, Human; identical to SEQ ID NO: 96618

SEQ ID NO: 99013 - DNA, 601 bp, Human; identical to SEQ ID NO: 96619

SEQ ID NO: 99014 - DNA, 601 bp, Human; identical to SEQ ID NO: 96620

SEQ ID NO: 99015 - DNA, 601 bp, Human; identical to SEQ ID NO: 96621

SEQ ID NO: 99016 - DNA, 601 bp, Human; identical to SEQ ID NO: 96622

SEQ ID NO: 99017 - DNA, 601 bp, Human; identical to SEQ ID NO: 96623

SEQ ID NO: 99018 - DNA, 601 bp, Human; identical to SEQ ID NO: 96624

SEQ ID NO: 99019 - DNA, 601 bp, Human; identical to SEQ ID NO: 96625

SEQ ID NO: 99020 - DNA, 601 bp, Human; identical to SEQ ID NO: 96626

SEQ ID NO: 99021 - DNA, 601 bp, Human; identical to SEQ ID NO: 96627

SEQ ID NO: 99022 - DNA, 601 bp, Human; identical to SEQ ID NO: 96628

SEQ ID NO: 99023 - DNA, 601 bp, Human; identical to SEQ ID NO: 96629

SEQ ID NO: 99024 - DNA, 601 bp, Human; identical to SEQ ID NO: 96630

SEQ ID NO: 99025 - DNA, 601 bp, Human; identical to SEQ ID NO: 96631

SEQ ID NO: 99026 - DNA, 601 bp, Human; identical to SEQ ID NO: 96632

SEQ ID NO: 99027 - DNA, 601 bp, Human; identical to SEQ ID NO: 96633

SEQ ID NO: 99028 - DNA, 601 bp, Human; identical to SEQ ID NO: 96634

SEQ ID NO: 99029 - DNA, 601 bp, Human; identical to SEQ ID NO: 96635

SEQ ID NO: 99030 - DNA, 601 bp, Human; identical to SEQ ID NO: 96636

SEQ ID NO: 99031 - DNA, 601 bp, Human; identical to SEQ ID NO: 96637

SEQ ID NO: 99032 - DNA, 601 bp, Human; identical to SEQ ID NO: 96638

SEQ ID NO: 99033 - DNA, 601 bp, Human; identical to SEQ ID NO: 96639

SEQ ID NO: 99034 - DNA, 601 bp, Human; identical to SEQ ID NO: 96640

SEQ ID NO: 99035 - DNA, 601 bp, Human; identical to SEQ ID NO: 96375

SEQ ID NO: 99036 - DNA, 601 bp, Human; identical to SEQ ID NO: 96376

SEQ ID NO: 99037 - DNA, 601 bp, Human; identical to SEQ ID NO: 96377

SEQ ID NO: 99038 - DNA, 601 bp, Human; identical to SEQ ID NO: 96378

SEQ ID NO: 99039 - DNA, 601 bp, Human; identical to SEQ ID NO: 96379

SEQ ID NO: 99040 - DNA, 601 bp, Human; identical to SEQ ID NO: 96380

SEQ ID NO: 99041 - DNA, 601 bp, Human; identical to SEQ ID NO: 96381

SEQ ID NO: 99042 - DNA, 601 bp, Human; identical to SEQ ID NO: 96382

SEQ ID NO: 99043 - DNA, 601 bp, Human; identical to SEQ ID NO: 96383

SEQ ID NO: 99044 - DNA, 601 bp, Human; identical to SEQ ID NO: 96384

SEQ ID NO: 99045 - DNA, 601 bp, Human; identical to SEQ ID NO: 96385

SEQ ID NO: 99046 - DNA, 601 bp, Human; identical to SEQ ID NO: 96386

SEQ ID NO: 99047 - DNA, 601 bp, Human; identical to SEQ ID NO: 96387

SEQ ID NO: 99048 - DNA, 601 bp, Human; identical to SEQ ID NO: 96388

SEQ ID NO: 99049 - DNA, 601 bp, Human; identical to SEQ ID NO: 96389

SEQ ID NO: 99050 - DNA, 601 bp, Human; identical to SEQ ID NO: 96390

SEQ ID NO: 99051 - DNA, 601 bp, Human; identical to SEQ ID NO: 96391

SEQ ID NO: 99052 - DNA, 601 bp, Human; identical to SEQ ID NO: 96392

SEQ ID NO: 99053 - DNA, 601 bp, Human; identical to SEQ ID NO: 96393

SEQ ID NO: 99054 - DNA, 601 bp, Human; identical to SEQ ID NO: 96394

SEQ ID NO: 99055 - DNA, 601 bp, Human; identical to SEQ ID NO: 96395

SEQ ID NO: 99056 - DNA, 601 bp, Human; identical to SEQ ID NO: 96396

SEQ ID NO: 99057 - DNA, 601 bp, Human; identical to SEQ ID NO: 96397

SEQ ID NO: 99058 - DNA, 601 bp, Human; identical to SEQ ID NO: 96398

SEQ ID NO: 99059 - DNA, 601 bp, Human; identical to SEQ ID NO: 96399

SEQ ID NO: 99060 - DNA, 601 bp, Human; identical to SEQ ID NO: 96400

SEQ ID NO: 99061 - DNA, 601 bp, Human; identical to SEQ ID NO: 96401

SEQ ID NO: 99062 - DNA, 601 bp, Human; identical to SEQ ID NO: 96402

SEQ ID NO: 99063 - DNA, 601 bp, Human; identical to SEQ ID NO: 96403

SEQ ID NO: 99064 - DNA, 601 bp, Human; identical to SEQ ID NO: 96404

SEQ ID NO: 99065 - DNA, 601 bp, Human; identical to SEQ ID NO: 96405

SEQ ID NO: 99066 - DNA, 601 bp, Human; identical to SEQ ID NO: 96406

SEQ ID NO: 99067 - DNA, 601 bp, Human; identical to SEQ ID NO: 96407

SEQ ID NO: 99068 - DNA, 601 bp, Human; identical to SEQ ID NO: 96408

SEQ ID NO: 99069 - DNA, 601 bp, Human; identical to SEQ ID NO: 96409

SEQ ID NO: 99070 - DNA, 601 bp, Human; identical to SEQ ID NO: 96410

SEQ ID NO: 99071 - DNA, 601 bp, Human; identical to SEQ ID NO: 96411

SEQ ID NO: 99072 - DNA, 601 bp, Human; identical to SEQ ID NO: 96412

SEQ ID NO: 99073 - DNA, 601 bp, Human; identical to SEQ ID NO: 96413

SEQ ID NO: 99074 - DNA, 601 bp, Human; identical to SEQ ID NO: 96414

SEQ ID NO: 99075 - DNA, 601 bp, Human; identical to SEQ ID NO: 96415

SEQ ID NO: 99076 - DNA, 601 bp, Human; identical to SEQ ID NO: 96416

SEQ ID NO: 99077 - DNA, 601 bp, Human; identical to SEQ ID NO: 96417

SEQ ID NO: 99078 - DNA, 601 bp, Human; identical to SEQ ID NO: 96418

SEQ ID NO: 99079 - DNA, 601 bp, Human; identical to SEQ ID NO: 96419

SEQ ID NO: 99080 - DNA, 601 bp, Human; identical to SEQ ID NO: 96420

SEQ ID NO: 99081 - DNA, 601 bp, Human; identical to SEQ ID NO: 96421

SEQ ID NO: 99082 - DNA, 601 bp, Human; identical to SEQ ID NO: 96422

SEQ ID NO: 99083 - DNA, 601 bp, Human; identical to SEQ ID NO: 96423

SEQ ID NO: 99084 - DNA, 601 bp, Human; identical to SEQ ID NO: 96424

SEQ ID NO: 99085 - DNA, 601 bp, Human; identical to SEQ ID NO: 96425

SEQ ID NO: 99086 - DNA, 601 bp, Human; identical to SEQ ID NO: 96426

SEQ ID NO: 99087 - DNA, 601 bp, Human; identical to SEQ ID NO: 96427

SEQ ID NO: 99088 - DNA, 601 bp, Human; identical to SEQ ID NO: 96428

SEQ ID NO: 99089 - DNA, 601 bp, Human; identical to SEQ ID NO: 96429

SEQ ID NO: 99090 - DNA, 601 bp, Human; identical to SEQ ID NO: 96430

SEQ ID NO: 99091 - DNA, 601 bp, Human; identical to SEQ ID NO: 96431

SEQ ID NO: 99092 - DNA, 601 bp, Human; identical to SEQ ID NO: 96432

SEQ ID NO: 99093 - DNA, 601 bp, Human; identical to SEQ ID NO: 96433

SEQ ID NO: 99094 - DNA, 601 bp, Human; identical to SEQ ID NO: 96434

SEQ ID NO: 99095 - DNA, 601 bp, Human; identical to SEQ ID NO: 96435

SEQ ID NO: 99096 - DNA, 601 bp, Human; identical to SEQ ID NO: 96436

SEQ ID NO: 99097 - DNA, 601 bp, Human; identical to SEQ ID NO: 96437

SEQ ID NO: 99098 - DNA, 601 bp, Human; identical to SEQ ID NO: 96438

SEQ ID NO: 99099 - DNA, 601 bp, Human; identical to SEQ ID NO: 96439

SEQ ID NO: 99100 - DNA, 601 bp, Human; identical to SEQ ID NO: 96440

SEQ ID NO: 99101 - DNA, 601 bp, Human; identical to SEQ ID NO: 96441

SEQ ID NO: 99102 - DNA, 601 bp, Human; identical to SEQ ID NO: 96442

SEQ ID NO: 99103 - DNA, 601 bp, Human; identical to SEQ ID NO: 96443

SEQ ID NO: 99104 - DNA, 601 bp, Human; identical to SEQ ID NO: 96444

SEQ ID NO: 99105 - DNA, 601 bp, Human; identical to SEQ ID NO: 96445

SEQ ID NO: 99106 - DNA, 601 bp, Human; identical to SEQ ID NO: 96446

SEQ ID NO: 99107 - DNA, 601 bp, Human; identical to SEQ ID NO: 96447

SEQ ID NO: 99108 - DNA, 601 bp, Human; identical to SEQ ID NO: 96448

SEQ ID NO: 99109 - DNA, 601 bp, Human; identical to SEQ ID NO: 96449

SEQ ID NO: 99110 - DNA, 601 bp, Human; identical to SEQ ID NO: 96450

SEQ ID NO: 99111 - DNA, 601 bp, Human; identical to SEQ ID NO: 96451

SEQ ID NO: 99112 - DNA, 601 bp, Human; identical to SEQ ID NO: 96452

SEQ ID NO: 99113 - DNA, 601 bp, Human; identical to SEQ ID NO: 96453

SEQ ID NO: 99114 - DNA, 601 bp, Human; identical to SEQ ID NO: 96454

SEQ ID NO: 99115 - DNA, 601 bp, Human; identical to SEQ ID NO: 96455

SEQ ID NO: 99116 - DNA, 601 bp, Human; identical to SEQ ID NO: 96456

SEQ ID NO: 99117 - DNA, 601 bp, Human; identical to SEQ ID NO: 96457

SEQ ID NO: 99118 - DNA, 601 bp, Human; identical to SEQ ID NO: 96458

SEQ ID NO: 99119 - DNA, 601 bp, Human; identical to SEQ ID NO: 96459

SEQ ID NO: 99120 - DNA, 601 bp, Human; identical to SEQ ID NO: 96460

SEQ ID NO: 99121 - DNA, 601 bp, Human; identical to SEQ ID NO: 96461

SEQ ID NO: 99122 - DNA, 601 bp, Human; identical to SEQ ID NO: 96462

SEQ ID NO: 99123 - DNA, 601 bp, Human; identical to SEQ ID NO: 96463

SEQ ID NO: 99124 - DNA, 601 bp, Human; identical to SEQ ID NO: 96464

SEQ ID NO: 99125 - DNA, 601 bp, Human; identical to SEQ ID NO: 96465

SEQ ID NO: 99126 - DNA, 601 bp, Human; identical to SEQ ID NO: 96466

SEQ ID NO: 99127 - DNA, 601 bp, Human; identical to SEQ ID NO: 96467

SEQ ID NO: 99128 - DNA, 601 bp, Human; identical to SEQ ID NO: 96468

SEQ ID NO: 99129 - DNA, 601 bp, Human; identical to SEQ ID NO: 96469

SEQ ID NO: 99130 - DNA, 601 bp, Human; identical to SEQ ID NO: 96470

SEQ ID NO: 99131 - DNA, 601 bp, Human; identical to SEQ ID NO: 96471

SEQ ID NO: 99132 - DNA, 601 bp, Human; identical to SEQ ID NO: 96472

SEQ ID NO: 99133 - DNA, 601 bp, Human; identical to SEQ ID NO: 96473

SEQ ID NO: 99134 - DNA, 601 bp, Human; identical to SEQ ID NO: 96474

SEQ ID NO: 99135 - DNA, 601 bp, Human; identical to SEQ ID NO: 96475

SEQ ID NO: 99136 - DNA, 601 bp, Human; identical to SEQ ID NO: 96476

SEQ ID NO: 99137 - DNA, 601 bp, Human; identical to SEQ ID NO: 96477

SEQ ID NO: 99138 - DNA, 601 bp, Human; identical to SEQ ID NO: 96478

SEQ ID NO: 99139 - DNA, 601 bp, Human; identical to SEQ ID NO: 96479

SEQ ID NO: 99140 - DNA, 601 bp, Human; identical to SEQ ID NO: 96480

SEQ ID NO: 99141 - DNA, 601 bp, Human; identical to SEQ ID NO: 96481

SEQ ID NO: 99142 - DNA, 601 bp, Human; identical to SEQ ID NO: 96482

SEQ ID NO: 99143 - DNA, 601 bp, Human; identical to SEQ ID NO: 96483

SEQ ID NO: 99144 - DNA, 601 bp, Human; identical to SEQ ID NO: 96484

SEQ ID NO: 99145 - DNA, 601 bp, Human; identical to SEQ ID NO: 96485

SEQ ID NO: 99146 - DNA, 601 bp, Human; identical to SEQ ID NO: 96486

SEQ ID NO: 99147 - DNA, 601 bp, Human; identical to SEQ ID NO: 96487

SEQ ID NO: 99148 - DNA, 601 bp, Human; identical to SEQ ID NO: 96488

SEQ ID NO: 99149 - DNA, 601 bp, Human; identical to SEQ ID NO: 96489

SEQ ID NO: 99150 - DNA, 601 bp, Human; identical to SEQ ID NO: 96490

SEQ ID NO: 99151 - DNA, 601 bp, Human; identical to SEQ ID NO: 96491

SEQ ID NO: 99152 - DNA, 601 bp, Human; identical to SEQ ID NO: 96492

SEQ ID NO: 99153 - DNA, 601 bp, Human; identical to SEQ ID NO: 96493

SEQ ID NO: 99154 - DNA, 601 bp, Human; identical to SEQ ID NO: 96494

SEQ ID NO: 99155 - DNA, 601 bp, Human; identical to SEQ ID NO: 96495

SEQ ID NO: 99156 - DNA, 601 bp, Human; identical to SEQ ID NO: 96496

SEQ ID NO: 99157 - DNA, 601 bp, Human; identical to SEQ ID NO: 96497

SEQ ID NO: 99158 - DNA, 601 bp, Human; identical to SEQ ID NO: 96498

SEQ ID NO: 99159 - DNA, 601 bp, Human; identical to SEQ ID NO: 96499

SEQ ID NO: 99160 - DNA, 601 bp, Human; identical to SEQ ID NO: 96500

SEQ ID NO: 99161 - DNA, 601 bp, Human; identical to SEQ ID NO: 96501

SEQ ID NO: 99162 - DNA, 601 bp, Human; identical to SEQ ID NO: 96502

SEQ ID NO: 99163 - DNA, 601 bp, Human; identical to SEQ ID NO: 96503

SEQ ID NO: 99164 - DNA, 601 bp, Human; identical to SEQ ID NO: 96504

SEQ ID NO: 99165 - DNA, 601 bp, Human; identical to SEQ ID NO: 96505

SEQ ID NO: 99166 - DNA, 601 bp, Human; identical to SEQ ID NO: 96506

SEQ ID NO: 99167 - DNA, 601 bp, Human; identical to SEQ ID NO: 96507

SEQ ID NO: 99168 - DNA, 601 bp, Human; identical to SEQ ID NO: 96508

SEQ ID NO: 99169 - DNA, 601 bp, Human; identical to SEQ ID NO: 96509

SEQ ID NO: 99170 - DNA, 601 bp, Human; identical to SEQ ID NO: 96510

SEQ ID NO: 99171 - DNA, 601 bp, Human; identical to SEQ ID NO: 96511

SEQ ID NO: 99172 - DNA, 601 bp, Human; identical to SEQ ID NO: 96512

SEQ ID NO: 99173 - DNA, 601 bp, Human; identical to SEQ ID NO: 96513

SEQ ID NO: 99174 - DNA, 601 bp, Human; identical to SEQ ID NO: 96514

SEQ ID NO: 99175 - DNA, 601 bp, Human; identical to SEQ ID NO: 96515

SEQ ID NO: 99176 - DNA, 601 bp, Human; identical to SEQ ID NO: 96516

SEQ ID NO: 99177 - DNA, 601 bp, Human; identical to SEQ ID NO: 96517

SEQ ID NO: 99178 - DNA, 601 bp, Human; identical to SEQ ID NO: 96518

SEQ ID NO: 99179 - DNA, 601 bp, Human; identical to SEQ ID NO: 96519

SEQ ID NO: 99180 - DNA, 601 bp, Human; identical to SEQ ID NO: 96520

SEQ ID NO: 99181 - DNA, 601 bp, Human; identical to SEQ ID NO: 96521

SEQ ID NO: 99182 - DNA, 601 bp, Human; identical to SEQ ID NO: 96522

SEQ ID NO: 99183 - DNA, 601 bp, Human; identical to SEQ ID NO: 96523

SEQ ID NO: 99184 - DNA, 601 bp, Human; identical to SEQ ID NO: 96524

SEQ ID NO: 99185 - DNA, 601 bp, Human; identical to SEQ ID NO: 96525

SEQ ID NO: 99186 - DNA, 601 bp, Human; identical to SEQ ID NO: 96526

SEQ ID NO: 99187 - DNA, 601 bp, Human; identical to SEQ ID NO: 96527

SEQ ID NO: 99188 - DNA, 601 bp, Human; identical to SEQ ID NO: 96528

SEQ ID NO: 99189 - DNA, 601 bp, Human; identical to SEQ ID NO: 96529

SEQ ID NO: 99190 - DNA, 601 bp, Human; identical to SEQ ID NO: 96530

SEQ ID NO: 99191 - DNA, 601 bp, Human; identical to SEQ ID NO: 96531

SEQ ID NO: 99192 - DNA, 601 bp, Human; identical to SEQ ID NO: 96532

SEQ ID NO: 99193 - DNA, 601 bp, Human; identical to SEQ ID NO: 96533

SEQ ID NO: 99194 - DNA, 601 bp, Human; identical to SEQ ID NO: 96534

SEQ ID NO: 99195 - DNA, 601 bp, Human; identical to SEQ ID NO: 96535

SEQ ID NO: 99196 - DNA, 601 bp, Human; identical to SEQ ID NO: 96536

SEQ ID NO: 99197 - DNA, 601 bp, Human; identical to SEQ ID NO: 96537

SEQ ID NO: 99198 - DNA, 601 bp, Human; identical to SEQ ID NO: 96538

SEQ ID NO: 99199 - DNA, 601 bp, Human; identical to SEQ ID NO: 96539

SEQ ID NO: 99200 - DNA, 601 bp, Human; identical to SEQ ID NO: 96540

SEQ ID NO: 99201 - DNA, 601 bp, Human; identical to SEQ ID NO: 96541

SEQ ID NO: 99202 - DNA, 601 bp, Human; identical to SEQ ID NO: 96542

SEQ ID NO: 99203 - DNA, 601 bp, Human; identical to SEQ ID NO: 96543

SEQ ID NO: 99204 - DNA, 601 bp, Human; identical to SEQ ID NO: 96544

SEQ ID NO: 99205 - DNA, 601 bp, Human; identical to SEQ ID NO: 96545

SEQ ID NO: 99206 - DNA, 601 bp, Human; identical to SEQ ID NO: 96546

SEQ ID NO: 99207 - DNA, 601 bp, Human; identical to SEQ ID NO: 96547

SEQ ID NO: 99208 - DNA, 601 bp, Human; identical to SEQ ID NO: 96548

SEQ ID NO: 99209 - DNA, 601 bp, Human; identical to SEQ ID NO: 96549

SEQ ID NO: 99210 - DNA, 601 bp, Human; identical to SEQ ID NO: 96550

SEQ ID NO: 99211 - DNA, 601 bp, Human; identical to SEQ ID NO: 96551

SEQ ID NO: 99212 - DNA, 601 bp, Human; identical to SEQ ID NO: 96552

SEQ ID NO: 99213 - DNA, 601 bp, Human; identical to SEQ ID NO: 96553

SEQ ID NO: 99214 - DNA, 601 bp, Human; identical to SEQ ID NO: 96554

SEQ ID NO: 99215 - DNA, 601 bp, Human; identical to SEQ ID NO: 96555

SEQ ID NO: 99216 - DNA, 601 bp, Human; identical to SEQ ID NO: 96556

SEQ ID NO: 99217 - DNA, 601 bp, Human; identical to SEQ ID NO: 96557

SEQ ID NO: 99218 - DNA, 601 bp, Human; identical to SEQ ID NO: 96558

SEQ ID NO: 99219 - DNA, 601 bp, Human; identical to SEQ ID NO: 96559

SEQ ID NO: 99220 - DNA, 601 bp, Human; identical to SEQ ID NO: 96560

SEQ ID NO: 99221 - DNA, 601 bp, Human; identical to SEQ ID NO: 96561

SEQ ID NO: 99222 - DNA, 601 bp, Human; identical to SEQ ID NO: 96562

SEQ ID NO: 99223 - DNA, 601 bp, Human; identical to SEQ ID NO: 96563

SEQ ID NO: 99224 - DNA, 601 bp, Human; identical to SEQ ID NO: 96564

SEQ ID NO: 99225 - DNA, 601 bp, Human; identical to SEQ ID NO: 96565

SEQ ID NO: 99226 - DNA, 601 bp, Human; identical to SEQ ID NO: 96566

SEQ ID NO: 99227 - DNA, 601 bp, Human; identical to SEQ ID NO: 96567

SEQ ID NO: 99228 - DNA, 601 bp, Human; identical to SEQ ID NO: 96568

SEQ ID NO: 99229 - DNA, 601 bp, Human; identical to SEQ ID NO: 96569

SEQ ID NO: 99230 - DNA, 601 bp, Human; identical to SEQ ID NO: 96570

SEQ ID NO: 99231 - DNA, 601 bp, Human; identical to SEQ ID NO: 96571

SEQ ID NO: 99232 - DNA, 601 bp, Human; identical to SEQ ID NO: 96572

SEQ ID NO: 99233 - DNA, 601 bp, Human; identical to SEQ ID NO: 96573

SEQ ID NO: 99234 - DNA, 601 bp, Human; identical to SEQ ID NO: 96574

SEQ ID NO: 99235 - DNA, 601 bp, Human; identical to SEQ ID NO: 96575

SEQ ID NO: 99236 - DNA, 601 bp, Human; identical to SEQ ID NO: 96576

SEQ ID NO: 99237 - DNA, 601 bp, Human; identical to SEQ ID NO: 96577

SEQ ID NO: 99238 - DNA, 601 bp, Human; identical to SEQ ID NO: 96578

SEQ ID NO: 99239 - DNA, 601 bp, Human; identical to SEQ ID NO: 96579

SEQ ID NO: 99240 - DNA, 601 bp, Human; identical to SEQ ID NO: 96580

SEQ ID NO: 99241 - DNA, 601 bp, Human; identical to SEQ ID NO: 96581

SEQ ID NO: 99242 - DNA, 601 bp, Human; identical to SEQ ID NO: 96582

SEQ ID NO: 99243 - DNA, 601 bp, Human; identical to SEQ ID NO: 96583

SEQ ID NO: 99244 - DNA, 601 bp, Human; identical to SEQ ID NO: 96584

SEQ ID NO: 99245 - DNA, 417 bp, Human; identical to SEQ ID NO: 96585

SEQ ID NO: 99246 - DNA, 480 bp, Human; identical to SEQ ID NO: 96586

SEQ ID NO: 99247 - DNA, 601 bp, Human; identical to SEQ ID NO: 96587

SEQ ID NO: 99248 - DNA, 601 bp, Human; identical to SEQ ID NO: 96588

SEQ ID NO: 99249 - DNA, 601 bp, Human; identical to SEQ ID NO: 96589

SEQ ID NO: 99250 - DNA, 601 bp, Human; identical to SEQ ID NO: 96590

SEQ ID NO: 99251 - DNA, 601 bp, Human; identical to SEQ ID NO: 96591

SEQ ID NO: 99252 - DNA, 601 bp, Human; identical to SEQ ID NO: 96592

SEQ ID NO: 99253 - DNA, 601 bp, Human; identical to SEQ ID NO: 96593

SEQ ID NO: 99254 - DNA, 601 bp, Human; identical to SEQ ID NO: 96594

SEQ ID NO: 99255 - DNA, 601 bp, Human; identical to SEQ ID NO: 96595

SEQ ID NO: 99256 - DNA, 601 bp, Human; identical to SEQ ID NO: 96596

SEQ ID NO: 99257 - DNA, 601 bp, Human; identical to SEQ ID NO: 96597

SEQ ID NO: 99258 - DNA, 601 bp, Human; identical to SEQ ID NO: 96598

SEQ ID NO: 99259 - DNA, 601 bp, Human; identical to SEQ ID NO: 96599

SEQ ID NO: 99260 - DNA, 601 bp, Human; identical to SEQ ID NO: 96600

SEQ ID NO: 99261 - DNA, 601 bp, Human; identical to SEQ ID NO: 96601

SEQ ID NO: 99262 - DNA, 601 bp, Human; identical to SEQ ID NO: 96602

SEQ ID NO: 99263 - DNA, 601 bp, Human; identical to SEQ ID NO: 96603

SEQ ID NO: 99264 - DNA, 601 bp, Human; identical to SEQ ID NO: 96604

SEQ ID NO: 99265 - DNA, 601 bp, Human; identical to SEQ ID NO: 96605

SEQ ID NO: 99266 - DNA, 601 bp, Human; identical to SEQ ID NO: 96606

SEQ ID NO: 99267 - DNA, 601 bp, Human; identical to SEQ ID NO: 96607

SEQ ID NO: 99268 - DNA, 601 bp, Human; identical to SEQ ID NO: 96608

SEQ ID NO: 99269 - DNA, 601 bp, Human; identical to SEQ ID NO: 96609

SEQ ID NO: 99270 - DNA, 601 bp, Human; identical to SEQ ID NO: 96610

SEQ ID NO: 99271 - DNA, 601 bp, Human; identical to SEQ ID NO: 96611

SEQ ID NO: 99272 - DNA, 601 bp, Human; identical to SEQ ID NO: 96612

SEQ ID NO: 99273 - DNA, 601 bp, Human; identical to SEQ ID NO: 96613

SEQ ID NO: 99274 - DNA, 601 bp, Human; identical to SEQ ID NO: 96614

SEQ ID NO: 99275 - DNA, 601 bp, Human; identical to SEQ ID NO: 96615

SEQ ID NO: 99276 - DNA, 601 bp, Human; identical to SEQ ID NO: 96616

SEQ ID NO: 99277 - DNA, 601 bp, Human; identical to SEQ ID NO: 96617

SEQ ID NO: 99278 - DNA, 601 bp, Human; identical to SEQ ID NO: 96618

SEQ ID NO: 99279 - DNA, 601 bp, Human; identical to SEQ ID NO: 96619

SEQ ID NO: 99280 - DNA, 601 bp, Human; identical to SEQ ID NO: 96620

SEQ ID NO: 99281 - DNA, 601 bp, Human; identical to SEQ ID NO: 96621

SEQ ID NO: 99282 - DNA, 601 bp, Human; identical to SEQ ID NO: 96622

SEQ ID NO: 99283 - DNA, 601 bp, Human; identical to SEQ ID NO: 96623

SEQ ID NO: 99284 - DNA, 601 bp, Human; identical to SEQ ID NO: 96624

SEQ ID NO: 99285 - DNA, 601 bp, Human; identical to SEQ ID NO: 96625

SEQ ID NO: 99286 - DNA, 601 bp, Human; identical to SEQ ID NO: 96626

SEQ ID NO: 99287 - DNA, 601 bp, Human; identical to SEQ ID NO: 96627

SEQ ID NO: 99288 - DNA, 601 bp, Human; identical to SEQ ID NO: 96628

SEQ ID NO: 99289 - DNA, 601 bp, Human; identical to SEQ ID NO: 96629

SEQ ID NO: 99290 - DNA, 601 bp, Human; identical to SEQ ID NO: 96630

SEQ ID NO: 99291 - DNA, 601 bp, Human; identical to SEQ ID NO: 96631

SEQ ID NO: 99292 - DNA, 601 bp, Human; identical to SEQ ID NO: 96632

SEQ ID NO: 99293 - DNA, 601 bp, Human; identical to SEQ ID NO: 96633

SEQ ID NO: 99294 - DNA, 601 bp, Human; identical to SEQ ID NO: 96634

SEQ ID NO: 99295 - DNA, 601 bp, Human; identical to SEQ ID NO: 96635

SEQ ID NO: 99296 - DNA, 601 bp, Human; identical to SEQ ID NO: 96636

SEQ ID NO: 99297 - DNA, 601 bp, Human; identical to SEQ ID NO: 96637

SEQ ID NO: 99298 - DNA, 601 bp, Human; identical to SEQ ID NO: 96638

SEQ ID NO: 99299 - DNA, 601 bp, Human; identical to SEQ ID NO: 96639

SEQ ID NO: 99300 - DNA, 601 bp, Human; identical to SEQ ID NO: 96640

SEQ ID NO: 99301 - DNA, 601 bp, Human; identical to SEQ ID NO: 96375

SEQ ID NO: 99302 - DNA, 601 bp, Human; identical to SEQ ID NO: 96376

SEQ ID NO: 99303 - DNA, 601 bp, Human; identical to SEQ ID NO: 96377

SEQ ID NO: 99304 - DNA, 601 bp, Human; identical to SEQ ID NO: 96378

SEQ ID NO: 99305 - DNA, 601 bp, Human; identical to SEQ ID NO: 96379

SEQ ID NO: 99306 - DNA, 601 bp, Human; identical to SEQ ID NO: 96380

SEQ ID NO: 99307 - DNA, 601 bp, Human; identical to SEQ ID NO: 96381

SEQ ID NO: 99308 - DNA, 601 bp, Human; identical to SEQ ID NO: 96382

SEQ ID NO: 99309 - DNA, 601 bp, Human; identical to SEQ ID NO: 96383

SEQ ID NO: 99310 - DNA, 601 bp, Human; identical to SEQ ID NO: 96384

SEQ ID NO: 99311 - DNA, 601 bp, Human; identical to SEQ ID NO: 96385

SEQ ID NO: 99312 - DNA, 601 bp, Human; identical to SEQ ID NO: 96386

SEQ ID NO: 99313 - DNA, 601 bp, Human; identical to SEQ ID NO: 96387

SEQ ID NO: 99314 - DNA, 601 bp, Human; identical to SEQ ID NO: 96388

SEQ ID NO: 99315 - DNA, 601 bp, Human; identical to SEQ ID NO: 96389

SEQ ID NO: 99316 - DNA, 601 bp, Human; identical to SEQ ID NO: 96390

SEQ ID NO: 99317 - DNA, 601 bp, Human; identical to SEQ ID NO: 96391

SEQ ID NO: 99318 - DNA, 601 bp, Human; identical to SEQ ID NO: 96392

SEQ ID NO: 99319 - DNA, 601 bp, Human; identical to SEQ ID NO: 96393

SEQ ID NO: 99320 - DNA, 601 bp, Human; identical to SEQ ID NO: 96394

SEQ ID NO: 99321 - DNA, 601 bp, Human; identical to SEQ ID NO: 96395

SEQ ID NO: 99322 - DNA, 601 bp, Human; identical to SEQ ID NO: 96396

SEQ ID NO: 99323 - DNA, 601 bp, Human; identical to SEQ ID NO: 96397

SEQ ID NO: 99324 - DNA, 601 bp, Human; identical to SEQ ID NO: 96398

SEQ ID NO: 99325 - DNA, 601 bp, Human; identical to SEQ ID NO: 96399

SEQ ID NO: 99326 - DNA, 601 bp, Human; identical to SEQ ID NO: 96400

SEQ ID NO: 99327 - DNA, 601 bp, Human; identical to SEQ ID NO: 96401

SEQ ID NO: 99328 - DNA, 601 bp, Human; identical to SEQ ID NO: 96402

SEQ ID NO: 99329 - DNA, 601 bp, Human; identical to SEQ ID NO: 96403

SEQ ID NO: 99330 - DNA, 601 bp, Human; identical to SEQ ID NO: 96404

SEQ ID NO: 99331 - DNA, 601 bp, Human; identical to SEQ ID NO: 96405

SEQ ID NO: 99332 - DNA, 601 bp, Human; identical to SEQ ID NO: 96406

SEQ ID NO: 99333 - DNA, 601 bp, Human; identical to SEQ ID NO: 96407

SEQ ID NO: 99334 - DNA, 601 bp, Human; identical to SEQ ID NO: 96408

SEQ ID NO: 99335 - DNA, 601 bp, Human; identical to SEQ ID NO: 96409

SEQ ID NO: 99336 - DNA, 601 bp, Human; identical to SEQ ID NO: 96410

SEQ ID NO: 99337 - DNA, 601 bp, Human; identical to SEQ ID NO: 96411

SEQ ID NO: 99338 - DNA, 601 bp, Human; identical to SEQ ID NO: 96412

SEQ ID NO: 99339 - DNA, 601 bp, Human; identical to SEQ ID NO: 96413

SEQ ID NO: 99340 - DNA, 601 bp, Human; identical to SEQ ID NO: 96414

SEQ ID NO: 99341 - DNA, 601 bp, Human; identical to SEQ ID NO: 96415

SEQ ID NO: 99342 - DNA, 601 bp, Human; identical to SEQ ID NO: 96416

SEQ ID NO: 99343 - DNA, 601 bp, Human; identical to SEQ ID NO: 96417

SEQ ID NO: 99344 - DNA, 601 bp, Human; identical to SEQ ID NO: 96418

SEQ ID NO: 99345 - DNA, 601 bp, Human; identical to SEQ ID NO: 96419

SEQ ID NO: 99346 - DNA, 601 bp, Human; identical to SEQ ID NO: 96420

SEQ ID NO: 99347 - DNA, 601 bp, Human; identical to SEQ ID NO: 96421

SEQ ID NO: 99348 - DNA, 601 bp, Human; identical to SEQ ID NO: 96422

SEQ ID NO: 99349 - DNA, 601 bp, Human; identical to SEQ ID NO: 96423

SEQ ID NO: 99350 - DNA, 601 bp, Human; identical to SEQ ID NO: 96424

SEQ ID NO: 99351 - DNA, 601 bp, Human; identical to SEQ ID NO: 96425

SEQ ID NO: 99352 - DNA, 601 bp, Human; identical to SEQ ID NO: 96426

SEQ ID NO: 99353 - DNA, 601 bp, Human; identical to SEQ ID NO: 96427

SEQ ID NO: 99354 - DNA, 601 bp, Human; identical to SEQ ID NO: 96428

SEQ ID NO: 99355 - DNA, 601 bp, Human; identical to SEQ ID NO: 96429

SEQ ID NO: 99356 - DNA, 601 bp, Human; identical to SEQ ID NO: 96430

SEQ ID NO: 99357 - DNA, 601 bp, Human; identical to SEQ ID NO: 96431

SEQ ID NO: 99358 - DNA, 601 bp, Human; identical to SEQ ID NO: 96432

SEQ ID NO: 99359 - DNA, 601 bp, Human; identical to SEQ ID NO: 96433

SEQ ID NO: 99360 - DNA, 601 bp, Human; identical to SEQ ID NO: 96434

SEQ ID NO: 99361 - DNA, 601 bp, Human; identical to SEQ ID NO: 96435

SEQ ID NO: 99362 - DNA, 601 bp, Human; identical to SEQ ID NO: 96436

SEQ ID NO: 99363 - DNA, 601 bp, Human; identical to SEQ ID NO: 96437

SEQ ID NO: 99364 - DNA, 601 bp, Human; identical to SEQ ID NO: 96438

SEQ ID NO: 99365 - DNA, 601 bp, Human; identical to SEQ ID NO: 96439

SEQ ID NO: 99366 - DNA, 601 bp, Human; identical to SEQ ID NO: 96440

SEQ ID NO: 99367 - DNA, 601 bp, Human; identical to SEQ ID NO: 96441

SEQ ID NO: 99368 - DNA, 601 bp, Human; identical to SEQ ID NO: 96442

SEQ ID NO: 99369 - DNA, 601 bp, Human; identical to SEQ ID NO: 96443

SEQ ID NO: 99370 - DNA, 601 bp, Human; identical to SEQ ID NO: 96444

SEQ ID NO: 99371 - DNA, 601 bp, Human; identical to SEQ ID NO: 96445

SEQ ID NO: 99372 - DNA, 601 bp, Human; identical to SEQ ID NO: 96446

SEQ ID NO: 99373 - DNA, 601 bp, Human; identical to SEQ ID NO: 96447

SEQ ID NO: 99374 - DNA, 601 bp, Human; identical to SEQ ID NO: 96448

SEQ ID NO: 99375 - DNA, 601 bp, Human; identical to SEQ ID NO: 96449

SEQ ID NO: 99376 - DNA, 601 bp, Human; identical to SEQ ID NO: 96450

SEQ ID NO: 99377 - DNA, 601 bp, Human; identical to SEQ ID NO: 96451

SEQ ID NO: 99378 - DNA, 601 bp, Human; identical to SEQ ID NO: 96452

SEQ ID NO: 99379 - DNA, 601 bp, Human; identical to SEQ ID NO: 96453

SEQ ID NO: 99380 - DNA, 601 bp, Human; identical to SEQ ID NO: 96454

SEQ ID NO: 99381 - DNA, 601 bp, Human; identical to SEQ ID NO: 96455

SEQ ID NO: 99382 - DNA, 601 bp, Human; identical to SEQ ID NO: 96456

SEQ ID NO: 99383 - DNA, 601 bp, Human; identical to SEQ ID NO: 96457

SEQ ID NO: 99384 - DNA, 601 bp, Human; identical to SEQ ID NO: 96458

SEQ ID NO: 99385 - DNA, 601 bp, Human; identical to SEQ ID NO: 96459

SEQ ID NO: 99386 - DNA, 601 bp, Human; identical to SEQ ID NO: 96460

SEQ ID NO: 99387 - DNA, 601 bp, Human; identical to SEQ ID NO: 96461

SEQ ID NO: 99388 - DNA, 601 bp, Human; identical to SEQ ID NO: 96462

SEQ ID NO: 99389 - DNA, 601 bp, Human; identical to SEQ ID NO: 96463

SEQ ID NO: 99390 - DNA, 601 bp, Human; identical to SEQ ID NO: 96464

SEQ ID NO: 99391 - DNA, 601 bp, Human; identical to SEQ ID NO: 96465

SEQ ID NO: 99392 - DNA, 601 bp, Human; identical to SEQ ID NO: 96466

SEQ ID NO: 99393 - DNA, 601 bp, Human; identical to SEQ ID NO: 96467

SEQ ID NO: 99394 - DNA, 601 bp, Human; identical to SEQ ID NO: 96468

SEQ ID NO: 99395 - DNA, 601 bp, Human; identical to SEQ ID NO: 96469

SEQ ID NO: 99396 - DNA, 601 bp, Human; identical to SEQ ID NO: 96470

SEQ ID NO: 99397 - DNA, 601 bp, Human; identical to SEQ ID NO: 96471

SEQ ID NO: 99398 - DNA, 601 bp, Human; identical to SEQ ID NO: 96472

SEQ ID NO: 99399 - DNA, 601 bp, Human; identical to SEQ ID NO: 96473

SEQ ID NO: 99400 - DNA, 601 bp, Human; identical to SEQ ID NO: 96474

SEQ ID NO: 99401 - DNA, 601 bp, Human; identical to SEQ ID NO: 96475

SEQ ID NO: 99402 - DNA, 601 bp, Human; identical to SEQ ID NO: 96476

SEQ ID NO: 99403 - DNA, 601 bp, Human; identical to SEQ ID NO: 96477

SEQ ID NO: 99404 - DNA, 601 bp, Human; identical to SEQ ID NO: 96478

SEQ ID NO: 99405 - DNA, 601 bp, Human; identical to SEQ ID NO: 96479

SEQ ID NO: 99406 - DNA, 601 bp, Human; identical to SEQ ID NO: 96480

SEQ ID NO: 99407 - DNA, 601 bp, Human; identical to SEQ ID NO: 96481

SEQ ID NO: 99408 - DNA, 601 bp, Human; identical to SEQ ID NO: 96482

SEQ ID NO: 99409 - DNA, 601 bp, Human; identical to SEQ ID NO: 96483

SEQ ID NO: 99410 - DNA, 601 bp, Human; identical to SEQ ID NO: 96484

SEQ ID NO: 99411 - DNA, 601 bp, Human; identical to SEQ ID NO: 96485

SEQ ID NO: 99412 - DNA, 601 bp, Human; identical to SEQ ID NO: 96486

SEQ ID NO: 99413 - DNA, 601 bp, Human; identical to SEQ ID NO: 96487

SEQ ID NO: 99414 - DNA, 601 bp, Human; identical to SEQ ID NO: 96488

SEQ ID NO: 99415 - DNA, 601 bp, Human; identical to SEQ ID NO: 96489

SEQ ID NO: 99416 - DNA, 601 bp, Human; identical to SEQ ID NO: 96490

SEQ ID NO: 99417 - DNA, 601 bp, Human; identical to SEQ ID NO: 96491

SEQ ID NO: 99418 - DNA, 601 bp, Human; identical to SEQ ID NO: 96492

SEQ ID NO: 99419 - DNA, 601 bp, Human; identical to SEQ ID NO: 96493

SEQ ID NO: 99420 - DNA, 601 bp, Human; identical to SEQ ID NO: 96494

SEQ ID NO: 99421 - DNA, 601 bp, Human; identical to SEQ ID NO: 96495

SEQ ID NO: 99422 - DNA, 601 bp, Human; identical to SEQ ID NO: 96496

SEQ ID NO: 99423 - DNA, 601 bp, Human; identical to SEQ ID NO: 96497

SEQ ID NO: 99424 - DNA, 601 bp, Human; identical to SEQ ID NO: 96498

SEQ ID NO: 99425 - DNA, 601 bp, Human; identical to SEQ ID NO: 96499

SEQ ID NO: 99426 - DNA, 601 bp, Human; identical to SEQ ID NO: 96500

SEQ ID NO: 99427 - DNA, 601 bp, Human; identical to SEQ ID NO: 96501

SEQ ID NO: 99428 - DNA, 601 bp, Human; identical to SEQ ID NO: 96502

SEQ ID NO: 99429 - DNA, 601 bp, Human; identical to SEQ ID NO: 96503

SEQ ID NO: 99430 - DNA, 601 bp, Human; identical to SEQ ID NO: 96504

SEQ ID NO: 99431 - DNA, 601 bp, Human; identical to SEQ ID NO: 96505

SEQ ID NO: 99432 - DNA, 601 bp, Human; identical to SEQ ID NO: 96506

SEQ ID NO: 99433 - DNA, 601 bp, Human; identical to SEQ ID NO: 96507

SEQ ID NO: 99434 - DNA, 601 bp, Human; identical to SEQ ID NO: 96508

SEQ ID NO: 99435 - DNA, 601 bp, Human; identical to SEQ ID NO: 96509

SEQ ID NO: 99436 - DNA, 601 bp, Human; identical to SEQ ID NO: 96510

SEQ ID NO: 99437 - DNA, 601 bp, Human; identical to SEQ ID NO: 96511

SEQ ID NO: 99438 - DNA, 601 bp, Human; identical to SEQ ID NO: 96512

SEQ ID NO: 99439 - DNA, 601 bp, Human; identical to SEQ ID NO: 96513

SEQ ID NO: 99440 - DNA, 601 bp, Human; identical to SEQ ID NO: 96514

SEQ ID NO: 99441 - DNA, 601 bp, Human; identical to SEQ ID NO: 96515

SEQ ID NO: 99442 - DNA, 601 bp, Human; identical to SEQ ID NO: 96516

SEQ ID NO: 99443 - DNA, 601 bp, Human; identical to SEQ ID NO: 96517

SEQ ID NO: 99444 - DNA, 601 bp, Human; identical to SEQ ID NO: 96518

SEQ ID NO: 99445 - DNA, 601 bp, Human; identical to SEQ ID NO: 96519

SEQ ID NO: 99446 - DNA, 601 bp, Human; identical to SEQ ID NO: 96520

SEQ ID NO: 99447 - DNA, 601 bp, Human; identical to SEQ ID NO: 96521

SEQ ID NO: 99448 - DNA, 601 bp, Human; identical to SEQ ID NO: 96522

SEQ ID NO: 99449 - DNA, 601 bp, Human; identical to SEQ ID NO: 96523

SEQ ID NO: 99450 - DNA, 601 bp, Human; identical to SEQ ID NO: 96524

SEQ ID NO: 99451 - DNA, 601 bp, Human; identical to SEQ ID NO: 96525

SEQ ID NO: 99452 - DNA, 601 bp, Human; identical to SEQ ID NO: 96526

SEQ ID NO: 99453 - DNA, 601 bp, Human; identical to SEQ ID NO: 96527

SEQ ID NO: 99454 - DNA, 601 bp, Human; identical to SEQ ID NO: 96528

SEQ ID NO: 99455 - DNA, 601 bp, Human; identical to SEQ ID NO: 96529

SEQ ID NO: 99456 - DNA, 601 bp, Human; identical to SEQ ID NO: 96530

SEQ ID NO: 99457 - DNA, 601 bp, Human; identical to SEQ ID NO: 96531

SEQ ID NO: 99458 - DNA, 601 bp, Human; identical to SEQ ID NO: 96532

SEQ ID NO: 99459 - DNA, 601 bp, Human; identical to SEQ ID NO: 96533

SEQ ID NO: 99460 - DNA, 601 bp, Human; identical to SEQ ID NO: 96534

SEQ ID NO: 99461 - DNA, 601 bp, Human; identical to SEQ ID NO: 96535

SEQ ID NO: 99462 - DNA, 601 bp, Human; identical to SEQ ID NO: 96536

SEQ ID NO: 99463 - DNA, 601 bp, Human; identical to SEQ ID NO: 96537

SEQ ID NO: 99464 - DNA, 601 bp, Human; identical to SEQ ID NO: 96538

SEQ ID NO: 99465 - DNA, 601 bp, Human; identical to SEQ ID NO: 96539

SEQ ID NO: 99466 - DNA, 601 bp, Human; identical to SEQ ID NO: 96540

SEQ ID NO: 99467 - DNA, 601 bp, Human; identical to SEQ ID NO: 96541

SEQ ID NO: 99468 - DNA, 601 bp, Human; identical to SEQ ID NO: 96542

SEQ ID NO: 99469 - DNA, 601 bp, Human; identical to SEQ ID NO: 96543

SEQ ID NO: 99470 - DNA, 601 bp, Human; identical to SEQ ID NO: 96544

SEQ ID NO: 99471 - DNA, 601 bp, Human; identical to SEQ ID NO: 96545

SEQ ID NO: 99472 - DNA, 601 bp, Human; identical to SEQ ID NO: 96546

SEQ ID NO: 99473 - DNA, 601 bp, Human; identical to SEQ ID NO: 96547

SEQ ID NO: 99474 - DNA, 601 bp, Human; identical to SEQ ID NO: 96548

SEQ ID NO: 99475 - DNA, 601 bp, Human; identical to SEQ ID NO: 96549

SEQ ID NO: 99476 - DNA, 601 bp, Human; identical to SEQ ID NO: 96550

SEQ ID NO: 99477 - DNA, 601 bp, Human; identical to SEQ ID NO: 96551

SEQ ID NO: 99478 - DNA, 601 bp, Human; identical to SEQ ID NO: 96552

SEQ ID NO: 99479 - DNA, 601 bp, Human; identical to SEQ ID NO: 96553

SEQ ID NO: 99480 - DNA, 601 bp, Human; identical to SEQ ID NO: 96554

SEQ ID NO: 99481 - DNA, 601 bp, Human; identical to SEQ ID NO: 96555

SEQ ID NO: 99482 - DNA, 601 bp, Human; identical to SEQ ID NO: 96556

SEQ ID NO: 99483 - DNA, 601 bp, Human; identical to SEQ ID NO: 96557

SEQ ID NO: 99484 - DNA, 601 bp, Human; identical to SEQ ID NO: 96558

SEQ ID NO: 99485 - DNA, 601 bp, Human; identical to SEQ ID NO: 96559

SEQ ID NO: 99486 - DNA, 601 bp, Human; identical to SEQ ID NO: 96560

SEQ ID NO: 99487 - DNA, 601 bp, Human; identical to SEQ ID NO: 96561

SEQ ID NO: 99488 - DNA, 601 bp, Human; identical to SEQ ID NO: 96562

SEQ ID NO: 99489 - DNA, 601 bp, Human; identical to SEQ ID NO: 96563

SEQ ID NO: 99490 - DNA, 601 bp, Human; identical to SEQ ID NO: 96564

SEQ ID NO: 99491 - DNA, 601 bp, Human; identical to SEQ ID NO: 96565

SEQ ID NO: 99492 - DNA, 601 bp, Human; identical to SEQ ID NO: 96566

SEQ ID NO: 99493 - DNA, 601 bp, Human; identical to SEQ ID NO: 96567

SEQ ID NO: 99494 - DNA, 601 bp, Human; identical to SEQ ID NO: 96568

SEQ ID NO: 99495 - DNA, 601 bp, Human; identical to SEQ ID NO: 96569

SEQ ID NO: 99496 - DNA, 601 bp, Human; identical to SEQ ID NO: 96570

SEQ ID NO: 99497 - DNA, 601 bp, Human; identical to SEQ ID NO: 96571

SEQ ID NO: 99498 - DNA, 601 bp, Human; identical to SEQ ID NO: 96572

SEQ ID NO: 99499 - DNA, 601 bp, Human; identical to SEQ ID NO: 96573

SEQ ID NO: 99500 - DNA, 601 bp, Human; identical to SEQ ID NO: 96574

SEQ ID NO: 99501 - DNA, 601 bp, Human; identical to SEQ ID NO: 96575

SEQ ID NO: 99502 - DNA, 601 bp, Human; identical to SEQ ID NO: 96576

SEQ ID NO: 99503 - DNA, 601 bp, Human; identical to SEQ ID NO: 96577

SEQ ID NO: 99504 - DNA, 601 bp, Human; identical to SEQ ID NO: 96578

SEQ ID NO: 99505 - DNA, 601 bp, Human; identical to SEQ ID NO: 96579

SEQ ID NO: 99506 - DNA, 601 bp, Human; identical to SEQ ID NO: 96580

SEQ ID NO: 99507 - DNA, 601 bp, Human; identical to SEQ ID NO: 96581

SEQ ID NO: 99508 - DNA, 601 bp, Human; identical to SEQ ID NO: 96582

SEQ ID NO: 99509 - DNA, 601 bp, Human; identical to SEQ ID NO: 96583

SEQ ID NO: 99510 - DNA, 601 bp, Human; identical to SEQ ID NO: 96584

SEQ ID NO: 99511 - DNA, 417 bp, Human; identical to SEQ ID NO: 96585

SEQ ID NO: 99512 - DNA, 480 bp, Human; identical to SEQ ID NO: 96586

SEQ ID NO: 99513 - DNA, 601 bp, Human; identical to SEQ ID NO: 96587

SEQ ID NO: 99514 - DNA, 601 bp, Human; identical to SEQ ID NO: 96588

SEQ ID NO: 99515 - DNA, 601 bp, Human; identical to SEQ ID NO: 96589

SEQ ID NO: 99516 - DNA, 601 bp, Human; identical to SEQ ID NO: 96590

SEQ ID NO: 99517 - DNA, 601 bp, Human; identical to SEQ ID NO: 96591

SEQ ID NO: 99518 - DNA, 601 bp, Human; identical to SEQ ID NO: 96592

SEQ ID NO: 99519 - DNA, 601 bp, Human; identical to SEQ ID NO: 96593

SEQ ID NO: 99520 - DNA, 601 bp, Human; identical to SEQ ID NO: 96594

SEQ ID NO: 99521 - DNA, 601 bp, Human; identical to SEQ ID NO: 96595

SEQ ID NO: 99522 - DNA, 601 bp, Human; identical to SEQ ID NO: 96596

SEQ ID NO: 99523 - DNA, 601 bp, Human; identical to SEQ ID NO: 96597

SEQ ID NO: 99524 - DNA, 601 bp, Human; identical to SEQ ID NO: 96598

SEQ ID NO: 99525 - DNA, 601 bp, Human; identical to SEQ ID NO: 96599

SEQ ID NO: 99526 - DNA, 601 bp, Human; identical to SEQ ID NO: 96600

SEQ ID NO: 99527 - DNA, 601 bp, Human; identical to SEQ ID NO: 96601

SEQ ID NO: 99528 - DNA, 601 bp, Human; identical to SEQ ID NO: 96602

SEQ ID NO: 99529 - DNA, 601 bp, Human; identical to SEQ ID NO: 96603

SEQ ID NO: 99530 - DNA, 601 bp, Human; identical to SEQ ID NO: 96604

SEQ ID NO: 99531 - DNA, 601 bp, Human; identical to SEQ ID NO: 96605

SEQ ID NO: 99532 - DNA, 601 bp, Human; identical to SEQ ID NO: 96606

SEQ ID NO: 99533 - DNA, 601 bp, Human; identical to SEQ ID NO: 96607

SEQ ID NO: 99534 - DNA, 601 bp, Human; identical to SEQ ID NO: 96608

SEQ ID NO: 99535 - DNA, 601 bp, Human; identical to SEQ ID NO: 96609

SEQ ID NO: 99536 - DNA, 601 bp, Human; identical to SEQ ID NO: 96610

SEQ ID NO: 99537 - DNA, 601 bp, Human; identical to SEQ ID NO: 96611

SEQ ID NO: 99538 - DNA, 601 bp, Human; identical to SEQ ID NO: 96612

SEQ ID NO: 99539 - DNA, 601 bp, Human; identical to SEQ ID NO: 96613

SEQ ID NO: 99540 - DNA, 601 bp, Human; identical to SEQ ID NO: 96614

SEQ ID NO: 99541 - DNA, 601 bp, Human; identical to SEQ ID NO: 96615

SEQ ID NO: 99542 - DNA, 601 bp, Human; identical to SEQ ID NO: 96616

SEQ ID NO: 99543 - DNA, 601 bp, Human; identical to SEQ ID NO: 96617

SEQ ID NO: 99544 - DNA, 601 bp, Human; identical to SEQ ID NO: 96618

SEQ ID NO: 99545 - DNA, 601 bp, Human; identical to SEQ ID NO: 96619

SEQ ID NO: 99546 - DNA, 601 bp, Human; identical to SEQ ID NO: 96620

SEQ ID NO: 99547 - DNA, 601 bp, Human; identical to SEQ ID NO: 96621

SEQ ID NO: 99548 - DNA, 601 bp, Human; identical to SEQ ID NO: 96622

SEQ ID NO: 99549 - DNA, 601 bp, Human; identical to SEQ ID NO: 96623

SEQ ID NO: 99550 - DNA, 601 bp, Human; identical to SEQ ID NO: 96624

SEQ ID NO: 99551 - DNA, 601 bp, Human; identical to SEQ ID NO: 96625

SEQ ID NO: 99552 - DNA, 601 bp, Human; identical to SEQ ID NO: 96626

SEQ ID NO: 99553 - DNA, 601 bp, Human; identical to SEQ ID NO: 96627

SEQ ID NO: 99554 - DNA, 601 bp, Human; identical to SEQ ID NO: 96628

SEQ ID NO: 99555 - DNA, 601 bp, Human; identical to SEQ ID NO: 96629

SEQ ID NO: 99556 - DNA, 601 bp, Human; identical to SEQ ID NO: 96630

SEQ ID NO: 99557 - DNA, 601 bp, Human; identical to SEQ ID NO: 96631

SEQ ID NO: 99558 - DNA, 601 bp, Human; identical to SEQ ID NO: 96632

SEQ ID NO: 99559 - DNA, 601 bp, Human; identical to SEQ ID NO: 96633

SEQ ID NO: 99560 - DNA, 601 bp, Human; identical to SEQ ID NO: 96634

SEQ ID NO: 99561 - DNA, 601 bp, Human; identical to SEQ ID NO: 96635

SEQ ID NO: 99562 - DNA, 601 bp, Human; identical to SEQ ID NO: 96636

SEQ ID NO: 99563 - DNA, 601 bp, Human; identical to SEQ ID NO: 96637

SEQ ID NO: 99564 - DNA, 601 bp, Human; identical to SEQ ID NO: 96638

SEQ ID NO: 99565 - DNA, 601 bp, Human; identical to SEQ ID NO: 96639

SEQ ID NO: 99566 - DNA, 601 bp, Human; identical to SEQ ID NO: 96640

SEQ ID NO: 99567 - DNA, 601 bp, Human; identical to SEQ ID NO: 96375

SEQ ID NO: 99568 - DNA, 601 bp, Human; identical to SEQ ID NO: 96376

SEQ ID NO: 99569 - DNA, 601 bp, Human; identical to SEQ ID NO: 96377

SEQ ID NO: 99570 - DNA, 601 bp, Human; identical to SEQ ID NO: 96378

SEQ ID NO: 99571 - DNA, 601 bp, Human; identical to SEQ ID NO: 96379

SEQ ID NO: 99572 - DNA, 601 bp, Human; identical to SEQ ID NO: 96380

SEQ ID NO: 99573 - DNA, 601 bp, Human; identical to SEQ ID NO: 96381

SEQ ID NO: 99574 - DNA, 601 bp, Human; identical to SEQ ID NO: 96382

SEQ ID NO: 99575 - DNA, 601 bp, Human; identical to SEQ ID NO: 96383

SEQ ID NO: 99576 - DNA, 601 bp, Human; identical to SEQ ID NO: 96384

SEQ ID NO: 99577 - DNA, 601 bp, Human; identical to SEQ ID NO: 96385

SEQ ID NO: 99578 - DNA, 601 bp, Human; identical to SEQ ID NO: 96386

SEQ ID NO: 99579 - DNA, 601 bp, Human; identical to SEQ ID NO: 96387

SEQ ID NO: 99580 - DNA, 601 bp, Human; identical to SEQ ID NO: 96388

SEQ ID NO: 99581 - DNA, 601 bp, Human; identical to SEQ ID NO: 96389

SEQ ID NO: 99582 - DNA, 601 bp, Human; identical to SEQ ID NO: 96390

SEQ ID NO: 99583 - DNA, 601 bp, Human; identical to SEQ ID NO: 96391

SEQ ID NO: 99584 - DNA, 601 bp, Human; identical to SEQ ID NO: 96392

SEQ ID NO: 99585 - DNA, 601 bp, Human; identical to SEQ ID NO: 96393

SEQ ID NO: 99586 - DNA, 601 bp, Human; identical to SEQ ID NO: 96394

SEQ ID NO: 99587 - DNA, 601 bp, Human; identical to SEQ ID NO: 96395

SEQ ID NO: 99588 - DNA, 601 bp, Human; identical to SEQ ID NO: 96396

SEQ ID NO: 99589 - DNA, 601 bp, Human; identical to SEQ ID NO: 96397

SEQ ID NO: 99590 - DNA, 601 bp, Human; identical to SEQ ID NO: 96398

SEQ ID NO: 99591 - DNA, 601 bp, Human; identical to SEQ ID NO: 96399

SEQ ID NO: 99592 - DNA, 601 bp, Human; identical to SEQ ID NO: 96400

SEQ ID NO: 99593 - DNA, 601 bp, Human; identical to SEQ ID NO: 96401

SEQ ID NO: 99594 - DNA, 601 bp, Human; identical to SEQ ID NO: 96402

SEQ ID NO: 99595 - DNA, 601 bp, Human; identical to SEQ ID NO: 96403

SEQ ID NO: 99596 - DNA, 601 bp, Human; identical to SEQ ID NO: 96404

SEQ ID NO: 99597 - DNA, 601 bp, Human; identical to SEQ ID NO: 96405

SEQ ID NO: 99598 - DNA, 601 bp, Human; identical to SEQ ID NO: 96406

SEQ ID NO: 99599 - DNA, 601 bp, Human; identical to SEQ ID NO: 96407

SEQ ID NO: 99600 - DNA, 601 bp, Human; identical to SEQ ID NO: 96408

SEQ ID NO: 99601 - DNA, 601 bp, Human; identical to SEQ ID NO: 96409

SEQ ID NO: 99602 - DNA, 601 bp, Human; identical to SEQ ID NO: 96410

SEQ ID NO: 99603 - DNA, 601 bp, Human; identical to SEQ ID NO: 96411

SEQ ID NO: 99604 - DNA, 601 bp, Human; identical to SEQ ID NO: 96412

SEQ ID NO: 99605 - DNA, 601 bp, Human; identical to SEQ ID NO: 96413

SEQ ID NO: 99606 - DNA, 601 bp, Human; identical to SEQ ID NO: 96414

SEQ ID NO: 99607 - DNA, 601 bp, Human; identical to SEQ ID NO: 96415

SEQ ID NO: 99608 - DNA, 601 bp, Human; identical to SEQ ID NO: 96416

SEQ ID NO: 99609 - DNA, 601 bp, Human; identical to SEQ ID NO: 96417

SEQ ID NO: 99610 - DNA, 601 bp, Human; identical to SEQ ID NO: 96418

SEQ ID NO: 99611 - DNA, 601 bp, Human; identical to SEQ ID NO: 96419

SEQ ID NO: 99612 - DNA, 601 bp, Human; identical to SEQ ID NO: 96420

SEQ ID NO: 99613 - DNA, 601 bp, Human; identical to SEQ ID NO: 96421

SEQ ID NO: 99614 - DNA, 601 bp, Human; identical to SEQ ID NO: 96422

SEQ ID NO: 99615 - DNA, 601 bp, Human; identical to SEQ ID NO: 96423

SEQ ID NO: 99616 - DNA, 601 bp, Human; identical to SEQ ID NO: 96424

SEQ ID NO: 99617 - DNA, 601 bp, Human; identical to SEQ ID NO: 96425

SEQ ID NO: 99618 - DNA, 601 bp, Human; identical to SEQ ID NO: 96426

SEQ ID NO: 99619 - DNA, 601 bp, Human; identical to SEQ ID NO: 96427

SEQ ID NO: 99620 - DNA, 601 bp, Human; identical to SEQ ID NO: 96428

SEQ ID NO: 99621 - DNA, 601 bp, Human; identical to SEQ ID NO: 96429

SEQ ID NO: 99622 - DNA, 601 bp, Human; identical to SEQ ID NO: 96430

SEQ ID NO: 99623 - DNA, 601 bp, Human; identical to SEQ ID NO: 96431

SEQ ID NO: 99624 - DNA, 601 bp, Human; identical to SEQ ID NO: 96432

SEQ ID NO: 99625 - DNA, 601 bp, Human; identical to SEQ ID NO: 96433

SEQ ID NO: 99626 - DNA, 601 bp, Human; identical to SEQ ID NO: 96434

SEQ ID NO: 99627 - DNA, 601 bp, Human; identical to SEQ ID NO: 96435

SEQ ID NO: 99628 - DNA, 601 bp, Human; identical to SEQ ID NO: 96436

SEQ ID NO: 99629 - DNA, 601 bp, Human; identical to SEQ ID NO: 96437

SEQ ID NO: 99630 - DNA, 601 bp, Human; identical to SEQ ID NO: 96438

SEQ ID NO: 99631 - DNA, 601 bp, Human; identical to SEQ ID NO: 96439

SEQ ID NO: 99632 - DNA, 601 bp, Human; identical to SEQ ID NO: 96440

SEQ ID NO: 99633 - DNA, 601 bp, Human; identical to SEQ ID NO: 96441

SEQ ID NO: 99634 - DNA, 601 bp, Human; identical to SEQ ID NO: 96442

SEQ ID NO: 99635 - DNA, 601 bp, Human; identical to SEQ ID NO: 96443

SEQ ID NO: 99636 - DNA, 601 bp, Human; identical to SEQ ID NO: 96444

SEQ ID NO: 99637 - DNA, 601 bp, Human; identical to SEQ ID NO: 96445

SEQ ID NO: 99638 - DNA, 601 bp, Human; identical to SEQ ID NO: 96446

SEQ ID NO: 99639 - DNA, 601 bp, Human; identical to SEQ ID NO: 96447

SEQ ID NO: 99640 - DNA, 601 bp, Human; identical to SEQ ID NO: 96448

SEQ ID NO: 99641 - DNA, 601 bp, Human; identical to SEQ ID NO: 96449

SEQ ID NO: 99642 - DNA, 601 bp, Human; identical to SEQ ID NO: 96450

SEQ ID NO: 99643 - DNA, 601 bp, Human; identical to SEQ ID NO: 96451

SEQ ID NO: 99644 - DNA, 601 bp, Human; identical to SEQ ID NO: 96452

SEQ ID NO: 99645 - DNA, 601 bp, Human; identical to SEQ ID NO: 96453

SEQ ID NO: 99646 - DNA, 601 bp, Human; identical to SEQ ID NO: 96454

SEQ ID NO: 99647 - DNA, 601 bp, Human; identical to SEQ ID NO: 96455

SEQ ID NO: 99648 - DNA, 601 bp, Human; identical to SEQ ID NO: 96456

SEQ ID NO: 99649 - DNA, 601 bp, Human; identical to SEQ ID NO: 96457

SEQ ID NO: 99650 - DNA, 601 bp, Human; identical to SEQ ID NO: 96458

SEQ ID NO: 99651 - DNA, 601 bp, Human; identical to SEQ ID NO: 96459

SEQ ID NO: 99652 - DNA, 601 bp, Human; identical to SEQ ID NO: 96460

SEQ ID NO: 99653 - DNA, 601 bp, Human; identical to SEQ ID NO: 96461

SEQ ID NO: 99654 - DNA, 601 bp, Human; identical to SEQ ID NO: 96462

SEQ ID NO: 99655 - DNA, 601 bp, Human; identical to SEQ ID NO: 96463

SEQ ID NO: 99656 - DNA, 601 bp, Human; identical to SEQ ID NO: 96464

SEQ ID NO: 99657 - DNA, 601 bp, Human; identical to SEQ ID NO: 96465

SEQ ID NO: 99658 - DNA, 601 bp, Human; identical to SEQ ID NO: 96466

SEQ ID NO: 99659 - DNA, 601 bp, Human; identical to SEQ ID NO: 96467

SEQ ID NO: 99660 - DNA, 601 bp, Human; identical to SEQ ID NO: 96468

SEQ ID NO: 99661 - DNA, 601 bp, Human; identical to SEQ ID NO: 96469

SEQ ID NO: 99662 - DNA, 601 bp, Human; identical to SEQ ID NO: 96470

SEQ ID NO: 99663 - DNA, 601 bp, Human; identical to SEQ ID NO: 96471

SEQ ID NO: 99664 - DNA, 601 bp, Human; identical to SEQ ID NO: 96472

SEQ ID NO: 99665 - DNA, 601 bp, Human; identical to SEQ ID NO: 96473

SEQ ID NO: 99666 - DNA, 601 bp, Human; identical to SEQ ID NO: 96474

SEQ ID NO: 99667 - DNA, 601 bp, Human; identical to SEQ ID NO: 96475

SEQ ID NO: 99668 - DNA, 601 bp, Human; identical to SEQ ID NO: 96476

SEQ ID NO: 99669 - DNA, 601 bp, Human; identical to SEQ ID NO: 96477

SEQ ID NO: 99670 - DNA, 601 bp, Human; identical to SEQ ID NO: 96478

SEQ ID NO: 99671 - DNA, 601 bp, Human; identical to SEQ ID NO: 96479

SEQ ID NO: 99672 - DNA, 601 bp, Human; identical to SEQ ID NO: 96480

SEQ ID NO: 99673 - DNA, 601 bp, Human; identical to SEQ ID NO: 96481

SEQ ID NO: 99674 - DNA, 601 bp, Human; identical to SEQ ID NO: 96482

SEQ ID NO: 99675 - DNA, 601 bp, Human; identical to SEQ ID NO: 96483

SEQ ID NO: 99676 - DNA, 601 bp, Human; identical to SEQ ID NO: 96484

SEQ ID NO: 99677 - DNA, 601 bp, Human; identical to SEQ ID NO: 96485

SEQ ID NO: 99678 - DNA, 601 bp, Human; identical to SEQ ID NO: 96486

SEQ ID NO: 99679 - DNA, 601 bp, Human; identical to SEQ ID NO: 96487

SEQ ID NO: 99680 - DNA, 601 bp, Human; identical to SEQ ID NO: 96488

SEQ ID NO: 99681 - DNA, 601 bp, Human; identical to SEQ ID NO: 96489

SEQ ID NO: 99682 - DNA, 601 bp, Human; identical to SEQ ID NO: 96490

SEQ ID NO: 99683 - DNA, 601 bp, Human; identical to SEQ ID NO: 96491

SEQ ID NO: 99684 - DNA, 601 bp, Human; identical to SEQ ID NO: 96492

SEQ ID NO: 99685 - DNA, 601 bp, Human; identical to SEQ ID NO: 96493

SEQ ID NO: 99686 - DNA, 601 bp, Human; identical to SEQ ID NO: 96494

SEQ ID NO: 99687 - DNA, 601 bp, Human; identical to SEQ ID NO: 96495

SEQ ID NO: 99688 - DNA, 601 bp, Human; identical to SEQ ID NO: 96496

SEQ ID NO: 99689 - DNA, 601 bp, Human; identical to SEQ ID NO: 96497

SEQ ID NO: 99690 - DNA, 601 bp, Human; identical to SEQ ID NO: 96498

SEQ ID NO: 99691 - DNA, 601 bp, Human; identical to SEQ ID NO: 96499

SEQ ID NO: 99692 - DNA, 601 bp, Human; identical to SEQ ID NO: 96500

SEQ ID NO: 99693 - DNA, 601 bp, Human; identical to SEQ ID NO: 96501

SEQ ID NO: 99694 - DNA, 601 bp, Human; identical to SEQ ID NO: 96502

SEQ ID NO: 99695 - DNA, 601 bp, Human; identical to SEQ ID NO: 96503

SEQ ID NO: 99696 - DNA, 601 bp, Human; identical to SEQ ID NO: 96504

SEQ ID NO: 99697 - DNA, 601 bp, Human; identical to SEQ ID NO: 96505

SEQ ID NO: 99698 - DNA, 601 bp, Human; identical to SEQ ID NO: 96506

SEQ ID NO: 99699 - DNA, 601 bp, Human; identical to SEQ ID NO: 96507

SEQ ID NO: 99700 - DNA, 601 bp, Human; identical to SEQ ID NO: 96508

SEQ ID NO: 99701 - DNA, 601 bp, Human; identical to SEQ ID NO: 96509

SEQ ID NO: 99702 - DNA, 601 bp, Human; identical to SEQ ID NO: 96510

SEQ ID NO: 99703 - DNA, 601 bp, Human; identical to SEQ ID NO: 96511

SEQ ID NO: 99704 - DNA, 601 bp, Human; identical to SEQ ID NO: 96512

SEQ ID NO: 99705 - DNA, 601 bp, Human; identical to SEQ ID NO: 96513

SEQ ID NO: 99706 - DNA, 601 bp, Human; identical to SEQ ID NO: 96514

SEQ ID NO: 99707 - DNA, 601 bp, Human; identical to SEQ ID NO: 96515

SEQ ID NO: 99708 - DNA, 601 bp, Human; identical to SEQ ID NO: 96516

SEQ ID NO: 99709 - DNA, 601 bp, Human; identical to SEQ ID NO: 96517

SEQ ID NO: 99710 - DNA, 601 bp, Human; identical to SEQ ID NO: 96518

SEQ ID NO: 99711 - DNA, 601 bp, Human; identical to SEQ ID NO: 96519

SEQ ID NO: 99712 - DNA, 601 bp, Human; identical to SEQ ID NO: 96520

SEQ ID NO: 99713 - DNA, 601 bp, Human; identical to SEQ ID NO: 96521

SEQ ID NO: 99714 - DNA, 601 bp, Human; identical to SEQ ID NO: 96522

SEQ ID NO: 99715 - DNA, 601 bp, Human; identical to SEQ ID NO: 96523

SEQ ID NO: 99716 - DNA, 601 bp, Human; identical to SEQ ID NO: 96524

SEQ ID NO: 99717 - DNA, 601 bp, Human; identical to SEQ ID NO: 96525

SEQ ID NO: 99718 - DNA, 601 bp, Human; identical to SEQ ID NO: 96526

SEQ ID NO: 99719 - DNA, 601 bp, Human; identical to SEQ ID NO: 96527

SEQ ID NO: 99720 - DNA, 601 bp, Human; identical to SEQ ID NO: 96528

SEQ ID NO: 99721 - DNA, 601 bp, Human; identical to SEQ ID NO: 96529

SEQ ID NO: 99722 - DNA, 601 bp, Human; identical to SEQ ID NO: 96530

SEQ ID NO: 99723 - DNA, 601 bp, Human; identical to SEQ ID NO: 96531

SEQ ID NO: 99724 - DNA, 601 bp, Human; identical to SEQ ID NO: 96532

SEQ ID NO: 99725 - DNA, 601 bp, Human; identical to SEQ ID NO: 96533

SEQ ID NO: 99726 - DNA, 601 bp, Human; identical to SEQ ID NO: 96534

SEQ ID NO: 99727 - DNA, 601 bp, Human; identical to SEQ ID NO: 96535

SEQ ID NO: 99728 - DNA, 601 bp, Human; identical to SEQ ID NO: 96536

SEQ ID NO: 99729 - DNA, 601 bp, Human; identical to SEQ ID NO: 96537

SEQ ID NO: 99730 - DNA, 601 bp, Human; identical to SEQ ID NO: 96538

SEQ ID NO: 99731 - DNA, 601 bp, Human; identical to SEQ ID NO: 96539

SEQ ID NO: 99732 - DNA, 601 bp, Human; identical to SEQ ID NO: 96540

SEQ ID NO: 99733 - DNA, 601 bp, Human; identical to SEQ ID NO: 96541

SEQ ID NO: 99734 - DNA, 601 bp, Human; identical to SEQ ID NO: 96542

SEQ ID NO: 99735 - DNA, 601 bp, Human; identical to SEQ ID NO: 96543

SEQ ID NO: 99736 - DNA, 601 bp, Human; identical to SEQ ID NO: 96544

SEQ ID NO: 99737 - DNA, 601 bp, Human; identical to SEQ ID NO: 96545

SEQ ID NO: 99738 - DNA, 601 bp, Human; identical to SEQ ID NO: 96546

SEQ ID NO: 99739 - DNA, 601 bp, Human; identical to SEQ ID NO: 96547

SEQ ID NO: 99740 - DNA, 601 bp, Human; identical to SEQ ID NO: 96548

SEQ ID NO: 99741 - DNA, 601 bp, Human; identical to SEQ ID NO: 96549

SEQ ID NO: 99742 - DNA, 601 bp, Human; identical to SEQ ID NO: 96550

SEQ ID NO: 99743 - DNA, 601 bp, Human; identical to SEQ ID NO: 96551

SEQ ID NO: 99744 - DNA, 601 bp, Human; identical to SEQ ID NO: 96552

SEQ ID NO: 99745 - DNA, 601 bp, Human; identical to SEQ ID NO: 96553

SEQ ID NO: 99746 - DNA, 601 bp, Human; identical to SEQ ID NO: 96554

SEQ ID NO: 99747 - DNA, 601 bp, Human; identical to SEQ ID NO: 96555

SEQ ID NO: 99748 - DNA, 601 bp, Human; identical to SEQ ID NO: 96556

SEQ ID NO: 99749 - DNA, 601 bp, Human; identical to SEQ ID NO: 96557

SEQ ID NO: 99750 - DNA, 601 bp, Human; identical to SEQ ID NO: 96558

SEQ ID NO: 99751 - DNA, 601 bp, Human; identical to SEQ ID NO: 96559

SEQ ID NO: 99752 - DNA, 601 bp, Human; identical to SEQ ID NO: 96560

SEQ ID NO: 99753 - DNA, 601 bp, Human; identical to SEQ ID NO: 96561

SEQ ID NO: 99754 - DNA, 601 bp, Human; identical to SEQ ID NO: 96562

SEQ ID NO: 99755 - DNA, 601 bp, Human; identical to SEQ ID NO: 96563

SEQ ID NO: 99756 - DNA, 601 bp, Human; identical to SEQ ID NO: 96564

SEQ ID NO: 99757 - DNA, 601 bp, Human; identical to SEQ ID NO: 96565

SEQ ID NO: 99758 - DNA, 601 bp, Human; identical to SEQ ID NO: 96566

SEQ ID NO: 99759 - DNA, 601 bp, Human; identical to SEQ ID NO: 96567

SEQ ID NO: 99760 - DNA, 601 bp, Human; identical to SEQ ID NO: 96568

SEQ ID NO: 99761 - DNA, 601 bp, Human; identical to SEQ ID NO: 96569

SEQ ID NO: 99762 - DNA, 601 bp, Human; identical to SEQ ID NO: 96570

SEQ ID NO: 99763 - DNA, 601 bp, Human; identical to SEQ ID NO: 96571

SEQ ID NO: 99764 - DNA, 601 bp, Human; identical to SEQ ID NO: 96572

SEQ ID NO: 99765 - DNA, 601 bp, Human; identical to SEQ ID NO: 96573

SEQ ID NO: 99766 - DNA, 601 bp, Human; identical to SEQ ID NO: 96574

SEQ ID NO: 99767 - DNA, 601 bp, Human; identical to SEQ ID NO: 96575

SEQ ID NO: 99768 - DNA, 601 bp, Human; identical to SEQ ID NO: 96576

SEQ ID NO: 99769 - DNA, 601 bp, Human; identical to SEQ ID NO: 96577

SEQ ID NO: 99770 - DNA, 601 bp, Human; identical to SEQ ID NO: 96578

SEQ ID NO: 99771 - DNA, 601 bp, Human; identical to SEQ ID NO: 96579

SEQ ID NO: 99772 - DNA, 601 bp, Human; identical to SEQ ID NO: 96580

SEQ ID NO: 99773 - DNA, 601 bp, Human; identical to SEQ ID NO: 96581

SEQ ID NO: 99774 - DNA, 601 bp, Human; identical to SEQ ID NO: 96582

SEQ ID NO: 99775 - DNA, 601 bp, Human; identical to SEQ ID NO: 96583

SEQ ID NO: 99776 - DNA, 601 bp, Human; identical to SEQ ID NO: 96584

SEQ ID NO: 99777 - DNA, 417 bp, Human; identical to SEQ ID NO: 96585

SEQ ID NO: 99778 - DNA, 480 bp, Human; identical to SEQ ID NO: 96586

SEQ ID NO: 99779 - DNA, 601 bp, Human; identical to SEQ ID NO: 96587

SEQ ID NO: 99780 - DNA, 601 bp, Human; identical to SEQ ID NO: 96588

SEQ ID NO: 99781 - DNA, 601 bp, Human; identical to SEQ ID NO: 96589

SEQ ID NO: 99782 - DNA, 601 bp, Human; identical to SEQ ID NO: 96590

SEQ ID NO: 99783 - DNA, 601 bp, Human; identical to SEQ ID NO: 96591

SEQ ID NO: 99784 - DNA, 601 bp, Human; identical to SEQ ID NO: 96592

SEQ ID NO: 99785 - DNA, 601 bp, Human; identical to SEQ ID NO: 96593

SEQ ID NO: 99786 - DNA, 601 bp, Human; identical to SEQ ID NO: 96594

SEQ ID NO: 99787 - DNA, 601 bp, Human; identical to SEQ ID NO: 96595

SEQ ID NO: 99788 - DNA, 601 bp, Human; identical to SEQ ID NO: 96596

SEQ ID NO: 99789 - DNA, 601 bp, Human; identical to SEQ ID NO: 96597

SEQ ID NO: 99790 - DNA, 601 bp, Human; identical to SEQ ID NO: 96598

SEQ ID NO: 99791 - DNA, 601 bp, Human; identical to SEQ ID NO: 96599

SEQ ID NO: 99792 - DNA, 601 bp, Human; identical to SEQ ID NO: 96600

SEQ ID NO: 99793 - DNA, 601 bp, Human; identical to SEQ ID NO: 96601

SEQ ID NO: 99794 - DNA, 601 bp, Human; identical to SEQ ID NO: 96602

SEQ ID NO: 99795 - DNA, 601 bp, Human; identical to SEQ ID NO: 96603

SEQ ID NO: 99796 - DNA, 601 bp, Human; identical to SEQ ID NO: 96604

SEQ ID NO: 99797 - DNA, 601 bp, Human; identical to SEQ ID NO: 96605

SEQ ID NO: 99798 - DNA, 601 bp, Human; identical to SEQ ID NO: 96606

SEQ ID NO: 99799 - DNA, 601 bp, Human; identical to SEQ ID NO: 96607

SEQ ID NO: 99800 - DNA, 601 bp, Human; identical to SEQ ID NO: 96608

SEQ ID NO: 99801 - DNA, 601 bp, Human; identical to SEQ ID NO: 96609

SEQ ID NO: 99802 - DNA, 601 bp, Human; identical to SEQ ID NO: 96610

SEQ ID NO: 99803 - DNA, 601 bp, Human; identical to SEQ ID NO: 96611

SEQ ID NO: 99804 - DNA, 601 bp, Human; identical to SEQ ID NO: 96612

SEQ ID NO: 99805 - DNA, 601 bp, Human; identical to SEQ ID NO: 96613

SEQ ID NO: 99806 - DNA, 601 bp, Human; identical to SEQ ID NO: 96614

SEQ ID NO: 99807 - DNA, 601 bp, Human; identical to SEQ ID NO: 96615

SEQ ID NO: 99808 - DNA, 601 bp, Human; identical to SEQ ID NO: 96616

SEQ ID NO: 99809 - DNA, 601 bp, Human; identical to SEQ ID NO: 96617

SEQ ID NO: 99810 - DNA, 601 bp, Human; identical to SEQ ID NO: 96618

SEQ ID NO: 99811 - DNA, 601 bp, Human; identical to SEQ ID NO: 96619

SEQ ID NO: 99812 - DNA, 601 bp, Human; identical to SEQ ID NO: 96620

SEQ ID NO: 99813 - DNA, 601 bp, Human; identical to SEQ ID NO: 96621

SEQ ID NO: 99814 - DNA, 601 bp, Human; identical to SEQ ID NO: 96622

SEQ ID NO: 99815 - DNA, 601 bp, Human; identical to SEQ ID NO: 96623

SEQ ID NO: 99816 - DNA, 601 bp, Human; identical to SEQ ID NO: 96624

SEQ ID NO: 99817 - DNA, 601 bp, Human; identical to SEQ ID NO: 96625

SEQ ID NO: 99818 - DNA, 601 bp, Human; identical to SEQ ID NO: 96626

SEQ ID NO: 99819 - DNA, 601 bp, Human; identical to SEQ ID NO: 96627

SEQ ID NO: 99820 - DNA, 601 bp, Human; identical to SEQ ID NO: 96628

SEQ ID NO: 99821 - DNA, 601 bp, Human; identical to SEQ ID NO: 96629

SEQ ID NO: 99822 - DNA, 601 bp, Human; identical to SEQ ID NO: 96630

SEQ ID NO: 99823 - DNA, 601 bp, Human; identical to SEQ ID NO: 96631

SEQ ID NO: 99824 - DNA, 601 bp, Human; identical to SEQ ID NO: 96632

SEQ ID NO: 99825 - DNA, 601 bp, Human; identical to SEQ ID NO: 96633

SEQ ID NO: 99826 - DNA, 601 bp, Human; identical to SEQ ID NO: 96634

SEQ ID NO: 99827 - DNA, 601 bp, Human; identical to SEQ ID NO: 96635

SEQ ID NO: 99828 - DNA, 601 bp, Human; identical to SEQ ID NO: 96636

SEQ ID NO: 99829 - DNA, 601 bp, Human; identical to SEQ ID NO: 96637

SEQ ID NO: 99830 - DNA, 601 bp, Human; identical to SEQ ID NO: 96638

SEQ ID NO: 99831 - DNA, 601 bp, Human; identical to SEQ ID NO: 96639

SEQ ID NO: 99832 - DNA, 601 bp, Human; identical to SEQ ID NO: 96640

SEQ ID NO: 99833 - DNA, 601 bp, Human; identical to SEQ ID NO: 96375

SEQ ID NO: 99834 - DNA, 601 bp, Human; identical to SEQ ID NO: 96376

SEQ ID NO: 99835 - DNA, 601 bp, Human; identical to SEQ ID NO: 96377

SEQ ID NO: 99836 - DNA, 601 bp, Human; identical to SEQ ID NO: 96378

SEQ ID NO: 99837 - DNA, 601 bp, Human; identical to SEQ ID NO: 96379

SEQ ID NO: 99838 - DNA, 601 bp, Human; identical to SEQ ID NO: 96380

SEQ ID NO: 99839 - DNA, 601 bp, Human; identical to SEQ ID NO: 96381

SEQ ID NO: 99840 - DNA, 601 bp, Human; identical to SEQ ID NO: 96382

SEQ ID NO: 99841 - DNA, 601 bp, Human; identical to SEQ ID NO: 96383

SEQ ID NO: 99842 - DNA, 601 bp, Human; identical to SEQ ID NO: 96384

SEQ ID NO: 99843 - DNA, 601 bp, Human; identical to SEQ ID NO: 96385

SEQ ID NO: 99844 - DNA, 601 bp, Human; identical to SEQ ID NO: 96386

SEQ ID NO: 99845 - DNA, 601 bp, Human; identical to SEQ ID NO: 96387

SEQ ID NO: 99846 - DNA, 601 bp, Human; identical to SEQ ID NO: 96388

SEQ ID NO: 99847 - DNA, 601 bp, Human; identical to SEQ ID NO: 96389

SEQ ID NO: 99848 - DNA, 601 bp, Human; identical to SEQ ID NO: 96390

SEQ ID NO: 99849 - DNA, 601 bp, Human; identical to SEQ ID NO: 96391

SEQ ID NO: 99850 - DNA, 601 bp, Human; identical to SEQ ID NO: 96392

SEQ ID NO: 99851 - DNA, 601 bp, Human; identical to SEQ ID NO: 96393

SEQ ID NO: 99852 - DNA, 601 bp, Human; identical to SEQ ID NO: 96394

SEQ ID NO: 99853 - DNA, 601 bp, Human; identical to SEQ ID NO: 96395

SEQ ID NO: 99854 - DNA, 601 bp, Human; identical to SEQ ID NO: 96396

SEQ ID NO: 99855 - DNA, 601 bp, Human; identical to SEQ ID NO: 96397

SEQ ID NO: 99856 - DNA, 601 bp, Human; identical to SEQ ID NO: 96398

SEQ ID NO: 99857 - DNA, 601 bp, Human; identical to SEQ ID NO: 96399

SEQ ID NO: 99858 - DNA, 601 bp, Human; identical to SEQ ID NO: 96400

SEQ ID NO: 99859 - DNA, 601 bp, Human; identical to SEQ ID NO: 96401

SEQ ID NO: 99860 - DNA, 601 bp, Human; identical to SEQ ID NO: 96402

SEQ ID NO: 99861 - DNA, 601 bp, Human; identical to SEQ ID NO: 96403

SEQ ID NO: 99862 - DNA, 601 bp, Human; identical to SEQ ID NO: 96404

SEQ ID NO: 99863 - DNA, 601 bp, Human; identical to SEQ ID NO: 96405

SEQ ID NO: 99864 - DNA, 601 bp, Human; identical to SEQ ID NO: 96406

SEQ ID NO: 99865 - DNA, 601 bp, Human; identical to SEQ ID NO: 96407

SEQ ID NO: 99866 - DNA, 601 bp, Human; identical to SEQ ID NO: 96408

SEQ ID NO: 99867 - DNA, 601 bp, Human; identical to SEQ ID NO: 96409

SEQ ID NO: 99868 - DNA, 601 bp, Human; identical to SEQ ID NO: 96410

SEQ ID NO: 99869 - DNA, 601 bp, Human; identical to SEQ ID NO: 96411

SEQ ID NO: 99870 - DNA, 601 bp, Human; identical to SEQ ID NO: 96412

SEQ ID NO: 99871 - DNA, 601 bp, Human; identical to SEQ ID NO: 96413

SEQ ID NO: 99872 - DNA, 601 bp, Human; identical to SEQ ID NO: 96414

SEQ ID NO: 99873 - DNA, 601 bp, Human; identical to SEQ ID NO: 96415

SEQ ID NO: 99874 - DNA, 601 bp, Human; identical to SEQ ID NO: 96416

SEQ ID NO: 99875 - DNA, 601 bp, Human; identical to SEQ ID NO: 96417

SEQ ID NO: 99876 - DNA, 601 bp, Human; identical to SEQ ID NO: 96418

SEQ ID NO: 99877 - DNA, 601 bp, Human; identical to SEQ ID NO: 96419

SEQ ID NO: 99878 - DNA, 601 bp, Human; identical to SEQ ID NO: 96420

SEQ ID NO: 99879 - DNA, 601 bp, Human; identical to SEQ ID NO: 96421

SEQ ID NO: 99880 - DNA, 601 bp, Human; identical to SEQ ID NO: 96422

SEQ ID NO: 99881 - DNA, 601 bp, Human; identical to SEQ ID NO: 96423

SEQ ID NO: 99882 - DNA, 601 bp, Human; identical to SEQ ID NO: 96424

SEQ ID NO: 99883 - DNA, 601 bp, Human; identical to SEQ ID NO: 96425

SEQ ID NO: 99884 - DNA, 601 bp, Human; identical to SEQ ID NO: 96426

SEQ ID NO: 99885 - DNA, 601 bp, Human; identical to SEQ ID NO: 96427

SEQ ID NO: 99886 - DNA, 601 bp, Human; identical to SEQ ID NO: 96428

SEQ ID NO: 99887 - DNA, 601 bp, Human; identical to SEQ ID NO: 96429

SEQ ID NO: 99888 - DNA, 601 bp, Human; identical to SEQ ID NO: 96430

SEQ ID NO: 99889 - DNA, 601 bp, Human; identical to SEQ ID NO: 96431

SEQ ID NO: 99890 - DNA, 601 bp, Human; identical to SEQ ID NO: 96432

SEQ ID NO: 99891 - DNA, 601 bp, Human; identical to SEQ ID NO: 96433

SEQ ID NO: 99892 - DNA, 601 bp, Human; identical to SEQ ID NO: 96434

SEQ ID NO: 99893 - DNA, 601 bp, Human; identical to SEQ ID NO: 96435

SEQ ID NO: 99894 - DNA, 601 bp, Human; identical to SEQ ID NO: 96436

SEQ ID NO: 99895 - DNA, 601 bp, Human; identical to SEQ ID NO: 96437

SEQ ID NO: 99896 - DNA, 601 bp, Human; identical to SEQ ID NO: 96438

SEQ ID NO: 99897 - DNA, 601 bp, Human; identical to SEQ ID NO: 96439

SEQ ID NO: 99898 - DNA, 601 bp, Human; identical to SEQ ID NO: 96440

SEQ ID NO: 99899 - DNA, 601 bp, Human; identical to SEQ ID NO: 96441

SEQ ID NO: 99900 - DNA, 601 bp, Human; identical to SEQ ID NO: 96442

SEQ ID NO: 99901 - DNA, 601 bp, Human; identical to SEQ ID NO: 96443

SEQ ID NO: 99902 - DNA, 601 bp, Human; identical to SEQ ID NO: 96444

SEQ ID NO: 99903 - DNA, 601 bp, Human; identical to SEQ ID NO: 96445

SEQ ID NO: 99904 - DNA, 601 bp, Human; identical to SEQ ID NO: 96446

SEQ ID NO: 99905 - DNA, 601 bp, Human; identical to SEQ ID NO: 96447

SEQ ID NO: 99906 - DNA, 601 bp, Human; identical to SEQ ID NO: 96448

SEQ ID NO: 99907 - DNA, 601 bp, Human; identical to SEQ ID NO: 96449

SEQ ID NO: 99908 - DNA, 601 bp, Human; identical to SEQ ID NO: 96450

SEQ ID NO: 99909 - DNA, 601 bp, Human; identical to SEQ ID NO: 96451

SEQ ID NO: 99910 - DNA, 601 bp, Human; identical to SEQ ID NO: 96452

SEQ ID NO: 99911 - DNA, 601 bp, Human; identical to SEQ ID NO: 96453

SEQ ID NO: 99912 - DNA, 601 bp, Human; identical to SEQ ID NO: 96454

SEQ ID NO: 99913 - DNA, 601 bp, Human; identical to SEQ ID NO: 96455

SEQ ID NO: 99914 - DNA, 601 bp, Human; identical to SEQ ID NO: 96456

SEQ ID NO: 99915 - DNA, 601 bp, Human; identical to SEQ ID NO: 96457

SEQ ID NO: 99916 - DNA, 601 bp, Human; identical to SEQ ID NO: 96458

SEQ ID NO: 99917 - DNA, 601 bp, Human; identical to SEQ ID NO: 96459

SEQ ID NO: 99918 - DNA, 601 bp, Human; identical to SEQ ID NO: 96460

SEQ ID NO: 99919 - DNA, 601 bp, Human; identical to SEQ ID NO: 96461

SEQ ID NO: 99920 - DNA, 601 bp, Human; identical to SEQ ID NO: 96462

SEQ ID NO: 99921 - DNA, 601 bp, Human; identical to SEQ ID NO: 96463

SEQ ID NO: 99922 - DNA, 601 bp, Human; identical to SEQ ID NO: 96464

SEQ ID NO: 99923 - DNA, 601 bp, Human; identical to SEQ ID NO: 96465

SEQ ID NO: 99924 - DNA, 601 bp, Human; identical to SEQ ID NO: 96466

SEQ ID NO: 99925 - DNA, 601 bp, Human; identical to SEQ ID NO: 96467

SEQ ID NO: 99926 - DNA, 601 bp, Human; identical to SEQ ID NO: 96468

SEQ ID NO: 99927 - DNA, 601 bp, Human; identical to SEQ ID NO: 96469

SEQ ID NO: 99928 - DNA, 601 bp, Human; identical to SEQ ID NO: 96470

SEQ ID NO: 99929 - DNA, 601 bp, Human; identical to SEQ ID NO: 96471

SEQ ID NO: 99930 - DNA, 601 bp, Human; identical to SEQ ID NO: 96472

SEQ ID NO: 99931 - DNA, 601 bp, Human; identical to SEQ ID NO: 96473

SEQ ID NO: 99932 - DNA, 601 bp, Human; identical to SEQ ID NO: 96474

SEQ ID NO: 99933 - DNA, 601 bp, Human; identical to SEQ ID NO: 96475

SEQ ID NO: 99934 - DNA, 601 bp, Human; identical to SEQ ID NO: 96476

SEQ ID NO: 99935 - DNA, 601 bp, Human; identical to SEQ ID NO: 96477

SEQ ID NO: 99936 - DNA, 601 bp, Human; identical to SEQ ID NO: 96478

SEQ ID NO: 99937 - DNA, 601 bp, Human; identical to SEQ ID NO: 96479

SEQ ID NO: 99938 - DNA, 601 bp, Human; identical to SEQ ID NO: 96480

SEQ ID NO: 99939 - DNA, 601 bp, Human; identical to SEQ ID NO: 96481

SEQ ID NO: 99940 - DNA, 601 bp, Human; identical to SEQ ID NO: 96482

SEQ ID NO: 99941 - DNA, 601 bp, Human; identical to SEQ ID NO: 96483

SEQ ID NO: 99942 - DNA, 601 bp, Human; identical to SEQ ID NO: 96484

SEQ ID NO: 99943 - DNA, 601 bp, Human; identical to SEQ ID NO: 96485

SEQ ID NO: 99944 - DNA, 601 bp, Human; identical to SEQ ID NO: 96486

SEQ ID NO: 99945 - DNA, 601 bp, Human; identical to SEQ ID NO: 96487

SEQ ID NO: 99946 - DNA, 601 bp, Human; identical to SEQ ID NO: 96488

SEQ ID NO: 99947 - DNA, 601 bp, Human; identical to SEQ ID NO: 96489

SEQ ID NO: 99948 - DNA, 601 bp, Human; identical to SEQ ID NO: 96490

SEQ ID NO: 99949 - DNA, 601 bp, Human; identical to SEQ ID NO: 96491

SEQ ID NO: 99950 - DNA, 601 bp, Human; identical to SEQ ID NO: 96492

SEQ ID NO: 99951 - DNA, 601 bp, Human; identical to SEQ ID NO: 96493

SEQ ID NO: 99952 - DNA, 601 bp, Human; identical to SEQ ID NO: 96494

SEQ ID NO: 99953 - DNA, 601 bp, Human; identical to SEQ ID NO: 96495

SEQ ID NO: 99954 - DNA, 601 bp, Human; identical to SEQ ID NO: 96496

SEQ ID NO: 99955 - DNA, 601 bp, Human; identical to SEQ ID NO: 96497

SEQ ID NO: 99956 - DNA, 601 bp, Human; identical to SEQ ID NO: 96498

SEQ ID NO: 99957 - DNA, 601 bp, Human; identical to SEQ ID NO: 96499

SEQ ID NO: 99958 - DNA, 601 bp, Human; identical to SEQ ID NO: 96500

SEQ ID NO: 99959 - DNA, 601 bp, Human; identical to SEQ ID NO: 96501

SEQ ID NO: 99960 - DNA, 601 bp, Human; identical to SEQ ID NO: 96502

SEQ ID NO: 99961 - DNA, 601 bp, Human; identical to SEQ ID NO: 96503

SEQ ID NO: 99962 - DNA, 601 bp, Human; identical to SEQ ID NO: 96504

SEQ ID NO: 99963 - DNA, 601 bp, Human; identical to SEQ ID NO: 96505

SEQ ID NO: 99964 - DNA, 601 bp, Human; identical to SEQ ID NO: 96506

SEQ ID NO: 99965 - DNA, 601 bp, Human; identical to SEQ ID NO: 96507

SEQ ID NO: 99966 - DNA, 601 bp, Human; identical to SEQ ID NO: 96508

SEQ ID NO: 99967 - DNA, 601 bp, Human; identical to SEQ ID NO: 96509

SEQ ID NO: 99968 - DNA, 601 bp, Human; identical to SEQ ID NO: 96510

SEQ ID NO: 99969 - DNA, 601 bp, Human; identical to SEQ ID NO: 96511

SEQ ID NO: 99970 - DNA, 601 bp, Human; identical to SEQ ID NO: 96512

SEQ ID NO: 99971 - DNA, 601 bp, Human; identical to SEQ ID NO: 96513

SEQ ID NO: 99972 - DNA, 601 bp, Human; identical to SEQ ID NO: 96514

SEQ ID NO: 99973 - DNA, 601 bp, Human; identical to SEQ ID NO: 96515

SEQ ID NO: 99974 - DNA, 601 bp, Human; identical to SEQ ID NO: 96516

SEQ ID NO: 99975 - DNA, 601 bp, Human; identical to SEQ ID NO: 96517

SEQ ID NO: 99976 - DNA, 601 bp, Human; identical to SEQ ID NO: 96518

SEQ ID NO: 99977 - DNA, 601 bp, Human; identical to SEQ ID NO: 96519

SEQ ID NO: 99978 - DNA, 601 bp, Human; identical to SEQ ID NO: 96520

SEQ ID NO: 99979 - DNA, 601 bp, Human; identical to SEQ ID NO: 96521

SEQ ID NO: 99980 - DNA, 601 bp, Human; identical to SEQ ID NO: 96522

SEQ ID NO: 99981 - DNA, 601 bp, Human; identical to SEQ ID NO: 96523

SEQ ID NO: 99982 - DNA, 601 bp, Human; identical to SEQ ID NO: 96524

SEQ ID NO: 99983 - DNA, 601 bp, Human; identical to SEQ ID NO: 96525

SEQ ID NO: 99984 - DNA, 601 bp, Human; identical to SEQ ID NO: 96526

SEQ ID NO: 99985 - DNA, 601 bp, Human; identical to SEQ ID NO: 96527

SEQ ID NO: 99986 - DNA, 601 bp, Human; identical to SEQ ID NO: 96528

SEQ ID NO: 99987 - DNA, 601 bp, Human; identical to SEQ ID NO: 96529

SEQ ID NO: 99988 - DNA, 601 bp, Human; identical to SEQ ID NO: 96530

SEQ ID NO: 99989 - DNA, 601 bp, Human; identical to SEQ ID NO: 96531

SEQ ID NO: 99990 - DNA, 601 bp, Human; identical to SEQ ID NO: 96532

SEQ ID NO: 99991 - DNA, 601 bp, Human; identical to SEQ ID NO: 96533

SEQ ID NO: 99992 - DNA, 601 bp, Human; identical to SEQ ID NO: 96534

SEQ ID NO: 99993 - DNA, 601 bp, Human; identical to SEQ ID NO: 96535

SEQ ID NO: 99994 - DNA, 601 bp, Human; identical to SEQ ID NO: 96536

SEQ ID NO: 99995 - DNA, 601 bp, Human; identical to SEQ ID NO: 96537

SEQ ID NO: 99996 - DNA, 601 bp, Human; identical to SEQ ID NO: 96538

SEQ ID NO: 99997 - DNA, 601 bp, Human; identical to SEQ ID NO: 96539

SEQ ID NO: 99998 - DNA, 601 bp, Human; identical to SEQ ID NO: 96540

SEQ ID NO: 99999 - DNA, 601 bp, Human; identical to SEQ ID NO: 96541

SEQ ID NO: 100000 - DNA, 601 bp, Human; identical to SEQ ID NO: 96542

SEQ ID NO: 100001 - DNA, 601 bp, Human; identical to SEQ ID NO: 96543

SEQ ID NO: 100002 - DNA, 601 bp, Human; identical to SEQ ID NO: 96544

SEQ ID NO: 100003 - DNA, 601 bp, Human; identical to SEQ ID NO: 96545

SEQ ID NO: 100004 - DNA, 601 bp, Human; identical to SEQ ID NO: 96546

SEQ ID NO: 100005 - DNA, 601 bp, Human; identical to SEQ ID NO: 96547

SEQ ID NO: 100006 - DNA, 601 bp, Human; identical to SEQ ID NO: 96548

SEQ ID NO: 100007 - DNA, 601 bp, Human; identical to SEQ ID NO: 96549

SEQ ID NO: 100008 - DNA, 601 bp, Human; identical to SEQ ID NO: 96550

SEQ ID NO: 100009 - DNA, 601 bp, Human; identical to SEQ ID NO: 96551

SEQ ID NO: 100010 - DNA, 601 bp, Human; identical to SEQ ID NO: 96552

SEQ ID NO: 100011 - DNA, 601 bp, Human; identical to SEQ ID NO: 96553

SEQ ID NO: 100012 - DNA, 601 bp, Human; identical to SEQ ID NO: 96554

SEQ ID NO: 100013 - DNA, 601 bp, Human; identical to SEQ ID NO: 96555

SEQ ID NO: 100014 - DNA, 601 bp, Human; identical to SEQ ID NO: 96556

SEQ ID NO: 100015 - DNA, 601 bp, Human; identical to SEQ ID NO: 96557

SEQ ID NO: 100016 - DNA, 601 bp, Human; identical to SEQ ID NO: 96558

SEQ ID NO: 100017 - DNA, 601 bp, Human; identical to SEQ ID NO: 96559

SEQ ID NO: 100018 - DNA, 601 bp, Human; identical to SEQ ID NO: 96560

SEQ ID NO: 100019 - DNA, 601 bp, Human; identical to SEQ ID NO: 96561

SEQ ID NO: 100020 - DNA, 601 bp, Human; identical to SEQ ID NO: 96562

SEQ ID NO: 100021 - DNA, 601 bp, Human; identical to SEQ ID NO: 96563

SEQ ID NO: 100022 - DNA, 601 bp, Human; identical to SEQ ID NO: 96564

SEQ ID NO: 100023 - DNA, 601 bp, Human; identical to SEQ ID NO: 96565

SEQ ID NO: 100024 - DNA, 601 bp, Human; identical to SEQ ID NO: 96566

SEQ ID NO: 100025 - DNA, 601 bp, Human; identical to SEQ ID NO: 96567

SEQ ID NO: 100026 - DNA, 601 bp, Human; identical to SEQ ID NO: 96568

SEQ ID NO: 100027 - DNA, 601 bp, Human; identical to SEQ ID NO: 96569

SEQ ID NO: 100028 - DNA, 601 bp, Human; identical to SEQ ID NO: 96570

SEQ ID NO: 100029 - DNA, 601 bp, Human; identical to SEQ ID NO: 96571

SEQ ID NO: 100030 - DNA, 601 bp, Human; identical to SEQ ID NO: 96572

SEQ ID NO: 100031 - DNA, 601 bp, Human; identical to SEQ ID NO: 96573

SEQ ID NO: 100032 - DNA, 601 bp, Human; identical to SEQ ID NO: 96574

SEQ ID NO: 100033 - DNA, 601 bp, Human; identical to SEQ ID NO: 96575

SEQ ID NO: 100034 - DNA, 601 bp, Human; identical to SEQ ID NO: 96576

SEQ ID NO: 100035 - DNA, 601 bp, Human; identical to SEQ ID NO: 96577

SEQ ID NO: 100036 - DNA, 601 bp, Human; identical to SEQ ID NO: 96578

SEQ ID NO: 100037 - DNA, 601 bp, Human; identical to SEQ ID NO: 96579

SEQ ID NO: 100038 - DNA, 601 bp, Human; identical to SEQ ID NO: 96580

SEQ ID NO: 100039 - DNA, 601 bp, Human; identical to SEQ ID NO: 96581

SEQ ID NO: 100040 - DNA, 601 bp, Human; identical to SEQ ID NO: 96582

SEQ ID NO: 100041 - DNA, 601 bp, Human; identical to SEQ ID NO: 96583

SEQ ID NO: 100042 - DNA, 601 bp, Human; identical to SEQ ID NO: 96584

SEQ ID NO: 100043 - DNA, 417 bp, Human; identical to SEQ ID NO: 96585

SEQ ID NO: 100044 - DNA, 480 bp, Human; identical to SEQ ID NO: 96586

SEQ ID NO: 100045 - DNA, 601 bp, Human; identical to SEQ ID NO: 96587

SEQ ID NO: 100046 - DNA, 601 bp, Human; identical to SEQ ID NO: 96588

SEQ ID NO: 100047 - DNA, 601 bp, Human; identical to SEQ ID NO: 96589

SEQ ID NO: 100048 - DNA, 601 bp, Human; identical to SEQ ID NO: 96590

SEQ ID NO: 100049 - DNA, 601 bp, Human; identical to SEQ ID NO: 96591

SEQ ID NO: 100050 - DNA, 601 bp, Human; identical to SEQ ID NO: 96592

SEQ ID NO: 100051 - DNA, 601 bp, Human; identical to SEQ ID NO: 96593

SEQ ID NO: 100052 - DNA, 601 bp, Human; identical to SEQ ID NO: 96594

SEQ ID NO: 100053 - DNA, 601 bp, Human; identical to SEQ ID NO: 96595

SEQ ID NO: 100054 - DNA, 601 bp, Human; identical to SEQ ID NO: 96596

SEQ ID NO: 100055 - DNA, 601 bp, Human; identical to SEQ ID NO: 96597

SEQ ID NO: 100056 - DNA, 601 bp, Human; identical to SEQ ID NO: 96598

SEQ ID NO: 100057 - DNA, 601 bp, Human; identical to SEQ ID NO: 96599

SEQ ID NO: 100058 - DNA, 601 bp, Human; identical to SEQ ID NO: 96600

SEQ ID NO: 100059 - DNA, 601 bp, Human; identical to SEQ ID NO: 96601

SEQ ID NO: 100060 - DNA, 601 bp, Human; identical to SEQ ID NO: 96602

SEQ ID NO: 100061 - DNA, 601 bp, Human; identical to SEQ ID NO: 96603

SEQ ID NO: 100062 - DNA, 601 bp, Human; identical to SEQ ID NO: 96604

SEQ ID NO: 100063 - DNA, 601 bp, Human; identical to SEQ ID NO: 96605

SEQ ID NO: 100064 - DNA, 601 bp, Human; identical to SEQ ID NO: 96606

SEQ ID NO: 100065 - DNA, 601 bp, Human; identical to SEQ ID NO: 96607

SEQ ID NO: 100066 - DNA, 601 bp, Human; identical to SEQ ID NO: 96608

SEQ ID NO: 100067 - DNA, 601 bp, Human; identical to SEQ ID NO: 96609

SEQ ID NO: 100068 - DNA, 601 bp, Human; identical to SEQ ID NO: 96610

SEQ ID NO: 100069 - DNA, 601 bp, Human; identical to SEQ ID NO: 96611

SEQ ID NO: 100070 - DNA, 601 bp, Human; identical to SEQ ID NO: 96612

SEQ ID NO: 100071 - DNA, 601 bp, Human; identical to SEQ ID NO: 96613

SEQ ID NO: 100072 - DNA, 601 bp, Human; identical to SEQ ID NO: 96614

SEQ ID NO: 100073 - DNA, 601 bp, Human; identical to SEQ ID NO: 96615

SEQ ID NO: 100074 - DNA, 601 bp, Human; identical to SEQ ID NO: 96616

SEQ ID NO: 100075 - DNA, 601 bp, Human; identical to SEQ ID NO: 96617

SEQ ID NO: 100076 - DNA, 601 bp, Human; identical to SEQ ID NO: 96618

SEQ ID NO: 100077 - DNA, 601 bp, Human; identical to SEQ ID NO: 96619

SEQ ID NO: 100078 - DNA, 601 bp, Human; identical to SEQ ID NO: 96620

SEQ ID NO: 100079 - DNA, 601 bp, Human; identical to SEQ ID NO: 96621

SEQ ID NO: 100080 - DNA, 601 bp, Human; identical to SEQ ID NO: 96622

SEQ ID NO: 100081 - DNA, 601 bp, Human; identical to SEQ ID NO: 96623

SEQ ID NO: 100082 - DNA, 601 bp, Human; identical to SEQ ID NO: 96624

SEQ ID NO: 100083 - DNA, 601 bp, Human; identical to SEQ ID NO: 96625

SEQ ID NO: 100084 - DNA, 601 bp, Human; identical to SEQ ID NO: 96626

SEQ ID NO: 100085 - DNA, 601 bp, Human; identical to SEQ ID NO: 96627

SEQ ID NO: 100086 - DNA, 601 bp, Human; identical to SEQ ID NO: 96628

SEQ ID NO: 100087 - DNA, 601 bp, Human; identical to SEQ ID NO: 96629

SEQ ID NO: 100088 - DNA, 601 bp, Human; identical to SEQ ID NO: 96630

SEQ ID NO: 100089 - DNA, 601 bp, Human; identical to SEQ ID NO: 96631

SEQ ID NO: 100090 - DNA, 601 bp, Human; identical to SEQ ID NO: 96632

SEQ ID NO: 100091 - DNA, 601 bp, Human; identical to SEQ ID NO: 96633

SEQ ID NO: 100092 - DNA, 601 bp, Human; identical to SEQ ID NO: 96634

SEQ ID NO: 100093 - DNA, 601 bp, Human; identical to SEQ ID NO: 96635

SEQ ID NO: 100094 - DNA, 601 bp, Human; identical to SEQ ID NO: 96636

SEQ ID NO: 100095 - DNA, 601 bp, Human; identical to SEQ ID NO: 96637

SEQ ID NO: 100096 - DNA, 601 bp, Human; identical to SEQ ID NO: 96638

SEQ ID NO: 100097 - DNA, 601 bp, Human; identical to SEQ ID NO: 96639

SEQ ID NO: 100098 - DNA, 601 bp, Human; identical to SEQ ID NO: 96640

SEQ ID NO: 100099 - DNA, 601 bp, Human; identical to SEQ ID NO: 96375

SEQ ID NO: 100100 - DNA, 601 bp, Human; identical to SEQ ID NO: 96376

SEQ ID NO: 100101 - DNA, 601 bp, Human; identical to SEQ ID NO: 96377

SEQ ID NO: 100102 - DNA, 601 bp, Human; identical to SEQ ID NO: 96378

SEQ ID NO: 100103 - DNA, 601 bp, Human; identical to SEQ ID NO: 96379

SEQ ID NO: 100104 - DNA, 601 bp, Human; identical to SEQ ID NO: 96380

SEQ ID NO: 100105 - DNA, 601 bp, Human; identical to SEQ ID NO: 96381

SEQ ID NO: 100106 - DNA, 601 bp, Human; identical to SEQ ID NO: 96382

SEQ ID NO: 100107 - DNA, 601 bp, Human; identical to SEQ ID NO: 96383

SEQ ID NO: 100108 - DNA, 601 bp, Human; identical to SEQ ID NO: 96384

SEQ ID NO: 100109 - DNA, 601 bp, Human; identical to SEQ ID NO: 96385

SEQ ID NO: 100110 - DNA, 601 bp, Human; identical to SEQ ID NO: 96386

SEQ ID NO: 100111 - DNA, 601 bp, Human; identical to SEQ ID NO: 96387

SEQ ID NO: 100112 - DNA, 601 bp, Human; identical to SEQ ID NO: 96388

SEQ ID NO: 100113 - DNA, 601 bp, Human; identical to SEQ ID NO: 96389

SEQ ID NO: 100114 - DNA, 601 bp, Human; identical to SEQ ID NO: 96390

SEQ ID NO: 100115 - DNA, 601 bp, Human; identical to SEQ ID NO: 96391

SEQ ID NO: 100116 - DNA, 601 bp, Human; identical to SEQ ID NO: 96392

SEQ ID NO: 100117 - DNA, 601 bp, Human; identical to SEQ ID NO: 96393

SEQ ID NO: 100118 - DNA, 601 bp, Human; identical to SEQ ID NO: 96394

SEQ ID NO: 100119 - DNA, 601 bp, Human; identical to SEQ ID NO: 96395

SEQ ID NO: 100120 - DNA, 601 bp, Human; identical to SEQ ID NO: 96396

SEQ ID NO: 100121 - DNA, 601 bp, Human; identical to SEQ ID NO: 96397

SEQ ID NO: 100122 - DNA, 601 bp, Human; identical to SEQ ID NO: 96398

SEQ ID NO: 100123 - DNA, 601 bp, Human; identical to SEQ ID NO: 96399

SEQ ID NO: 100124 - DNA, 601 bp, Human; identical to SEQ ID NO: 96400

SEQ ID NO: 100125 - DNA, 601 bp, Human; identical to SEQ ID NO: 96401

SEQ ID NO: 100126 - DNA, 601 bp, Human; identical to SEQ ID NO: 96402

SEQ ID NO: 100127 - DNA, 601 bp, Human; identical to SEQ ID NO: 96403

SEQ ID NO: 100128 - DNA, 601 bp, Human; identical to SEQ ID NO: 96404

SEQ ID NO: 100129 - DNA, 601 bp, Human; identical to SEQ ID NO: 96405

SEQ ID NO: 100130 - DNA, 601 bp, Human; identical to SEQ ID NO: 96406

SEQ ID NO: 100131 - DNA, 601 bp, Human; identical to SEQ ID NO: 96407

SEQ ID NO: 100132 - DNA, 601 bp, Human; identical to SEQ ID NO: 96408

SEQ ID NO: 100133 - DNA, 601 bp, Human; identical to SEQ ID NO: 96409

SEQ ID NO: 100134 - DNA, 601 bp, Human; identical to SEQ ID NO: 96410

SEQ ID NO: 100135 - DNA, 601 bp, Human; identical to SEQ ID NO: 96411

SEQ ID NO: 100136 - DNA, 601 bp, Human; identical to SEQ ID NO: 96412

SEQ ID NO: 100137 - DNA, 601 bp, Human; identical to SEQ ID NO: 96413

SEQ ID NO: 100138 - DNA, 601 bp, Human; identical to SEQ ID NO: 96414

SEQ ID NO: 100139 - DNA, 601 bp, Human; identical to SEQ ID NO: 96415

SEQ ID NO: 100140 - DNA, 601 bp, Human; identical to SEQ ID NO: 96416

SEQ ID NO: 100141 - DNA, 601 bp, Human; identical to SEQ ID NO: 96417

SEQ ID NO: 100142 - DNA, 601 bp, Human; identical to SEQ ID NO: 96418

SEQ ID NO: 100143 - DNA, 601 bp, Human; identical to SEQ ID NO: 96419

SEQ ID NO: 100144 - DNA, 601 bp, Human; identical to SEQ ID NO: 96420

SEQ ID NO: 100145 - DNA, 601 bp, Human; identical to SEQ ID NO: 96421

SEQ ID NO: 100146 - DNA, 601 bp, Human; identical to SEQ ID NO: 96422

SEQ ID NO: 100147 - DNA, 601 bp, Human; identical to SEQ ID NO: 96423

SEQ ID NO: 100148 - DNA, 601 bp, Human; identical to SEQ ID NO: 96424

SEQ ID NO: 100149 - DNA, 601 bp, Human; identical to SEQ ID NO: 96425

SEQ ID NO: 100150 - DNA, 601 bp, Human; identical to SEQ ID NO: 96426

SEQ ID NO: 100151 - DNA, 601 bp, Human; identical to SEQ ID NO: 96427

SEQ ID NO: 100152 - DNA, 601 bp, Human; identical to SEQ ID NO: 96428

SEQ ID NO: 100153 - DNA, 601 bp, Human; identical to SEQ ID NO: 96429

SEQ ID NO: 100154 - DNA, 601 bp, Human; identical to SEQ ID NO: 96430

SEQ ID NO: 100155 - DNA, 601 bp, Human; identical to SEQ ID NO: 96431

SEQ ID NO: 100156 - DNA, 601 bp, Human; identical to SEQ ID NO: 96432

SEQ ID NO: 100157 - DNA, 601 bp, Human; identical to SEQ ID NO: 96433

SEQ ID NO: 100158 - DNA, 601 bp, Human; identical to SEQ ID NO: 96434

SEQ ID NO: 100159 - DNA, 601 bp, Human; identical to SEQ ID NO: 96435

SEQ ID NO: 100160 - DNA, 601 bp, Human; identical to SEQ ID NO: 96436

SEQ ID NO: 100161 - DNA, 601 bp, Human; identical to SEQ ID NO: 96437

SEQ ID NO: 100162 - DNA, 601 bp, Human; identical to SEQ ID NO: 96438

SEQ ID NO: 100163 - DNA, 601 bp, Human; identical to SEQ ID NO: 96439

SEQ ID NO: 100164 - DNA, 601 bp, Human; identical to SEQ ID NO: 96440

SEQ ID NO: 100165 - DNA, 601 bp, Human; identical to SEQ ID NO: 96441

SEQ ID NO: 100166 - DNA, 601 bp, Human; identical to SEQ ID NO: 96442

SEQ ID NO: 100167 - DNA, 601 bp, Human; identical to SEQ ID NO: 96443

SEQ ID NO: 100168 - DNA, 601 bp, Human; identical to SEQ ID NO: 96444

SEQ ID NO: 100169 - DNA, 601 bp, Human; identical to SEQ ID NO: 96445

SEQ ID NO: 100170 - DNA, 601 bp, Human; identical to SEQ ID NO: 96446

SEQ ID NO: 100171 - DNA, 601 bp, Human; identical to SEQ ID NO: 96447

SEQ ID NO: 100172 - DNA, 601 bp, Human; identical to SEQ ID NO: 96448

SEQ ID NO: 100173 - DNA, 601 bp, Human; identical to SEQ ID NO: 96449

SEQ ID NO: 100174 - DNA, 601 bp, Human; identical to SEQ ID NO: 96450

SEQ ID NO: 100175 - DNA, 601 bp, Human; identical to SEQ ID NO: 96451

SEQ ID NO: 100176 - DNA, 601 bp, Human; identical to SEQ ID NO: 96452

SEQ ID NO: 100177 - DNA, 601 bp, Human; identical to SEQ ID NO: 96453

SEQ ID NO: 100178 - DNA, 601 bp, Human; identical to SEQ ID NO: 96454

SEQ ID NO: 100179 - DNA, 601 bp, Human; identical to SEQ ID NO: 96455

SEQ ID NO: 100180 - DNA, 601 bp, Human; identical to SEQ ID NO: 96456

SEQ ID NO: 100181 - DNA, 601 bp, Human; identical to SEQ ID NO: 96457

SEQ ID NO: 100182 - DNA, 601 bp, Human; identical to SEQ ID NO: 96458

SEQ ID NO: 100183 - DNA, 601 bp, Human; identical to SEQ ID NO: 96459

SEQ ID NO: 100184 - DNA, 601 bp, Human; identical to SEQ ID NO: 96460

SEQ ID NO: 100185 - DNA, 601 bp, Human; identical to SEQ ID NO: 96461

SEQ ID NO: 100186 - DNA, 601 bp, Human; identical to SEQ ID NO: 96462

SEQ ID NO: 100187 - DNA, 601 bp, Human; identical to SEQ ID NO: 96463

SEQ ID NO: 100188 - DNA, 601 bp, Human; identical to SEQ ID NO: 96464

SEQ ID NO: 100189 - DNA, 601 bp, Human; identical to SEQ ID NO: 96465

SEQ ID NO: 100190 - DNA, 601 bp, Human; identical to SEQ ID NO: 96466

SEQ ID NO: 100191 - DNA, 601 bp, Human; identical to SEQ ID NO: 96467

SEQ ID NO: 100192 - DNA, 601 bp, Human; identical to SEQ ID NO: 96468

SEQ ID NO: 100193 - DNA, 601 bp, Human; identical to SEQ ID NO: 96469

SEQ ID NO: 100194 - DNA, 601 bp, Human; identical to SEQ ID NO: 96470

SEQ ID NO: 100195 - DNA, 601 bp, Human; identical to SEQ ID NO: 96471

SEQ ID NO: 100196 - DNA, 601 bp, Human; identical to SEQ ID NO: 96472

SEQ ID NO: 100197 - DNA, 601 bp, Human; identical to SEQ ID NO: 96473

SEQ ID NO: 100198 - DNA, 601 bp, Human; identical to SEQ ID NO: 96474

SEQ ID NO: 100199 - DNA, 601 bp, Human; identical to SEQ ID NO: 96475

SEQ ID NO: 100200 - DNA, 601 bp, Human; identical to SEQ ID NO: 96476

SEQ ID NO: 100201 - DNA, 601 bp, Human; identical to SEQ ID NO: 96477

SEQ ID NO: 100202 - DNA, 601 bp, Human; identical to SEQ ID NO: 96478

SEQ ID NO: 100203 - DNA, 601 bp, Human; identical to SEQ ID NO: 96479

SEQ ID NO: 100204 - DNA, 601 bp, Human; identical to SEQ ID NO: 96480

SEQ ID NO: 100205 - DNA, 601 bp, Human; identical to SEQ ID NO: 96481

SEQ ID NO: 100206 - DNA, 601 bp, Human; identical to SEQ ID NO: 96482

SEQ ID NO: 100207 - DNA, 601 bp, Human; identical to SEQ ID NO: 96483

SEQ ID NO: 100208 - DNA, 601 bp, Human; identical to SEQ ID NO: 96484

SEQ ID NO: 100209 - DNA, 601 bp, Human; identical to SEQ ID NO: 96485

SEQ ID NO: 100210 - DNA, 601 bp, Human; identical to SEQ ID NO: 96486

SEQ ID NO: 100211 - DNA, 601 bp, Human; identical to SEQ ID NO: 96487

SEQ ID NO: 100212 - DNA, 601 bp, Human; identical to SEQ ID NO: 96488

SEQ ID NO: 100213 - DNA, 601 bp, Human; identical to SEQ ID NO: 96489

SEQ ID NO: 100214 - DNA, 601 bp, Human; identical to SEQ ID NO: 96490

SEQ ID NO: 100215 - DNA, 601 bp, Human; identical to SEQ ID NO: 96491

SEQ ID NO: 100216 - DNA, 601 bp, Human; identical to SEQ ID NO: 96492

SEQ ID NO: 100217 - DNA, 601 bp, Human; identical to SEQ ID NO: 96493

SEQ ID NO: 100218 - DNA, 601 bp, Human; identical to SEQ ID NO: 96494

SEQ ID NO: 100219 - DNA, 601 bp, Human; identical to SEQ ID NO: 96495

SEQ ID NO: 100220 - DNA, 601 bp, Human; identical to SEQ ID NO: 96496

SEQ ID NO: 100221 - DNA, 601 bp, Human; identical to SEQ ID NO: 96497

SEQ ID NO: 100222 - DNA, 601 bp, Human; identical to SEQ ID NO: 96498

SEQ ID NO: 100223 - DNA, 601 bp, Human; identical to SEQ ID NO: 96499

SEQ ID NO: 100224 - DNA, 601 bp, Human; identical to SEQ ID NO: 96500

SEQ ID NO: 100225 - DNA, 601 bp, Human; identical to SEQ ID NO: 96501

SEQ ID NO: 100226 - DNA, 601 bp, Human; identical to SEQ ID NO: 96502

SEQ ID NO: 100227 - DNA, 601 bp, Human; identical to SEQ ID NO: 96503

SEQ ID NO: 100228 - DNA, 601 bp, Human; identical to SEQ ID NO: 96504

SEQ ID NO: 100229 - DNA, 601 bp, Human; identical to SEQ ID NO: 96505

SEQ ID NO: 100230 - DNA, 601 bp, Human; identical to SEQ ID NO: 96506

SEQ ID NO: 100231 - DNA, 601 bp, Human; identical to SEQ ID NO: 96507

SEQ ID NO: 100232 - DNA, 601 bp, Human; identical to SEQ ID NO: 96508

SEQ ID NO: 100233 - DNA, 601 bp, Human; identical to SEQ ID NO: 96509

SEQ ID NO: 100234 - DNA, 601 bp, Human; identical to SEQ ID NO: 96510

SEQ ID NO: 100235 - DNA, 601 bp, Human; identical to SEQ ID NO: 96511

SEQ ID NO: 100236 - DNA, 601 bp, Human; identical to SEQ ID NO: 96512

SEQ ID NO: 100237 - DNA, 601 bp, Human; identical to SEQ ID NO: 96513

SEQ ID NO: 100238 - DNA, 601 bp, Human; identical to SEQ ID NO: 96514

SEQ ID NO: 100239 - DNA, 601 bp, Human; identical to SEQ ID NO: 96515

SEQ ID NO: 100240 - DNA, 601 bp, Human; identical to SEQ ID NO: 96516

SEQ ID NO: 100241 - DNA, 601 bp, Human; identical to SEQ ID NO: 96517

SEQ ID NO: 100242 - DNA, 601 bp, Human; identical to SEQ ID NO: 96518

SEQ ID NO: 100243 - DNA, 601 bp, Human; identical to SEQ ID NO: 96519

SEQ ID NO: 100244 - DNA, 601 bp, Human; identical to SEQ ID NO: 96520

SEQ ID NO: 100245 - DNA, 601 bp, Human; identical to SEQ ID NO: 96521

SEQ ID NO: 100246 - DNA, 601 bp, Human; identical to SEQ ID NO: 96522

SEQ ID NO: 100247 - DNA, 601 bp, Human; identical to SEQ ID NO: 96523

SEQ ID NO: 100248 - DNA, 601 bp, Human; identical to SEQ ID NO: 96524

SEQ ID NO: 100249 - DNA, 601 bp, Human; identical to SEQ ID NO: 96525

SEQ ID NO: 100250 - DNA, 601 bp, Human; identical to SEQ ID NO: 96526

SEQ ID NO: 100251 - DNA, 601 bp, Human; identical to SEQ ID NO: 96527

SEQ ID NO: 100252 - DNA, 601 bp, Human; identical to SEQ ID NO: 96528

SEQ ID NO: 100253 - DNA, 601 bp, Human; identical to SEQ ID NO: 96529

SEQ ID NO: 100254 - DNA, 601 bp, Human; identical to SEQ ID NO: 96530

SEQ ID NO: 100255 - DNA, 601 bp, Human; identical to SEQ ID NO: 96531

SEQ ID NO: 100256 - DNA, 601 bp, Human; identical to SEQ ID NO: 96532

SEQ ID NO: 100257 - DNA, 601 bp, Human; identical to SEQ ID NO: 96533

SEQ ID NO: 100258 - DNA, 601 bp, Human; identical to SEQ ID NO: 96534

SEQ ID NO: 100259 - DNA, 601 bp, Human; identical to SEQ ID NO: 96535

SEQ ID NO: 100260 - DNA, 601 bp, Human; identical to SEQ ID NO: 96536

SEQ ID NO: 100261 - DNA, 601 bp, Human; identical to SEQ ID NO: 96537

SEQ ID NO: 100262 - DNA, 601 bp, Human; identical to SEQ ID NO: 96538

SEQ ID NO: 100263 - DNA, 601 bp, Human; identical to SEQ ID NO: 96539

SEQ ID NO: 100264 - DNA, 601 bp, Human; identical to SEQ ID NO: 96540

SEQ ID NO: 100265 - DNA, 601 bp, Human; identical to SEQ ID NO: 96541

SEQ ID NO: 100266 - DNA, 601 bp, Human; identical to SEQ ID NO: 96542

SEQ ID NO: 100267 - DNA, 601 bp, Human; identical to SEQ ID NO: 96543

SEQ ID NO: 100268 - DNA, 601 bp, Human; identical to SEQ ID NO: 96544

SEQ ID NO: 100269 - DNA, 601 bp, Human; identical to SEQ ID NO: 96545

SEQ ID NO: 100270 - DNA, 601 bp, Human; identical to SEQ ID NO: 96546

SEQ ID NO: 100271 - DNA, 601 bp, Human; identical to SEQ ID NO: 96547

SEQ ID NO: 100272 - DNA, 601 bp, Human; identical to SEQ ID NO: 96548

SEQ ID NO: 100273 - DNA, 601 bp, Human; identical to SEQ ID NO: 96549

SEQ ID NO: 100274 - DNA, 601 bp, Human; identical to SEQ ID NO: 96550

SEQ ID NO: 100275 - DNA, 601 bp, Human; identical to SEQ ID NO: 96551

SEQ ID NO: 100276 - DNA, 601 bp, Human; identical to SEQ ID NO: 96552

SEQ ID NO: 100277 - DNA, 601 bp, Human; identical to SEQ ID NO: 96553

SEQ ID NO: 100278 - DNA, 601 bp, Human; identical to SEQ ID NO: 96554

SEQ ID NO: 100279 - DNA, 601 bp, Human; identical to SEQ ID NO: 96555

SEQ ID NO: 100280 - DNA, 601 bp, Human; identical to SEQ ID NO: 96556

SEQ ID NO: 100281 - DNA, 601 bp, Human; identical to SEQ ID NO: 96557

SEQ ID NO: 100282 - DNA, 601 bp, Human; identical to SEQ ID NO: 96558

SEQ ID NO: 100283 - DNA, 601 bp, Human; identical to SEQ ID NO: 96559

SEQ ID NO: 100284 - DNA, 601 bp, Human; identical to SEQ ID NO: 96560

SEQ ID NO: 100285 - DNA, 601 bp, Human; identical to SEQ ID NO: 96561

SEQ ID NO: 100286 - DNA, 601 bp, Human; identical to SEQ ID NO: 96562

SEQ ID NO: 100287 - DNA, 601 bp, Human; identical to SEQ ID NO: 96563

SEQ ID NO: 100288 - DNA, 601 bp, Human; identical to SEQ ID NO: 96564

SEQ ID NO: 100289 - DNA, 601 bp, Human; identical to SEQ ID NO: 96565

SEQ ID NO: 100290 - DNA, 601 bp, Human; identical to SEQ ID NO: 96566

SEQ ID NO: 100291 - DNA, 601 bp, Human; identical to SEQ ID NO: 96567

SEQ ID NO: 100292 - DNA, 601 bp, Human; identical to SEQ ID NO: 96568

SEQ ID NO: 100293 - DNA, 601 bp, Human; identical to SEQ ID NO: 96569

SEQ ID NO: 100294 - DNA, 601 bp, Human; identical to SEQ ID NO: 96570

SEQ ID NO: 100295 - DNA, 601 bp, Human; identical to SEQ ID NO: 96571

SEQ ID NO: 100296 - DNA, 601 bp, Human; identical to SEQ ID NO: 96572

SEQ ID NO: 100297 - DNA, 601 bp, Human; identical to SEQ ID NO: 96573

SEQ ID NO: 100298 - DNA, 601 bp, Human; identical to SEQ ID NO: 96574

SEQ ID NO: 100299 - DNA, 601 bp, Human; identical to SEQ ID NO: 96575

SEQ ID NO: 100300 - DNA, 601 bp, Human; identical to SEQ ID NO: 96576

SEQ ID NO: 100301 - DNA, 601 bp, Human; identical to SEQ ID NO: 96577

SEQ ID NO: 100302 - DNA, 601 bp, Human; identical to SEQ ID NO: 96578

SEQ ID NO: 100303 - DNA, 601 bp, Human; identical to SEQ ID NO: 96579

SEQ ID NO: 100304 - DNA, 601 bp, Human; identical to SEQ ID NO: 96580

SEQ ID NO: 100305 - DNA, 601 bp, Human; identical to SEQ ID NO: 96581

SEQ ID NO: 100306 - DNA, 601 bp, Human; identical to SEQ ID NO: 96582

SEQ ID NO: 100307 - DNA, 601 bp, Human; identical to SEQ ID NO: 96583

SEQ ID NO: 100308 - DNA, 601 bp, Human; identical to SEQ ID NO: 96584

SEQ ID NO: 100309 - DNA, 417 bp, Human; identical to SEQ ID NO: 96585

SEQ ID NO: 100310 - DNA, 480 bp, Human; identical to SEQ ID NO: 96586

SEQ ID NO: 100311 - DNA, 601 bp, Human; identical to SEQ ID NO: 96587

SEQ ID NO: 100312 - DNA, 601 bp, Human; identical to SEQ ID NO: 96588

SEQ ID NO: 100313 - DNA, 601 bp, Human; identical to SEQ ID NO: 96589

SEQ ID NO: 100314 - DNA, 601 bp, Human; identical to SEQ ID NO: 96590

SEQ ID NO: 100315 - DNA, 601 bp, Human; identical to SEQ ID NO: 96591

SEQ ID NO: 100316 - DNA, 601 bp, Human; identical to SEQ ID NO: 96592

SEQ ID NO: 100317 - DNA, 601 bp, Human; identical to SEQ ID NO: 96593

SEQ ID NO: 100318 - DNA, 601 bp, Human; identical to SEQ ID NO: 96594

SEQ ID NO: 100319 - DNA, 601 bp, Human; identical to SEQ ID NO: 96595

SEQ ID NO: 100320 - DNA, 601 bp, Human; identical to SEQ ID NO: 96596

SEQ ID NO: 100321 - DNA, 601 bp, Human; identical to SEQ ID NO: 96597

SEQ ID NO: 100322 - DNA, 601 bp, Human; identical to SEQ ID NO: 96598

SEQ ID NO: 100323 - DNA, 601 bp, Human; identical to SEQ ID NO: 96599

SEQ ID NO: 100324 - DNA, 601 bp, Human; identical to SEQ ID NO: 96600

SEQ ID NO: 100325 - DNA, 601 bp, Human; identical to SEQ ID NO: 96601

SEQ ID NO: 100326 - DNA, 601 bp, Human; identical to SEQ ID NO: 96602

SEQ ID NO: 100327 - DNA, 601 bp, Human; identical to SEQ ID NO: 96603

SEQ ID NO: 100328 - DNA, 601 bp, Human; identical to SEQ ID NO: 96604

SEQ ID NO: 100329 - DNA, 601 bp, Human; identical to SEQ ID NO: 96605

SEQ ID NO: 100330 - DNA, 601 bp, Human; identical to SEQ ID NO: 96606

SEQ ID NO: 100331 - DNA, 601 bp, Human; identical to SEQ ID NO: 96607

SEQ ID NO: 100332 - DNA, 601 bp, Human; identical to SEQ ID NO: 96608

SEQ ID NO: 100333 - DNA, 601 bp, Human; identical to SEQ ID NO: 96609

SEQ ID NO: 100334 - DNA, 601 bp, Human; identical to SEQ ID NO: 96610

SEQ ID NO: 100335 - DNA, 601 bp, Human; identical to SEQ ID NO: 96611

SEQ ID NO: 100336 - DNA, 601 bp, Human; identical to SEQ ID NO: 96612

SEQ ID NO: 100337 - DNA, 601 bp, Human; identical to SEQ ID NO: 96613

SEQ ID NO: 100338 - DNA, 601 bp, Human; identical to SEQ ID NO: 96614

SEQ ID NO: 100339 - DNA, 601 bp, Human; identical to SEQ ID NO: 96615

SEQ ID NO: 100340 - DNA, 601 bp, Human; identical to SEQ ID NO: 96616

SEQ ID NO: 100341 - DNA, 601 bp, Human; identical to SEQ ID NO: 96617

SEQ ID NO: 100342 - DNA, 601 bp, Human; identical to SEQ ID NO: 96618

SEQ ID NO: 100343 - DNA, 601 bp, Human; identical to SEQ ID NO: 96619

SEQ ID NO: 100344 - DNA, 601 bp, Human; identical to SEQ ID NO: 96620

SEQ ID NO: 100345 - DNA, 601 bp, Human; identical to SEQ ID NO: 96621

SEQ ID NO: 100346 - DNA, 601 bp, Human; identical to SEQ ID NO: 96622

SEQ ID NO: 100347 - DNA, 601 bp, Human; identical to SEQ ID NO: 96623

SEQ ID NO: 100348 - DNA, 601 bp, Human; identical to SEQ ID NO: 96624

SEQ ID NO: 100349 - DNA, 601 bp, Human; identical to SEQ ID NO: 96625

SEQ ID NO: 100350 - DNA, 601 bp, Human; identical to SEQ ID NO: 96626

SEQ ID NO: 100351 - DNA, 601 bp, Human; identical to SEQ ID NO: 96627

SEQ ID NO: 100352 - DNA, 601 bp, Human; identical to SEQ ID NO: 96628

SEQ ID NO: 100353 - DNA, 601 bp, Human; identical to SEQ ID NO: 96629

SEQ ID NO: 100354 - DNA, 601 bp, Human; identical to SEQ ID NO: 96630

SEQ ID NO: 100355 - DNA, 601 bp, Human; identical to SEQ ID NO: 96631

SEQ ID NO: 100356 - DNA, 601 bp, Human; identical to SEQ ID NO: 96632

SEQ ID NO: 100357 - DNA, 601 bp, Human; identical to SEQ ID NO: 96633

SEQ ID NO: 100358 - DNA, 601 bp, Human; identical to SEQ ID NO: 96634

SEQ ID NO: 100359 - DNA, 601 bp, Human; identical to SEQ ID NO: 96635

SEQ ID NO: 100360 - DNA, 601 bp, Human; identical to SEQ ID NO: 96636

SEQ ID NO: 100361 - DNA, 601 bp, Human; identical to SEQ ID NO: 96637

SEQ ID NO: 100362 - DNA, 601 bp, Human; identical to SEQ ID NO: 96638

SEQ ID NO: 100363 - DNA, 601 bp, Human; identical to SEQ ID NO: 96639

SEQ ID NO: 100364 - DNA, 601 bp, Human; identical to SEQ ID NO: 96640

SEQ ID NO: 100365 - DNA, 601 bp, Human; identical to SEQ ID NO: 96375

SEQ ID NO: 100366 - DNA, 601 bp, Human; identical to SEQ ID NO: 96376

SEQ ID NO: 100367 - DNA, 601 bp, Human; identical to SEQ ID NO: 96377

SEQ ID NO: 100368 - DNA, 601 bp, Human; identical to SEQ ID NO: 96378

SEQ ID NO: 100369 - DNA, 601 bp, Human; identical to SEQ ID NO: 96379

SEQ ID NO: 100370 - DNA, 601 bp, Human; identical to SEQ ID NO: 96380

SEQ ID NO: 100371 - DNA, 601 bp, Human; identical to SEQ ID NO: 96381

SEQ ID NO: 100372 - DNA, 601 bp, Human; identical to SEQ ID NO: 96382

SEQ ID NO: 100373 - DNA, 601 bp, Human; identical to SEQ ID NO: 96383

SEQ ID NO: 100374 - DNA, 601 bp, Human; identical to SEQ ID NO: 96384

SEQ ID NO: 100375 - DNA, 601 bp, Human; identical to SEQ ID NO: 96385

SEQ ID NO: 100376 - DNA, 601 bp, Human; identical to SEQ ID NO: 96386

SEQ ID NO: 100377 - DNA, 601 bp, Human; identical to SEQ ID NO: 96387

SEQ ID NO: 100378 - DNA, 601 bp, Human; identical to SEQ ID NO: 96388

SEQ ID NO: 100379 - DNA, 601 bp, Human; identical to SEQ ID NO: 96389

SEQ ID NO: 100380 - DNA, 601 bp, Human; identical to SEQ ID NO: 96390

SEQ ID NO: 100381 - DNA, 601 bp, Human; identical to SEQ ID NO: 96391

SEQ ID NO: 100382 - DNA, 601 bp, Human; identical to SEQ ID NO: 96392

SEQ ID NO: 100383 - DNA, 601 bp, Human; identical to SEQ ID NO: 96393

SEQ ID NO: 100384 - DNA, 601 bp, Human; identical to SEQ ID NO: 96394

SEQ ID NO: 100385 - DNA, 601 bp, Human; identical to SEQ ID NO: 96395

SEQ ID NO: 100386 - DNA, 601 bp, Human; identical to SEQ ID NO: 96396

SEQ ID NO: 100387 - DNA, 601 bp, Human; identical to SEQ ID NO: 96397

SEQ ID NO: 100388 - DNA, 601 bp, Human; identical to SEQ ID NO: 96398

SEQ ID NO: 100389 - DNA, 601 bp, Human; identical to SEQ ID NO: 96399

SEQ ID NO: 100390 - DNA, 601 bp, Human; identical to SEQ ID NO: 96400

SEQ ID NO: 100391 - DNA, 601 bp, Human; identical to SEQ ID NO: 96401

SEQ ID NO: 100392 - DNA, 601 bp, Human; identical to SEQ ID NO: 96402

SEQ ID NO: 100393 - DNA, 601 bp, Human; identical to SEQ ID NO: 96403

SEQ ID NO: 100394 - DNA, 601 bp, Human; identical to SEQ ID NO: 96404

SEQ ID NO: 100395 - DNA, 601 bp, Human; identical to SEQ ID NO: 96405

SEQ ID NO: 100396 - DNA, 601 bp, Human; identical to SEQ ID NO: 96406

SEQ ID NO: 100397 - DNA, 601 bp, Human; identical to SEQ ID NO: 96407

SEQ ID NO: 100398 - DNA, 601 bp, Human; identical to SEQ ID NO: 96408

SEQ ID NO: 100399 - DNA, 601 bp, Human; identical to SEQ ID NO: 96409

SEQ ID NO: 100400 - DNA, 601 bp, Human; identical to SEQ ID NO: 96410

SEQ ID NO: 100401 - DNA, 601 bp, Human; identical to SEQ ID NO: 96411

SEQ ID NO: 100402 - DNA, 601 bp, Human; identical to SEQ ID NO: 96412

SEQ ID NO: 100403 - DNA, 601 bp, Human; identical to SEQ ID NO: 96413

SEQ ID NO: 100404 - DNA, 601 bp, Human; identical to SEQ ID NO: 96414

SEQ ID NO: 100405 - DNA, 601 bp, Human; identical to SEQ ID NO: 96415

SEQ ID NO: 100406 - DNA, 601 bp, Human; identical to SEQ ID NO: 96416

SEQ ID NO: 100407 - DNA, 601 bp, Human; identical to SEQ ID NO: 96417

SEQ ID NO: 100408 - DNA, 601 bp, Human; identical to SEQ ID NO: 96418

SEQ ID NO: 100409 - DNA, 601 bp, Human; identical to SEQ ID NO: 96419

SEQ ID NO: 100410 - DNA, 601 bp, Human; identical to SEQ ID NO: 96420

SEQ ID NO: 100411 - DNA, 601 bp, Human; identical to SEQ ID NO: 96421

SEQ ID NO: 100412 - DNA, 601 bp, Human; identical to SEQ ID NO: 96422

SEQ ID NO: 100413 - DNA, 601 bp, Human; identical to SEQ ID NO: 96423

SEQ ID NO: 100414 - DNA, 601 bp, Human; identical to SEQ ID NO: 96424

SEQ ID NO: 100415 - DNA, 601 bp, Human; identical to SEQ ID NO: 96425

SEQ ID NO: 100416 - DNA, 601 bp, Human; identical to SEQ ID NO: 96426

SEQ ID NO: 100417 - DNA, 601 bp, Human; identical to SEQ ID NO: 96427

SEQ ID NO: 100418 - DNA, 601 bp, Human; identical to SEQ ID NO: 96428

SEQ ID NO: 100419 - DNA, 601 bp, Human; identical to SEQ ID NO: 96429

SEQ ID NO: 100420 - DNA, 601 bp, Human; identical to SEQ ID NO: 96430

SEQ ID NO: 100421 - DNA, 601 bp, Human; identical to SEQ ID NO: 96431

SEQ ID NO: 100422 - DNA, 601 bp, Human; identical to SEQ ID NO: 96432

SEQ ID NO: 100423 - DNA, 601 bp, Human; identical to SEQ ID NO: 96433

SEQ ID NO: 100424 - DNA, 601 bp, Human; identical to SEQ ID NO: 96434

SEQ ID NO: 100425 - DNA, 601 bp, Human; identical to SEQ ID NO: 96435

SEQ ID NO: 100426 - DNA, 601 bp, Human; identical to SEQ ID NO: 96436

SEQ ID NO: 100427 - DNA, 601 bp, Human; identical to SEQ ID NO: 96437

SEQ ID NO: 100428 - DNA, 601 bp, Human; identical to SEQ ID NO: 96438

SEQ ID NO: 100429 - DNA, 601 bp, Human; identical to SEQ ID NO: 96439

SEQ ID NO: 100430 - DNA, 601 bp, Human; identical to SEQ ID NO: 96440

SEQ ID NO: 100431 - DNA, 601 bp, Human; identical to SEQ ID NO: 96441

SEQ ID NO: 100432 - DNA, 601 bp, Human; identical to SEQ ID NO: 96442

SEQ ID NO: 100433 - DNA, 601 bp, Human; identical to SEQ ID NO: 96443

SEQ ID NO: 100434 - DNA, 601 bp, Human; identical to SEQ ID NO: 96444

SEQ ID NO: 100435 - DNA, 601 bp, Human; identical to SEQ ID NO: 96445

SEQ ID NO: 100436 - DNA, 601 bp, Human; identical to SEQ ID NO: 96446

SEQ ID NO: 100437 - DNA, 601 bp, Human; identical to SEQ ID NO: 96447

SEQ ID NO: 100438 - DNA, 601 bp, Human; identical to SEQ ID NO: 96448

SEQ ID NO: 100439 - DNA, 601 bp, Human; identical to SEQ ID NO: 96449

SEQ ID NO: 100440 - DNA, 601 bp, Human; identical to SEQ ID NO: 96450

SEQ ID NO: 100441 - DNA, 601 bp, Human; identical to SEQ ID NO: 96451

SEQ ID NO: 100442 - DNA, 601 bp, Human; identical to SEQ ID NO: 96452

SEQ ID NO: 100443 - DNA, 601 bp, Human; identical to SEQ ID NO: 96453

SEQ ID NO: 100444 - DNA, 601 bp, Human; identical to SEQ ID NO: 96454

SEQ ID NO: 100445 - DNA, 601 bp, Human; identical to SEQ ID NO: 96455

SEQ ID NO: 100446 - DNA, 601 bp, Human; identical to SEQ ID NO: 96456

SEQ ID NO: 100447 - DNA, 601 bp, Human; identical to SEQ ID NO: 96457

SEQ ID NO: 100448 - DNA, 601 bp, Human; identical to SEQ ID NO: 96458

SEQ ID NO: 100449 - DNA, 601 bp, Human; identical to SEQ ID NO: 96459

SEQ ID NO: 100450 - DNA, 601 bp, Human; identical to SEQ ID NO: 96460

SEQ ID NO: 100451 - DNA, 601 bp, Human; identical to SEQ ID NO: 96461

SEQ ID NO: 100452 - DNA, 601 bp, Human; identical to SEQ ID NO: 96462

SEQ ID NO: 100453 - DNA, 601 bp, Human; identical to SEQ ID NO: 96463

SEQ ID NO: 100454 - DNA, 601 bp, Human; identical to SEQ ID NO: 96464

SEQ ID NO: 100455 - DNA, 601 bp, Human; identical to SEQ ID NO: 96465

SEQ ID NO: 100456 - DNA, 601 bp, Human; identical to SEQ ID NO: 96466

SEQ ID NO: 100457 - DNA, 601 bp, Human; identical to SEQ ID NO: 96467

SEQ ID NO: 100458 - DNA, 601 bp, Human; identical to SEQ ID NO: 96468

SEQ ID NO: 100459 - DNA, 601 bp, Human; identical to SEQ ID NO: 96469

SEQ ID NO: 100460 - DNA, 601 bp, Human; identical to SEQ ID NO: 96470

SEQ ID NO: 100461 - DNA, 601 bp, Human; identical to SEQ ID NO: 96471

SEQ ID NO: 100462 - DNA, 601 bp, Human; identical to SEQ ID NO: 96472

SEQ ID NO: 100463 - DNA, 601 bp, Human; identical to SEQ ID NO: 96473

SEQ ID NO: 100464 - DNA, 601 bp, Human; identical to SEQ ID NO: 96474

SEQ ID NO: 100465 - DNA, 601 bp, Human; identical to SEQ ID NO: 96475

SEQ ID NO: 100466 - DNA, 601 bp, Human; identical to SEQ ID NO: 96476

SEQ ID NO: 100467 - DNA, 601 bp, Human; identical to SEQ ID NO: 96477

SEQ ID NO: 100468 - DNA, 601 bp, Human; identical to SEQ ID NO: 96478

SEQ ID NO: 100469 - DNA, 601 bp, Human; identical to SEQ ID NO: 96479

SEQ ID NO: 100470 - DNA, 601 bp, Human; identical to SEQ ID NO: 96480

SEQ ID NO: 100471 - DNA, 601 bp, Human; identical to SEQ ID NO: 96481

SEQ ID NO: 100472 - DNA, 601 bp, Human; identical to SEQ ID NO: 96482

SEQ ID NO: 100473 - DNA, 601 bp, Human; identical to SEQ ID NO: 96483

SEQ ID NO: 100474 - DNA, 601 bp, Human; identical to SEQ ID NO: 96484

SEQ ID NO: 100475 - DNA, 601 bp, Human; identical to SEQ ID NO: 96485

SEQ ID NO: 100476 - DNA, 601 bp, Human; identical to SEQ ID NO: 96486

SEQ ID NO: 100477 - DNA, 601 bp, Human; identical to SEQ ID NO: 96487

SEQ ID NO: 100478 - DNA, 601 bp, Human; identical to SEQ ID NO: 96488

SEQ ID NO: 100479 - DNA, 601 bp, Human; identical to SEQ ID NO: 96489

SEQ ID NO: 100480 - DNA, 601 bp, Human; identical to SEQ ID NO: 96490

SEQ ID NO: 100481 - DNA, 601 bp, Human; identical to SEQ ID NO: 96491

SEQ ID NO: 100482 - DNA, 601 bp, Human; identical to SEQ ID NO: 96492

SEQ ID NO: 100483 - DNA, 601 bp, Human; identical to SEQ ID NO: 96493

SEQ ID NO: 100484 - DNA, 601 bp, Human; identical to SEQ ID NO: 96494

SEQ ID NO: 100485 - DNA, 601 bp, Human; identical to SEQ ID NO: 96495

SEQ ID NO: 100486 - DNA, 601 bp, Human; identical to SEQ ID NO: 96496

SEQ ID NO: 100487 - DNA, 601 bp, Human; identical to SEQ ID NO: 96497

SEQ ID NO: 100488 - DNA, 601 bp, Human; identical to SEQ ID NO: 96498

SEQ ID NO: 100489 - DNA, 601 bp, Human; identical to SEQ ID NO: 96499

SEQ ID NO: 100490 - DNA, 601 bp, Human; identical to SEQ ID NO: 96500

SEQ ID NO: 100491 - DNA, 601 bp, Human; identical to SEQ ID NO: 96501

SEQ ID NO: 100492 - DNA, 601 bp, Human; identical to SEQ ID NO: 96502

SEQ ID NO: 100493 - DNA, 601 bp, Human; identical to SEQ ID NO: 96503

SEQ ID NO: 100494 - DNA, 601 bp, Human; identical to SEQ ID NO: 96504

SEQ ID NO: 100495 - DNA, 601 bp, Human; identical to SEQ ID NO: 96505

SEQ ID NO: 100496 - DNA, 601 bp, Human; identical to SEQ ID NO: 96506

SEQ ID NO: 100497 - DNA, 601 bp, Human; identical to SEQ ID NO: 96507

SEQ ID NO: 100498 - DNA, 601 bp, Human; identical to SEQ ID NO: 96508

SEQ ID NO: 100499 - DNA, 601 bp, Human; identical to SEQ ID NO: 96509

SEQ ID NO: 100500 - DNA, 601 bp, Human; identical to SEQ ID NO: 96510

SEQ ID NO: 100501 - DNA, 601 bp, Human; identical to SEQ ID NO: 96511

SEQ ID NO: 100502 - DNA, 601 bp, Human; identical to SEQ ID NO: 96512

SEQ ID NO: 100503 - DNA, 601 bp, Human; identical to SEQ ID NO: 96513

SEQ ID NO: 100504 - DNA, 601 bp, Human; identical to SEQ ID NO: 96514

SEQ ID NO: 100505 - DNA, 601 bp, Human; identical to SEQ ID NO: 96515

SEQ ID NO: 100506 - DNA, 601 bp, Human; identical to SEQ ID NO: 96516

SEQ ID NO: 100507 - DNA, 601 bp, Human; identical to SEQ ID NO: 96517

SEQ ID NO: 100508 - DNA, 601 bp, Human; identical to SEQ ID NO: 96518

SEQ ID NO: 100509 - DNA, 601 bp, Human; identical to SEQ ID NO: 96519

SEQ ID NO: 100510 - DNA, 601 bp, Human; identical to SEQ ID NO: 96520

SEQ ID NO: 100511 - DNA, 601 bp, Human; identical to SEQ ID NO: 96521

SEQ ID NO: 100512 - DNA, 601 bp, Human; identical to SEQ ID NO: 96522

SEQ ID NO: 100513 - DNA, 601 bp, Human; identical to SEQ ID NO: 96523

SEQ ID NO: 100514 - DNA, 601 bp, Human; identical to SEQ ID NO: 96524

SEQ ID NO: 100515 - DNA, 601 bp, Human; identical to SEQ ID NO: 96525

SEQ ID NO: 100516 - DNA, 601 bp, Human; identical to SEQ ID NO: 96526

SEQ ID NO: 100517 - DNA, 601 bp, Human; identical to SEQ ID NO: 96527

SEQ ID NO: 100518 - DNA, 601 bp, Human; identical to SEQ ID NO: 96528

SEQ ID NO: 100519 - DNA, 601 bp, Human; identical to SEQ ID NO: 96529

SEQ ID NO: 100520 - DNA, 601 bp, Human; identical to SEQ ID NO: 96530

SEQ ID NO: 100521 - DNA, 601 bp, Human; identical to SEQ ID NO: 96531

SEQ ID NO: 100522 - DNA, 601 bp, Human; identical to SEQ ID NO: 96532

SEQ ID NO: 100523 - DNA, 601 bp, Human; identical to SEQ ID NO: 96533

SEQ ID NO: 100524 - DNA, 601 bp, Human; identical to SEQ ID NO: 96534

SEQ ID NO: 100525 - DNA, 601 bp, Human; identical to SEQ ID NO: 96535

SEQ ID NO: 100526 - DNA, 601 bp, Human; identical to SEQ ID NO: 96536

SEQ ID NO: 100527 - DNA, 601 bp, Human; identical to SEQ ID NO: 96537

SEQ ID NO: 100528 - DNA, 601 bp, Human; identical to SEQ ID NO: 96538

SEQ ID NO: 100529 - DNA, 601 bp, Human; identical to SEQ ID NO: 96539

SEQ ID NO: 100530 - DNA, 601 bp, Human; identical to SEQ ID NO: 96540

SEQ ID NO: 100531 - DNA, 601 bp, Human; identical to SEQ ID NO: 96541

SEQ ID NO: 100532 - DNA, 601 bp, Human; identical to SEQ ID NO: 96542

SEQ ID NO: 100533 - DNA, 601 bp, Human; identical to SEQ ID NO: 96543

SEQ ID NO: 100534 - DNA, 601 bp, Human; identical to SEQ ID NO: 96544

SEQ ID NO: 100535 - DNA, 601 bp, Human; identical to SEQ ID NO: 96545

SEQ ID NO: 100536 - DNA, 601 bp, Human; identical to SEQ ID NO: 96546

SEQ ID NO: 100537 - DNA, 601 bp, Human; identical to SEQ ID NO: 96547

SEQ ID NO: 100538 - DNA, 601 bp, Human; identical to SEQ ID NO: 96548

SEQ ID NO: 100539 - DNA, 601 bp, Human; identical to SEQ ID NO: 96549

SEQ ID NO: 100540 - DNA, 601 bp, Human; identical to SEQ ID NO: 96550

SEQ ID NO: 100541 - DNA, 601 bp, Human; identical to SEQ ID NO: 96551

SEQ ID NO: 100542 - DNA, 601 bp, Human; identical to SEQ ID NO: 96552

SEQ ID NO: 100543 - DNA, 601 bp, Human; identical to SEQ ID NO: 96553

SEQ ID NO: 100544 - DNA, 601 bp, Human; identical to SEQ ID NO: 96554

SEQ ID NO: 100545 - DNA, 601 bp, Human; identical to SEQ ID NO: 96555

SEQ ID NO: 100546 - DNA, 601 bp, Human; identical to SEQ ID NO: 96556

SEQ ID NO: 100547 - DNA, 601 bp, Human; identical to SEQ ID NO: 96557

SEQ ID NO: 100548 - DNA, 601 bp, Human; identical to SEQ ID NO: 96558

SEQ ID NO: 100549 - DNA, 601 bp, Human; identical to SEQ ID NO: 96559

SEQ ID NO: 100550 - DNA, 601 bp, Human; identical to SEQ ID NO: 96560

SEQ ID NO: 100551 - DNA, 601 bp, Human; identical to SEQ ID NO: 96561

SEQ ID NO: 100552 - DNA, 601 bp, Human; identical to SEQ ID NO: 96562

SEQ ID NO: 100553 - DNA, 601 bp, Human; identical to SEQ ID NO: 96563

SEQ ID NO: 100554 - DNA, 601 bp, Human; identical to SEQ ID NO: 96564

SEQ ID NO: 100555 - DNA, 601 bp, Human; identical to SEQ ID NO: 96565

SEQ ID NO: 100556 - DNA, 601 bp, Human; identical to SEQ ID NO: 96566

SEQ ID NO: 100557 - DNA, 601 bp, Human; identical to SEQ ID NO: 96567

SEQ ID NO: 100558 - DNA, 601 bp, Human; identical to SEQ ID NO: 96568

SEQ ID NO: 100559 - DNA, 601 bp, Human; identical to SEQ ID NO: 96569

SEQ ID NO: 100560 - DNA, 601 bp, Human; identical to SEQ ID NO: 96570

SEQ ID NO: 100561 - DNA, 601 bp, Human; identical to SEQ ID NO: 96571

SEQ ID NO: 100562 - DNA, 601 bp, Human; identical to SEQ ID NO: 96572

SEQ ID NO: 100563 - DNA, 601 bp, Human; identical to SEQ ID NO: 96573

SEQ ID NO: 100564 - DNA, 601 bp, Human; identical to SEQ ID NO: 96574

SEQ ID NO: 100565 - DNA, 601 bp, Human; identical to SEQ ID NO: 96575

SEQ ID NO: 100566 - DNA, 601 bp, Human; identical to SEQ ID NO: 96576

SEQ ID NO: 100567 - DNA, 601 bp, Human; identical to SEQ ID NO: 96577

SEQ ID NO: 100568 - DNA, 601 bp, Human; identical to SEQ ID NO: 96578

SEQ ID NO: 100569 - DNA, 601 bp, Human; identical to SEQ ID NO: 96579

SEQ ID NO: 100570 - DNA, 601 bp, Human; identical to SEQ ID NO: 96580

SEQ ID NO: 100571 - DNA, 601 bp, Human; identical to SEQ ID NO: 96581

SEQ ID NO: 100572 - DNA, 601 bp, Human; identical to SEQ ID NO: 96582

SEQ ID NO: 100573 - DNA, 601 bp, Human; identical to SEQ ID NO: 96583

SEQ ID NO: 100574 - DNA, 601 bp, Human; identical to SEQ ID NO: 96584

SEQ ID NO: 100575 - DNA, 417 bp, Human; identical to SEQ ID NO: 96585

SEQ ID NO: 100576 - DNA, 480 bp, Human; identical to SEQ ID NO: 96586

SEQ ID NO: 100577 - DNA, 601 bp, Human; identical to SEQ ID NO: 96587

SEQ ID NO: 100578 - DNA, 601 bp, Human; identical to SEQ ID NO: 96588

SEQ ID NO: 100579 - DNA, 601 bp, Human; identical to SEQ ID NO: 96589

SEQ ID NO: 100580 - DNA, 601 bp, Human; identical to SEQ ID NO: 96590

SEQ ID NO: 100581 - DNA, 601 bp, Human; identical to SEQ ID NO: 96591

SEQ ID NO: 100582 - DNA, 601 bp, Human; identical to SEQ ID NO: 96592

SEQ ID NO: 100583 - DNA, 601 bp, Human; identical to SEQ ID NO: 96593

SEQ ID NO: 100584 - DNA, 601 bp, Human; identical to SEQ ID NO: 96594

SEQ ID NO: 100585 - DNA, 601 bp, Human; identical to SEQ ID NO: 96595

SEQ ID NO: 100586 - DNA, 601 bp, Human; identical to SEQ ID NO: 96596

SEQ ID NO: 100587 - DNA, 601 bp, Human; identical to SEQ ID NO: 96597

SEQ ID NO: 100588 - DNA, 601 bp, Human; identical to SEQ ID NO: 96598

SEQ ID NO: 100589 - DNA, 601 bp, Human; identical to SEQ ID NO: 96599

SEQ ID NO: 100590 - DNA, 601 bp, Human; identical to SEQ ID NO: 96600

SEQ ID NO: 100591 - DNA, 601 bp, Human; identical to SEQ ID NO: 96601

SEQ ID NO: 100592 - DNA, 601 bp, Human; identical to SEQ ID NO: 96602

SEQ ID NO: 100593 - DNA, 601 bp, Human; identical to SEQ ID NO: 96603

SEQ ID NO: 100594 - DNA, 601 bp, Human; identical to SEQ ID NO: 96604

SEQ ID NO: 100595 - DNA, 601 bp, Human; identical to SEQ ID NO: 96605

SEQ ID NO: 100596 - DNA, 601 bp, Human; identical to SEQ ID NO: 96606

SEQ ID NO: 100597 - DNA, 601 bp, Human; identical to SEQ ID NO: 96607

SEQ ID NO: 100598 - DNA, 601 bp, Human; identical to SEQ ID NO: 96608

SEQ ID NO: 100599 - DNA, 601 bp, Human; identical to SEQ ID NO: 96609

SEQ ID NO: 100600 - DNA, 601 bp, Human; identical to SEQ ID NO: 96610

SEQ ID NO: 100601 - DNA, 601 bp, Human; identical to SEQ ID NO: 96611

SEQ ID NO: 100602 - DNA, 601 bp, Human; identical to SEQ ID NO: 96612

SEQ ID NO: 100603 - DNA, 601 bp, Human; identical to SEQ ID NO: 96613

SEQ ID NO: 100604 - DNA, 601 bp, Human; identical to SEQ ID NO: 96614

SEQ ID NO: 100605 - DNA, 601 bp, Human; identical to SEQ ID NO: 96615

SEQ ID NO: 100606 - DNA, 601 bp, Human; identical to SEQ ID NO: 96616

SEQ ID NO: 100607 - DNA, 601 bp, Human; identical to SEQ ID NO: 96617

SEQ ID NO: 100608 - DNA, 601 bp, Human; identical to SEQ ID NO: 96618

SEQ ID NO: 100609 - DNA, 601 bp, Human; identical to SEQ ID NO: 96619

SEQ ID NO: 100610 - DNA, 601 bp, Human; identical to SEQ ID NO: 96620

SEQ ID NO: 100611 - DNA, 601 bp, Human; identical to SEQ ID NO: 96621

SEQ ID NO: 100612 - DNA, 601 bp, Human; identical to SEQ ID NO: 96622

SEQ ID NO: 100613 - DNA, 601 bp, Human; identical to SEQ ID NO: 96623

SEQ ID NO: 100614 - DNA, 601 bp, Human; identical to SEQ ID NO: 96624

SEQ ID NO: 100615 - DNA, 601 bp, Human; identical to SEQ ID NO: 96625

SEQ ID NO: 100616 - DNA, 601 bp, Human; identical to SEQ ID NO: 96626

SEQ ID NO: 100617 - DNA, 601 bp, Human; identical to SEQ ID NO: 96627

SEQ ID NO: 100618 - DNA, 601 bp, Human; identical to SEQ ID NO: 96628

SEQ ID NO: 100619 - DNA, 601 bp, Human; identical to SEQ ID NO: 96629

SEQ ID NO: 100620 - DNA, 601 bp, Human; identical to SEQ ID NO: 96630

SEQ ID NO: 100621 - DNA, 601 bp, Human; identical to SEQ ID NO: 96631

SEQ ID NO: 100622 - DNA, 601 bp, Human; identical to SEQ ID NO: 96632

SEQ ID NO: 100623 - DNA, 601 bp, Human; identical to SEQ ID NO: 96633

SEQ ID NO: 100624 - DNA, 601 bp, Human; identical to SEQ ID NO: 96634

SEQ ID NO: 100625 - DNA, 601 bp, Human; identical to SEQ ID NO: 96635

SEQ ID NO: 100626 - DNA, 601 bp, Human; identical to SEQ ID NO: 96636

SEQ ID NO: 100627 - DNA, 601 bp, Human; identical to SEQ ID NO: 96637

SEQ ID NO: 100628 - DNA, 601 bp, Human; identical to SEQ ID NO: 96638

SEQ ID NO: 100629 - DNA, 601 bp, Human; identical to SEQ ID NO: 96639

SEQ ID NO: 100630 - DNA, 601 bp, Human; identical to SEQ ID NO: 96640

SEQ ID NO: 100631 - DNA, 601 bp, Human; identical to SEQ ID NO: 96375

SEQ ID NO: 100632 - DNA, 601 bp, Human; identical to SEQ ID NO: 96376

SEQ ID NO: 100633 - DNA, 601 bp, Human; identical to SEQ ID NO: 96377

SEQ ID NO: 100634 - DNA, 601 bp, Human; identical to SEQ ID NO: 96378

SEQ ID NO: 100635 - DNA, 601 bp, Human; identical to SEQ ID NO: 96379

SEQ ID NO: 100636 - DNA, 601 bp, Human; identical to SEQ ID NO: 96380

SEQ ID NO: 100637 - DNA, 601 bp, Human; identical to SEQ ID NO: 96381

SEQ ID NO: 100638 - DNA, 601 bp, Human; identical to SEQ ID NO: 96382

SEQ ID NO: 100639 - DNA, 601 bp, Human; identical to SEQ ID NO: 96383

SEQ ID NO: 100640 - DNA, 601 bp, Human; identical to SEQ ID NO: 96384

SEQ ID NO: 100641 - DNA, 601 bp, Human; identical to SEQ ID NO: 96385

SEQ ID NO: 100642 - DNA, 601 bp, Human; identical to SEQ ID NO: 96386

SEQ ID NO: 100643 - DNA, 601 bp, Human; identical to SEQ ID NO: 96387

SEQ ID NO: 100644 - DNA, 601 bp, Human; identical to SEQ ID NO: 96388

SEQ ID NO: 100645 - DNA, 601 bp, Human; identical to SEQ ID NO: 96389

SEQ ID NO: 100646 - DNA, 601 bp, Human; identical to SEQ ID NO: 96390

SEQ ID NO: 100647 - DNA, 601 bp, Human; identical to SEQ ID NO: 96391

SEQ ID NO: 100648 - DNA, 601 bp, Human; identical to SEQ ID NO: 96392

SEQ ID NO: 100649 - DNA, 601 bp, Human; identical to SEQ ID NO: 96393

SEQ ID NO: 100650 - DNA, 601 bp, Human; identical to SEQ ID NO: 96394

SEQ ID NO: 100651 - DNA, 601 bp, Human; identical to SEQ ID NO: 96395

SEQ ID NO: 100652 - DNA, 601 bp, Human; identical to SEQ ID NO: 96396

SEQ ID NO: 100653 - DNA, 601 bp, Human; identical to SEQ ID NO: 96397

SEQ ID NO: 100654 - DNA, 601 bp, Human; identical to SEQ ID NO: 96398

SEQ ID NO: 100655 - DNA, 601 bp, Human; identical to SEQ ID NO: 96399

SEQ ID NO: 100656 - DNA, 601 bp, Human; identical to SEQ ID NO: 96400

SEQ ID NO: 100657 - DNA, 601 bp, Human; identical to SEQ ID NO: 96401

SEQ ID NO: 100658 - DNA, 601 bp, Human; identical to SEQ ID NO: 96402

SEQ ID NO: 100659 - DNA, 601 bp, Human; identical to SEQ ID NO: 96403

SEQ ID NO: 100660 - DNA, 601 bp, Human; identical to SEQ ID NO: 96404

SEQ ID NO: 100661 - DNA, 601 bp, Human; identical to SEQ ID NO: 96405

SEQ ID NO: 100662 - DNA, 601 bp, Human; identical to SEQ ID NO: 96406

SEQ ID NO: 100663 - DNA, 601 bp, Human; identical to SEQ ID NO: 96407

SEQ ID NO: 100664 - DNA, 601 bp, Human; identical to SEQ ID NO: 96408

SEQ ID NO: 100665 - DNA, 601 bp, Human; identical to SEQ ID NO: 96409

SEQ ID NO: 100666 - DNA, 601 bp, Human; identical to SEQ ID NO: 96410

SEQ ID NO: 100667 - DNA, 601 bp, Human; identical to SEQ ID NO: 96411

SEQ ID NO: 100668 - DNA, 601 bp, Human; identical to SEQ ID NO: 96412

SEQ ID NO: 100669 - DNA, 601 bp, Human; identical to SEQ ID NO: 96413

SEQ ID NO: 100670 - DNA, 601 bp, Human; identical to SEQ ID NO: 96414

SEQ ID NO: 100671 - DNA, 601 bp, Human; identical to SEQ ID NO: 96415

SEQ ID NO: 100672 - DNA, 601 bp, Human; identical to SEQ ID NO: 96416

SEQ ID NO: 100673 - DNA, 601 bp, Human; identical to SEQ ID NO: 96417

SEQ ID NO: 100674 - DNA, 601 bp, Human; identical to SEQ ID NO: 96418

SEQ ID NO: 100675 - DNA, 601 bp, Human; identical to SEQ ID NO: 96419

SEQ ID NO: 100676 - DNA, 601 bp, Human; identical to SEQ ID NO: 96420

SEQ ID NO: 100677 - DNA, 601 bp, Human; identical to SEQ ID NO: 96421

SEQ ID NO: 100678 - DNA, 601 bp, Human; identical to SEQ ID NO: 96422

SEQ ID NO: 100679 - DNA, 601 bp, Human; identical to SEQ ID NO: 96423

SEQ ID NO: 100680 - DNA, 601 bp, Human; identical to SEQ ID NO: 96424

SEQ ID NO: 100681 - DNA, 601 bp, Human; identical to SEQ ID NO: 96425

SEQ ID NO: 100682 - DNA, 601 bp, Human; identical to SEQ ID NO: 96426

SEQ ID NO: 100683 - DNA, 601 bp, Human; identical to SEQ ID NO: 96427

SEQ ID NO: 100684 - DNA, 601 bp, Human; identical to SEQ ID NO: 96428

SEQ ID NO: 100685 - DNA, 601 bp, Human; identical to SEQ ID NO: 96429

SEQ ID NO: 100686 - DNA, 601 bp, Human; identical to SEQ ID NO: 96430

SEQ ID NO: 100687 - DNA, 601 bp, Human; identical to SEQ ID NO: 96431

SEQ ID NO: 100688 - DNA, 601 bp, Human; identical to SEQ ID NO: 96432

SEQ ID NO: 100689 - DNA, 601 bp, Human; identical to SEQ ID NO: 96433

SEQ ID NO: 100690 - DNA, 601 bp, Human; identical to SEQ ID NO: 96434

SEQ ID NO: 100691 - DNA, 601 bp, Human; identical to SEQ ID NO: 96435

SEQ ID NO: 100692 - DNA, 601 bp, Human; identical to SEQ ID NO: 96436

SEQ ID NO: 100693 - DNA, 601 bp, Human; identical to SEQ ID NO: 96437

SEQ ID NO: 100694 - DNA, 601 bp, Human; identical to SEQ ID NO: 96438

SEQ ID NO: 100695 - DNA, 601 bp, Human; identical to SEQ ID NO: 96439

SEQ ID NO: 100696 - DNA, 601 bp, Human; identical to SEQ ID NO: 96440

SEQ ID NO: 100697 - DNA, 601 bp, Human; identical to SEQ ID NO: 96441

SEQ ID NO: 100698 - DNA, 601 bp, Human; identical to SEQ ID NO: 96442

SEQ ID NO: 100699 - DNA, 601 bp, Human; identical to SEQ ID NO: 96443

SEQ ID NO: 100700 - DNA, 601 bp, Human; identical to SEQ ID NO: 96444

SEQ ID NO: 100701 - DNA, 601 bp, Human; identical to SEQ ID NO: 96445

SEQ ID NO: 100702 - DNA, 601 bp, Human; identical to SEQ ID NO: 96446

SEQ ID NO: 100703 - DNA, 601 bp, Human; identical to SEQ ID NO: 96447

SEQ ID NO: 100704 - DNA, 601 bp, Human; identical to SEQ ID NO: 96448

SEQ ID NO: 100705 - DNA, 601 bp, Human; identical to SEQ ID NO: 96449

SEQ ID NO: 100706 - DNA, 601 bp, Human; identical to SEQ ID NO: 96450

SEQ ID NO: 100707 - DNA, 601 bp, Human; identical to SEQ ID NO: 96451

SEQ ID NO: 100708 - DNA, 601 bp, Human; identical to SEQ ID NO: 96452

SEQ ID NO: 100709 - DNA, 601 bp, Human; identical to SEQ ID NO: 96453

SEQ ID NO: 100710 - DNA, 601 bp, Human; identical to SEQ ID NO: 96454

SEQ ID NO: 100711 - DNA, 601 bp, Human; identical to SEQ ID NO: 96455

SEQ ID NO: 100712 - DNA, 601 bp, Human; identical to SEQ ID NO: 96456

SEQ ID NO: 100713 - DNA, 601 bp, Human; identical to SEQ ID NO: 96457

SEQ ID NO: 100714 - DNA, 601 bp, Human; identical to SEQ ID NO: 96458

SEQ ID NO: 100715 - DNA, 601 bp, Human; identical to SEQ ID NO: 96459

SEQ ID NO: 100716 - DNA, 601 bp, Human; identical to SEQ ID NO: 96460

SEQ ID NO: 100717 - DNA, 601 bp, Human; identical to SEQ ID NO: 96461

SEQ ID NO: 100718 - DNA, 601 bp, Human; identical to SEQ ID NO: 96462

SEQ ID NO: 100719 - DNA, 601 bp, Human; identical to SEQ ID NO: 96463

SEQ ID NO: 100720 - DNA, 601 bp, Human; identical to SEQ ID NO: 96464

SEQ ID NO: 100721 - DNA, 601 bp, Human; identical to SEQ ID NO: 96465

SEQ ID NO: 100722 - DNA, 601 bp, Human; identical to SEQ ID NO: 96466

SEQ ID NO: 100723 - DNA, 601 bp, Human; identical to SEQ ID NO: 96467

SEQ ID NO: 100724 - DNA, 601 bp, Human; identical to SEQ ID NO: 96468

SEQ ID NO: 100725 - DNA, 601 bp, Human; identical to SEQ ID NO: 96469

SEQ ID NO: 100726 - DNA, 601 bp, Human; identical to SEQ ID NO: 96470

SEQ ID NO: 100727 - DNA, 601 bp, Human; identical to SEQ ID NO: 96471

SEQ ID NO: 100728 - DNA, 601 bp, Human; identical to SEQ ID NO: 96472

SEQ ID NO: 100729 - DNA, 601 bp, Human; identical to SEQ ID NO: 96473

SEQ ID NO: 100730 - DNA, 601 bp, Human; identical to SEQ ID NO: 96474

SEQ ID NO: 100731 - DNA, 601 bp, Human; identical to SEQ ID NO: 96475

SEQ ID NO: 100732 - DNA, 601 bp, Human; identical to SEQ ID NO: 96476

SEQ ID NO: 100733 - DNA, 601 bp, Human; identical to SEQ ID NO: 96477

SEQ ID NO: 100734 - DNA, 601 bp, Human; identical to SEQ ID NO: 96478

SEQ ID NO: 100735 - DNA, 601 bp, Human; identical to SEQ ID NO: 96479

SEQ ID NO: 100736 - DNA, 601 bp, Human; identical to SEQ ID NO: 96480

SEQ ID NO: 100737 - DNA, 601 bp, Human; identical to SEQ ID NO: 96481

SEQ ID NO: 100738 - DNA, 601 bp, Human; identical to SEQ ID NO: 96482

SEQ ID NO: 100739 - DNA, 601 bp, Human; identical to SEQ ID NO: 96483

SEQ ID NO: 100740 - DNA, 601 bp, Human; identical to SEQ ID NO: 96484

SEQ ID NO: 100741 - DNA, 601 bp, Human; identical to SEQ ID NO: 96485

SEQ ID NO: 100742 - DNA, 601 bp, Human; identical to SEQ ID NO: 96486

SEQ ID NO: 100743 - DNA, 601 bp, Human; identical to SEQ ID NO: 96487

SEQ ID NO: 100744 - DNA, 601 bp, Human; identical to SEQ ID NO: 96488

SEQ ID NO: 100745 - DNA, 601 bp, Human; identical to SEQ ID NO: 96489

SEQ ID NO: 100746 - DNA, 601 bp, Human; identical to SEQ ID NO: 96490

SEQ ID NO: 100747 - DNA, 601 bp, Human; identical to SEQ ID NO: 96491

SEQ ID NO: 100748 - DNA, 601 bp, Human; identical to SEQ ID NO: 96492

SEQ ID NO: 100749 - DNA, 601 bp, Human; identical to SEQ ID NO: 96493

SEQ ID NO: 100750 - DNA, 601 bp, Human; identical to SEQ ID NO: 96494

SEQ ID NO: 100751 - DNA, 601 bp, Human; identical to SEQ ID NO: 96495

SEQ ID NO: 100752 - DNA, 601 bp, Human; identical to SEQ ID NO: 96496

SEQ ID NO: 100753 - DNA, 601 bp, Human; identical to SEQ ID NO: 96497

SEQ ID NO: 100754 - DNA, 601 bp, Human; identical to SEQ ID NO: 96498

SEQ ID NO: 100755 - DNA, 601 bp, Human; identical to SEQ ID NO: 96499

SEQ ID NO: 100756 - DNA, 601 bp, Human; identical to SEQ ID NO: 96500

SEQ ID NO: 100757 - DNA, 601 bp, Human; identical to SEQ ID NO: 96501

SEQ ID NO: 100758 - DNA, 601 bp, Human; identical to SEQ ID NO: 96502

SEQ ID NO: 100759 - DNA, 601 bp, Human; identical to SEQ ID NO: 96503

SEQ ID NO: 100760 - DNA, 601 bp, Human; identical to SEQ ID NO: 96504

SEQ ID NO: 100761 - DNA, 601 bp, Human; identical to SEQ ID NO: 96505

SEQ ID NO: 100762 - DNA, 601 bp, Human; identical to SEQ ID NO: 96506

SEQ ID NO: 100763 - DNA, 601 bp, Human; identical to SEQ ID NO: 96507

SEQ ID NO: 100764 - DNA, 601 bp, Human; identical to SEQ ID NO: 96508

SEQ ID NO: 100765 - DNA, 601 bp, Human; identical to SEQ ID NO: 96509

SEQ ID NO: 100766 - DNA, 601 bp, Human; identical to SEQ ID NO: 96510

SEQ ID NO: 100767 - DNA, 601 bp, Human; identical to SEQ ID NO: 96511

SEQ ID NO: 100768 - DNA, 601 bp, Human; identical to SEQ ID NO: 96512

SEQ ID NO: 100769 - DNA, 601 bp, Human; identical to SEQ ID NO: 96513

SEQ ID NO: 100770 - DNA, 601 bp, Human; identical to SEQ ID NO: 96514

SEQ ID NO: 100771 - DNA, 601 bp, Human; identical to SEQ ID NO: 96515

SEQ ID NO: 100772 - DNA, 601 bp, Human; identical to SEQ ID NO: 96516

SEQ ID NO: 100773 - DNA, 601 bp, Human; identical to SEQ ID NO: 96517

SEQ ID NO: 100774 - DNA, 601 bp, Human; identical to SEQ ID NO: 96518

SEQ ID NO: 100775 - DNA, 601 bp, Human; identical to SEQ ID NO: 96519

SEQ ID NO: 100776 - DNA, 601 bp, Human; identical to SEQ ID NO: 96520

SEQ ID NO: 100777 - DNA, 601 bp, Human; identical to SEQ ID NO: 96521

SEQ ID NO: 100778 - DNA, 601 bp, Human; identical to SEQ ID NO: 96522

SEQ ID NO: 100779 - DNA, 601 bp, Human; identical to SEQ ID NO: 96523

SEQ ID NO: 100780 - DNA, 601 bp, Human; identical to SEQ ID NO: 96524

SEQ ID NO: 100781 - DNA, 601 bp, Human; identical to SEQ ID NO: 96525

SEQ ID NO: 100782 - DNA, 601 bp, Human; identical to SEQ ID NO: 96526

SEQ ID NO: 100783 - DNA, 601 bp, Human; identical to SEQ ID NO: 96527

SEQ ID NO: 100784 - DNA, 601 bp, Human; identical to SEQ ID NO: 96528

SEQ ID NO: 100785 - DNA, 601 bp, Human; identical to SEQ ID NO: 96529

SEQ ID NO: 100786 - DNA, 601 bp, Human; identical to SEQ ID NO: 96530

SEQ ID NO: 100787 - DNA, 601 bp, Human; identical to SEQ ID NO: 96531

SEQ ID NO: 100788 - DNA, 601 bp, Human; identical to SEQ ID NO: 96532

SEQ ID NO: 100789 - DNA, 601 bp, Human; identical to SEQ ID NO: 96533

SEQ ID NO: 100790 - DNA, 601 bp, Human; identical to SEQ ID NO: 96534

SEQ ID NO: 100791 - DNA, 601 bp, Human; identical to SEQ ID NO: 96535

SEQ ID NO: 100792 - DNA, 601 bp, Human; identical to SEQ ID NO: 96536

SEQ ID NO: 100793 - DNA, 601 bp, Human; identical to SEQ ID NO: 96537

SEQ ID NO: 100794 - DNA, 601 bp, Human; identical to SEQ ID NO: 96538

SEQ ID NO: 100795 - DNA, 601 bp, Human; identical to SEQ ID NO: 96539

SEQ ID NO: 100796 - DNA, 601 bp, Human; identical to SEQ ID NO: 96540

SEQ ID NO: 100797 - DNA, 601 bp, Human; identical to SEQ ID NO: 96541

SEQ ID NO: 100798 - DNA, 601 bp, Human; identical to SEQ ID NO: 96542

SEQ ID NO: 100799 - DNA, 601 bp, Human; identical to SEQ ID NO: 96543

SEQ ID NO: 100800 - DNA, 601 bp, Human; identical to SEQ ID NO: 96544

SEQ ID NO: 100801 - DNA, 601 bp, Human; identical to SEQ ID NO: 96545

SEQ ID NO: 100802 - DNA, 601 bp, Human; identical to SEQ ID NO: 96546

SEQ ID NO: 100803 - DNA, 601 bp, Human; identical to SEQ ID NO: 96547

SEQ ID NO: 100804 - DNA, 601 bp, Human; identical to SEQ ID NO: 96548

SEQ ID NO: 100805 - DNA, 601 bp, Human; identical to SEQ ID NO: 96549

SEQ ID NO: 100806 - DNA, 601 bp, Human; identical to SEQ ID NO: 96550

SEQ ID NO: 100807 - DNA, 601 bp, Human; identical to SEQ ID NO: 96551

SEQ ID NO: 100808 - DNA, 601 bp, Human; identical to SEQ ID NO: 96552

SEQ ID NO: 100809 - DNA, 601 bp, Human; identical to SEQ ID NO: 96553

SEQ ID NO: 100810 - DNA, 601 bp, Human; identical to SEQ ID NO: 96554

SEQ ID NO: 100811 - DNA, 601 bp, Human; identical to SEQ ID NO: 96555

SEQ ID NO: 100812 - DNA, 601 bp, Human; identical to SEQ ID NO: 96556

SEQ ID NO: 100813 - DNA, 601 bp, Human; identical to SEQ ID NO: 96557

SEQ ID NO: 100814 - DNA, 601 bp, Human; identical to SEQ ID NO: 96558

SEQ ID NO: 100815 - DNA, 601 bp, Human; identical to SEQ ID NO: 96559

SEQ ID NO: 100816 - DNA, 601 bp, Human; identical to SEQ ID NO: 96560

SEQ ID NO: 100817 - DNA, 601 bp, Human; identical to SEQ ID NO: 96561

SEQ ID NO: 100818 - DNA, 601 bp, Human; identical to SEQ ID NO: 96562

SEQ ID NO: 100819 - DNA, 601 bp, Human; identical to SEQ ID NO: 96563

SEQ ID NO: 100820 - DNA, 601 bp, Human; identical to SEQ ID NO: 96564

SEQ ID NO: 100821 - DNA, 601 bp, Human; identical to SEQ ID NO: 96565

SEQ ID NO: 100822 - DNA, 601 bp, Human; identical to SEQ ID NO: 96566

SEQ ID NO: 100823 - DNA, 601 bp, Human; identical to SEQ ID NO: 96567

SEQ ID NO: 100824 - DNA, 601 bp, Human; identical to SEQ ID NO: 96568

SEQ ID NO: 100825 - DNA, 601 bp, Human; identical to SEQ ID NO: 96569

SEQ ID NO: 100826 - DNA, 601 bp, Human; identical to SEQ ID NO: 96570

SEQ ID NO: 100827 - DNA, 601 bp, Human; identical to SEQ ID NO: 96571

SEQ ID NO: 100828 - DNA, 601 bp, Human; identical to SEQ ID NO: 96572

SEQ ID NO: 100829 - DNA, 601 bp, Human; identical to SEQ ID NO: 96573

SEQ ID NO: 100830 - DNA, 601 bp, Human; identical to SEQ ID NO: 96574

SEQ ID NO: 100831 - DNA, 601 bp, Human; identical to SEQ ID NO: 96575

SEQ ID NO: 100832 - DNA, 601 bp, Human; identical to SEQ ID NO: 96576

SEQ ID NO: 100833 - DNA, 601 bp, Human; identical to SEQ ID NO: 96577

SEQ ID NO: 100834 - DNA, 601 bp, Human; identical to SEQ ID NO: 96578

SEQ ID NO: 100835 - DNA, 601 bp, Human; identical to SEQ ID NO: 96579

SEQ ID NO: 100836 - DNA, 601 bp, Human; identical to SEQ ID NO: 96580

SEQ ID NO: 100837 - DNA, 601 bp, Human; identical to SEQ ID NO: 96581

SEQ ID NO: 100838 - DNA, 601 bp, Human; identical to SEQ ID NO: 96582

SEQ ID NO: 100839 - DNA, 601 bp, Human; identical to SEQ ID NO: 96583

SEQ ID NO: 100840 - DNA, 601 bp, Human; identical to SEQ ID NO: 96584

SEQ ID NO: 100841 - DNA, 417 bp, Human; identical to SEQ ID NO: 96585

SEQ ID NO: 100842 - DNA, 480 bp, Human; identical to SEQ ID NO: 96586

SEQ ID NO: 100843 - DNA, 601 bp, Human; identical to SEQ ID NO: 96587

SEQ ID NO: 100844 - DNA, 601 bp, Human; identical to SEQ ID NO: 96588

SEQ ID NO: 100845 - DNA, 601 bp, Human; identical to SEQ ID NO: 96589

SEQ ID NO: 100846 - DNA, 601 bp, Human; identical to SEQ ID NO: 96590

SEQ ID NO: 100847 - DNA, 601 bp, Human; identical to SEQ ID NO: 96591

SEQ ID NO: 100848 - DNA, 601 bp, Human; identical to SEQ ID NO: 96592

SEQ ID NO: 100849 - DNA, 601 bp, Human; identical to SEQ ID NO: 96593

SEQ ID NO: 100850 - DNA, 601 bp, Human; identical to SEQ ID NO: 96594

SEQ ID NO: 100851 - DNA, 601 bp, Human; identical to SEQ ID NO: 96595

SEQ ID NO: 100852 - DNA, 601 bp, Human; identical to SEQ ID NO: 96596

SEQ ID NO: 100853 - DNA, 601 bp, Human; identical to SEQ ID NO: 96597

SEQ ID NO: 100854 - DNA, 601 bp, Human; identical to SEQ ID NO: 96598

SEQ ID NO: 100855 - DNA, 601 bp, Human; identical to SEQ ID NO: 96599

SEQ ID NO: 100856 - DNA, 601 bp, Human; identical to SEQ ID NO: 96600

SEQ ID NO: 100857 - DNA, 601 bp, Human; identical to SEQ ID NO: 96601

SEQ ID NO: 100858 - DNA, 601 bp, Human; identical to SEQ ID NO: 96602

SEQ ID NO: 100859 - DNA, 601 bp, Human; identical to SEQ ID NO: 96603

SEQ ID NO: 100860 - DNA, 601 bp, Human; identical to SEQ ID NO: 96604

SEQ ID NO: 100861 - DNA, 601 bp, Human; identical to SEQ ID NO: 96605

SEQ ID NO: 100862 - DNA, 601 bp, Human; identical to SEQ ID NO: 96606

SEQ ID NO: 100863 - DNA, 601 bp, Human; identical to SEQ ID NO: 96607

SEQ ID NO: 100864 - DNA, 601 bp, Human; identical to SEQ ID NO: 96608

SEQ ID NO: 100865 - DNA, 601 bp, Human; identical to SEQ ID NO: 96609

SEQ ID NO: 100866 - DNA, 601 bp, Human; identical to SEQ ID NO: 96610

SEQ ID NO: 100867 - DNA, 601 bp, Human; identical to SEQ ID NO: 96611

SEQ ID NO: 100868 - DNA, 601 bp, Human; identical to SEQ ID NO: 96612

SEQ ID NO: 100869 - DNA, 601 bp, Human; identical to SEQ ID NO: 96613

SEQ ID NO: 100870 - DNA, 601 bp, Human; identical to SEQ ID NO: 96614

SEQ ID NO: 100871 - DNA, 601 bp, Human; identical to SEQ ID NO: 96615

SEQ ID NO: 100872 - DNA, 601 bp, Human; identical to SEQ ID NO: 96616

SEQ ID NO: 100873 - DNA, 601 bp, Human; identical to SEQ ID NO: 96617

SEQ ID NO: 100874 - DNA, 601 bp, Human; identical to SEQ ID NO: 96618

SEQ ID NO: 100875 - DNA, 601 bp, Human; identical to SEQ ID NO: 96619

SEQ ID NO: 100876 - DNA, 601 bp, Human; identical to SEQ ID NO: 96620

SEQ ID NO: 100877 - DNA, 601 bp, Human; identical to SEQ ID NO: 96621

SEQ ID NO: 100878 - DNA, 601 bp, Human; identical to SEQ ID NO: 96622

SEQ ID NO: 100879 - DNA, 601 bp, Human; identical to SEQ ID NO: 96623

SEQ ID NO: 100880 - DNA, 601 bp, Human; identical to SEQ ID NO: 96624

SEQ ID NO: 100881 - DNA, 601 bp, Human; identical to SEQ ID NO: 96625

SEQ ID NO: 100882 - DNA, 601 bp, Human; identical to SEQ ID NO: 96626

SEQ ID NO: 100883 - DNA, 601 bp, Human; identical to SEQ ID NO: 96627

SEQ ID NO: 100884 - DNA, 601 bp, Human; identical to SEQ ID NO: 96628

SEQ ID NO: 100885 - DNA, 601 bp, Human; identical to SEQ ID NO: 96629

SEQ ID NO: 100886 - DNA, 601 bp, Human; identical to SEQ ID NO: 96630

SEQ ID NO: 100887 - DNA, 601 bp, Human; identical to SEQ ID NO: 96631

SEQ ID NO: 100888 - DNA, 601 bp, Human; identical to SEQ ID NO: 96632

SEQ ID NO: 100889 - DNA, 601 bp, Human; identical to SEQ ID NO: 96633

SEQ ID NO: 100890 - DNA, 601 bp, Human; identical to SEQ ID NO: 96634

SEQ ID NO: 100891 - DNA, 601 bp, Human; identical to SEQ ID NO: 96635

SEQ ID NO: 100892 - DNA, 601 bp, Human; identical to SEQ ID NO: 96636

SEQ ID NO: 100893 - DNA, 601 bp, Human; identical to SEQ ID NO: 96637

SEQ ID NO: 100894 - DNA, 601 bp, Human; identical to SEQ ID NO: 96638

SEQ ID NO: 100895 - DNA, 601 bp, Human; identical to SEQ ID NO: 96639

SEQ ID NO: 100896 - DNA, 601 bp, Human; identical to SEQ ID NO: 96640

SEQ ID NO: 100897 - DNA, 417 bp, Human; identical to SEQ ID NO: 96585

SEQ ID NO: 100898 - DNA, 480 bp, Human; identical to SEQ ID NO: 96586

SEQ ID NO: 100899 - DNA, 601 bp, Human; identical to SEQ ID NO: 96587

SEQ ID NO: 100900 - DNA, 601 bp, Human; identical to SEQ ID NO: 96588

SEQ ID NO: 100901 - DNA, 601 bp, Human; identical to SEQ ID NO: 96589

SEQ ID NO: 100902 - DNA, 601 bp, Human; identical to SEQ ID NO: 96590

SEQ ID NO: 100903 - DNA, 601 bp, Human; identical to SEQ ID NO: 96591

SEQ ID NO: 100904 - DNA, 601 bp, Human; identical to SEQ ID NO: 96592

SEQ ID NO: 100905 - DNA, 601 bp, Human; identical to SEQ ID NO: 96593

SEQ ID NO: 100906 - DNA, 601 bp, Human; identical to SEQ ID NO: 96594

SEQ ID NO: 100907 - DNA, 601 bp, Human; identical to SEQ ID NO: 96595

SEQ ID NO: 100908 - DNA, 601 bp, Human; identical to SEQ ID NO: 96596

SEQ ID NO: 100909 - DNA, 601 bp, Human; identical to SEQ ID NO: 96597

SEQ ID NO: 100910 - DNA, 601 bp, Human; identical to SEQ ID NO: 96598

SEQ ID NO: 100911 - DNA, 601 bp, Human; identical to SEQ ID NO: 96599

SEQ ID NO: 100912 - DNA, 601 bp, Human; identical to SEQ ID NO: 96600

SEQ ID NO: 100913 - DNA, 601 bp, Human; identical to SEQ ID NO: 96601

SEQ ID NO: 100914 - DNA, 601 bp, Human; identical to SEQ ID NO: 96602

SEQ ID NO: 100915 - DNA, 601 bp, Human; identical to SEQ ID NO: 96603

SEQ ID NO: 100916 - DNA, 601 bp, Human; identical to SEQ ID NO: 96604

SEQ ID NO: 100917 - DNA, 601 bp, Human; identical to SEQ ID NO: 96605

SEQ ID NO: 100918 - DNA, 601 bp, Human; identical to SEQ ID NO: 96606

SEQ ID NO: 100919 - DNA, 601 bp, Human; identical to SEQ ID NO: 96607

SEQ ID NO: 100920 - DNA, 601 bp, Human; identical to SEQ ID NO: 96608

SEQ ID NO: 100921 - DNA, 601 bp, Human; identical to SEQ ID NO: 96609

SEQ ID NO: 100922 - DNA, 601 bp, Human; identical to SEQ ID NO: 96610

SEQ ID NO: 100923 - DNA, 601 bp, Human; identical to SEQ ID NO: 96611

SEQ ID NO: 100924 - DNA, 601 bp, Human; identical to SEQ ID NO: 96612

SEQ ID NO: 100925 - DNA, 601 bp, Human; identical to SEQ ID NO: 96613

SEQ ID NO: 100926 - DNA, 601 bp, Human; identical to SEQ ID NO: 96614

SEQ ID NO: 100927 - DNA, 601 bp, Human; identical to SEQ ID NO: 96615

SEQ ID NO: 100928 - DNA, 601 bp, Human; identical to SEQ ID NO: 96616

SEQ ID NO: 100929 - DNA, 601 bp, Human; identical to SEQ ID NO: 96617

SEQ ID NO: 100930 - DNA, 601 bp, Human; identical to SEQ ID NO: 96618

SEQ ID NO: 100931 - DNA, 601 bp, Human; identical to SEQ ID NO: 96619

SEQ ID NO: 100932 - DNA, 601 bp, Human; identical to SEQ ID NO: 96620

SEQ ID NO: 100933 - DNA, 601 bp, Human; identical to SEQ ID NO: 96621

SEQ ID NO: 100934 - DNA, 601 bp, Human; identical to SEQ ID NO: 96622

SEQ ID NO: 100935 - DNA, 601 bp, Human; identical to SEQ ID NO: 96375

SEQ ID NO: 100936 - DNA, 601 bp, Human; identical to SEQ ID NO: 96376

SEQ ID NO: 100937 - DNA, 601 bp, Human; identical to SEQ ID NO: 96377

SEQ ID NO: 100938 - DNA, 601 bp, Human; identical to SEQ ID NO: 96378

SEQ ID NO: 100939 - DNA, 601 bp, Human; identical to SEQ ID NO: 96379

SEQ ID NO: 100940 - DNA, 601 bp, Human; identical to SEQ ID NO: 96380

SEQ ID NO: 100941 - DNA, 601 bp, Human; identical to SEQ ID NO: 96381

SEQ ID NO: 100942 - DNA, 601 bp, Human; identical to SEQ ID NO: 96382

SEQ ID NO: 100943 - DNA, 601 bp, Human; identical to SEQ ID NO: 96383

SEQ ID NO: 100944 - DNA, 601 bp, Human; identical to SEQ ID NO: 96384

SEQ ID NO: 100945 - DNA, 601 bp, Human; identical to SEQ ID NO: 96385

SEQ ID NO: 100946 - DNA, 601 bp, Human; identical to SEQ ID NO: 96386

SEQ ID NO: 100947 - DNA, 601 bp, Human; identical to SEQ ID NO: 96387

SEQ ID NO: 100948 - DNA, 601 bp, Human; identical to SEQ ID NO: 96388

SEQ ID NO: 100949 - DNA, 601 bp, Human; identical to SEQ ID NO: 96389

SEQ ID NO: 100950 - DNA, 601 bp, Human; identical to SEQ ID NO: 96390

SEQ ID NO: 100951 - DNA, 601 bp, Human; identical to SEQ ID NO: 96391

SEQ ID NO: 100952 - DNA, 601 bp, Human; identical to SEQ ID NO: 96392

SEQ ID NO: 100953 - DNA, 601 bp, Human; identical to SEQ ID NO: 96393

SEQ ID NO: 100954 - DNA, 601 bp, Human; identical to SEQ ID NO: 96394

SEQ ID NO: 100955 - DNA, 601 bp, Human; identical to SEQ ID NO: 96395

SEQ ID NO: 100956 - DNA, 601 bp, Human; identical to SEQ ID NO: 96396

SEQ ID NO: 100957 - DNA, 601 bp, Human; identical to SEQ ID NO: 96397

SEQ ID NO: 100958 - DNA, 601 bp, Human; identical to SEQ ID NO: 96398

SEQ ID NO: 100959 - DNA, 601 bp, Human; identical to SEQ ID NO: 96399

SEQ ID NO: 100960 - DNA, 601 bp, Human; identical to SEQ ID NO: 96400

SEQ ID NO: 100961 - DNA, 601 bp, Human; identical to SEQ ID NO: 96401

SEQ ID NO: 100962 - DNA, 601 bp, Human; identical to SEQ ID NO: 96402

SEQ ID NO: 100963 - DNA, 601 bp, Human; identical to SEQ ID NO: 96403

SEQ ID NO: 100964 - DNA, 601 bp, Human; identical to SEQ ID NO: 96404

SEQ ID NO: 100965 - DNA, 601 bp, Human; identical to SEQ ID NO: 96405

SEQ ID NO: 100966 - DNA, 601 bp, Human; identical to SEQ ID NO: 96406

SEQ ID NO: 100967 - DNA, 601 bp, Human; identical to SEQ ID NO: 96407

SEQ ID NO: 100968 - DNA, 601 bp, Human; identical to SEQ ID NO: 96408

SEQ ID NO: 100969 - DNA, 601 bp, Human; identical to SEQ ID NO: 96409

SEQ ID NO: 100970 - DNA, 601 bp, Human; identical to SEQ ID NO: 96410

SEQ ID NO: 100971 - DNA, 601 bp, Human; identical to SEQ ID NO: 96411

SEQ ID NO: 100972 - DNA, 601 bp, Human; identical to SEQ ID NO: 96412

SEQ ID NO: 100973 - DNA, 601 bp, Human; identical to SEQ ID NO: 96413

SEQ ID NO: 100974 - DNA, 601 bp, Human; identical to SEQ ID NO: 96414

SEQ ID NO: 100975 - DNA, 601 bp, Human; identical to SEQ ID NO: 96415

SEQ ID NO: 100976 - DNA, 601 bp, Human; identical to SEQ ID NO: 96416

SEQ ID NO: 100977 - DNA, 601 bp, Human; identical to SEQ ID NO: 96417

SEQ ID NO: 100978 - DNA, 601 bp, Human; identical to SEQ ID NO: 96418

SEQ ID NO: 100979 - DNA, 601 bp, Human; identical to SEQ ID NO: 96419

SEQ ID NO: 100980 - DNA, 601 bp, Human; identical to SEQ ID NO: 96420

SEQ ID NO: 100981 - DNA, 601 bp, Human; identical to SEQ ID NO: 96421

SEQ ID NO: 100982 - DNA, 601 bp, Human; identical to SEQ ID NO: 96422

SEQ ID NO: 100983 - DNA, 601 bp, Human; identical to SEQ ID NO: 96423

SEQ ID NO: 100984 - DNA, 601 bp, Human; identical to SEQ ID NO: 96424

SEQ ID NO: 100985 - DNA, 601 bp, Human; identical to SEQ ID NO: 96425

SEQ ID NO: 100986 - DNA, 601 bp, Human; identical to SEQ ID NO: 96426

SEQ ID NO: 100987 - DNA, 601 bp, Human; identical to SEQ ID NO: 96427

SEQ ID NO: 100988 - DNA, 601 bp, Human; identical to SEQ ID NO: 96428

SEQ ID NO: 100989 - DNA, 601 bp, Human; identical to SEQ ID NO: 96429

SEQ ID NO: 100990 - DNA, 601 bp, Human; identical to SEQ ID NO: 96430

SEQ ID NO: 100991 - DNA, 601 bp, Human; identical to SEQ ID NO: 96431

SEQ ID NO: 100992 - DNA, 601 bp, Human; identical to SEQ ID NO: 96432

SEQ ID NO: 100993 - DNA, 601 bp, Human; identical to SEQ ID NO: 96433

SEQ ID NO: 100994 - DNA, 601 bp, Human; identical to SEQ ID NO: 96434

SEQ ID NO: 100995 - DNA, 601 bp, Human; identical to SEQ ID NO: 96435

SEQ ID NO: 100996 - DNA, 601 bp, Human; identical to SEQ ID NO: 96436

SEQ ID NO: 100997 - DNA, 601 bp, Human; identical to SEQ ID NO: 96437

SEQ ID NO: 100998 - DNA, 601 bp, Human; identical to SEQ ID NO: 96438

SEQ ID NO: 100999 - DNA, 601 bp, Human; identical to SEQ ID NO: 96439

SEQ ID NO: 101000 - DNA, 601 bp, Human; identical to SEQ ID NO: 96440

SEQ ID NO: 101001 - DNA, 601 bp, Human; identical to SEQ ID NO: 96441

SEQ ID NO: 101002 - DNA, 601 bp, Human; identical to SEQ ID NO: 96442

SEQ ID NO: 101003 - DNA, 601 bp, Human; identical to SEQ ID NO: 96443

SEQ ID NO: 101004 - DNA, 601 bp, Human; identical to SEQ ID NO: 96444

SEQ ID NO: 101005 - DNA, 601 bp, Human; identical to SEQ ID NO: 96445

SEQ ID NO: 101006 - DNA, 601 bp, Human; identical to SEQ ID NO: 96446

SEQ ID NO: 101007 - DNA, 601 bp, Human; identical to SEQ ID NO: 96447

SEQ ID NO: 101008 - DNA, 601 bp, Human; identical to SEQ ID NO: 96448

SEQ ID NO: 101009 - DNA, 601 bp, Human; identical to SEQ ID NO: 96449

SEQ ID NO: 101010 - DNA, 601 bp, Human; identical to SEQ ID NO: 96450

SEQ ID NO: 101011 - DNA, 601 bp, Human; identical to SEQ ID NO: 96451

SEQ ID NO: 101012 - DNA, 601 bp, Human; identical to SEQ ID NO: 96452

SEQ ID NO: 101013 - DNA, 601 bp, Human; identical to SEQ ID NO: 96453

SEQ ID NO: 101014 - DNA, 601 bp, Human; identical to SEQ ID NO: 96454

SEQ ID NO: 101015 - DNA, 601 bp, Human; identical to SEQ ID NO: 96455

SEQ ID NO: 101016 - DNA, 601 bp, Human; identical to SEQ ID NO: 96456

SEQ ID NO: 101017 - DNA, 601 bp, Human; identical to SEQ ID NO: 96457

SEQ ID NO: 101018 - DNA, 601 bp, Human; identical to SEQ ID NO: 96458

SEQ ID NO: 101019 - DNA, 601 bp, Human; identical to SEQ ID NO: 96459

SEQ ID NO: 101020 - DNA, 601 bp, Human; identical to SEQ ID NO: 96460

SEQ ID NO: 101021 - DNA, 601 bp, Human; identical to SEQ ID NO: 96461

SEQ ID NO: 101022 - DNA, 601 bp, Human; identical to SEQ ID NO: 96462

SEQ ID NO: 101023 - DNA, 601 bp, Human; identical to SEQ ID NO: 96463

SEQ ID NO: 101024 - DNA, 601 bp, Human; identical to SEQ ID NO: 96464

SEQ ID NO: 101025 - DNA, 601 bp, Human; identical to SEQ ID NO: 96465

SEQ ID NO: 101026 - DNA, 601 bp, Human; identical to SEQ ID NO: 96466

SEQ ID NO: 101027 - DNA, 601 bp, Human; identical to SEQ ID NO: 96467

SEQ ID NO: 101028 - DNA, 601 bp, Human; identical to SEQ ID NO: 96468

SEQ ID NO: 101029 - DNA, 601 bp, Human; identical to SEQ ID NO: 96469

SEQ ID NO: 101030 - DNA, 601 bp, Human; identical to SEQ ID NO: 96470

SEQ ID NO: 101031 - DNA, 601 bp, Human; identical to SEQ ID NO: 96471

SEQ ID NO: 101032 - DNA, 601 bp, Human; identical to SEQ ID NO: 96472

SEQ ID NO: 101033 - DNA, 601 bp, Human; identical to SEQ ID NO: 96473

SEQ ID NO: 101034 - DNA, 601 bp, Human; identical to SEQ ID NO: 96474

SEQ ID NO: 101035 - DNA, 601 bp, Human; identical to SEQ ID NO: 96475

SEQ ID NO: 101036 - DNA, 601 bp, Human; identical to SEQ ID NO: 96476

SEQ ID NO: 101037 - DNA, 601 bp, Human; identical to SEQ ID NO: 96477

SEQ ID NO: 101038 - DNA, 601 bp, Human; identical to SEQ ID NO: 96478

SEQ ID NO: 101039 - DNA, 601 bp, Human; identical to SEQ ID NO: 96479

SEQ ID NO: 101040 - DNA, 601 bp, Human; identical to SEQ ID NO: 96480

SEQ ID NO: 101041 - DNA, 601 bp, Human; identical to SEQ ID NO: 96481

SEQ ID NO: 101042 - DNA, 601 bp, Human; identical to SEQ ID NO: 96482

SEQ ID NO: 101043 - DNA, 601 bp, Human; identical to SEQ ID NO: 96483

SEQ ID NO: 101044 - DNA, 601 bp, Human; identical to SEQ ID NO: 96484

SEQ ID NO: 101045 - DNA, 601 bp, Human; identical to SEQ ID NO: 96485

SEQ ID NO: 101046 - DNA, 601 bp, Human; identical to SEQ ID NO: 96486

SEQ ID NO: 101047 - DNA, 601 bp, Human; identical to SEQ ID NO: 96487

SEQ ID NO: 101048 - DNA, 601 bp, Human; identical to SEQ ID NO: 96488

SEQ ID NO: 101049 - DNA, 601 bp, Human; identical to SEQ ID NO: 96489

SEQ ID NO: 101050 - DNA, 601 bp, Human; identical to SEQ ID NO: 96490

SEQ ID NO: 101051 - DNA, 601 bp, Human; identical to SEQ ID NO: 96491

SEQ ID NO: 101052 - DNA, 601 bp, Human; identical to SEQ ID NO: 96492

SEQ ID NO: 101053 - DNA, 601 bp, Human; identical to SEQ ID NO: 96493

SEQ ID NO: 101054 - DNA, 601 bp, Human; identical to SEQ ID NO: 96494

SEQ ID NO: 101055 - DNA, 601 bp, Human; identical to SEQ ID NO: 96495

SEQ ID NO: 101056 - DNA, 601 bp, Human; identical to SEQ ID NO: 96496

SEQ ID NO: 101057 - DNA, 601 bp, Human; identical to SEQ ID NO: 96497

SEQ ID NO: 101058 - DNA, 601 bp, Human; identical to SEQ ID NO: 96498

SEQ ID NO: 101059 - DNA, 601 bp, Human; identical to SEQ ID NO: 96499

SEQ ID NO: 101060 - DNA, 601 bp, Human; identical to SEQ ID NO: 96500

SEQ ID NO: 101061 - DNA, 601 bp, Human; identical to SEQ ID NO: 96501

SEQ ID NO: 101062 - DNA, 601 bp, Human; identical to SEQ ID NO: 96502

SEQ ID NO: 101063 - DNA, 601 bp, Human; identical to SEQ ID NO: 96503

SEQ ID NO: 101064 - DNA, 601 bp, Human; identical to SEQ ID NO: 96504

SEQ ID NO: 101065 - DNA, 601 bp, Human; identical to SEQ ID NO: 96505

SEQ ID NO: 101066 - DNA, 601 bp, Human; identical to SEQ ID NO: 96506

SEQ ID NO: 101067 - DNA, 601 bp, Human; identical to SEQ ID NO: 96507

SEQ ID NO: 101068 - DNA, 601 bp, Human; identical to SEQ ID NO: 96508

SEQ ID NO: 101069 - DNA, 601 bp, Human; identical to SEQ ID NO: 96509

SEQ ID NO: 101070 - DNA, 601 bp, Human; identical to SEQ ID NO: 96510

SEQ ID NO: 101071 - DNA, 601 bp, Human; identical to SEQ ID NO: 96511

SEQ ID NO: 101072 - DNA, 601 bp, Human; identical to SEQ ID NO: 96512

SEQ ID NO: 101073 - DNA, 601 bp, Human; identical to SEQ ID NO: 96513

SEQ ID NO: 101074 - DNA, 601 bp, Human; identical to SEQ ID NO: 96514

SEQ ID NO: 101075 - DNA, 601 bp, Human; identical to SEQ ID NO: 96515

SEQ ID NO: 101076 - DNA, 601 bp, Human; identical to SEQ ID NO: 96516

SEQ ID NO: 101077 - DNA, 601 bp, Human; identical to SEQ ID NO: 96517

SEQ ID NO: 101078 - DNA, 601 bp, Human; identical to SEQ ID NO: 96518

SEQ ID NO: 101079 - DNA, 601 bp, Human; identical to SEQ ID NO: 96519

SEQ ID NO: 101080 - DNA, 601 bp, Human; identical to SEQ ID NO: 96520

SEQ ID NO: 101081 - DNA, 601 bp, Human; identical to SEQ ID NO: 96521

SEQ ID NO: 101082 - DNA, 601 bp, Human; identical to SEQ ID NO: 96522

SEQ ID NO: 101083 - DNA, 601 bp, Human; identical to SEQ ID NO: 96523

SEQ ID NO: 101084 - DNA, 601 bp, Human; identical to SEQ ID NO: 96524

SEQ ID NO: 101085 - DNA, 601 bp, Human; identical to SEQ ID NO: 96525

SEQ ID NO: 101086 - DNA, 601 bp, Human; identical to SEQ ID NO: 96526

SEQ ID NO: 101087 - DNA, 601 bp, Human; identical to SEQ ID NO: 96527

SEQ ID NO: 101088 - DNA, 601 bp, Human; identical to SEQ ID NO: 96528

SEQ ID NO: 101089 - DNA, 601 bp, Human; identical to SEQ ID NO: 96529

SEQ ID NO: 101090 - DNA, 601 bp, Human; identical to SEQ ID NO: 96530

SEQ ID NO: 101091 - DNA, 601 bp, Human; identical to SEQ ID NO: 96531

SEQ ID NO: 101092 - DNA, 601 bp, Human; identical to SEQ ID NO: 96532

SEQ ID NO: 101093 - DNA, 601 bp, Human; identical to SEQ ID NO: 96533

SEQ ID NO: 101094 - DNA, 601 bp, Human; identical to SEQ ID NO: 96534

SEQ ID NO: 101095 - DNA, 601 bp, Human; identical to SEQ ID NO: 96535

SEQ ID NO: 101096 - DNA, 601 bp, Human; identical to SEQ ID NO: 96536

SEQ ID NO: 101097 - DNA, 601 bp, Human; identical to SEQ ID NO: 96537

SEQ ID NO: 101098 - DNA, 601 bp, Human; identical to SEQ ID NO: 96538

SEQ ID NO: 101099 - DNA, 601 bp, Human; identical to SEQ ID NO: 96539

SEQ ID NO: 101100 - DNA, 601 bp, Human; identical to SEQ ID NO: 96540

SEQ ID NO: 101101 - DNA, 601 bp, Human; identical to SEQ ID NO: 96541

SEQ ID NO: 101102 - DNA, 601 bp, Human; identical to SEQ ID NO: 96542

SEQ ID NO: 101103 - DNA, 601 bp, Human; identical to SEQ ID NO: 96543

SEQ ID NO: 101104 - DNA, 601 bp, Human; identical to SEQ ID NO: 96544

SEQ ID NO: 101105 - DNA, 601 bp, Human; identical to SEQ ID NO: 96545

SEQ ID NO: 101106 - DNA, 601 bp, Human; identical to SEQ ID NO: 96546

SEQ ID NO: 101107 - DNA, 601 bp, Human; identical to SEQ ID NO: 96547

SEQ ID NO: 101108 - DNA, 601 bp, Human; identical to SEQ ID NO: 96548

SEQ ID NO: 101109 - DNA, 601 bp, Human; identical to SEQ ID NO: 96549

SEQ ID NO: 101110 - DNA, 601 bp, Human; identical to SEQ ID NO: 96550

SEQ ID NO: 101111 - DNA, 601 bp, Human; identical to SEQ ID NO: 96551

SEQ ID NO: 101112 - DNA, 601 bp, Human; identical to SEQ ID NO: 96552

SEQ ID NO: 101113 - DNA, 601 bp, Human; identical to SEQ ID NO: 96553

SEQ ID NO: 101114 - DNA, 601 bp, Human; identical to SEQ ID NO: 96554

SEQ ID NO: 101115 - DNA, 601 bp, Human; identical to SEQ ID NO: 96555

SEQ ID NO: 101116 - DNA, 601 bp, Human; identical to SEQ ID NO: 96556

SEQ ID NO: 101117 - DNA, 601 bp, Human; identical to SEQ ID NO: 96557

SEQ ID NO: 101118 - DNA, 601 bp, Human; identical to SEQ ID NO: 96558

SEQ ID NO: 101119 - DNA, 601 bp, Human; identical to SEQ ID NO: 96559

SEQ ID NO: 101120 - DNA, 601 bp, Human; identical to SEQ ID NO: 96560

SEQ ID NO: 101121 - DNA, 601 bp, Human; identical to SEQ ID NO: 96561

SEQ ID NO: 101122 - DNA, 601 bp, Human; identical to SEQ ID NO: 96562

SEQ ID NO: 101123 - DNA, 601 bp, Human; identical to SEQ ID NO: 96563

SEQ ID NO: 101124 - DNA, 601 bp, Human; identical to SEQ ID NO: 96564

SEQ ID NO: 101125 - DNA, 601 bp, Human; identical to SEQ ID NO: 96565

SEQ ID NO: 101126 - DNA, 601 bp, Human; identical to SEQ ID NO: 96566

SEQ ID NO: 101127 - DNA, 601 bp, Human; identical to SEQ ID NO: 96567

SEQ ID NO: 101128 - DNA, 601 bp, Human; identical to SEQ ID NO: 96568

SEQ ID NO: 101129 - DNA, 601 bp, Human; identical to SEQ ID NO: 96569

SEQ ID NO: 101130 - DNA, 601 bp, Human; identical to SEQ ID NO: 96570

SEQ ID NO: 101131 - DNA, 601 bp, Human; identical to SEQ ID NO: 96571

SEQ ID NO: 101132 - DNA, 601 bp, Human; identical to SEQ ID NO: 96572

SEQ ID NO: 101133 - DNA, 601 bp, Human; identical to SEQ ID NO: 96573

SEQ ID NO: 101134 - DNA, 601 bp, Human; identical to SEQ ID NO: 96574

SEQ ID NO: 101135 - DNA, 601 bp, Human; identical to SEQ ID NO: 96575

SEQ ID NO: 101136 - DNA, 601 bp, Human; identical to SEQ ID NO: 96576

SEQ ID NO: 101137 - DNA, 601 bp, Human; identical to SEQ ID NO: 96577

SEQ ID NO: 101138 - DNA, 601 bp, Human; identical to SEQ ID NO: 96578

SEQ ID NO: 101139 - DNA, 601 bp, Human; identical to SEQ ID NO: 96579

SEQ ID NO: 101140 - DNA, 601 bp, Human; identical to SEQ ID NO: 96580

SEQ ID NO: 101141 - DNA, 601 bp, Human; identical to SEQ ID NO: 96581

SEQ ID NO: 101142 - DNA, 601 bp, Human; identical to SEQ ID NO: 96582

SEQ ID NO: 101143 - DNA, 601 bp, Human; identical to SEQ ID NO: 96583

SEQ ID NO: 101144 - DNA, 601 bp, Human; identical to SEQ ID NO: 96584

SEQ ID NO: 101145 - DNA, 417 bp, Human; identical to SEQ ID NO: 96585

SEQ ID NO: 101146 - DNA, 480 bp, Human; identical to SEQ ID NO: 96586

SEQ ID NO: 101147 - DNA, 601 bp, Human; identical to SEQ ID NO: 96587

SEQ ID NO: 101148 - DNA, 601 bp, Human; identical to SEQ ID NO: 96588

SEQ ID NO: 101149 - DNA, 601 bp, Human; identical to SEQ ID NO: 96589

SEQ ID NO: 101150 - DNA, 601 bp, Human; identical to SEQ ID NO: 96590

SEQ ID NO: 101151 - DNA, 601 bp, Human; identical to SEQ ID NO: 96591

SEQ ID NO: 101152 - DNA, 601 bp, Human; identical to SEQ ID NO: 96592

SEQ ID NO: 101153 - DNA, 601 bp, Human; identical to SEQ ID NO: 96593

SEQ ID NO: 101154 - DNA, 601 bp, Human; identical to SEQ ID NO: 96594

SEQ ID NO: 101155 - DNA, 601 bp, Human; identical to SEQ ID NO: 96595

SEQ ID NO: 101156 - DNA, 601 bp, Human; identical to SEQ ID NO: 96596

SEQ ID NO: 101157 - DNA, 601 bp, Human; identical to SEQ ID NO: 96597

SEQ ID NO: 101158 - DNA, 601 bp, Human; identical to SEQ ID NO: 96598

SEQ ID NO: 101159 - DNA, 601 bp, Human; identical to SEQ ID NO: 96599

SEQ ID NO: 101160 - DNA, 601 bp, Human; identical to SEQ ID NO: 96600

SEQ ID NO: 101161 - DNA, 601 bp, Human; identical to SEQ ID NO: 96601

SEQ ID NO: 101162 - DNA, 601 bp, Human; identical to SEQ ID NO: 96602

SEQ ID NO: 101163 - DNA, 601 bp, Human; identical to SEQ ID NO: 96603

SEQ ID NO: 101164 - DNA, 601 bp, Human; identical to SEQ ID NO: 96604

SEQ ID NO: 101165 - DNA, 601 bp, Human; identical to SEQ ID NO: 96605

SEQ ID NO: 101166 - DNA, 601 bp, Human; identical to SEQ ID NO: 96606

SEQ ID NO: 101167 - DNA, 601 bp, Human; identical to SEQ ID NO: 96607

SEQ ID NO: 101168 - DNA, 601 bp, Human; identical to SEQ ID NO: 96608

SEQ ID NO: 101169 - DNA, 601 bp, Human; identical to SEQ ID NO: 96609

SEQ ID NO: 101170 - DNA, 601 bp, Human; identical to SEQ ID NO: 96610

SEQ ID NO: 101171 - DNA, 601 bp, Human; identical to SEQ ID NO: 96611

SEQ ID NO: 101172 - DNA, 601 bp, Human; identical to SEQ ID NO: 96612

SEQ ID NO: 101173 - DNA, 601 bp, Human; identical to SEQ ID NO: 96613

SEQ ID NO: 101174 - DNA, 601 bp, Human; identical to SEQ ID NO: 96614

SEQ ID NO: 101175 - DNA, 601 bp, Human; identical to SEQ ID NO: 96615

SEQ ID NO: 101176 - DNA, 601 bp, Human; identical to SEQ ID NO: 96616

SEQ ID NO: 101177 - DNA, 601 bp, Human; identical to SEQ ID NO: 96617

SEQ ID NO: 101178 - DNA, 601 bp, Human; identical to SEQ ID NO: 96618

SEQ ID NO: 101179 - DNA, 601 bp, Human; identical to SEQ ID NO: 96619

SEQ ID NO: 101180 - DNA, 601 bp, Human; identical to SEQ ID NO: 96620

SEQ ID NO: 101181 - DNA, 601 bp, Human; identical to SEQ ID NO: 96621

SEQ ID NO: 101182 - DNA, 601 bp, Human; identical to SEQ ID NO: 96622

SEQ ID NO: 101183 - DNA, 601 bp, Human; identical to SEQ ID NO: 96623

SEQ ID NO: 101184 - DNA, 601 bp, Human; identical to SEQ ID NO: 96624

SEQ ID NO: 101185 - DNA, 601 bp, Human; identical to SEQ ID NO: 96625

SEQ ID NO: 101186 - DNA, 601 bp, Human; identical to SEQ ID NO: 96626

SEQ ID NO: 101187 - DNA, 601 bp, Human; identical to SEQ ID NO: 96627

SEQ ID NO: 101188 - DNA, 601 bp, Human; identical to SEQ ID NO: 96628

SEQ ID NO: 101189 - DNA, 601 bp, Human; identical to SEQ ID NO: 96629

SEQ ID NO: 101190 - DNA, 601 bp, Human; identical to SEQ ID NO: 96630

SEQ ID NO: 101191 - DNA, 601 bp, Human; identical to SEQ ID NO: 96631

SEQ ID NO: 101192 - DNA, 601 bp, Human; identical to SEQ ID NO: 96632

SEQ ID NO: 101193 - DNA, 601 bp, Human; identical to SEQ ID NO: 96633

SEQ ID NO: 101194 - DNA, 601 bp, Human; identical to SEQ ID NO: 96634

SEQ ID NO: 101195 - DNA, 601 bp, Human; identical to SEQ ID NO: 96635

SEQ ID NO: 101196 - DNA, 601 bp, Human; identical to SEQ ID NO: 96636

SEQ ID NO: 101197 - DNA, 601 bp, Human; identical to SEQ ID NO: 96637

SEQ ID NO: 101198 - DNA, 601 bp, Human; identical to SEQ ID NO: 96638

SEQ ID NO: 101199 - DNA, 601 bp, Human; identical to SEQ ID NO: 96639

SEQ ID NO: 101200 - DNA, 601 bp, Human; identical to SEQ ID NO: 96640

SEQ ID NO: 101201 - DNA, 601 bp, Human; identical to SEQ ID NO: 96375

SEQ ID NO: 101202 - DNA, 601 bp, Human; identical to SEQ ID NO: 96376

SEQ ID NO: 101203 - DNA, 601 bp, Human; identical to SEQ ID NO: 96377

SEQ ID NO: 101204 - DNA, 601 bp, Human; identical to SEQ ID NO: 96378

SEQ ID NO: 101205 - DNA, 601 bp, Human; identical to SEQ ID NO: 96379

SEQ ID NO: 101206 - DNA, 601 bp, Human; identical to SEQ ID NO: 96380

SEQ ID NO: 101207 - DNA, 601 bp, Human; identical to SEQ ID NO: 96381

SEQ ID NO: 101208 - DNA, 601 bp, Human; identical to SEQ ID NO: 96382

SEQ ID NO: 101209 - DNA, 601 bp, Human; identical to SEQ ID NO: 96383

SEQ ID NO: 101210 - DNA, 601 bp, Human; identical to SEQ ID NO: 96384

SEQ ID NO: 101211 - DNA, 601 bp, Human; identical to SEQ ID NO: 96385

SEQ ID NO: 101212 - DNA, 601 bp, Human; identical to SEQ ID NO: 96386

SEQ ID NO: 101213 - DNA, 601 bp, Human; identical to SEQ ID NO: 96387

SEQ ID NO: 101214 - DNA, 601 bp, Human; identical to SEQ ID NO: 96388

SEQ ID NO: 101215 - DNA, 601 bp, Human; identical to SEQ ID NO: 96389

SEQ ID NO: 101216 - DNA, 601 bp, Human; identical to SEQ ID NO: 96390

SEQ ID NO: 101217 - DNA, 601 bp, Human; identical to SEQ ID NO: 96391

SEQ ID NO: 101218 - DNA, 601 bp, Human; identical to SEQ ID NO: 96392

SEQ ID NO: 101219 - DNA, 601 bp, Human; identical to SEQ ID NO: 96393

SEQ ID NO: 101220 - DNA, 601 bp, Human; identical to SEQ ID NO: 96394

SEQ ID NO: 101221 - DNA, 601 bp, Human; identical to SEQ ID NO: 96395

SEQ ID NO: 101222 - DNA, 601 bp, Human; identical to SEQ ID NO: 96396

SEQ ID NO: 101223 - DNA, 601 bp, Human; identical to SEQ ID NO: 96397

SEQ ID NO: 101224 - DNA, 601 bp, Human; identical to SEQ ID NO: 96398

SEQ ID NO: 101225 - DNA, 601 bp, Human; identical to SEQ ID NO: 96399

SEQ ID NO: 101226 - DNA, 601 bp, Human; identical to SEQ ID NO: 96400

SEQ ID NO: 101227 - DNA, 601 bp, Human; identical to SEQ ID NO: 96401

SEQ ID NO: 101228 - DNA, 601 bp, Human; identical to SEQ ID NO: 96402

SEQ ID NO: 101229 - DNA, 601 bp, Human; identical to SEQ ID NO: 96403

SEQ ID NO: 101230 - DNA, 601 bp, Human; identical to SEQ ID NO: 96404

SEQ ID NO: 101231 - DNA, 601 bp, Human; identical to SEQ ID NO: 96405

SEQ ID NO: 101232 - DNA, 601 bp, Human; identical to SEQ ID NO: 96406

SEQ ID NO: 101233 - DNA, 601 bp, Human; identical to SEQ ID NO: 96407

SEQ ID NO: 101234 - DNA, 601 bp, Human; identical to SEQ ID NO: 96408

SEQ ID NO: 101235 - DNA, 601 bp, Human; identical to SEQ ID NO: 96409

SEQ ID NO: 101236 - DNA, 601 bp, Human; identical to SEQ ID NO: 96410

SEQ ID NO: 101237 - DNA, 601 bp, Human; identical to SEQ ID NO: 96411

SEQ ID NO: 101238 - DNA, 601 bp, Human; identical to SEQ ID NO: 96412

SEQ ID NO: 101239 - DNA, 601 bp, Human; identical to SEQ ID NO: 96413

SEQ ID NO: 101240 - DNA, 601 bp, Human; identical to SEQ ID NO: 96414

SEQ ID NO: 101241 - DNA, 601 bp, Human; identical to SEQ ID NO: 96415

SEQ ID NO: 101242 - DNA, 601 bp, Human; identical to SEQ ID NO: 96416

SEQ ID NO: 101243 - DNA, 601 bp, Human; identical to SEQ ID NO: 96417

SEQ ID NO: 101244 - DNA, 601 bp, Human; identical to SEQ ID NO: 96418

SEQ ID NO: 101245 - DNA, 601 bp, Human; identical to SEQ ID NO: 96419

SEQ ID NO: 101246 - DNA, 601 bp, Human; identical to SEQ ID NO: 96420

SEQ ID NO: 101247 - DNA, 601 bp, Human; identical to SEQ ID NO: 96421

SEQ ID NO: 101248 - DNA, 601 bp, Human; identical to SEQ ID NO: 96422

SEQ ID NO: 101249 - DNA, 601 bp, Human; identical to SEQ ID NO: 96423

SEQ ID NO: 101250 - DNA, 601 bp, Human; identical to SEQ ID NO: 96424

SEQ ID NO: 101251 - DNA, 601 bp, Human; identical to SEQ ID NO: 96425

SEQ ID NO: 101252 - DNA, 601 bp, Human; identical to SEQ ID NO: 96426

SEQ ID NO: 101253 - DNA, 601 bp, Human; identical to SEQ ID NO: 96427

SEQ ID NO: 101254 - DNA, 601 bp, Human; identical to SEQ ID NO: 96428

SEQ ID NO: 101255 - DNA, 601 bp, Human; identical to SEQ ID NO: 96429

SEQ ID NO: 101256 - DNA, 601 bp, Human; identical to SEQ ID NO: 96430

SEQ ID NO: 101257 - DNA, 601 bp, Human; identical to SEQ ID NO: 96431

SEQ ID NO: 101258 - DNA, 601 bp, Human; identical to SEQ ID NO: 96432

SEQ ID NO: 101259 - DNA, 601 bp, Human; identical to SEQ ID NO: 96433

SEQ ID NO: 101260 - DNA, 601 bp, Human; identical to SEQ ID NO: 96434

SEQ ID NO: 101261 - DNA, 601 bp, Human; identical to SEQ ID NO: 96435

SEQ ID NO: 101262 - DNA, 601 bp, Human; identical to SEQ ID NO: 96436

SEQ ID NO: 101263 - DNA, 601 bp, Human; identical to SEQ ID NO: 96437

SEQ ID NO: 101264 - DNA, 601 bp, Human; identical to SEQ ID NO: 96438

SEQ ID NO: 101265 - DNA, 601 bp, Human; identical to SEQ ID NO: 96439

SEQ ID NO: 101266 - DNA, 601 bp, Human; identical to SEQ ID NO: 96440

SEQ ID NO: 101267 - DNA, 601 bp, Human; identical to SEQ ID NO: 96441

SEQ ID NO: 101268 - DNA, 601 bp, Human; identical to SEQ ID NO: 96442

SEQ ID NO: 101269 - DNA, 601 bp, Human; identical to SEQ ID NO: 96443

SEQ ID NO: 101270 - DNA, 601 bp, Human; identical to SEQ ID NO: 96444

SEQ ID NO: 101271 - DNA, 601 bp, Human; identical to SEQ ID NO: 96445

SEQ ID NO: 101272 - DNA, 601 bp, Human; identical to SEQ ID NO: 96446

SEQ ID NO: 101273 - DNA, 601 bp, Human; identical to SEQ ID NO: 96447

SEQ ID NO: 101274 - DNA, 601 bp, Human; identical to SEQ ID NO: 96448

SEQ ID NO: 101275 - DNA, 601 bp, Human; identical to SEQ ID NO: 96449

SEQ ID NO: 101276 - DNA, 601 bp, Human; identical to SEQ ID NO: 96450

SEQ ID NO: 101277 - DNA, 601 bp, Human; identical to SEQ ID NO: 96451

SEQ ID NO: 101278 - DNA, 601 bp, Human; identical to SEQ ID NO: 96452

SEQ ID NO: 101279 - DNA, 601 bp, Human; identical to SEQ ID NO: 96453

SEQ ID NO: 101280 - DNA, 601 bp, Human; identical to SEQ ID NO: 96454

SEQ ID NO: 101281 - DNA, 601 bp, Human; identical to SEQ ID NO: 96455

SEQ ID NO: 101282 - DNA, 601 bp, Human; identical to SEQ ID NO: 96456

SEQ ID NO: 101283 - DNA, 601 bp, Human; identical to SEQ ID NO: 96457

SEQ ID NO: 101284 - DNA, 601 bp, Human; identical to SEQ ID NO: 96458

SEQ ID NO: 101285 - DNA, 601 bp, Human; identical to SEQ ID NO: 96459

SEQ ID NO: 101286 - DNA, 601 bp, Human; identical to SEQ ID NO: 96460

SEQ ID NO: 101287 - DNA, 601 bp, Human; identical to SEQ ID NO: 96461

SEQ ID NO: 101288 - DNA, 601 bp, Human; identical to SEQ ID NO: 96462

SEQ ID NO: 101289 - DNA, 601 bp, Human; identical to SEQ ID NO: 96463

SEQ ID NO: 101290 - DNA, 601 bp, Human; identical to SEQ ID NO: 96464

SEQ ID NO: 101291 - DNA, 601 bp, Human; identical to SEQ ID NO: 96465

SEQ ID NO: 101292 - DNA, 601 bp, Human; identical to SEQ ID NO: 96466

SEQ ID NO: 101293 - DNA, 601 bp, Human; identical to SEQ ID NO: 96467

SEQ ID NO: 101294 - DNA, 601 bp, Human; identical to SEQ ID NO: 96468

SEQ ID NO: 101295 - DNA, 601 bp, Human; identical to SEQ ID NO: 96469

SEQ ID NO: 101296 - DNA, 601 bp, Human; identical to SEQ ID NO: 96470

SEQ ID NO: 101297 - DNA, 601 bp, Human; identical to SEQ ID NO: 96471

SEQ ID NO: 101298 - DNA, 601 bp, Human; identical to SEQ ID NO: 96472

SEQ ID NO: 101299 - DNA, 601 bp, Human; identical to SEQ ID NO: 96473

SEQ ID NO: 101300 - DNA, 601 bp, Human; identical to SEQ ID NO: 96474

SEQ ID NO: 101301 - DNA, 601 bp, Human; identical to SEQ ID NO: 96475

SEQ ID NO: 101302 - DNA, 601 bp, Human; identical to SEQ ID NO: 96476

SEQ ID NO: 101303 - DNA, 601 bp, Human; identical to SEQ ID NO: 96477

SEQ ID NO: 101304 - DNA, 601 bp, Human; identical to SEQ ID NO: 96478

SEQ ID NO: 101305 - DNA, 601 bp, Human; identical to SEQ ID NO: 96479

SEQ ID NO: 101306 - DNA, 601 bp, Human; identical to SEQ ID NO: 96480

SEQ ID NO: 101307 - DNA, 601 bp, Human; identical to SEQ ID NO: 96481

SEQ ID NO: 101308 - DNA, 601 bp, Human; identical to SEQ ID NO: 96482

SEQ ID NO: 101309 - DNA, 601 bp, Human; identical to SEQ ID NO: 96483

SEQ ID NO: 101310 - DNA, 601 bp, Human; identical to SEQ ID NO: 96484

SEQ ID NO: 101311 - DNA, 601 bp, Human; identical to SEQ ID NO: 96485

SEQ ID NO: 101312 - DNA, 601 bp, Human; identical to SEQ ID NO: 96486

SEQ ID NO: 101313 - DNA, 601 bp, Human; identical to SEQ ID NO: 96487

SEQ ID NO: 101314 - DNA, 601 bp, Human; identical to SEQ ID NO: 96488

SEQ ID NO: 101315 - DNA, 601 bp, Human; identical to SEQ ID NO: 96489

SEQ ID NO: 101316 - DNA, 601 bp, Human; identical to SEQ ID NO: 96490

SEQ ID NO: 101317 - DNA, 601 bp, Human; identical to SEQ ID NO: 96491

SEQ ID NO: 101318 - DNA, 601 bp, Human; identical to SEQ ID NO: 96492

SEQ ID NO: 101319 - DNA, 601 bp, Human; identical to SEQ ID NO: 96493

SEQ ID NO: 101320 - DNA, 601 bp, Human; identical to SEQ ID NO: 96494

SEQ ID NO: 101321 - DNA, 601 bp, Human; identical to SEQ ID NO: 96495

SEQ ID NO: 101322 - DNA, 601 bp, Human; identical to SEQ ID NO: 96496

SEQ ID NO: 101323 - DNA, 601 bp, Human; identical to SEQ ID NO: 96497

SEQ ID NO: 101324 - DNA, 601 bp, Human; identical to SEQ ID NO: 96498

SEQ ID NO: 101325 - DNA, 601 bp, Human; identical to SEQ ID NO: 96499

SEQ ID NO: 101326 - DNA, 601 bp, Human; identical to SEQ ID NO: 96500

SEQ ID NO: 101327 - DNA, 601 bp, Human; identical to SEQ ID NO: 96501

SEQ ID NO: 101328 - DNA, 601 bp, Human; identical to SEQ ID NO: 96502

SEQ ID NO: 101329 - DNA, 601 bp, Human; identical to SEQ ID NO: 96503

SEQ ID NO: 101330 - DNA, 601 bp, Human; identical to SEQ ID NO: 96504

SEQ ID NO: 101331 - DNA, 601 bp, Human; identical to SEQ ID NO: 96505

SEQ ID NO: 101332 - DNA, 601 bp, Human; identical to SEQ ID NO: 96506

SEQ ID NO: 101333 - DNA, 601 bp, Human; identical to SEQ ID NO: 96507

SEQ ID NO: 101334 - DNA, 601 bp, Human; identical to SEQ ID NO: 96508

SEQ ID NO: 101335 - DNA, 601 bp, Human; identical to SEQ ID NO: 96509

SEQ ID NO: 101336 - DNA, 601 bp, Human; identical to SEQ ID NO: 96510

SEQ ID NO: 101337 - DNA, 601 bp, Human; identical to SEQ ID NO: 96511

SEQ ID NO: 101338 - DNA, 601 bp, Human; identical to SEQ ID NO: 96512

SEQ ID NO: 101339 - DNA, 601 bp, Human; identical to SEQ ID NO: 96513

SEQ ID NO: 101340 - DNA, 601 bp, Human; identical to SEQ ID NO: 96514

SEQ ID NO: 101341 - DNA, 601 bp, Human; identical to SEQ ID NO: 96515

SEQ ID NO: 101342 - DNA, 601 bp, Human; identical to SEQ ID NO: 96516

SEQ ID NO: 101343 - DNA, 601 bp, Human; identical to SEQ ID NO: 96517

SEQ ID NO: 101344 - DNA, 601 bp, Human; identical to SEQ ID NO: 96518

SEQ ID NO: 101345 - DNA, 601 bp, Human; identical to SEQ ID NO: 96519

SEQ ID NO: 101346 - DNA, 601 bp, Human; identical to SEQ ID NO: 96520

SEQ ID NO: 101347 - DNA, 601 bp, Human; identical to SEQ ID NO: 96521

SEQ ID NO: 101348 - DNA, 601 bp, Human; identical to SEQ ID NO: 96522

SEQ ID NO: 101349 - DNA, 601 bp, Human; identical to SEQ ID NO: 96523

SEQ ID NO: 101350 - DNA, 601 bp, Human; identical to SEQ ID NO: 96524

SEQ ID NO: 101351 - DNA, 601 bp, Human; identical to SEQ ID NO: 96525

SEQ ID NO: 101352 - DNA, 601 bp, Human; identical to SEQ ID NO: 96526

SEQ ID NO: 101353 - DNA, 601 bp, Human; identical to SEQ ID NO: 96527

SEQ ID NO: 101354 - DNA, 601 bp, Human; identical to SEQ ID NO: 96528

SEQ ID NO: 101355 - DNA, 601 bp, Human; identical to SEQ ID NO: 96529

SEQ ID NO: 101356 - DNA, 601 bp, Human; identical to SEQ ID NO: 96530

SEQ ID NO: 101357 - DNA, 601 bp, Human; identical to SEQ ID NO: 96531

SEQ ID NO: 101358 - DNA, 601 bp, Human; identical to SEQ ID NO: 96532

SEQ ID NO: 101359 - DNA, 601 bp, Human; identical to SEQ ID NO: 96533

SEQ ID NO: 101360 - DNA, 601 bp, Human; identical to SEQ ID NO: 96534

SEQ ID NO: 101361 - DNA, 601 bp, Human; identical to SEQ ID NO: 96535

SEQ ID NO: 101362 - DNA, 601 bp, Human; identical to SEQ ID NO: 96536

SEQ ID NO: 101363 - DNA, 601 bp, Human; identical to SEQ ID NO: 96537

SEQ ID NO: 101364 - DNA, 601 bp, Human; identical to SEQ ID NO: 96538

SEQ ID NO: 101365 - DNA, 601 bp, Human; identical to SEQ ID NO: 96539

SEQ ID NO: 101366 - DNA, 601 bp, Human; identical to SEQ ID NO: 96540

SEQ ID NO: 101367 - DNA, 601 bp, Human; identical to SEQ ID NO: 96541

SEQ ID NO: 101368 - DNA, 601 bp, Human; identical to SEQ ID NO: 96542

SEQ ID NO: 101369 - DNA, 601 bp, Human; identical to SEQ ID NO: 96543

SEQ ID NO: 101370 - DNA, 601 bp, Human; identical to SEQ ID NO: 96544

SEQ ID NO: 101371 - DNA, 601 bp, Human; identical to SEQ ID NO: 96545

SEQ ID NO: 101372 - DNA, 601 bp, Human; identical to SEQ ID NO: 96546

SEQ ID NO: 101373 - DNA, 601 bp, Human; identical to SEQ ID NO: 96547

SEQ ID NO: 101374 - DNA, 601 bp, Human; identical to SEQ ID NO: 96548

SEQ ID NO: 101375 - DNA, 601 bp, Human; identical to SEQ ID NO: 96549

SEQ ID NO: 101376 - DNA, 601 bp, Human; identical to SEQ ID NO: 96550

SEQ ID NO: 101377 - DNA, 601 bp, Human; identical to SEQ ID NO: 96551

SEQ ID NO: 101378 - DNA, 601 bp, Human; identical to SEQ ID NO: 96552

SEQ ID NO: 101379 - DNA, 601 bp, Human; identical to SEQ ID NO: 96553

SEQ ID NO: 101380 - DNA, 601 bp, Human; identical to SEQ ID NO: 96554

SEQ ID NO: 101381 - DNA, 601 bp, Human; identical to SEQ ID NO: 96555

SEQ ID NO: 101382 - DNA, 601 bp, Human; identical to SEQ ID NO: 96556

SEQ ID NO: 101383 - DNA, 601 bp, Human; identical to SEQ ID NO: 96557

SEQ ID NO: 101384 - DNA, 601 bp, Human; identical to SEQ ID NO: 96558

SEQ ID NO: 101385 - DNA, 601 bp, Human; identical to SEQ ID NO: 96559

SEQ ID NO: 101386 - DNA, 601 bp, Human; identical to SEQ ID NO: 96560

SEQ ID NO: 101387 - DNA, 601 bp, Human; identical to SEQ ID NO: 96561

SEQ ID NO: 101388 - DNA, 601 bp, Human; identical to SEQ ID NO: 96562

SEQ ID NO: 101389 - DNA, 601 bp, Human; identical to SEQ ID NO: 96563

SEQ ID NO: 101390 - DNA, 601 bp, Human; identical to SEQ ID NO: 96564

SEQ ID NO: 101391 - DNA, 601 bp, Human; identical to SEQ ID NO: 96565

SEQ ID NO: 101392 - DNA, 601 bp, Human; identical to SEQ ID NO: 96566

SEQ ID NO: 101393 - DNA, 601 bp, Human; identical to SEQ ID NO: 96567

SEQ ID NO: 101394 - DNA, 601 bp, Human; identical to SEQ ID NO: 96568

SEQ ID NO: 101395 - DNA, 601 bp, Human; identical to SEQ ID NO: 96569

SEQ ID NO: 101396 - DNA, 601 bp, Human; identical to SEQ ID NO: 96570

SEQ ID NO: 101397 - DNA, 601 bp, Human; identical to SEQ ID NO: 96571

SEQ ID NO: 101398 - DNA, 601 bp, Human; identical to SEQ ID NO: 96572

SEQ ID NO: 101399 - DNA, 601 bp, Human; identical to SEQ ID NO: 96573

SEQ ID NO: 101400 - DNA, 601 bp, Human; identical to SEQ ID NO: 96574

SEQ ID NO: 101401 - DNA, 601 bp, Human; identical to SEQ ID NO: 96575

SEQ ID NO: 101402 - DNA, 601 bp, Human; identical to SEQ ID NO: 96576

SEQ ID NO: 101403 - DNA, 601 bp, Human; identical to SEQ ID NO: 96577

SEQ ID NO: 101404 - DNA, 601 bp, Human; identical to SEQ ID NO: 96578

SEQ ID NO: 101405 - DNA, 601 bp, Human; identical to SEQ ID NO: 96579

SEQ ID NO: 101406 - DNA, 601 bp, Human; identical to SEQ ID NO: 96580

SEQ ID NO: 101407 - DNA, 601 bp, Human; identical to SEQ ID NO: 96581

SEQ ID NO: 101408 - DNA, 601 bp, Human; identical to SEQ ID NO: 96582

SEQ ID NO: 101409 - DNA, 601 bp, Human; identical to SEQ ID NO: 96583

SEQ ID NO: 101410 - DNA, 601 bp, Human; identical to SEQ ID NO: 96584

SEQ ID NO: 101411 - DNA, 417 bp, Human; identical to SEQ ID NO: 96585

SEQ ID NO: 101412 - DNA, 480 bp, Human; identical to SEQ ID NO: 96586

SEQ ID NO: 101413 - DNA, 601 bp, Human; identical to SEQ ID NO: 96587

SEQ ID NO: 101414 - DNA, 601 bp, Human; identical to SEQ ID NO: 96588

SEQ ID NO: 101415 - DNA, 601 bp, Human; identical to SEQ ID NO: 96589

SEQ ID NO: 101416 - DNA, 601 bp, Human; identical to SEQ ID NO: 96590

SEQ ID NO: 101417 - DNA, 601 bp, Human; identical to SEQ ID NO: 96591

SEQ ID NO: 101418 - DNA, 601 bp, Human; identical to SEQ ID NO: 96592

SEQ ID NO: 101419 - DNA, 601 bp, Human; identical to SEQ ID NO: 96593

SEQ ID NO: 101420 - DNA, 601 bp, Human; identical to SEQ ID NO: 96594

SEQ ID NO: 101421 - DNA, 601 bp, Human; identical to SEQ ID NO: 96595

SEQ ID NO: 101422 - DNA, 601 bp, Human; identical to SEQ ID NO: 96596

SEQ ID NO: 101423 - DNA, 601 bp, Human; identical to SEQ ID NO: 96597

SEQ ID NO: 101424 - DNA, 601 bp, Human; identical to SEQ ID NO: 96598

SEQ ID NO: 101425 - DNA, 601 bp, Human; identical to SEQ ID NO: 96599

SEQ ID NO: 101426 - DNA, 601 bp, Human; identical to SEQ ID NO: 96600

SEQ ID NO: 101427 - DNA, 601 bp, Human; identical to SEQ ID NO: 96601

SEQ ID NO: 101428 - DNA, 601 bp, Human; identical to SEQ ID NO: 96602

SEQ ID NO: 101429 - DNA, 601 bp, Human; identical to SEQ ID NO: 96603

SEQ ID NO: 101430 - DNA, 601 bp, Human; identical to SEQ ID NO: 96604

SEQ ID NO: 101431 - DNA, 601 bp, Human; identical to SEQ ID NO: 96605

SEQ ID NO: 101432 - DNA, 601 bp, Human; identical to SEQ ID NO: 96606

SEQ ID NO: 101433 - DNA, 601 bp, Human; identical to SEQ ID NO: 96607

SEQ ID NO: 101434 - DNA, 601 bp, Human; identical to SEQ ID NO: 96608

SEQ ID NO: 101435 - DNA, 601 bp, Human; identical to SEQ ID NO: 96609

SEQ ID NO: 101436 - DNA, 601 bp, Human; identical to SEQ ID NO: 96610

SEQ ID NO: 101437 - DNA, 601 bp, Human; identical to SEQ ID NO: 96611

SEQ ID NO: 101438 - DNA, 601 bp, Human; identical to SEQ ID NO: 96612

SEQ ID NO: 101439 - DNA, 601 bp, Human; identical to SEQ ID NO: 96613

SEQ ID NO: 101440 - DNA, 601 bp, Human; identical to SEQ ID NO: 96614

SEQ ID NO: 101441 - DNA, 601 bp, Human; identical to SEQ ID NO: 96615

SEQ ID NO: 101442 - DNA, 601 bp, Human; identical to SEQ ID NO: 96616

SEQ ID NO: 101443 - DNA, 601 bp, Human; identical to SEQ ID NO: 96617

SEQ ID NO: 101444 - DNA, 601 bp, Human; identical to SEQ ID NO: 96618

SEQ ID NO: 101445 - DNA, 601 bp, Human; identical to SEQ ID NO: 96619

SEQ ID NO: 101446 - DNA, 601 bp, Human; identical to SEQ ID NO: 96620

SEQ ID NO: 101447 - DNA, 601 bp, Human; identical to SEQ ID NO: 96621

SEQ ID NO: 101448 - DNA, 601 bp, Human; identical to SEQ ID NO: 96622

SEQ ID NO: 101449 - DNA, 601 bp, Human; identical to SEQ ID NO: 96623

SEQ ID NO: 101450 - DNA, 601 bp, Human; identical to SEQ ID NO: 96624

SEQ ID NO: 101451 - DNA, 601 bp, Human; identical to SEQ ID NO: 96625

SEQ ID NO: 101452 - DNA, 601 bp, Human; identical to SEQ ID NO: 96626

SEQ ID NO: 101453 - DNA, 601 bp, Human; identical to SEQ ID NO: 96627

SEQ ID NO: 101454 - DNA, 601 bp, Human; identical to SEQ ID NO: 96628

SEQ ID NO: 101455 - DNA, 601 bp, Human; identical to SEQ ID NO: 96629

SEQ ID NO: 101456 - DNA, 601 bp, Human; identical to SEQ ID NO: 96630

SEQ ID NO: 101457 - DNA, 601 bp, Human; identical to SEQ ID NO: 96631

SEQ ID NO: 101458 - DNA, 601 bp, Human; identical to SEQ ID NO: 96632

SEQ ID NO: 101459 - DNA, 601 bp, Human; identical to SEQ ID NO: 96633

SEQ ID NO: 101460 - DNA, 601 bp, Human; identical to SEQ ID NO: 96634

SEQ ID NO: 101461 - DNA, 601 bp, Human; identical to SEQ ID NO: 96635

SEQ ID NO: 101462 - DNA, 601 bp, Human; identical to SEQ ID NO: 96636

SEQ ID NO: 101463 - DNA, 601 bp, Human; identical to SEQ ID NO: 96637

SEQ ID NO: 101464 - DNA, 601 bp, Human; identical to SEQ ID NO: 96638

SEQ ID NO: 101465 - DNA, 601 bp, Human; identical to SEQ ID NO: 96639

SEQ ID NO: 101466 - DNA, 601 bp, Human; identical to SEQ ID NO: 96640

SEQ ID NO: 101467 - DNA, 601 bp, Human; identical to SEQ ID NO: 96375

SEQ ID NO: 101468 - DNA, 601 bp, Human; identical to SEQ ID NO: 96376

SEQ ID NO: 101469 - DNA, 601 bp, Human; identical to SEQ ID NO: 96377

SEQ ID NO: 101470 - DNA, 601 bp, Human; identical to SEQ ID NO: 96378

SEQ ID NO: 101471 - DNA, 601 bp, Human; identical to SEQ ID NO: 96379

SEQ ID NO: 101472 - DNA, 601 bp, Human; identical to SEQ ID NO: 96380

SEQ ID NO: 101473 - DNA, 601 bp, Human; identical to SEQ ID NO: 96381

SEQ ID NO: 101474 - DNA, 601 bp, Human; identical to SEQ ID NO: 96382

SEQ ID NO: 101475 - DNA, 601 bp, Human; identical to SEQ ID NO: 96383

SEQ ID NO: 101476 - DNA, 601 bp, Human; identical to SEQ ID NO: 96384

SEQ ID NO: 101477 - DNA, 601 bp, Human; identical to SEQ ID NO: 96385

SEQ ID NO: 101478 - DNA, 601 bp, Human; identical to SEQ ID NO: 96386

SEQ ID NO: 101479 - DNA, 601 bp, Human; identical to SEQ ID NO: 96387

SEQ ID NO: 101480 - DNA, 601 bp, Human; identical to SEQ ID NO: 96388

SEQ ID NO: 101481 - DNA, 601 bp, Human; identical to SEQ ID NO: 96389

SEQ ID NO: 101482 - DNA, 601 bp, Human; identical to SEQ ID NO: 96390

SEQ ID NO: 101483 - DNA, 601 bp, Human; identical to SEQ ID NO: 96391

SEQ ID NO: 101484 - DNA, 601 bp, Human; identical to SEQ ID NO: 96392

SEQ ID NO: 101485 - DNA, 601 bp, Human; identical to SEQ ID NO: 96393

SEQ ID NO: 101486 - DNA, 601 bp, Human; identical to SEQ ID NO: 96394

SEQ ID NO: 101487 - DNA, 601 bp, Human; identical to SEQ ID NO: 96395

SEQ ID NO: 101488 - DNA, 601 bp, Human; identical to SEQ ID NO: 96396

SEQ ID NO: 101489 - DNA, 601 bp, Human; identical to SEQ ID NO: 96397

SEQ ID NO: 101490 - DNA, 601 bp, Human; identical to SEQ ID NO: 96398

SEQ ID NO: 101491 - DNA, 601 bp, Human; identical to SEQ ID NO: 96399

SEQ ID NO: 101492 - DNA, 601 bp, Human; identical to SEQ ID NO: 96400

SEQ ID NO: 101493 - DNA, 601 bp, Human; identical to SEQ ID NO: 96401

SEQ ID NO: 101494 - DNA, 601 bp, Human; identical to SEQ ID NO: 96402

SEQ ID NO: 101495 - DNA, 601 bp, Human; identical to SEQ ID NO: 96403

SEQ ID NO: 101496 - DNA, 601 bp, Human; identical to SEQ ID NO: 96404

SEQ ID NO: 101497 - DNA, 601 bp, Human; identical to SEQ ID NO: 96405

SEQ ID NO: 101498 - DNA, 601 bp, Human; identical to SEQ ID NO: 96406

SEQ ID NO: 101499 - DNA, 601 bp, Human; identical to SEQ ID NO: 96407

SEQ ID NO: 101500 - DNA, 601 bp, Human; identical to SEQ ID NO: 96408

SEQ ID NO: 101501 - DNA, 601 bp, Human; identical to SEQ ID NO: 96409

SEQ ID NO: 101502 - DNA, 601 bp, Human; identical to SEQ ID NO: 96410

SEQ ID NO: 101503 - DNA, 601 bp, Human; identical to SEQ ID NO: 96411

SEQ ID NO: 101504 - DNA, 601 bp, Human; identical to SEQ ID NO: 96412

SEQ ID NO: 101505 - DNA, 601 bp, Human; identical to SEQ ID NO: 96413

SEQ ID NO: 101506 - DNA, 601 bp, Human; identical to SEQ ID NO: 96414

SEQ ID NO: 101507 - DNA, 601 bp, Human; identical to SEQ ID NO: 96415

SEQ ID NO: 101508 - DNA, 601 bp, Human; identical to SEQ ID NO: 96416

SEQ ID NO: 101509 - DNA, 601 bp, Human; identical to SEQ ID NO: 96417

SEQ ID NO: 101510 - DNA, 601 bp, Human; identical to SEQ ID NO: 96418

SEQ ID NO: 101511 - DNA, 601 bp, Human; identical to SEQ ID NO: 96419

SEQ ID NO: 101512 - DNA, 601 bp, Human; identical to SEQ ID NO: 96420

SEQ ID NO: 101513 - DNA, 601 bp, Human; identical to SEQ ID NO: 96421

SEQ ID NO: 101514 - DNA, 601 bp, Human; identical to SEQ ID NO: 96422

SEQ ID NO: 101515 - DNA, 601 bp, Human; identical to SEQ ID NO: 96423

SEQ ID NO: 101516 - DNA, 601 bp, Human; identical to SEQ ID NO: 96424

SEQ ID NO: 101517 - DNA, 601 bp, Human; identical to SEQ ID NO: 96425

SEQ ID NO: 101518 - DNA, 601 bp, Human; identical to SEQ ID NO: 96426

SEQ ID NO: 101519 - DNA, 601 bp, Human; identical to SEQ ID NO: 96427

SEQ ID NO: 101520 - DNA, 601 bp, Human; identical to SEQ ID NO: 96428

SEQ ID NO: 101521 - DNA, 601 bp, Human; identical to SEQ ID NO: 96429

SEQ ID NO: 101522 - DNA, 601 bp, Human; identical to SEQ ID NO: 96430

SEQ ID NO: 101523 - DNA, 601 bp, Human; identical to SEQ ID NO: 96431

SEQ ID NO: 101524 - DNA, 601 bp, Human; identical to SEQ ID NO: 96432

SEQ ID NO: 101525 - DNA, 601 bp, Human; identical to SEQ ID NO: 96433

SEQ ID NO: 101526 - DNA, 601 bp, Human; identical to SEQ ID NO: 96434

SEQ ID NO: 101527 - DNA, 601 bp, Human; identical to SEQ ID NO: 96435

SEQ ID NO: 101528 - DNA, 601 bp, Human; identical to SEQ ID NO: 96436

SEQ ID NO: 101529 - DNA, 601 bp, Human; identical to SEQ ID NO: 96437

SEQ ID NO: 101530 - DNA, 601 bp, Human; identical to SEQ ID NO: 96438

SEQ ID NO: 101531 - DNA, 601 bp, Human; identical to SEQ ID NO: 96439

SEQ ID NO: 101532 - DNA, 601 bp, Human; identical to SEQ ID NO: 96440

SEQ ID NO: 101533 - DNA, 601 bp, Human; identical to SEQ ID NO: 96441

SEQ ID NO: 101534 - DNA, 601 bp, Human; identical to SEQ ID NO: 96442

SEQ ID NO: 101535 - DNA, 601 bp, Human; identical to SEQ ID NO: 96443

SEQ ID NO: 101536 - DNA, 601 bp, Human; identical to SEQ ID NO: 96444

SEQ ID NO: 101537 - DNA, 601 bp, Human; identical to SEQ ID NO: 96445

SEQ ID NO: 101538 - DNA, 601 bp, Human; identical to SEQ ID NO: 96446

SEQ ID NO: 101539 - DNA, 601 bp, Human; identical to SEQ ID NO: 96447

SEQ ID NO: 101540 - DNA, 601 bp, Human; identical to SEQ ID NO: 96448

SEQ ID NO: 101541 - DNA, 601 bp, Human; identical to SEQ ID NO: 96449

SEQ ID NO: 101542 - DNA, 601 bp, Human; identical to SEQ ID NO: 96450

SEQ ID NO: 101543 - DNA, 601 bp, Human; identical to SEQ ID NO: 96451

SEQ ID NO: 101544 - DNA, 601 bp, Human; identical to SEQ ID NO: 96452

SEQ ID NO: 101545 - DNA, 601 bp, Human; identical to SEQ ID NO: 96453

SEQ ID NO: 101546 - DNA, 601 bp, Human; identical to SEQ ID NO: 96454

SEQ ID NO: 101547 - DNA, 601 bp, Human; identical to SEQ ID NO: 96455

SEQ ID NO: 101548 - DNA, 601 bp, Human; identical to SEQ ID NO: 96456

SEQ ID NO: 101549 - DNA, 601 bp, Human; identical to SEQ ID NO: 96457

SEQ ID NO: 101550 - DNA, 601 bp, Human; identical to SEQ ID NO: 96458

SEQ ID NO: 101551 - DNA, 601 bp, Human; identical to SEQ ID NO: 96459

SEQ ID NO: 101552 - DNA, 601 bp, Human; identical to SEQ ID NO: 96460

SEQ ID NO: 101553 - DNA, 601 bp, Human; identical to SEQ ID NO: 96461

SEQ ID NO: 101554 - DNA, 601 bp, Human; identical to SEQ ID NO: 96462

SEQ ID NO: 101555 - DNA, 601 bp, Human; identical to SEQ ID NO: 96463

SEQ ID NO: 101556 - DNA, 601 bp, Human; identical to SEQ ID NO: 96464

SEQ ID NO: 101557 - DNA, 601 bp, Human; identical to SEQ ID NO: 96465

SEQ ID NO: 101558 - DNA, 601 bp, Human; identical to SEQ ID NO: 96466

SEQ ID NO: 101559 - DNA, 601 bp, Human; identical to SEQ ID NO: 96467

SEQ ID NO: 101560 - DNA, 601 bp, Human; identical to SEQ ID NO: 96468

SEQ ID NO: 101561 - DNA, 601 bp, Human; identical to SEQ ID NO: 96469

SEQ ID NO: 101562 - DNA, 601 bp, Human; identical to SEQ ID NO: 96470

SEQ ID NO: 101563 - DNA, 601 bp, Human; identical to SEQ ID NO: 96471

SEQ ID NO: 101564 - DNA, 601 bp, Human; identical to SEQ ID NO: 96472

SEQ ID NO: 101565 - DNA, 601 bp, Human; identical to SEQ ID NO: 96473

SEQ ID NO: 101566 - DNA, 601 bp, Human; identical to SEQ ID NO: 96474

SEQ ID NO: 101567 - DNA, 601 bp, Human; identical to SEQ ID NO: 96475

SEQ ID NO: 101568 - DNA, 601 bp, Human; identical to SEQ ID NO: 96476

SEQ ID NO: 101569 - DNA, 601 bp, Human; identical to SEQ ID NO: 96477

SEQ ID NO: 101570 - DNA, 601 bp, Human; identical to SEQ ID NO: 96478

SEQ ID NO: 101571 - DNA, 601 bp, Human; identical to SEQ ID NO: 96479

SEQ ID NO: 101572 - DNA, 601 bp, Human; identical to SEQ ID NO: 96480

SEQ ID NO: 101573 - DNA, 601 bp, Human; identical to SEQ ID NO: 96481

SEQ ID NO: 101574 - DNA, 601 bp, Human; identical to SEQ ID NO: 96482

SEQ ID NO: 101575 - DNA, 601 bp, Human; identical to SEQ ID NO: 96483

SEQ ID NO: 101576 - DNA, 601 bp, Human; identical to SEQ ID NO: 96484

SEQ ID NO: 101577 - DNA, 601 bp, Human; identical to SEQ ID NO: 96485

SEQ ID NO: 101578 - DNA, 601 bp, Human; identical to SEQ ID NO: 96486

SEQ ID NO: 101579 - DNA, 601 bp, Human; identical to SEQ ID NO: 96487

SEQ ID NO: 101580 - DNA, 601 bp, Human; identical to SEQ ID NO: 96488

SEQ ID NO: 101581 - DNA, 601 bp, Human; identical to SEQ ID NO: 96489

SEQ ID NO: 101582 - DNA, 601 bp, Human; identical to SEQ ID NO: 96490

SEQ ID NO: 101583 - DNA, 601 bp, Human; identical to SEQ ID NO: 96491

SEQ ID NO: 101584 - DNA, 601 bp, Human; identical to SEQ ID NO: 96492

SEQ ID NO: 101585 - DNA, 601 bp, Human; identical to SEQ ID NO: 96493

SEQ ID NO: 101586 - DNA, 601 bp, Human; identical to SEQ ID NO: 96494

SEQ ID NO: 101587 - DNA, 601 bp, Human; identical to SEQ ID NO: 96495

SEQ ID NO: 101588 - DNA, 601 bp, Human; identical to SEQ ID NO: 96496

SEQ ID NO: 101589 - DNA, 601 bp, Human; identical to SEQ ID NO: 96497

SEQ ID NO: 101590 - DNA, 601 bp, Human; identical to SEQ ID NO: 96498

SEQ ID NO: 101591 - DNA, 601 bp, Human; identical to SEQ ID NO: 96499

SEQ ID NO: 101592 - DNA, 601 bp, Human; identical to SEQ ID NO: 96500

SEQ ID NO: 101593 - DNA, 601 bp, Human; identical to SEQ ID NO: 96501

SEQ ID NO: 101594 - DNA, 601 bp, Human; identical to SEQ ID NO: 96502

SEQ ID NO: 101595 - DNA, 601 bp, Human; identical to SEQ ID NO: 96503

SEQ ID NO: 101596 - DNA, 601 bp, Human; identical to SEQ ID NO: 96504

SEQ ID NO: 101597 - DNA, 601 bp, Human; identical to SEQ ID NO: 96505

SEQ ID NO: 101598 - DNA, 601 bp, Human; identical to SEQ ID NO: 96506

SEQ ID NO: 101599 - DNA, 601 bp, Human; identical to SEQ ID NO: 96507

SEQ ID NO: 101600 - DNA, 601 bp, Human; identical to SEQ ID NO: 96508

SEQ ID NO: 101601 - DNA, 601 bp, Human; identical to SEQ ID NO: 96509

SEQ ID NO: 101602 - DNA, 601 bp, Human; identical to SEQ ID NO: 96510

SEQ ID NO: 101603 - DNA, 601 bp, Human; identical to SEQ ID NO: 96511

SEQ ID NO: 101604 - DNA, 601 bp, Human; identical to SEQ ID NO: 96512

SEQ ID NO: 101605 - DNA, 601 bp, Human; identical to SEQ ID NO: 96513

SEQ ID NO: 101606 - DNA, 601 bp, Human; identical to SEQ ID NO: 96514

SEQ ID NO: 101607 - DNA, 601 bp, Human; identical to SEQ ID NO: 96515

SEQ ID NO: 101608 - DNA, 601 bp, Human; identical to SEQ ID NO: 96516

SEQ ID NO: 101609 - DNA, 601 bp, Human; identical to SEQ ID NO: 96517

SEQ ID NO: 101610 - DNA, 601 bp, Human; identical to SEQ ID NO: 96518

SEQ ID NO: 101611 - DNA, 601 bp, Human; identical to SEQ ID NO: 96519

SEQ ID NO: 101612 - DNA, 601 bp, Human; identical to SEQ ID NO: 96520

SEQ ID NO: 101613 - DNA, 601 bp, Human; identical to SEQ ID NO: 96521

SEQ ID NO: 101614 - DNA, 601 bp, Human; identical to SEQ ID NO: 96522

SEQ ID NO: 101615 - DNA, 601 bp, Human; identical to SEQ ID NO: 96523

SEQ ID NO: 101616 - DNA, 601 bp, Human; identical to SEQ ID NO: 96524

SEQ ID NO: 101617 - DNA, 601 bp, Human; identical to SEQ ID NO: 96525

SEQ ID NO: 101618 - DNA, 601 bp, Human; identical to SEQ ID NO: 96526

SEQ ID NO: 101619 - DNA, 601 bp, Human; identical to SEQ ID NO: 96527

SEQ ID NO: 101620 - DNA, 601 bp, Human; identical to SEQ ID NO: 96528

SEQ ID NO: 101621 - DNA, 601 bp, Human; identical to SEQ ID NO: 96529

SEQ ID NO: 101622 - DNA, 601 bp, Human; identical to SEQ ID NO: 96530

SEQ ID NO: 101623 - DNA, 601 bp, Human; identical to SEQ ID NO: 96531

SEQ ID NO: 101624 - DNA, 601 bp, Human; identical to SEQ ID NO: 96532

SEQ ID NO: 101625 - DNA, 601 bp, Human; identical to SEQ ID NO: 96533

SEQ ID NO: 101626 - DNA, 601 bp, Human; identical to SEQ ID NO: 96534

SEQ ID NO: 101627 - DNA, 601 bp, Human; identical to SEQ ID NO: 96535

SEQ ID NO: 101628 - DNA, 601 bp, Human; identical to SEQ ID NO: 96536

SEQ ID NO: 101629 - DNA, 601 bp, Human; identical to SEQ ID NO: 96537

SEQ ID NO: 101630 - DNA, 601 bp, Human; identical to SEQ ID NO: 96538

SEQ ID NO: 101631 - DNA, 601 bp, Human; identical to SEQ ID NO: 96539

SEQ ID NO: 101632 - DNA, 601 bp, Human; identical to SEQ ID NO: 96540

SEQ ID NO: 101633 - DNA, 601 bp, Human; identical to SEQ ID NO: 96541

SEQ ID NO: 101634 - DNA, 601 bp, Human; identical to SEQ ID NO: 96542

SEQ ID NO: 101635 - DNA, 601 bp, Human; identical to SEQ ID NO: 96543

SEQ ID NO: 101636 - DNA, 601 bp, Human; identical to SEQ ID NO: 96544

SEQ ID NO: 101637 - DNA, 601 bp, Human; identical to SEQ ID NO: 96545

SEQ ID NO: 101638 - DNA, 601 bp, Human; identical to SEQ ID NO: 96546

SEQ ID NO: 101639 - DNA, 601 bp, Human; identical to SEQ ID NO: 96547

SEQ ID NO: 101640 - DNA, 601 bp, Human; identical to SEQ ID NO: 96548

SEQ ID NO: 101641 - DNA, 601 bp, Human; identical to SEQ ID NO: 96549

SEQ ID NO: 101642 - DNA, 601 bp, Human; identical to SEQ ID NO: 96550

SEQ ID NO: 101643 - DNA, 601 bp, Human; identical to SEQ ID NO: 96551

SEQ ID NO: 101644 - DNA, 601 bp, Human; identical to SEQ ID NO: 96552

SEQ ID NO: 101645 - DNA, 601 bp, Human; identical to SEQ ID NO: 96553

SEQ ID NO: 101646 - DNA, 601 bp, Human; identical to SEQ ID NO: 96554

SEQ ID NO: 101647 - DNA, 601 bp, Human; identical to SEQ ID NO: 96555

SEQ ID NO: 101648 - DNA, 601 bp, Human; identical to SEQ ID NO: 96556

SEQ ID NO: 101649 - DNA, 601 bp, Human; identical to SEQ ID NO: 96557

SEQ ID NO: 101650 - DNA, 601 bp, Human; identical to SEQ ID NO: 96558

SEQ ID NO: 101651 - DNA, 601 bp, Human; identical to SEQ ID NO: 96559

SEQ ID NO: 101652 - DNA, 601 bp, Human; identical to SEQ ID NO: 96560

SEQ ID NO: 101653 - DNA, 601 bp, Human; identical to SEQ ID NO: 96561

SEQ ID NO: 101654 - DNA, 601 bp, Human; identical to SEQ ID NO: 96562

SEQ ID NO: 101655 - DNA, 601 bp, Human; identical to SEQ ID NO: 96563

SEQ ID NO: 101656 - DNA, 601 bp, Human; identical to SEQ ID NO: 96564

SEQ ID NO: 101657 - DNA, 601 bp, Human; identical to SEQ ID NO: 96565

SEQ ID NO: 101658 - DNA, 601 bp, Human; identical to SEQ ID NO: 96566

SEQ ID NO: 101659 - DNA, 601 bp, Human; identical to SEQ ID NO: 96567

SEQ ID NO: 101660 - DNA, 601 bp, Human; identical to SEQ ID NO: 96568

SEQ ID NO: 101661 - DNA, 601 bp, Human; identical to SEQ ID NO: 96569

SEQ ID NO: 101662 - DNA, 601 bp, Human; identical to SEQ ID NO: 96570

SEQ ID NO: 101663 - DNA, 601 bp, Human; identical to SEQ ID NO: 96571

SEQ ID NO: 101664 - DNA, 601 bp, Human; identical to SEQ ID NO: 96572

SEQ ID NO: 101665 - DNA, 601 bp, Human; identical to SEQ ID NO: 96573

SEQ ID NO: 101666 - DNA, 601 bp, Human; identical to SEQ ID NO: 96574

SEQ ID NO: 101667 - DNA, 601 bp, Human; identical to SEQ ID NO: 96575

SEQ ID NO: 101668 - DNA, 601 bp, Human; identical to SEQ ID NO: 96576

SEQ ID NO: 101669 - DNA, 601 bp, Human; identical to SEQ ID NO: 96577

SEQ ID NO: 101670 - DNA, 601 bp, Human; identical to SEQ ID NO: 96578

SEQ ID NO: 101671 - DNA, 601 bp, Human; identical to SEQ ID NO: 96579

SEQ ID NO: 101672 - DNA, 601 bp, Human; identical to SEQ ID NO: 96580

SEQ ID NO: 101673 - DNA, 601 bp, Human; identical to SEQ ID NO: 96581

SEQ ID NO: 101674 - DNA, 601 bp, Human; identical to SEQ ID NO: 96582

SEQ ID NO: 101675 - DNA, 601 bp, Human; identical to SEQ ID NO: 96583

SEQ ID NO: 101676 - DNA, 601 bp, Human; identical to SEQ ID NO: 96584

SEQ ID NO: 101677 - DNA, 417 bp, Human; identical to SEQ ID NO: 96585

SEQ ID NO: 101678 - DNA, 480 bp, Human; identical to SEQ ID NO: 96586

SEQ ID NO: 101679 - DNA, 601 bp, Human; identical to SEQ ID NO: 96587

SEQ ID NO: 101680 - DNA, 601 bp, Human; identical to SEQ ID NO: 96588

SEQ ID NO: 101681 - DNA, 601 bp, Human; identical to SEQ ID NO: 96589

SEQ ID NO: 101682 - DNA, 601 bp, Human; identical to SEQ ID NO: 96590

SEQ ID NO: 101683 - DNA, 601 bp, Human; identical to SEQ ID NO: 96591

SEQ ID NO: 101684 - DNA, 601 bp, Human; identical to SEQ ID NO: 96592

SEQ ID NO: 101685 - DNA, 601 bp, Human; identical to SEQ ID NO: 96593

SEQ ID NO: 101686 - DNA, 601 bp, Human; identical to SEQ ID NO: 96594

SEQ ID NO: 101687 - DNA, 601 bp, Human; identical to SEQ ID NO: 96595

SEQ ID NO: 101688 - DNA, 601 bp, Human; identical to SEQ ID NO: 96596

SEQ ID NO: 101689 - DNA, 601 bp, Human; identical to SEQ ID NO: 96597

SEQ ID NO: 101690 - DNA, 601 bp, Human; identical to SEQ ID NO: 96598

SEQ ID NO: 101691 - DNA, 601 bp, Human; identical to SEQ ID NO: 96599

SEQ ID NO: 101692 - DNA, 601 bp, Human; identical to SEQ ID NO: 96600

SEQ ID NO: 101693 - DNA, 601 bp, Human; identical to SEQ ID NO: 96601

SEQ ID NO: 101694 - DNA, 601 bp, Human; identical to SEQ ID NO: 96602

SEQ ID NO: 101695 - DNA, 601 bp, Human; identical to SEQ ID NO: 96603

SEQ ID NO: 101696 - DNA, 601 bp, Human; identical to SEQ ID NO: 96604

SEQ ID NO: 101697 - DNA, 601 bp, Human; identical to SEQ ID NO: 96605

SEQ ID NO: 101698 - DNA, 601 bp, Human; identical to SEQ ID NO: 96606

SEQ ID NO: 101699 - DNA, 601 bp, Human; identical to SEQ ID NO: 96607

SEQ ID NO: 101700 - DNA, 601 bp, Human; identical to SEQ ID NO: 96608

SEQ ID NO: 101701 - DNA, 601 bp, Human; identical to SEQ ID NO: 96609

SEQ ID NO: 101702 - DNA, 601 bp, Human; identical to SEQ ID NO: 96610

SEQ ID NO: 101703 - DNA, 601 bp, Human; identical to SEQ ID NO: 96611

SEQ ID NO: 101704 - DNA, 601 bp, Human; identical to SEQ ID NO: 96612

SEQ ID NO: 101705 - DNA, 601 bp, Human; identical to SEQ ID NO: 96613

SEQ ID NO: 101706 - DNA, 601 bp, Human; identical to SEQ ID NO: 96614

SEQ ID NO: 101707 - DNA, 601 bp, Human; identical to SEQ ID NO: 96615

SEQ ID NO: 101708 - DNA, 601 bp, Human; identical to SEQ ID NO: 96616

SEQ ID NO: 101709 - DNA, 601 bp, Human; identical to SEQ ID NO: 96617

SEQ ID NO: 101710 - DNA, 601 bp, Human; identical to SEQ ID NO: 96618

SEQ ID NO: 101711 - DNA, 601 bp, Human; identical to SEQ ID NO: 96619

SEQ ID NO: 101712 - DNA, 601 bp, Human; identical to SEQ ID NO: 96620

SEQ ID NO: 101713 - DNA, 601 bp, Human; identical to SEQ ID NO: 96621

SEQ ID NO: 101714 - DNA, 601 bp, Human; identical to SEQ ID NO: 96622

SEQ ID NO: 101715 - DNA, 601 bp, Human; identical to SEQ ID NO: 96623

SEQ ID NO: 101716 - DNA, 601 bp, Human; identical to SEQ ID NO: 96624

SEQ ID NO: 101717 - DNA, 601 bp, Human; identical to SEQ ID NO: 96625

SEQ ID NO: 101718 - DNA, 601 bp, Human; identical to SEQ ID NO: 96626

SEQ ID NO: 101719 - DNA, 601 bp, Human; identical to SEQ ID NO: 96627

SEQ ID NO: 101720 - DNA, 601 bp, Human; identical to SEQ ID NO: 96628

SEQ ID NO: 101721 - DNA, 601 bp, Human; identical to SEQ ID NO: 96629

SEQ ID NO: 101722 - DNA, 601 bp, Human; identical to SEQ ID NO: 96630

SEQ ID NO: 101723 - DNA, 601 bp, Human; identical to SEQ ID NO: 96631

SEQ ID NO: 101724 - DNA, 601 bp, Human; identical to SEQ ID NO: 96632

SEQ ID NO: 101725 - DNA, 601 bp, Human; identical to SEQ ID NO: 96633

SEQ ID NO: 101726 - DNA, 601 bp, Human; identical to SEQ ID NO: 96634

SEQ ID NO: 101727 - DNA, 601 bp, Human; identical to SEQ ID NO: 96635

SEQ ID NO: 101728 - DNA, 601 bp, Human; identical to SEQ ID NO: 96636

SEQ ID NO: 101729 - DNA, 601 bp, Human; identical to SEQ ID NO: 96637

SEQ ID NO: 101730 - DNA, 601 bp, Human; identical to SEQ ID NO: 96638

SEQ ID NO: 101731 - DNA, 601 bp, Human; identical to SEQ ID NO: 96639

SEQ ID NO: 101732 - DNA, 601 bp, Human; identical to SEQ ID NO: 96640

SEQ ID NO: 101733 - DNA, 601 bp, Human; identical to SEQ ID NO: 96375

SEQ ID NO: 101734 - DNA, 601 bp, Human; identical to SEQ ID NO: 96376

SEQ ID NO: 101735 - DNA, 601 bp, Human; identical to SEQ ID NO: 96377

SEQ ID NO: 101736 - DNA, 601 bp, Human; identical to SEQ ID NO: 96378

SEQ ID NO: 101737 - DNA, 601 bp, Human; identical to SEQ ID NO: 96379

SEQ ID NO: 101738 - DNA, 601 bp, Human; identical to SEQ ID NO: 96380

SEQ ID NO: 101739 - DNA, 601 bp, Human; identical to SEQ ID NO: 96381

SEQ ID NO: 101740 - DNA, 601 bp, Human; identical to SEQ ID NO: 96382

SEQ ID NO: 101741 - DNA, 601 bp, Human; identical to SEQ ID NO: 96383

SEQ ID NO: 101742 - DNA, 601 bp, Human; identical to SEQ ID NO: 96384

SEQ ID NO: 101743 - DNA, 601 bp, Human; identical to SEQ ID NO: 96385

SEQ ID NO: 101744 - DNA, 601 bp, Human; identical to SEQ ID NO: 96386

SEQ ID NO: 101745 - DNA, 601 bp, Human; identical to SEQ ID NO: 96387

SEQ ID NO: 101746 - DNA, 601 bp, Human; identical to SEQ ID NO: 96388

SEQ ID NO: 101747 - DNA, 601 bp, Human; identical to SEQ ID NO: 96389

SEQ ID NO: 101748 - DNA, 601 bp, Human; identical to SEQ ID NO: 96390

SEQ ID NO: 101749 - DNA, 601 bp, Human; identical to SEQ ID NO: 96391

SEQ ID NO: 101750 - DNA, 601 bp, Human; identical to SEQ ID NO: 96392

SEQ ID NO: 101751 - DNA, 601 bp, Human; identical to SEQ ID NO: 96393

SEQ ID NO: 101752 - DNA, 601 bp, Human; identical to SEQ ID NO: 96394

SEQ ID NO: 101753 - DNA, 601 bp, Human; identical to SEQ ID NO: 96395

SEQ ID NO: 101754 - DNA, 601 bp, Human; identical to SEQ ID NO: 96396

SEQ ID NO: 101755 - DNA, 601 bp, Human; identical to SEQ ID NO: 96397

SEQ ID NO: 101756 - DNA, 601 bp, Human; identical to SEQ ID NO: 96398

SEQ ID NO: 101757 - DNA, 601 bp, Human; identical to SEQ ID NO: 96399

SEQ ID NO: 101758 - DNA, 601 bp, Human; identical to SEQ ID NO: 96400

SEQ ID NO: 101759 - DNA, 601 bp, Human; identical to SEQ ID NO: 96401

SEQ ID NO: 101760 - DNA, 601 bp, Human; identical to SEQ ID NO: 96402

SEQ ID NO: 101761 - DNA, 601 bp, Human; identical to SEQ ID NO: 96403

SEQ ID NO: 101762 - DNA, 601 bp, Human; identical to SEQ ID NO: 96404

SEQ ID NO: 101763 - DNA, 601 bp, Human; identical to SEQ ID NO: 96405

SEQ ID NO: 101764 - DNA, 601 bp, Human; identical to SEQ ID NO: 96406

SEQ ID NO: 101765 - DNA, 601 bp, Human; identical to SEQ ID NO: 96407

SEQ ID NO: 101766 - DNA, 601 bp, Human; identical to SEQ ID NO: 96408

SEQ ID NO: 101767 - DNA, 601 bp, Human; identical to SEQ ID NO: 96409

SEQ ID NO: 101768 - DNA, 601 bp, Human; identical to SEQ ID NO: 96410

SEQ ID NO: 101769 - DNA, 601 bp, Human; identical to SEQ ID NO: 96411

SEQ ID NO: 101770 - DNA, 601 bp, Human; identical to SEQ ID NO: 96412

SEQ ID NO: 101771 - DNA, 601 bp, Human; identical to SEQ ID NO: 96413

SEQ ID NO: 101772 - DNA, 601 bp, Human; identical to SEQ ID NO: 96414

SEQ ID NO: 101773 - DNA, 601 bp, Human; identical to SEQ ID NO: 96415

SEQ ID NO: 101774 - DNA, 601 bp, Human; identical to SEQ ID NO: 96416

SEQ ID NO: 101775 - DNA, 601 bp, Human; identical to SEQ ID NO: 96417

SEQ ID NO: 101776 - DNA, 601 bp, Human; identical to SEQ ID NO: 96418

SEQ ID NO: 101777 - DNA, 601 bp, Human; identical to SEQ ID NO: 96419

SEQ ID NO: 101778 - DNA, 601 bp, Human; identical to SEQ ID NO: 96420

SEQ ID NO: 101779 - DNA, 601 bp, Human; identical to SEQ ID NO: 96421

SEQ ID NO: 101780 - DNA, 601 bp, Human; identical to SEQ ID NO: 96422

SEQ ID NO: 101781 - DNA, 601 bp, Human; identical to SEQ ID NO: 96423

SEQ ID NO: 101782 - DNA, 601 bp, Human; identical to SEQ ID NO: 96424

SEQ ID NO: 101783 - DNA, 601 bp, Human; identical to SEQ ID NO: 96425

SEQ ID NO: 101784 - DNA, 601 bp, Human; identical to SEQ ID NO: 96426

SEQ ID NO: 101785 - DNA, 601 bp, Human; identical to SEQ ID NO: 96427

SEQ ID NO: 101786 - DNA, 601 bp, Human; identical to SEQ ID NO: 96428

SEQ ID NO: 101787 - DNA, 601 bp, Human; identical to SEQ ID NO: 96429

SEQ ID NO: 101788 - DNA, 601 bp, Human; identical to SEQ ID NO: 96430

SEQ ID NO: 101789 - DNA, 601 bp, Human; identical to SEQ ID NO: 96431

SEQ ID NO: 101790 - DNA, 601 bp, Human; identical to SEQ ID NO: 96432

SEQ ID NO: 101791 - DNA, 601 bp, Human; identical to SEQ ID NO: 96433

SEQ ID NO: 101792 - DNA, 601 bp, Human; identical to SEQ ID NO: 96434

SEQ ID NO: 101793 - DNA, 601 bp, Human; identical to SEQ ID NO: 96435

SEQ ID NO: 101794 - DNA, 601 bp, Human; identical to SEQ ID NO: 96436

SEQ ID NO: 101795 - DNA, 601 bp, Human; identical to SEQ ID NO: 96437

SEQ ID NO: 101796 - DNA, 601 bp, Human; identical to SEQ ID NO: 96438

SEQ ID NO: 101797 - DNA, 601 bp, Human; identical to SEQ ID NO: 96439

SEQ ID NO: 101798 - DNA, 601 bp, Human; identical to SEQ ID NO: 96440

SEQ ID NO: 101799 - DNA, 601 bp, Human; identical to SEQ ID NO: 96441

SEQ ID NO: 101800 - DNA, 601 bp, Human; identical to SEQ ID NO: 96442

SEQ ID NO: 101801 - DNA, 601 bp, Human; identical to SEQ ID NO: 96443

SEQ ID NO: 101802 - DNA, 601 bp, Human; identical to SEQ ID NO: 96444

SEQ ID NO: 101803 - DNA, 601 bp, Human; identical to SEQ ID NO: 96445

SEQ ID NO: 101804 - DNA, 601 bp, Human; identical to SEQ ID NO: 96446

SEQ ID NO: 101805 - DNA, 601 bp, Human; identical to SEQ ID NO: 96447

SEQ ID NO: 101806 - DNA, 601 bp, Human; identical to SEQ ID NO: 96448

SEQ ID NO: 101807 - DNA, 601 bp, Human; identical to SEQ ID NO: 96449

SEQ ID NO: 101808 - DNA, 601 bp, Human; identical to SEQ ID NO: 96450

SEQ ID NO: 101809 - DNA, 601 bp, Human; identical to SEQ ID NO: 96451

SEQ ID NO: 101810 - DNA, 601 bp, Human; identical to SEQ ID NO: 96452

SEQ ID NO: 101811 - DNA, 601 bp, Human; identical to SEQ ID NO: 96453

SEQ ID NO: 101812 - DNA, 601 bp, Human; identical to SEQ ID NO: 96454

SEQ ID NO: 101813 - DNA, 601 bp, Human; identical to SEQ ID NO: 96455

SEQ ID NO: 101814 - DNA, 601 bp, Human; identical to SEQ ID NO: 96456

SEQ ID NO: 101815 - DNA, 601 bp, Human; identical to SEQ ID NO: 96457

SEQ ID NO: 101816 - DNA, 601 bp, Human; identical to SEQ ID NO: 96458

SEQ ID NO: 101817 - DNA, 601 bp, Human; identical to SEQ ID NO: 96459

SEQ ID NO: 101818 - DNA, 601 bp, Human; identical to SEQ ID NO: 96460

SEQ ID NO: 101819 - DNA, 601 bp, Human; identical to SEQ ID NO: 96461

SEQ ID NO: 101820 - DNA, 601 bp, Human; identical to SEQ ID NO: 96462

SEQ ID NO: 101821 - DNA, 601 bp, Human; identical to SEQ ID NO: 96463

SEQ ID NO: 101822 - DNA, 601 bp, Human; identical to SEQ ID NO: 96464

SEQ ID NO: 101823 - DNA, 601 bp, Human; identical to SEQ ID NO: 96465

SEQ ID NO: 101824 - DNA, 601 bp, Human; identical to SEQ ID NO: 96466

SEQ ID NO: 101825 - DNA, 601 bp, Human; identical to SEQ ID NO: 96467

SEQ ID NO: 101826 - DNA, 601 bp, Human; identical to SEQ ID NO: 96468

SEQ ID NO: 101827 - DNA, 601 bp, Human; identical to SEQ ID NO: 96469

SEQ ID NO: 101828 - DNA, 601 bp, Human; identical to SEQ ID NO: 96470

SEQ ID NO: 101829 - DNA, 601 bp, Human; identical to SEQ ID NO: 96471

SEQ ID NO: 101830 - DNA, 601 bp, Human; identical to SEQ ID NO: 96472

SEQ ID NO: 101831 - DNA, 601 bp, Human; identical to SEQ ID NO: 96473

SEQ ID NO: 101832 - DNA, 601 bp, Human; identical to SEQ ID NO: 96474

SEQ ID NO: 101833 - DNA, 601 bp, Human; identical to SEQ ID NO: 96475

SEQ ID NO: 101834 - DNA, 601 bp, Human; identical to SEQ ID NO: 96476

SEQ ID NO: 101835 - DNA, 601 bp, Human; identical to SEQ ID NO: 96477

SEQ ID NO: 101836 - DNA, 601 bp, Human; identical to SEQ ID NO: 96478

SEQ ID NO: 101837 - DNA, 601 bp, Human; identical to SEQ ID NO: 96479

SEQ ID NO: 101838 - DNA, 601 bp, Human; identical to SEQ ID NO: 96480

SEQ ID NO: 101839 - DNA, 601 bp, Human; identical to SEQ ID NO: 96481

SEQ ID NO: 101840 - DNA, 601 bp, Human; identical to SEQ ID NO: 96482

SEQ ID NO: 101841 - DNA, 601 bp, Human; identical to SEQ ID NO: 96483

SEQ ID NO: 101842 - DNA, 601 bp, Human; identical to SEQ ID NO: 96484

SEQ ID NO: 101843 - DNA, 601 bp, Human; identical to SEQ ID NO: 96485

SEQ ID NO: 101844 - DNA, 601 bp, Human; identical to SEQ ID NO: 96486

SEQ ID NO: 101845 - DNA, 601 bp, Human; identical to SEQ ID NO: 96487

SEQ ID NO: 101846 - DNA, 601 bp, Human; identical to SEQ ID NO: 96488

SEQ ID NO: 101847 - DNA, 601 bp, Human; identical to SEQ ID NO: 96489

SEQ ID NO: 101848 - DNA, 601 bp, Human; identical to SEQ ID NO: 96490

SEQ ID NO: 101849 - DNA, 601 bp, Human; identical to SEQ ID NO: 96491

SEQ ID NO: 101850 - DNA, 601 bp, Human; identical to SEQ ID NO: 96492

SEQ ID NO: 101851 - DNA, 601 bp, Human; identical to SEQ ID NO: 96493

SEQ ID NO: 101852 - DNA, 601 bp, Human; identical to SEQ ID NO: 96494

SEQ ID NO: 101853 - DNA, 601 bp, Human; identical to SEQ ID NO: 96495

SEQ ID NO: 101854 - DNA, 601 bp, Human; identical to SEQ ID NO: 96496

SEQ ID NO: 101855 - DNA, 601 bp, Human; identical to SEQ ID NO: 96497

SEQ ID NO: 101856 - DNA, 601 bp, Human; identical to SEQ ID NO: 96498

SEQ ID NO: 101857 - DNA, 601 bp, Human; identical to SEQ ID NO: 96499

SEQ ID NO: 101858 - DNA, 601 bp, Human; identical to SEQ ID NO: 96500

SEQ ID NO: 101859 - DNA, 601 bp, Human; identical to SEQ ID NO: 96501

SEQ ID NO: 101860 - DNA, 601 bp, Human; identical to SEQ ID NO: 96502

SEQ ID NO: 101861 - DNA, 601 bp, Human; identical to SEQ ID NO: 96503

SEQ ID NO: 101862 - DNA, 601 bp, Human; identical to SEQ ID NO: 96504

SEQ ID NO: 101863 - DNA, 601 bp, Human; identical to SEQ ID NO: 96505

SEQ ID NO: 101864 - DNA, 601 bp, Human; identical to SEQ ID NO: 96506

SEQ ID NO: 101865 - DNA, 601 bp, Human; identical to SEQ ID NO: 96507

SEQ ID NO: 101866 - DNA, 601 bp, Human; identical to SEQ ID NO: 96508

SEQ ID NO: 101867 - DNA, 601 bp, Human; identical to SEQ ID NO: 96509

SEQ ID NO: 101868 - DNA, 601 bp, Human; identical to SEQ ID NO: 96510

SEQ ID NO: 101869 - DNA, 601 bp, Human; identical to SEQ ID NO: 96511

SEQ ID NO: 101870 - DNA, 601 bp, Human; identical to SEQ ID NO: 96512

SEQ ID NO: 101871 - DNA, 601 bp, Human; identical to SEQ ID NO: 96513

SEQ ID NO: 101872 - DNA, 601 bp, Human; identical to SEQ ID NO: 96514

SEQ ID NO: 101873 - DNA, 601 bp, Human; identical to SEQ ID NO: 96515

SEQ ID NO: 101874 - DNA, 601 bp, Human; identical to SEQ ID NO: 96516

SEQ ID NO: 101875 - DNA, 601 bp, Human; identical to SEQ ID NO: 96517

SEQ ID NO: 101876 - DNA, 601 bp, Human; identical to SEQ ID NO: 96518

SEQ ID NO: 101877 - DNA, 601 bp, Human; identical to SEQ ID NO: 96519

SEQ ID NO: 101878 - DNA, 601 bp, Human; identical to SEQ ID NO: 96520

SEQ ID NO: 101879 - DNA, 601 bp, Human; identical to SEQ ID NO: 96521

SEQ ID NO: 101880 - DNA, 601 bp, Human; identical to SEQ ID NO: 96522

SEQ ID NO: 101881 - DNA, 601 bp, Human; identical to SEQ ID NO: 96523

SEQ ID NO: 101882 - DNA, 601 bp, Human; identical to SEQ ID NO: 96524

SEQ ID NO: 101883 - DNA, 601 bp, Human; identical to SEQ ID NO: 96525

SEQ ID NO: 101884 - DNA, 601 bp, Human; identical to SEQ ID NO: 96526

SEQ ID NO: 101885 - DNA, 601 bp, Human; identical to SEQ ID NO: 96527

SEQ ID NO: 101886 - DNA, 601 bp, Human; identical to SEQ ID NO: 96528

SEQ ID NO: 101887 - DNA, 601 bp, Human; identical to SEQ ID NO: 96529

SEQ ID NO: 101888 - DNA, 601 bp, Human; identical to SEQ ID NO: 96530

SEQ ID NO: 101889 - DNA, 601 bp, Human; identical to SEQ ID NO: 96531

SEQ ID NO: 101890 - DNA, 601 bp, Human; identical to SEQ ID NO: 96532

SEQ ID NO: 101891 - DNA, 601 bp, Human; identical to SEQ ID NO: 96533

SEQ ID NO: 101892 - DNA, 601 bp, Human; identical to SEQ ID NO: 96534

SEQ ID NO: 101893 - DNA, 601 bp, Human; identical to SEQ ID NO: 96535

SEQ ID NO: 101894 - DNA, 601 bp, Human; identical to SEQ ID NO: 96536

SEQ ID NO: 101895 - DNA, 601 bp, Human; identical to SEQ ID NO: 96537

SEQ ID NO: 101896 - DNA, 601 bp, Human; identical to SEQ ID NO: 96538

SEQ ID NO: 101897 - DNA, 601 bp, Human; identical to SEQ ID NO: 96539

SEQ ID NO: 101898 - DNA, 601 bp, Human; identical to SEQ ID NO: 96540

SEQ ID NO: 101899 - DNA, 601 bp, Human; identical to SEQ ID NO: 96541

SEQ ID NO: 101900 - DNA, 601 bp, Human; identical to SEQ ID NO: 96542

SEQ ID NO: 101901 - DNA, 601 bp, Human; identical to SEQ ID NO: 96543

SEQ ID NO: 101902 - DNA, 601 bp, Human; identical to SEQ ID NO: 96544

SEQ ID NO: 101903 - DNA, 601 bp, Human; identical to SEQ ID NO: 96545

SEQ ID NO: 101904 - DNA, 601 bp, Human; identical to SEQ ID NO: 96546

SEQ ID NO: 101905 - DNA, 601 bp, Human; identical to SEQ ID NO: 96547

SEQ ID NO: 101906 - DNA, 601 bp, Human; identical to SEQ ID NO: 96548

SEQ ID NO: 101907 - DNA, 601 bp, Human; identical to SEQ ID NO: 96549

SEQ ID NO: 101908 - DNA, 601 bp, Human; identical to SEQ ID NO: 96550

SEQ ID NO: 101909 - DNA, 601 bp, Human; identical to SEQ ID NO: 96551

SEQ ID NO: 101910 - DNA, 601 bp, Human; identical to SEQ ID NO: 96552

SEQ ID NO: 101911 - DNA, 601 bp, Human; identical to SEQ ID NO: 96553

SEQ ID NO: 101912 - DNA, 601 bp, Human; identical to SEQ ID NO: 96554

SEQ ID NO: 101913 - DNA, 601 bp, Human; identical to SEQ ID NO: 96555

SEQ ID NO: 101914 - DNA, 601 bp, Human; identical to SEQ ID NO: 96556

SEQ ID NO: 101915 - DNA, 601 bp, Human; identical to SEQ ID NO: 96557

SEQ ID NO: 101916 - DNA, 601 bp, Human; identical to SEQ ID NO: 96558

SEQ ID NO: 101917 - DNA, 601 bp, Human; identical to SEQ ID NO: 96559

SEQ ID NO: 101918 - DNA, 601 bp, Human; identical to SEQ ID NO: 96560

SEQ ID NO: 101919 - DNA, 601 bp, Human; identical to SEQ ID NO: 96561

SEQ ID NO: 101920 - DNA, 601 bp, Human; identical to SEQ ID NO: 96562

SEQ ID NO: 101921 - DNA, 601 bp, Human; identical to SEQ ID NO: 96563

SEQ ID NO: 101922 - DNA, 601 bp, Human; identical to SEQ ID NO: 96564

SEQ ID NO: 101923 - DNA, 601 bp, Human; identical to SEQ ID NO: 96565

SEQ ID NO: 101924 - DNA, 601 bp, Human; identical to SEQ ID NO: 96566

SEQ ID NO: 101925 - DNA, 601 bp, Human; identical to SEQ ID NO: 96567

SEQ ID NO: 101926 - DNA, 601 bp, Human; identical to SEQ ID NO: 96568

SEQ ID NO: 101927 - DNA, 601 bp, Human; identical to SEQ ID NO: 96569

SEQ ID NO: 101928 - DNA, 601 bp, Human; identical to SEQ ID NO: 96570

SEQ ID NO: 101929 - DNA, 601 bp, Human; identical to SEQ ID NO: 96571

SEQ ID NO: 101930 - DNA, 601 bp, Human; identical to SEQ ID NO: 96572

SEQ ID NO: 101931 - DNA, 601 bp, Human; identical to SEQ ID NO: 96573

SEQ ID NO: 101932 - DNA, 601 bp, Human; identical to SEQ ID NO: 96574

SEQ ID NO: 101933 - DNA, 601 bp, Human; identical to SEQ ID NO: 96575

SEQ ID NO: 101934 - DNA, 601 bp, Human; identical to SEQ ID NO: 96576

SEQ ID NO: 101935 - DNA, 601 bp, Human; identical to SEQ ID NO: 96577

SEQ ID NO: 101936 - DNA, 601 bp, Human; identical to SEQ ID NO: 96578

SEQ ID NO: 101937 - DNA, 601 bp, Human; identical to SEQ ID NO: 96579

SEQ ID NO: 101938 - DNA, 601 bp, Human; identical to SEQ ID NO: 96580

SEQ ID NO: 101939 - DNA, 601 bp, Human; identical to SEQ ID NO: 96581

SEQ ID NO: 101940 - DNA, 601 bp, Human; identical to SEQ ID NO: 96582

SEQ ID NO: 101941 - DNA, 601 bp, Human; identical to SEQ ID NO: 96583

SEQ ID NO: 101942 - DNA, 601 bp, Human; identical to SEQ ID NO: 96584

SEQ ID NO: 101943 - DNA, 417 bp, Human; identical to SEQ ID NO: 96585

SEQ ID NO: 101944 - DNA, 480 bp, Human; identical to SEQ ID NO: 96586

SEQ ID NO: 101945 - DNA, 601 bp, Human; identical to SEQ ID NO: 96587

SEQ ID NO: 101946 - DNA, 601 bp, Human; identical to SEQ ID NO: 96588

SEQ ID NO: 101947 - DNA, 601 bp, Human; identical to SEQ ID NO: 96589

SEQ ID NO: 101948 - DNA, 601 bp, Human; identical to SEQ ID NO: 96590

SEQ ID NO: 101949 - DNA, 601 bp, Human; identical to SEQ ID NO: 96591

SEQ ID NO: 101950 - DNA, 601 bp, Human; identical to SEQ ID NO: 96592

SEQ ID NO: 101951 - DNA, 601 bp, Human; identical to SEQ ID NO: 96593

SEQ ID NO: 101952 - DNA, 601 bp, Human; identical to SEQ ID NO: 96594

SEQ ID NO: 101953 - DNA, 601 bp, Human; identical to SEQ ID NO: 96595

SEQ ID NO: 101954 - DNA, 601 bp, Human; identical to SEQ ID NO: 96596

SEQ ID NO: 101955 - DNA, 601 bp, Human; identical to SEQ ID NO: 96597

SEQ ID NO: 101956 - DNA, 601 bp, Human; identical to SEQ ID NO: 96598

SEQ ID NO: 101957 - DNA, 601 bp, Human; identical to SEQ ID NO: 96599

SEQ ID NO: 101958 - DNA, 601 bp, Human; identical to SEQ ID NO: 96600

SEQ ID NO: 101959 - DNA, 601 bp, Human; identical to SEQ ID NO: 96601

SEQ ID NO: 101960 - DNA, 601 bp, Human; identical to SEQ ID NO: 96602

SEQ ID NO: 101961 - DNA, 601 bp, Human; identical to SEQ ID NO: 96603

SEQ ID NO: 101962 - DNA, 601 bp, Human; identical to SEQ ID NO: 96604

SEQ ID NO: 101963 - DNA, 601 bp, Human; identical to SEQ ID NO: 96605

SEQ ID NO: 101964 - DNA, 601 bp, Human; identical to SEQ ID NO: 96606

SEQ ID NO: 101965 - DNA, 601 bp, Human; identical to SEQ ID NO: 96607

SEQ ID NO: 101966 - DNA, 601 bp, Human; identical to SEQ ID NO: 96608

SEQ ID NO: 101967 - DNA, 601 bp, Human; identical to SEQ ID NO: 96609

SEQ ID NO: 101968 - DNA, 601 bp, Human; identical to SEQ ID NO: 96610

SEQ ID NO: 101969 - DNA, 601 bp, Human; identical to SEQ ID NO: 96611

SEQ ID NO: 101970 - DNA, 601 bp, Human; identical to SEQ ID NO: 96612

SEQ ID NO: 101971 - DNA, 601 bp, Human; identical to SEQ ID NO: 96613

SEQ ID NO: 101972 - DNA, 601 bp, Human; identical to SEQ ID NO: 96614

SEQ ID NO: 101973 - DNA, 601 bp, Human; identical to SEQ ID NO: 96615

SEQ ID NO: 101974 - DNA, 601 bp, Human; identical to SEQ ID NO: 96616

SEQ ID NO: 101975 - DNA, 601 bp, Human; identical to SEQ ID NO: 96617

SEQ ID NO: 101976 - DNA, 601 bp, Human; identical to SEQ ID NO: 96618

SEQ ID NO: 101977 - DNA, 601 bp, Human; identical to SEQ ID NO: 96619

SEQ ID NO: 101978 - DNA, 601 bp, Human; identical to SEQ ID NO: 96620

SEQ ID NO: 101979 - DNA, 601 bp, Human; identical to SEQ ID NO: 96621

SEQ ID NO: 101980 - DNA, 601 bp, Human; identical to SEQ ID NO: 96622

SEQ ID NO: 101981 - DNA, 601 bp, Human; identical to SEQ ID NO: 96623

SEQ ID NO: 101982 - DNA, 601 bp, Human; identical to SEQ ID NO: 96624

SEQ ID NO: 101983 - DNA, 601 bp, Human; identical to SEQ ID NO: 96625

SEQ ID NO: 101984 - DNA, 601 bp, Human; identical to SEQ ID NO: 96626

SEQ ID NO: 101985 - DNA, 601 bp, Human; identical to SEQ ID NO: 96627

SEQ ID NO: 101986 - DNA, 601 bp, Human; identical to SEQ ID NO: 96628

SEQ ID NO: 101987 - DNA, 601 bp, Human; identical to SEQ ID NO: 96629

SEQ ID NO: 101988 - DNA, 601 bp, Human; identical to SEQ ID NO: 96630

SEQ ID NO: 101989 - DNA, 601 bp, Human; identical to SEQ ID NO: 96631

SEQ ID NO: 101990 - DNA, 601 bp, Human; identical to SEQ ID NO: 96632

SEQ ID NO: 101991 - DNA, 601 bp, Human; identical to SEQ ID NO: 96633

SEQ ID NO: 101992 - DNA, 601 bp, Human; identical to SEQ ID NO: 96634

SEQ ID NO: 101993 - DNA, 601 bp, Human; identical to SEQ ID NO: 96635

SEQ ID NO: 101994 - DNA, 601 bp, Human; identical to SEQ ID NO: 96636

SEQ ID NO: 101995 - DNA, 601 bp, Human; identical to SEQ ID NO: 96637

SEQ ID NO: 101996 - DNA, 601 bp, Human; identical to SEQ ID NO: 96638

SEQ ID NO: 101997 - DNA, 601 bp, Human; identical to SEQ ID NO: 96639

SEQ ID NO: 101998 - DNA, 601 bp, Human; identical to SEQ ID NO: 96640

SEQ ID NO: 101999 - DNA, 417 bp, Human; identical to SEQ ID NO: 96585

SEQ ID NO: 102000 - DNA, 480 bp, Human; identical to SEQ ID NO: 96586

SEQ ID NO: 102001 - DNA, 601 bp, Human; identical to SEQ ID NO: 96587

SEQ ID NO: 102002 - DNA, 601 bp, Human; identical to SEQ ID NO: 96588

SEQ ID NO: 102003 - DNA, 601 bp, Human; identical to SEQ ID NO: 96589

SEQ ID NO: 102004 - DNA, 601 bp, Human; identical to SEQ ID NO: 96590

SEQ ID NO: 102005 - DNA, 601 bp, Human; identical to SEQ ID NO: 96591

SEQ ID NO: 102006 - DNA, 601 bp, Human; identical to SEQ ID NO: 96592

SEQ ID NO: 102007 - DNA, 601 bp, Human; identical to SEQ ID NO: 96593

SEQ ID NO: 102008 - DNA, 601 bp, Human; identical to SEQ ID NO: 96594

SEQ ID NO: 102009 - DNA, 601 bp, Human; identical to SEQ ID NO: 96595

SEQ ID NO: 102010 - DNA, 601 bp, Human; identical to SEQ ID NO: 96596

SEQ ID NO: 102011 - DNA, 601 bp, Human; identical to SEQ ID NO: 96597

SEQ ID NO: 102012 - DNA, 601 bp, Human; identical to SEQ ID NO: 96598

SEQ ID NO: 102013 - DNA, 601 bp, Human; identical to SEQ ID NO: 96599

SEQ ID NO: 102014 - DNA, 601 bp, Human; identical to SEQ ID NO: 96600

SEQ ID NO: 102015 - DNA, 601 bp, Human; identical to SEQ ID NO: 96601

SEQ ID NO: 102016 - DNA, 601 bp, Human; identical to SEQ ID NO: 96602

SEQ ID NO: 102017 - DNA, 601 bp, Human; identical to SEQ ID NO: 96603

SEQ ID NO: 102018 - DNA, 601 bp, Human; identical to SEQ ID NO: 96604

SEQ ID NO: 102019 - DNA, 601 bp, Human; identical to SEQ ID NO: 96605

SEQ ID NO: 102020 - DNA, 601 bp, Human; identical to SEQ ID NO: 96606

SEQ ID NO: 102021 - DNA, 601 bp, Human; identical to SEQ ID NO: 96607

SEQ ID NO: 102022 - DNA, 601 bp, Human; identical to SEQ ID NO: 96608

SEQ ID NO: 102023 - DNA, 601 bp, Human; identical to SEQ ID NO: 96609

SEQ ID NO: 102024 - DNA, 601 bp, Human; identical to SEQ ID NO: 96610

SEQ ID NO: 102025 - DNA, 601 bp, Human; identical to SEQ ID NO: 96611

SEQ ID NO: 102026 - DNA, 601 bp, Human; identical to SEQ ID NO: 96612

SEQ ID NO: 102027 - DNA, 601 bp, Human; identical to SEQ ID NO: 96613

SEQ ID NO: 102028 - DNA, 601 bp, Human; identical to SEQ ID NO: 96614

SEQ ID NO: 102029 - DNA, 601 bp, Human; identical to SEQ ID NO: 96615

SEQ ID NO: 102030 - DNA, 601 bp, Human; identical to SEQ ID NO: 96616

SEQ ID NO: 102031 - DNA, 601 bp, Human; identical to SEQ ID NO: 96617

SEQ ID NO: 102032 - DNA, 601 bp, Human; identical to SEQ ID NO: 96618

SEQ ID NO: 102033 - DNA, 601 bp, Human; identical to SEQ ID NO: 96619

SEQ ID NO: 102034 - DNA, 601 bp, Human; identical to SEQ ID NO: 96620

SEQ ID NO: 102035 - DNA, 601 bp, Human; identical to SEQ ID NO: 96621

SEQ ID NO: 102036 - DNA, 601 bp, Human; identical to SEQ ID NO: 96622

SEQ ID NO: 102037 - DNA, 601 bp, Human; identical to SEQ ID NO: 96623

SEQ ID NO: 102038 - DNA, 601 bp, Human; identical to SEQ ID NO: 96624

SEQ ID NO: 102039 - DNA, 601 bp, Human; identical to SEQ ID NO: 96625

SEQ ID NO: 102040 - DNA, 601 bp, Human; identical to SEQ ID NO: 96626

SEQ ID NO: 102041 - DNA, 601 bp, Human; identical to SEQ ID NO: 96627

SEQ ID NO: 102042 - DNA, 601 bp, Human; identical to SEQ ID NO: 96628

SEQ ID NO: 102043 - DNA, 601 bp, Human; identical to SEQ ID NO: 96629

SEQ ID NO: 102044 - DNA, 601 bp, Human; identical to SEQ ID NO: 96630

SEQ ID NO: 102045 - DNA, 601 bp, Human; identical to SEQ ID NO: 96631

SEQ ID NO: 102046 - DNA, 601 bp, Human; identical to SEQ ID NO: 96632

SEQ ID NO: 102047 - DNA, 601 bp, Human; identical to SEQ ID NO: 96633

SEQ ID NO: 102048 - DNA, 601 bp, Human; identical to SEQ ID NO: 96634

SEQ ID NO: 102049 - DNA, 601 bp, Human; identical to SEQ ID NO: 96635

SEQ ID NO: 102050 - DNA, 601 bp, Human; identical to SEQ ID NO: 96636

SEQ ID NO: 102051 - DNA, 601 bp, Human; identical to SEQ ID NO: 96637

SEQ ID NO: 102052 - DNA, 601 bp, Human; identical to SEQ ID NO: 96638

SEQ ID NO: 102053 - DNA, 601 bp, Human; identical to SEQ ID NO: 96639

SEQ ID NO: 102054 - DNA, 601 bp, Human; identical to SEQ ID NO: 96640

SEQ ID NO: 102055 - DNA, 417 bp, Human; identical to SEQ ID NO: 96585

SEQ ID NO: 102056 - DNA, 480 bp, Human; identical to SEQ ID NO: 96586

SEQ ID NO: 102057 - DNA, 601 bp, Human; identical to SEQ ID NO: 96587

SEQ ID NO: 102058 - DNA, 601 bp, Human; identical to SEQ ID NO: 96588

SEQ ID NO: 102059 - DNA, 601 bp, Human; identical to SEQ ID NO: 96589

SEQ ID NO: 102060 - DNA, 601 bp, Human; identical to SEQ ID NO: 96590

SEQ ID NO: 102061 - DNA, 601 bp, Human; identical to SEQ ID NO: 96591

SEQ ID NO: 102062 - DNA, 601 bp, Human; identical to SEQ ID NO: 96592

SEQ ID NO: 102063 - DNA, 601 bp, Human; identical to SEQ ID NO: 96593

SEQ ID NO: 102064 - DNA, 601 bp, Human; identical to SEQ ID NO: 96594

SEQ ID NO: 102065 - DNA, 601 bp, Human; identical to SEQ ID NO: 96595

SEQ ID NO: 102066 - DNA, 601 bp, Human; identical to SEQ ID NO: 96596

SEQ ID NO: 102067 - DNA, 601 bp, Human; identical to SEQ ID NO: 96597

SEQ ID NO: 102068 - DNA, 601 bp, Human; identical to SEQ ID NO: 96598

SEQ ID NO: 102069 - DNA, 601 bp, Human; identical to SEQ ID NO: 96599

SEQ ID NO: 102070 - DNA, 601 bp, Human; identical to SEQ ID NO: 96600

SEQ ID NO: 102071 - DNA, 601 bp, Human; identical to SEQ ID NO: 96601

SEQ ID NO: 102072 - DNA, 601 bp, Human; identical to SEQ ID NO: 96602

SEQ ID NO: 102073 - DNA, 601 bp, Human; identical to SEQ ID NO: 96603

SEQ ID NO: 102074 - DNA, 601 bp, Human; identical to SEQ ID NO: 96604

SEQ ID NO: 102075 - DNA, 601 bp, Human; identical to SEQ ID NO: 96605

SEQ ID NO: 102076 - DNA, 601 bp, Human; identical to SEQ ID NO: 96606

SEQ ID NO: 102077 - DNA, 601 bp, Human; identical to SEQ ID NO: 96607

SEQ ID NO: 102078 - DNA, 601 bp, Human; identical to SEQ ID NO: 96608

SEQ ID NO: 102079 - DNA, 601 bp, Human; identical to SEQ ID NO: 96609

SEQ ID NO: 102080 - DNA, 601 bp, Human; identical to SEQ ID NO: 96610

SEQ ID NO: 102081 - DNA, 601 bp, Human; identical to SEQ ID NO: 96611

SEQ ID NO: 102082 - DNA, 601 bp, Human; identical to SEQ ID NO: 96612

SEQ ID NO: 102083 - DNA, 601 bp, Human; identical to SEQ ID NO: 96613

SEQ ID NO: 102084 - DNA, 601 bp, Human; identical to SEQ ID NO: 96614

SEQ ID NO: 102085 - DNA, 601 bp, Human; identical to SEQ ID NO: 96615

SEQ ID NO: 102086 - DNA, 601 bp, Human; identical to SEQ ID NO: 96616

SEQ ID NO: 102087 - DNA, 601 bp, Human; identical to SEQ ID NO: 96617

SEQ ID NO: 102088 - DNA, 601 bp, Human; identical to SEQ ID NO: 96618

SEQ ID NO: 102089 - DNA, 601 bp, Human; identical to SEQ ID NO: 96619

SEQ ID NO: 102090 - DNA, 601 bp, Human; identical to SEQ ID NO: 96620

SEQ ID NO: 102091 - DNA, 601 bp, Human; identical to SEQ ID NO: 96621

SEQ ID NO: 102092 - DNA, 601 bp, Human; identical to SEQ ID NO: 96622

SEQ ID NO: 102093 - DNA, 601 bp, Human; identical to SEQ ID NO: 96623

SEQ ID NO: 102094 - DNA, 601 bp, Human; identical to SEQ ID NO: 96624

SEQ ID NO: 102095 - DNA, 601 bp, Human; identical to SEQ ID NO: 96625

SEQ ID NO: 102096 - DNA, 601 bp, Human; identical to SEQ ID NO: 96626

SEQ ID NO: 102097 - DNA, 601 bp, Human; identical to SEQ ID NO: 96627

SEQ ID NO: 102098 - DNA, 601 bp, Human; identical to SEQ ID NO: 96628

SEQ ID NO: 102099 - DNA, 601 bp, Human; identical to SEQ ID NO: 96629

SEQ ID NO: 102100 - DNA, 601 bp, Human; identical to SEQ ID NO: 96630

SEQ ID NO: 102101 - DNA, 601 bp, Human; identical to SEQ ID NO: 96631

SEQ ID NO: 102102 - DNA, 601 bp, Human; identical to SEQ ID NO: 96632

SEQ ID NO: 102103 - DNA, 601 bp, Human; identical to SEQ ID NO: 96633

SEQ ID NO: 102104 - DNA, 601 bp, Human; identical to SEQ ID NO: 96634

SEQ ID NO: 102105 - DNA, 601 bp, Human; identical to SEQ ID NO: 96635

SEQ ID NO: 102106 - DNA, 601 bp, Human; identical to SEQ ID NO: 96636

SEQ ID NO: 102107 - DNA, 601 bp, Human; identical to SEQ ID NO: 96637

SEQ ID NO: 102108 - DNA, 601 bp, Human; identical to SEQ ID NO: 96638

SEQ ID NO: 102109 - DNA, 601 bp, Human; identical to SEQ ID NO: 96639

SEQ ID NO: 102110 - DNA, 601 bp, Human; identical to SEQ ID NO: 96640

SEQ ID NO: 102111 - DNA, 417 bp, Human; identical to SEQ ID NO: 96585

SEQ ID NO: 102112 - DNA, 480 bp, Human; identical to SEQ ID NO: 96586

SEQ ID NO: 102113 - DNA, 601 bp, Human; identical to SEQ ID NO: 96587

SEQ ID NO: 102114 - DNA, 601 bp, Human; identical to SEQ ID NO: 96588

SEQ ID NO: 102115 - DNA, 601 bp, Human; identical to SEQ ID NO: 96589

SEQ ID NO: 102116 - DNA, 601 bp, Human; identical to SEQ ID NO: 96590

SEQ ID NO: 102117 - DNA, 601 bp, Human; identical to SEQ ID NO: 96591

SEQ ID NO: 102118 - DNA, 601 bp, Human; identical to SEQ ID NO: 96592

SEQ ID NO: 102119 - DNA, 601 bp, Human; identical to SEQ ID NO: 96593

SEQ ID NO: 102120 - DNA, 601 bp, Human; identical to SEQ ID NO: 96594

SEQ ID NO: 102121 - DNA, 601 bp, Human; identical to SEQ ID NO: 96595

SEQ ID NO: 102122 - DNA, 601 bp, Human; identical to SEQ ID NO: 96596

SEQ ID NO: 102123 - DNA, 601 bp, Human; identical to SEQ ID NO: 96597

SEQ ID NO: 102124 - DNA, 601 bp, Human; identical to SEQ ID NO: 96598

SEQ ID NO: 102125 - DNA, 601 bp, Human; identical to SEQ ID NO: 96599

SEQ ID NO: 102126 - DNA, 601 bp, Human; identical to SEQ ID NO: 96600

SEQ ID NO: 102127 - DNA, 601 bp, Human; identical to SEQ ID NO: 96601

SEQ ID NO: 102128 - DNA, 601 bp, Human; identical to SEQ ID NO: 96602

SEQ ID NO: 102129 - DNA, 601 bp, Human; identical to SEQ ID NO: 96603

SEQ ID NO: 102130 - DNA, 601 bp, Human; identical to SEQ ID NO: 96604

SEQ ID NO: 102131 - DNA, 601 bp, Human; identical to SEQ ID NO: 96605

SEQ ID NO: 102132 - DNA, 601 bp, Human; identical to SEQ ID NO: 96606

SEQ ID NO: 102133 - DNA, 601 bp, Human; identical to SEQ ID NO: 96607

SEQ ID NO: 102134 - DNA, 601 bp, Human; identical to SEQ ID NO: 96608

SEQ ID NO: 102135 - DNA, 601 bp, Human; identical to SEQ ID NO: 96609

SEQ ID NO: 102136 - DNA, 601 bp, Human; identical to SEQ ID NO: 96610

SEQ ID NO: 102137 - DNA, 601 bp, Human; identical to SEQ ID NO: 96611

SEQ ID NO: 102138 - DNA, 601 bp, Human; identical to SEQ ID NO: 96612

SEQ ID NO: 102139 - DNA, 601 bp, Human; identical to SEQ ID NO: 96613

SEQ ID NO: 102140 - DNA, 601 bp, Human; identical to SEQ ID NO: 96614

SEQ ID NO: 102141 - DNA, 601 bp, Human; identical to SEQ ID NO: 96615

SEQ ID NO: 102142 - DNA, 601 bp, Human; identical to SEQ ID NO: 96616

SEQ ID NO: 102143 - DNA, 601 bp, Human; identical to SEQ ID NO: 96617

SEQ ID NO: 102144 - DNA, 601 bp, Human; identical to SEQ ID NO: 96618

SEQ ID NO: 102145 - DNA, 601 bp, Human; identical to SEQ ID NO: 96619

SEQ ID NO: 102146 - DNA, 601 bp, Human; identical to SEQ ID NO: 96620

SEQ ID NO: 102147 - DNA, 601 bp, Human; identical to SEQ ID NO: 96621

SEQ ID NO: 102148 - DNA, 601 bp, Human; identical to SEQ ID NO: 96622

SEQ ID NO: 102149 - DNA, 601 bp, Human; identical to SEQ ID NO: 96623

SEQ ID NO: 102150 - DNA, 601 bp, Human; identical to SEQ ID NO: 96624

SEQ ID NO: 102151 - DNA, 601 bp, Human; identical to SEQ ID NO: 96625

SEQ ID NO: 102152 - DNA, 601 bp, Human; identical to SEQ ID NO: 96626

SEQ ID NO: 102153 - DNA, 601 bp, Human; identical to SEQ ID NO: 96627

SEQ ID NO: 102154 - DNA, 601 bp, Human; identical to SEQ ID NO: 96628

SEQ ID NO: 102155 - DNA, 601 bp, Human; identical to SEQ ID NO: 96629

SEQ ID NO: 102156 - DNA, 601 bp, Human; identical to SEQ ID NO: 96630

SEQ ID NO: 102157 - DNA, 601 bp, Human; identical to SEQ ID NO: 96631

SEQ ID NO: 102158 - DNA, 601 bp, Human; identical to SEQ ID NO: 96632

SEQ ID NO: 102159 - DNA, 601 bp, Human; identical to SEQ ID NO: 96633

SEQ ID NO: 102160 - DNA, 601 bp, Human; identical to SEQ ID NO: 96634

SEQ ID NO: 102161 - DNA, 601 bp, Human; identical to SEQ ID NO: 96635

SEQ ID NO: 102162 - DNA, 601 bp, Human; identical to SEQ ID NO: 96636

SEQ ID NO: 102163 - DNA, 601 bp, Human; identical to SEQ ID NO: 96637

SEQ ID NO: 102164 - DNA, 601 bp, Human; identical to SEQ ID NO: 96638

SEQ ID NO: 102165 - DNA, 601 bp, Human; identical to SEQ ID NO: 96639

SEQ ID NO: 102166 - DNA, 601 bp, Human; identical to SEQ ID NO: 96640

SEQ ID NO: 102167 - DNA, 417 bp, Human; identical to SEQ ID NO: 96585

SEQ ID NO: 102168 - DNA, 480 bp, Human; identical to SEQ ID NO: 96586

SEQ ID NO: 102169 - DNA, 601 bp, Human; identical to SEQ ID NO: 96587

SEQ ID NO: 102170 - DNA, 601 bp, Human; identical to SEQ ID NO: 96588

SEQ ID NO: 102171 - DNA, 601 bp, Human; identical to SEQ ID NO: 96589

SEQ ID NO: 102172 - DNA, 601 bp, Human; identical to SEQ ID NO: 96590

SEQ ID NO: 102173 - DNA, 601 bp, Human; identical to SEQ ID NO: 96591

SEQ ID NO: 102174 - DNA, 601 bp, Human; identical to SEQ ID NO: 96592

SEQ ID NO: 102175 - DNA, 601 bp, Human; identical to SEQ ID NO: 96593

SEQ ID NO: 102176 - DNA, 601 bp, Human; identical to SEQ ID NO: 96594

SEQ ID NO: 102177 - DNA, 601 bp, Human; identical to SEQ ID NO: 96595

SEQ ID NO: 102178 - DNA, 601 bp, Human; identical to SEQ ID NO: 96596

SEQ ID NO: 102179 - DNA, 601 bp, Human; identical to SEQ ID NO: 96597

SEQ ID NO: 102180 - DNA, 601 bp, Human; identical to SEQ ID NO: 96598

SEQ ID NO: 102181 - DNA, 601 bp, Human; identical to SEQ ID NO: 96599

SEQ ID NO: 102182 - DNA, 601 bp, Human; identical to SEQ ID NO: 96600

SEQ ID NO: 102183 - DNA, 601 bp, Human; identical to SEQ ID NO: 96601

SEQ ID NO: 102184 - DNA, 601 bp, Human; identical to SEQ ID NO: 96602

SEQ ID NO: 102185 - DNA, 601 bp, Human; identical to SEQ ID NO: 96603

SEQ ID NO: 102186 - DNA, 601 bp, Human; identical to SEQ ID NO: 96604

SEQ ID NO: 102187 - DNA, 601 bp, Human; identical to SEQ ID NO: 96605

SEQ ID NO: 102188 - DNA, 601 bp, Human; identical to SEQ ID NO: 96606

SEQ ID NO: 102189 - DNA, 601 bp, Human; identical to SEQ ID NO: 96607

SEQ ID NO: 102190 - DNA, 601 bp, Human; identical to SEQ ID NO: 96608

SEQ ID NO: 102191 - DNA, 601 bp, Human; identical to SEQ ID NO: 96609

SEQ ID NO: 102192 - DNA, 601 bp, Human; identical to SEQ ID NO: 96610

SEQ ID NO: 102193 - DNA, 601 bp, Human; identical to SEQ ID NO: 96611

SEQ ID NO: 102194 - DNA, 601 bp, Human; identical to SEQ ID NO: 96612

SEQ ID NO: 102195 - DNA, 601 bp, Human; identical to SEQ ID NO: 96613

SEQ ID NO: 102196 - DNA, 601 bp, Human; identical to SEQ ID NO: 96614

SEQ ID NO: 102197 - DNA, 601 bp, Human; identical to SEQ ID NO: 96615

SEQ ID NO: 102198 - DNA, 601 bp, Human; identical to SEQ ID NO: 96616

SEQ ID NO: 102199 - DNA, 601 bp, Human; identical to SEQ ID NO: 96617

SEQ ID NO: 102200 - DNA, 601 bp, Human; identical to SEQ ID NO: 96618

SEQ ID NO: 102201 - DNA, 601 bp, Human; identical to SEQ ID NO: 96619

SEQ ID NO: 102202 - DNA, 601 bp, Human; identical to SEQ ID NO: 96620

SEQ ID NO: 102203 - DNA, 601 bp, Human; identical to SEQ ID NO: 96621

SEQ ID NO: 102204 - DNA, 601 bp, Human; identical to SEQ ID NO: 96622

SEQ ID NO: 102205 - DNA, 601 bp, Human; identical to SEQ ID NO: 96623

SEQ ID NO: 102206 - DNA, 601 bp, Human; identical to SEQ ID NO: 96624

SEQ ID NO: 102207 - DNA, 601 bp, Human; identical to SEQ ID NO: 96625

SEQ ID NO: 102208 - DNA, 601 bp, Human; identical to SEQ ID NO: 96626

SEQ ID NO: 102209 - DNA, 601 bp, Human; identical to SEQ ID NO: 96627

SEQ ID NO: 102210 - DNA, 601 bp, Human; identical to SEQ ID NO: 96628

SEQ ID NO: 102211 - DNA, 601 bp, Human; identical to SEQ ID NO: 96629

SEQ ID NO: 102212 - DNA, 601 bp, Human; identical to SEQ ID NO: 96630

SEQ ID NO: 102213 - DNA, 601 bp, Human; identical to SEQ ID NO: 96631

SEQ ID NO: 102214 - DNA, 601 bp, Human; identical to SEQ ID NO: 96632

SEQ ID NO: 102215 - DNA, 601 bp, Human; identical to SEQ ID NO: 96633

SEQ ID NO: 102216 - DNA, 601 bp, Human; identical to SEQ ID NO: 96634

SEQ ID NO: 102217 - DNA, 601 bp, Human; identical to SEQ ID NO: 96635

SEQ ID NO: 102218 - DNA, 601 bp, Human; identical to SEQ ID NO: 96636

SEQ ID NO: 102219 - DNA, 601 bp, Human; identical to SEQ ID NO: 96637

SEQ ID NO: 102220 - DNA, 601 bp, Human; identical to SEQ ID NO: 96638

SEQ ID NO: 102221 - DNA, 601 bp, Human; identical to SEQ ID NO: 96639

SEQ ID NO: 102222 - DNA, 601 bp, Human; identical to SEQ ID NO: 96640

SEQ ID NO: 102223 - DNA, 417 bp, Human; identical to SEQ ID NO: 96585

SEQ ID NO: 102224 - DNA, 480 bp, Human; identical to SEQ ID NO: 96586

SEQ ID NO: 102225 - DNA, 601 bp, Human; identical to SEQ ID NO: 96587

SEQ ID NO: 102226 - DNA, 601 bp, Human; identical to SEQ ID NO: 96588

SEQ ID NO: 102227 - DNA, 601 bp, Human; identical to SEQ ID NO: 96589

SEQ ID NO: 102228 - DNA, 601 bp, Human; identical to SEQ ID NO: 96590

SEQ ID NO: 102229 - DNA, 601 bp, Human; identical to SEQ ID NO: 96591

SEQ ID NO: 102230 - DNA, 601 bp, Human; identical to SEQ ID NO: 96592

SEQ ID NO: 102231 - DNA, 601 bp, Human; identical to SEQ ID NO: 96593

SEQ ID NO: 102232 - DNA, 601 bp, Human; identical to SEQ ID NO: 96594

SEQ ID NO: 102233 - DNA, 601 bp, Human; identical to SEQ ID NO: 96595

SEQ ID NO: 102234 - DNA, 601 bp, Human; identical to SEQ ID NO: 96596

SEQ ID NO: 102235 - DNA, 601 bp, Human; identical to SEQ ID NO: 96597

SEQ ID NO: 102236 - DNA, 601 bp, Human; identical to SEQ ID NO: 96598

SEQ ID NO: 102237 - DNA, 601 bp, Human; identical to SEQ ID NO: 96599

SEQ ID NO: 102238 - DNA, 601 bp, Human; identical to SEQ ID NO: 96600

SEQ ID NO: 102239 - DNA, 601 bp, Human; identical to SEQ ID NO: 96601

SEQ ID NO: 102240 - DNA, 601 bp, Human; identical to SEQ ID NO: 96602

SEQ ID NO: 102241 - DNA, 601 bp, Human; identical to SEQ ID NO: 96603

SEQ ID NO: 102242 - DNA, 601 bp, Human; identical to SEQ ID NO: 96604

SEQ ID NO: 102243 - DNA, 601 bp, Human; identical to SEQ ID NO: 96605

SEQ ID NO: 102244 - DNA, 601 bp, Human; identical to SEQ ID NO: 96606

SEQ ID NO: 102245 - DNA, 601 bp, Human; identical to SEQ ID NO: 96607

SEQ ID NO: 102246 - DNA, 601 bp, Human; identical to SEQ ID NO: 96608

SEQ ID NO: 102247 - DNA, 601 bp, Human; identical to SEQ ID NO: 96609

SEQ ID NO: 102248 - DNA, 601 bp, Human; identical to SEQ ID NO: 96610

SEQ ID NO: 102249 - DNA, 601 bp, Human; identical to SEQ ID NO: 96611

SEQ ID NO: 102250 - DNA, 601 bp, Human; identical to SEQ ID NO: 96612

SEQ ID NO: 102251 - DNA, 601 bp, Human; identical to SEQ ID NO: 96613

SEQ ID NO: 102252 - DNA, 601 bp, Human; identical to SEQ ID NO: 96614

SEQ ID NO: 102253 - DNA, 601 bp, Human; identical to SEQ ID NO: 96615

SEQ ID NO: 102254 - DNA, 601 bp, Human; identical to SEQ ID NO: 96616

SEQ ID NO: 102255 - DNA, 601 bp, Human; identical to SEQ ID NO: 96617

SEQ ID NO: 102256 - DNA, 601 bp, Human; identical to SEQ ID NO: 96618

SEQ ID NO: 102257 - DNA, 601 bp, Human; identical to SEQ ID NO: 96619

SEQ ID NO: 102258 - DNA, 601 bp, Human; identical to SEQ ID NO: 96620

SEQ ID NO: 102259 - DNA, 601 bp, Human; identical to SEQ ID NO: 96621

SEQ ID NO: 102260 - DNA, 601 bp, Human; identical to SEQ ID NO: 96622

SEQ ID NO: 102261 - DNA, 601 bp, Human; identical to SEQ ID NO: 96623

SEQ ID NO: 102262 - DNA, 601 bp, Human; identical to SEQ ID NO: 96624

SEQ ID NO: 102263 - DNA, 601 bp, Human; identical to SEQ ID NO: 96625

SEQ ID NO: 102264 - DNA, 601 bp, Human; identical to SEQ ID NO: 96626

SEQ ID NO: 102265 - DNA, 601 bp, Human; identical to SEQ ID NO: 96627

SEQ ID NO: 102266 - DNA, 601 bp, Human; identical to SEQ ID NO: 96628

SEQ ID NO: 102267 - DNA, 601 bp, Human; identical to SEQ ID NO: 96629

SEQ ID NO: 102268 - DNA, 601 bp, Human; identical to SEQ ID NO: 96630

SEQ ID NO: 102269 - DNA, 601 bp, Human; identical to SEQ ID NO: 96631

SEQ ID NO: 102270 - DNA, 601 bp, Human; identical to SEQ ID NO: 96632

SEQ ID NO: 102271 - DNA, 601 bp, Human; identical to SEQ ID NO: 96633

SEQ ID NO: 102272 - DNA, 601 bp, Human; identical to SEQ ID NO: 96634

SEQ ID NO: 102273 - DNA, 601 bp, Human; identical to SEQ ID NO: 96635

SEQ ID NO: 102274 - DNA, 601 bp, Human; identical to SEQ ID NO: 96636

SEQ ID NO: 102275 - DNA, 601 bp, Human; identical to SEQ ID NO: 96637

SEQ ID NO: 102276 - DNA, 601 bp, Human; identical to SEQ ID NO: 96638

SEQ ID NO: 102277 - DNA, 601 bp, Human; identical to SEQ ID NO: 96639

SEQ ID NO: 102278 - DNA, 601 bp, Human; identical to SEQ ID NO: 96640

SEQ ID NO: 102279 - DNA, 601 bp, Human; identical to SEQ ID NO: 96501

SEQ ID NO: 102280 - DNA, 601 bp, Human; identical to SEQ ID NO: 96502

SEQ ID NO: 102281 - DNA, 601 bp, Human; identical to SEQ ID NO: 96503

SEQ ID NO: 102282 - DNA, 601 bp, Human; identical to SEQ ID NO: 96504

SEQ ID NO: 102283 - DNA, 601 bp, Human; identical to SEQ ID NO: 96505

SEQ ID NO: 102284 - DNA, 601 bp, Human; identical to SEQ ID NO: 96506

SEQ ID NO: 102285 - DNA, 601 bp, Human; identical to SEQ ID NO: 96507

SEQ ID NO: 102286 - DNA, 601 bp, Human; identical to SEQ ID NO: 96508

SEQ ID NO: 102287 - DNA, 601 bp, Human; identical to SEQ ID NO: 96509

SEQ ID NO: 102288 - DNA, 601 bp, Human; identical to SEQ ID NO: 96510

SEQ ID NO: 102289 - DNA, 601 bp, Human; identical to SEQ ID NO: 96511

SEQ ID NO: 102290 - DNA, 601 bp, Human; identical to SEQ ID NO: 96512

SEQ ID NO: 102291 - DNA, 601 bp, Human; identical to SEQ ID NO: 96513

SEQ ID NO: 102292 - DNA, 601 bp, Human; identical to SEQ ID NO: 96514

SEQ ID NO: 102293 - DNA, 601 bp, Human; identical to SEQ ID NO: 96515

SEQ ID NO: 102294 - DNA, 601 bp, Human; identical to SEQ ID NO: 96516

SEQ ID NO: 102295 - DNA, 601 bp, Human; identical to SEQ ID NO: 96517

SEQ ID NO: 102296 - DNA, 601 bp, Human; identical to SEQ ID NO: 96518

SEQ ID NO: 102297 - DNA, 601 bp, Human; identical to SEQ ID NO: 96519

SEQ ID NO: 102298 - DNA, 601 bp, Human; identical to SEQ ID NO: 96520

SEQ ID NO: 102299 - DNA, 601 bp, Human; identical to SEQ ID NO: 96521

SEQ ID NO: 102300 - DNA, 601 bp, Human; identical to SEQ ID NO: 96522

SEQ ID NO: 102301 - DNA, 601 bp, Human; identical to SEQ ID NO: 96523

SEQ ID NO: 102302 - DNA, 601 bp, Human; identical to SEQ ID NO: 96524

SEQ ID NO: 102303 - DNA, 601 bp, Human; identical to SEQ ID NO: 96525

SEQ ID NO: 102304 - DNA, 601 bp, Human; identical to SEQ ID NO: 96526

SEQ ID NO: 102305 - DNA, 601 bp, Human; identical to SEQ ID NO: 96527

SEQ ID NO: 102306 - DNA, 601 bp, Human; identical to SEQ ID NO: 96528

SEQ ID NO: 102307 - DNA, 601 bp, Human; identical to SEQ ID NO: 96529

SEQ ID NO: 102308 - DNA, 601 bp, Human; identical to SEQ ID NO: 96530

SEQ ID NO: 102309 - DNA, 601 bp, Human; identical to SEQ ID NO: 96531

SEQ ID NO: 102310 - DNA, 601 bp, Human; identical to SEQ ID NO: 96532

SEQ ID NO: 102311 - DNA, 601 bp, Human; identical to SEQ ID NO: 96533

SEQ ID NO: 102312 - DNA, 601 bp, Human; identical to SEQ ID NO: 96534

SEQ ID NO: 102313 - DNA, 601 bp, Human; identical to SEQ ID NO: 96535

SEQ ID NO: 102314 - DNA, 601 bp, Human; identical to SEQ ID NO: 96536

SEQ ID NO: 102315 - DNA, 601 bp, Human; identical to SEQ ID NO: 96537

SEQ ID NO: 102316 - DNA, 601 bp, Human; identical to SEQ ID NO: 96538

SEQ ID NO: 102317 - DNA, 601 bp, Human; identical to SEQ ID NO: 96539

SEQ ID NO: 102318 - DNA, 601 bp, Human; identical to SEQ ID NO: 96540

SEQ ID NO: 102319 - DNA, 601 bp, Human; identical to SEQ ID NO: 96541

SEQ ID NO: 102320 - DNA, 601 bp, Human; identical to SEQ ID NO: 96542

SEQ ID NO: 102321 - DNA, 601 bp, Human; identical to SEQ ID NO: 96543

SEQ ID NO: 102322 - DNA, 601 bp, Human; identical to SEQ ID NO: 96544

SEQ ID NO: 102323 - DNA, 601 bp, Human; identical to SEQ ID NO: 96545

SEQ ID NO: 102324 - DNA, 601 bp, Human; identical to SEQ ID NO: 96546

SEQ ID NO: 102325 - DNA, 601 bp, Human; identical to SEQ ID NO: 96547

SEQ ID NO: 102326 - DNA, 601 bp, Human; identical to SEQ ID NO: 96548

SEQ ID NO: 102327 - DNA, 601 bp, Human; identical to SEQ ID NO: 96549

SEQ ID NO: 102328 - DNA, 601 bp, Human; identical to SEQ ID NO: 96550

SEQ ID NO: 102329 - DNA, 601 bp, Human; identical to SEQ ID NO: 96551

SEQ ID NO: 102330 - DNA, 601 bp, Human; identical to SEQ ID NO: 96552

SEQ ID NO: 102331 - DNA, 601 bp, Human; identical to SEQ ID NO: 96553

SEQ ID NO: 102332 - DNA, 601 bp, Human; identical to SEQ ID NO: 96554

SEQ ID NO: 102333 - DNA, 601 bp, Human; identical to SEQ ID NO: 96555

SEQ ID NO: 102334 - DNA, 601 bp, Human; identical to SEQ ID NO: 96556

SEQ ID NO: 102335 - DNA, 601 bp, Human; identical to SEQ ID NO: 96557

SEQ ID NO: 102336 - DNA, 601 bp, Human; identical to SEQ ID NO: 96558

SEQ ID NO: 102337 - DNA, 601 bp, Human; identical to SEQ ID NO: 96559

SEQ ID NO: 102338 - DNA, 601 bp, Human; identical to SEQ ID NO: 96560

SEQ ID NO: 102339 - DNA, 601 bp, Human; identical to SEQ ID NO: 96561

SEQ ID NO: 102340 - DNA, 601 bp, Human; identical to SEQ ID NO: 96562

SEQ ID NO: 102341 - DNA, 601 bp, Human; identical to SEQ ID NO: 96563

SEQ ID NO: 102342 - DNA, 601 bp, Human; identical to SEQ ID NO: 96564

SEQ ID NO: 102343 - DNA, 601 bp, Human; identical to SEQ ID NO: 96565

SEQ ID NO: 102344 - DNA, 601 bp, Human; identical to SEQ ID NO: 96566

SEQ ID NO: 102345 - DNA, 601 bp, Human; identical to SEQ ID NO: 96567

SEQ ID NO: 102346 - DNA, 601 bp, Human; identical to SEQ ID NO: 96568

SEQ ID NO: 102347 - DNA, 601 bp, Human; identical to SEQ ID NO: 96569

SEQ ID NO: 102348 - DNA, 601 bp, Human; identical to SEQ ID NO: 96570

SEQ ID NO: 102349 - DNA, 601 bp, Human; identical to SEQ ID NO: 96571

SEQ ID NO: 102350 - DNA, 601 bp, Human; identical to SEQ ID NO: 96572

SEQ ID NO: 102351 - DNA, 601 bp, Human; identical to SEQ ID NO: 96573

SEQ ID NO: 102352 - DNA, 601 bp, Human; identical to SEQ ID NO: 96574

SEQ ID NO: 102353 - DNA, 601 bp, Human; identical to SEQ ID NO: 96575

SEQ ID NO: 102354 - DNA, 601 bp, Human; identical to SEQ ID NO: 96576

SEQ ID NO: 102355 - DNA, 601 bp, Human; identical to SEQ ID NO: 96577

SEQ ID NO: 102356 - DNA, 601 bp, Human; identical to SEQ ID NO: 96578

SEQ ID NO: 102357 - DNA, 601 bp, Human; identical to SEQ ID NO: 96579

SEQ ID NO: 102358 - DNA, 601 bp, Human; identical to SEQ ID NO: 96580

SEQ ID NO: 102359 - DNA, 601 bp, Human; identical to SEQ ID NO: 96581

SEQ ID NO: 102360 - DNA, 601 bp, Human; identical to SEQ ID NO: 96582

SEQ ID NO: 102361 - DNA, 601 bp, Human; identical to SEQ ID NO: 96583

SEQ ID NO: 102362 - DNA, 601 bp, Human; identical to SEQ ID NO: 96584

SEQ ID NO: 102363 - DNA, 417 bp, Human; identical to SEQ ID NO: 96585

SEQ ID NO: 102364 - DNA, 480 bp, Human; identical to SEQ ID NO: 96586

SEQ ID NO: 102365 - DNA, 601 bp, Human; identical to SEQ ID NO: 96587

SEQ ID NO: 102366 - DNA, 601 bp, Human; identical to SEQ ID NO: 96588

SEQ ID NO: 102367 - DNA, 601 bp, Human; identical to SEQ ID NO: 96589

SEQ ID NO: 102368 - DNA, 601 bp, Human; identical to SEQ ID NO: 96590

SEQ ID NO: 102369 - DNA, 601 bp, Human; identical to SEQ ID NO: 96591

SEQ ID NO: 102370 - DNA, 601 bp, Human; identical to SEQ ID NO: 96592

SEQ ID NO: 102371 - DNA, 601 bp, Human; identical to SEQ ID NO: 96593

SEQ ID NO: 102372 - DNA, 601 bp, Human; identical to SEQ ID NO: 96594

SEQ ID NO: 102373 - DNA, 601 bp, Human; identical to SEQ ID NO: 96595

SEQ ID NO: 102374 - DNA, 601 bp, Human; identical to SEQ ID NO: 96596

SEQ ID NO: 102375 - DNA, 601 bp, Human; identical to SEQ ID NO: 96597

SEQ ID NO: 102376 - DNA, 601 bp, Human; identical to SEQ ID NO: 96598

SEQ ID NO: 102377 - DNA, 601 bp, Human; identical to SEQ ID NO: 96599

SEQ ID NO: 102378 - DNA, 601 bp, Human; identical to SEQ ID NO: 96600

SEQ ID NO: 102379 - DNA, 601 bp, Human; identical to SEQ ID NO: 96601

SEQ ID NO: 102380 - DNA, 601 bp, Human; identical to SEQ ID NO: 96602

SEQ ID NO: 102381 - DNA, 601 bp, Human; identical to SEQ ID NO: 96603

SEQ ID NO: 102382 - DNA, 601 bp, Human; identical to SEQ ID NO: 96604

SEQ ID NO: 102383 - DNA, 601 bp, Human; identical to SEQ ID NO: 96605

SEQ ID NO: 102384 - DNA, 601 bp, Human; identical to SEQ ID NO: 96606

SEQ ID NO: 102385 - DNA, 601 bp, Human; identical to SEQ ID NO: 96607

SEQ ID NO: 102386 - DNA, 601 bp, Human; identical to SEQ ID NO: 96608

SEQ ID NO: 102387 - DNA, 601 bp, Human; identical to SEQ ID NO: 96609

SEQ ID NO: 102388 - DNA, 601 bp, Human; identical to SEQ ID NO: 96610

SEQ ID NO: 102389 - DNA, 601 bp, Human; identical to SEQ ID NO: 96611

SEQ ID NO: 102390 - DNA, 601 bp, Human; identical to SEQ ID NO: 96612

SEQ ID NO: 102391 - DNA, 601 bp, Human; identical to SEQ ID NO: 96613

SEQ ID NO: 102392 - DNA, 601 bp, Human; identical to SEQ ID NO: 96614

SEQ ID NO: 102393 - DNA, 601 bp, Human; identical to SEQ ID NO: 96615

SEQ ID NO: 102394 - DNA, 601 bp, Human; identical to SEQ ID NO: 96616

SEQ ID NO: 102395 - DNA, 601 bp, Human; identical to SEQ ID NO: 96617

SEQ ID NO: 102396 - DNA, 601 bp, Human; identical to SEQ ID NO: 96618

SEQ ID NO: 102397 - DNA, 601 bp, Human; identical to SEQ ID NO: 96619

SEQ ID NO: 102398 - DNA, 601 bp, Human; identical to SEQ ID NO: 96620

SEQ ID NO: 102399 - DNA, 601 bp, Human; identical to SEQ ID NO: 96621

SEQ ID NO: 102400 - DNA, 601 bp, Human; identical to SEQ ID NO: 96622

SEQ ID NO: 102401 - DNA, 601 bp, Human; identical to SEQ ID NO: 96623

SEQ ID NO: 102402 - DNA, 601 bp, Human; identical to SEQ ID NO: 96624

SEQ ID NO: 102403 - DNA, 601 bp, Human; identical to SEQ ID NO: 96625

SEQ ID NO: 102404 - DNA, 601 bp, Human; identical to SEQ ID NO: 96626

SEQ ID NO: 102405 - DNA, 601 bp, Human; identical to SEQ ID NO: 96627

SEQ ID NO: 102406 - DNA, 601 bp, Human; identical to SEQ ID NO: 96628

SEQ ID NO: 102407 - DNA, 601 bp, Human; identical to SEQ ID NO: 96629

SEQ ID NO: 102408 - DNA, 601 bp, Human; identical to SEQ ID NO: 96630

SEQ ID NO: 102409 - DNA, 601 bp, Human; identical to SEQ ID NO: 96631

SEQ ID NO: 102410 - DNA, 601 bp, Human; identical to SEQ ID NO: 96632

SEQ ID NO: 102411 - DNA, 601 bp, Human; identical to SEQ ID NO: 96633

SEQ ID NO: 102412 - DNA, 601 bp, Human; identical to SEQ ID NO: 96634

SEQ ID NO: 102413 - DNA, 601 bp, Human; identical to SEQ ID NO: 96635

SEQ ID NO: 102414 - DNA, 601 bp, Human; identical to SEQ ID NO: 96636

SEQ ID NO: 102415 - DNA, 601 bp, Human; identical to SEQ ID NO: 96637

SEQ ID NO: 102416 - DNA, 601 bp, Human; identical to SEQ ID NO: 96638

SEQ ID NO: 102417 - DNA, 601 bp, Human; identical to SEQ ID NO: 96639

SEQ ID NO: 102418 - DNA, 601 bp, Human; identical to SEQ ID NO: 96640

SEQ ID NO: 102419 - DNA, 601 bp, Human; identical to SEQ ID NO: 96501

SEQ ID NO: 102420 - DNA, 601 bp, Human; identical to SEQ ID NO: 96502

SEQ ID NO: 102421 - DNA, 601 bp, Human; identical to SEQ ID NO: 96503

SEQ ID NO: 102422 - DNA, 601 bp, Human; identical to SEQ ID NO: 96504

SEQ ID NO: 102423 - DNA, 601 bp, Human; identical to SEQ ID NO: 96505

SEQ ID NO: 102424 - DNA, 601 bp, Human; identical to SEQ ID NO: 96506

SEQ ID NO: 102425 - DNA, 601 bp, Human; identical to SEQ ID NO: 96507

SEQ ID NO: 102426 - DNA, 601 bp, Human; identical to SEQ ID NO: 96508

SEQ ID NO: 102427 - DNA, 601 bp, Human; identical to SEQ ID NO: 96509

SEQ ID NO: 102428 - DNA, 601 bp, Human; identical to SEQ ID NO: 96510

SEQ ID NO: 102429 - DNA, 601 bp, Human; identical to SEQ ID NO: 96511

SEQ ID NO: 102430 - DNA, 601 bp, Human; identical to SEQ ID NO: 96512

SEQ ID NO: 102431 - DNA, 601 bp, Human; identical to SEQ ID NO: 96513

SEQ ID NO: 102432 - DNA, 601 bp, Human; identical to SEQ ID NO: 96514

SEQ ID NO: 102433 - DNA, 601 bp, Human; identical to SEQ ID NO: 96515

SEQ ID NO: 102434 - DNA, 601 bp, Human; identical to SEQ ID NO: 96516

SEQ ID NO: 102435 - DNA, 601 bp, Human; identical to SEQ ID NO: 96517

SEQ ID NO: 102436 - DNA, 601 bp, Human; identical to SEQ ID NO: 96518

SEQ ID NO: 102437 - DNA, 601 bp, Human; identical to SEQ ID NO: 96519

SEQ ID NO: 102438 - DNA, 601 bp, Human; identical to SEQ ID NO: 96520

SEQ ID NO: 102439 - DNA, 601 bp, Human; identical to SEQ ID NO: 96521

SEQ ID NO: 102440 - DNA, 601 bp, Human; identical to SEQ ID NO: 96522

SEQ ID NO: 102441 - DNA, 601 bp, Human; identical to SEQ ID NO: 96523

SEQ ID NO: 102442 - DNA, 601 bp, Human; identical to SEQ ID NO: 96524

SEQ ID NO: 102443 - DNA, 601 bp, Human; identical to SEQ ID NO: 96525

SEQ ID NO: 102444 - DNA, 601 bp, Human; identical to SEQ ID NO: 96526

SEQ ID NO: 102445 - DNA, 601 bp, Human; identical to SEQ ID NO: 96527

SEQ ID NO: 102446 - DNA, 601 bp, Human; identical to SEQ ID NO: 96528

SEQ ID NO: 102447 - DNA, 601 bp, Human; identical to SEQ ID NO: 96529

SEQ ID NO: 102448 - DNA, 601 bp, Human; identical to SEQ ID NO: 96530

SEQ ID NO: 102449 - DNA, 601 bp, Human; identical to SEQ ID NO: 96531

SEQ ID NO: 102450 - DNA, 601 bp, Human; identical to SEQ ID NO: 96532

SEQ ID NO: 102451 - DNA, 601 bp, Human; identical to SEQ ID NO: 96533

SEQ ID NO: 102452 - DNA, 601 bp, Human; identical to SEQ ID NO: 96534

SEQ ID NO: 102453 - DNA, 601 bp, Human; identical to SEQ ID NO: 96535

SEQ ID NO: 102454 - DNA, 601 bp, Human; identical to SEQ ID NO: 96536

SEQ ID NO: 102455 - DNA, 601 bp, Human; identical to SEQ ID NO: 96537

SEQ ID NO: 102456 - DNA, 601 bp, Human; identical to SEQ ID NO: 96538

SEQ ID NO: 102457 - DNA, 601 bp, Human; identical to SEQ ID NO: 96539

SEQ ID NO: 102458 - DNA, 601 bp, Human; identical to SEQ ID NO: 96540

SEQ ID NO: 102459 - DNA, 601 bp, Human; identical to SEQ ID NO: 96541

SEQ ID NO: 102460 - DNA, 601 bp, Human; identical to SEQ ID NO: 96542

SEQ ID NO: 102461 - DNA, 601 bp, Human; identical to SEQ ID NO: 96543

SEQ ID NO: 102462 - DNA, 601 bp, Human; identical to SEQ ID NO: 96544

SEQ ID NO: 102463 - DNA, 601 bp, Human; identical to SEQ ID NO: 96545

SEQ ID NO: 102464 - DNA, 601 bp, Human; identical to SEQ ID NO: 96546

SEQ ID NO: 102465 - DNA, 601 bp, Human; identical to SEQ ID NO: 96547

SEQ ID NO: 102466 - DNA, 601 bp, Human; identical to SEQ ID NO: 96548

SEQ ID NO: 102467 - DNA, 601 bp, Human; identical to SEQ ID NO: 96549

SEQ ID NO: 102468 - DNA, 601 bp, Human; identical to SEQ ID NO: 96550

SEQ ID NO: 102469 - DNA, 601 bp, Human; identical to SEQ ID NO: 96551

SEQ ID NO: 102470 - DNA, 601 bp, Human; identical to SEQ ID NO: 96552

SEQ ID NO: 102471 - DNA, 601 bp, Human; identical to SEQ ID NO: 96553

SEQ ID NO: 102472 - DNA, 601 bp, Human; identical to SEQ ID NO: 96554

SEQ ID NO: 102473 - DNA, 601 bp, Human; identical to SEQ ID NO: 96555

SEQ ID NO: 102474 - DNA, 601 bp, Human; identical to SEQ ID NO: 96556

SEQ ID NO: 102475 - DNA, 601 bp, Human; identical to SEQ ID NO: 96557

SEQ ID NO: 102476 - DNA, 601 bp, Human; identical to SEQ ID NO: 96558

SEQ ID NO: 102477 - DNA, 601 bp, Human; identical to SEQ ID NO: 96559

SEQ ID NO: 102478 - DNA, 601 bp, Human; identical to SEQ ID NO: 96560

SEQ ID NO: 102479 - DNA, 601 bp, Human; identical to SEQ ID NO: 96561

SEQ ID NO: 102480 - DNA, 601 bp, Human; identical to SEQ ID NO: 96562

SEQ ID NO: 102481 - DNA, 601 bp, Human; identical to SEQ ID NO: 96563

SEQ ID NO: 102482 - DNA, 601 bp, Human; identical to SEQ ID NO: 96564

SEQ ID NO: 102483 - DNA, 601 bp, Human; identical to SEQ ID NO: 96565

SEQ ID NO: 102484 - DNA, 601 bp, Human; identical to SEQ ID NO: 96566

SEQ ID NO: 102485 - DNA, 601 bp, Human; identical to SEQ ID NO: 96567

SEQ ID NO: 102486 - DNA, 601 bp, Human; identical to SEQ ID NO: 96568

SEQ ID NO: 102487 - DNA, 601 bp, Human; identical to SEQ ID NO: 96569

SEQ ID NO: 102488 - DNA, 601 bp, Human; identical to SEQ ID NO: 96570

SEQ ID NO: 102489 - DNA, 601 bp, Human; identical to SEQ ID NO: 96571

SEQ ID NO: 102490 - DNA, 601 bp, Human; identical to SEQ ID NO: 96572

SEQ ID NO: 102491 - DNA, 601 bp, Human; identical to SEQ ID NO: 96573

SEQ ID NO: 102492 - DNA, 601 bp, Human; identical to SEQ ID NO: 96574

SEQ ID NO: 102493 - DNA, 601 bp, Human; identical to SEQ ID NO: 96575

SEQ ID NO: 102494 - DNA, 601 bp, Human; identical to SEQ ID NO: 96576

SEQ ID NO: 102495 - DNA, 601 bp, Human; identical to SEQ ID NO: 96577

SEQ ID NO: 102496 - DNA, 601 bp, Human; identical to SEQ ID NO: 96578

SEQ ID NO: 102497 - DNA, 601 bp, Human; identical to SEQ ID NO: 96579

SEQ ID NO: 102498 - DNA, 601 bp, Human; identical to SEQ ID NO: 96580

SEQ ID NO: 102499 - DNA, 601 bp, Human; identical to SEQ ID NO: 96581

SEQ ID NO: 102500 - DNA, 601 bp, Human; identical to SEQ ID NO: 96582

SEQ ID NO: 102501 - DNA, 601 bp, Human; identical to SEQ ID NO: 96583

SEQ ID NO: 102502 - DNA, 601 bp, Human; identical to SEQ ID NO: 96584

SEQ ID NO: 102503 - DNA, 417 bp, Human; identical to SEQ ID NO: 96585

SEQ ID NO: 102504 - DNA, 480 bp, Human; identical to SEQ ID NO: 96586

SEQ ID NO: 102505 - DNA, 601 bp, Human; identical to SEQ ID NO: 96587

SEQ ID NO: 102506 - DNA, 601 bp, Human; identical to SEQ ID NO: 96588

SEQ ID NO: 102507 - DNA, 601 bp, Human; identical to SEQ ID NO: 96589

SEQ ID NO: 102508 - DNA, 601 bp, Human; identical to SEQ ID NO: 96590

SEQ ID NO: 102509 - DNA, 601 bp, Human; identical to SEQ ID NO: 96591

SEQ ID NO: 102510 - DNA, 601 bp, Human; identical to SEQ ID NO: 96592

SEQ ID NO: 102511 - DNA, 601 bp, Human; identical to SEQ ID NO: 96593

SEQ ID NO: 102512 - DNA, 601 bp, Human; identical to SEQ ID NO: 96594

SEQ ID NO: 102513 - DNA, 601 bp, Human; identical to SEQ ID NO: 96595

SEQ ID NO: 102514 - DNA, 601 bp, Human; identical to SEQ ID NO: 96596

SEQ ID NO: 102515 - DNA, 601 bp, Human; identical to SEQ ID NO: 96597

SEQ ID NO: 102516 - DNA, 601 bp, Human; identical to SEQ ID NO: 96598

SEQ ID NO: 102517 - DNA, 601 bp, Human; identical to SEQ ID NO: 96599

SEQ ID NO: 102518 - DNA, 601 bp, Human; identical to SEQ ID NO: 96600

SEQ ID NO: 102519 - DNA, 601 bp, Human; identical to SEQ ID NO: 96601

SEQ ID NO: 102520 - DNA, 601 bp, Human; identical to SEQ ID NO: 96602

SEQ ID NO: 102521 - DNA, 601 bp, Human; identical to SEQ ID NO: 96603

SEQ ID NO: 102522 - DNA, 601 bp, Human; identical to SEQ ID NO: 96604

SEQ ID NO: 102523 - DNA, 601 bp, Human; identical to SEQ ID NO: 96605

SEQ ID NO: 102524 - DNA, 601 bp, Human; identical to SEQ ID NO: 96606

SEQ ID NO: 102525 - DNA, 601 bp, Human; identical to SEQ ID NO: 96607

SEQ ID NO: 102526 - DNA, 601 bp, Human; identical to SEQ ID NO: 96608

SEQ ID NO: 102527 - DNA, 601 bp, Human; identical to SEQ ID NO: 96609

SEQ ID NO: 102528 - DNA, 601 bp, Human; identical to SEQ ID NO: 96610

SEQ ID NO: 102529 - DNA, 601 bp, Human; identical to SEQ ID NO: 96611

SEQ ID NO: 102530 - DNA, 601 bp, Human; identical to SEQ ID NO: 96612

SEQ ID NO: 102531 - DNA, 601 bp, Human; identical to SEQ ID NO: 96613

SEQ ID NO: 102532 - DNA, 601 bp, Human; identical to SEQ ID NO: 96614

SEQ ID NO: 102533 - DNA, 601 bp, Human; identical to SEQ ID NO: 96615

SEQ ID NO: 102534 - DNA, 601 bp, Human; identical to SEQ ID NO: 96616

SEQ ID NO: 102535 - DNA, 601 bp, Human; identical to SEQ ID NO: 96617

SEQ ID NO: 102536 - DNA, 601 bp, Human; identical to SEQ ID NO: 96618

SEQ ID NO: 102537 - DNA, 601 bp, Human; identical to SEQ ID NO: 96619

SEQ ID NO: 102538 - DNA, 601 bp, Human; identical to SEQ ID NO: 96620

SEQ ID NO: 102539 - DNA, 601 bp, Human; identical to SEQ ID NO: 96621

SEQ ID NO: 102540 - DNA, 601 bp, Human; identical to SEQ ID NO: 96622

SEQ ID NO: 102541 - DNA, 601 bp, Human; identical to SEQ ID NO: 96623

SEQ ID NO: 102542 - DNA, 601 bp, Human; identical to SEQ ID NO: 96624

SEQ ID NO: 102543 - DNA, 601 bp, Human; identical to SEQ ID NO: 96625

SEQ ID NO: 102544 - DNA, 601 bp, Human; identical to SEQ ID NO: 96626

SEQ ID NO: 102545 - DNA, 601 bp, Human; identical to SEQ ID NO: 96627

SEQ ID NO: 102546 - DNA, 601 bp, Human; identical to SEQ ID NO: 96628

SEQ ID NO: 102547 - DNA, 601 bp, Human; identical to SEQ ID NO: 96629

SEQ ID NO: 102548 - DNA, 601 bp, Human; identical to SEQ ID NO: 96630

SEQ ID NO: 102549 - DNA, 601 bp, Human; identical to SEQ ID NO: 96631

SEQ ID NO: 102550 - DNA, 601 bp, Human; identical to SEQ ID NO: 96632

SEQ ID NO: 102551 - DNA, 601 bp, Human; identical to SEQ ID NO: 96633

SEQ ID NO: 102552 - DNA, 601 bp, Human; identical to SEQ ID NO: 96634

SEQ ID NO: 102553 - DNA, 601 bp, Human; identical to SEQ ID NO: 96635

SEQ ID NO: 102554 - DNA, 601 bp, Human; identical to SEQ ID NO: 96636

SEQ ID NO: 102555 - DNA, 601 bp, Human; identical to SEQ ID NO: 96637

SEQ ID NO: 102556 - DNA, 601 bp, Human; identical to SEQ ID NO: 96638

SEQ ID NO: 102557 - DNA, 601 bp, Human; identical to SEQ ID NO: 96639

SEQ ID NO: 102558 - DNA, 601 bp, Human; identical to SEQ ID NO: 96640

SEQ ID NO: 102559 - DNA, 601 bp, Human
tcctagataaatgagaaacaaaaacacatgtcacagctttagtcacgataggctgaaactagaagcaatgcaaatgtccatcaacaggtgagtgaataaacaaattgaggcacctctatccagggaaatactgctcagcaatagaaaggaatgatcaactgatattcatgaccacatggatgaactttacagaaggttgtgcaaaataagcatttgatttcatttccttttgagacagagtcttgctctgtcgtccaggctggagtgcagtggtgtgatcttggctcactgcaacctccgmctcccgggttcacgtgattctcgtgcctcagcctcctgagtagctgggattacaggtgccccccaccatgctctgctaatttttgtatttttaataggcatggggttttgtcatgttggccaggctgttttcgaactcctgacctcaggtgatccacctgtctcggcctcccaaagtgctgggattgcatgcgtgagccactgcacccgaccttgatttcatttctgtaaagttctaaaacaggcaaaactaatctatagttcagaaagcaggtcagtggttgcctggagccaggggtgg

SEQ ID NO: 102560 - DNA, 601 bp, Human
ctttggctgcatatggtaatcacctgtggagcttcaaacataccaatgcctgatcccacccctgaagattctgatgtaattgatctgatgtatggcctgggcactgtgagttttcaaagctccacaaggtgattctaatgttcagccctggaaatgaaccatcctagactccagactcctctttacagcctatccctagtaatagcttcagtattctgacaactggtgtcttgctttccattctagggcagatttccacatggtcccttttttttttgagatggagtctcactctgtcgcycaggctggagtgcagtggcgtgatctcagctcactgcaacctccgcctcccgggttcaagcaattcctctgcctcagcctccggagtagttgggactataggtgcatgccaccatgcctgaataattttttgtattttcagtagagacggggttcaccatattggccaggctggtcttgaactccttaccttgtgatccacctgcctcagcctcccaaagtgctgggattacaggtgtgagccactgcgcccggctgatcctttttttttaagatgggctctcactctgtcacctaggct

SEQ ID NO: 102561 - DNA, 601 bp, Human
gctcatcctgaacttccgggctcaagtgatcttcccaccttggcttcccaaagtgctgggatcacaggcatgagccactgcacctggcctccacatggtctttgaaggatttgtgccttagtgaggtttaatcctgtgacaagaatggttcataagagcccacaactagcttgggccagtgttttcacagctgtgtcaagcaacgagacacatctgtcccccataactgtctacaaattacagatgaggaaactgagagacagaggttgtctgaggtttttgtttttttgtttttttttttcttttgagacagagtctcactctgttgcccaggctggagtaaagtgttgcaatctcggctcactacaacctccgcctcctggattcaagtgattctcctgcctcagcctcctgagtagctgggattacaggcgcccaccaccatgcccggctaattttttgtgtttttagtggagacagggtttcaccgtgttggtcaggctggtctcgaactcctgacctcaggtgatctgcctgcctcggcctcccaaagtgctgggattacaggcatgagtcactgcgcccagcctgaggatttttt

SEQ ID NO: 102562 - DNA, 601 bp, Human
acttgactaggcggttcaagaccagcctgatcaacatggtggaaccccgtttctactaaaaatacaaaaattagttgggcgtgatggtgcgtgccagtagtcccagctacttgggagactaggcaggagaatcgcttgaacccgggaggcagaggttgcagtgagctgagatcctgccattgcatcacgtggttcttcaggaaaaggaggagaggccaggaagagggagatggttctagagagattaagggagcctgtctgattcaggatattgctcaggactcttgttgcaaagcatctwctctaggtcattgaaggcaagaaggagtttacttagggacattaggtattctcaggcttcctactagaggccacactgcccagagcaatgcctaaaccaggaagtgcacagctccagcaaaaatcctgtggccactgccattggtggccatacctggcagctccagggaatcatgttgggtactgggtgccagaaatgcaagcctaaaagcctctgccatcattctggccagacattggtttctgcctggtgcctacttctgaatccaagtcttactgggtgtttgattgacaaagctat

SEQ ID NO: 102563 - DNA, 601 bp, Human
gaaaaaagaaaacaaaaagtcatcgtatagtatgtttcttttgtgtcaagtttctgttaacatgtttttattgcttgtatcagtagtttgttccttttattgctgagtagtattctactgtacaaataaattataatttatttctccattctactgttgggtaatttctactttttatcaattataaattagcctctatgaacactcttctatagtctttttgtggactttttttttttttttcatttctcttgggcaaatacctaggagtggaattgctgagtcatatgataggcatatrtttagctttaatagatattgccaaagttttacaaagctattgagctattttacactcccattgactatgtgaaagaatctagttgttctccatcctcatcaacatatggggttatcagtcttttgaattttagcagaaaatctcactgcagttttaatttgcatttctctgatggctaatgatgctgagcaccttttcatgtgcttaatggccatgtaatatattctttttcttttttttttttttttgagacaaggtttcactttgtcacccaggctggagtgcggtggtgccatctta

SEQ ID NO: 102564 - DNA, 601 bp, Human
ggttgctgcgaatgccattaatttattcctttttatggctgagtaatattccgtcatatatatatatatatatatatacaccacagtttctttatccacttgttaactgatgggcatttggggtggttccatatttttgcaattgcgaattgtgctgctataaacgtgcgtgcaaggatctttttcatataatgacttcttttcctctgagtagatacccagtagtgggattgctggatcaaatggtagttctacttttagttctttaagggatctccacactgttttccatagtggttgyagtagtttacattcccaccagcagtgtagaagtgttccctgttcaccacatccatgccagcatctattattttttgattttttgattatggccattcttgcaggagtaaggtggttttgcgttgtggttttgatttgcatttctctgatcattaatgatgttgagcattttttcttttttctttttttcctgagacacagtctcactctgtcgtccaggctggagtgcagtggtgcgatctcggctcactgcaacctctgcctcctgggttcaagcaattctcctgcctcagcctcctga

SEQ ID NO: 102565 - DNA, 601 bp, Human
gagcctccgtgcctggccaagcattttttcatgtttcttggccatttgtatatcttcttttgtgaattatccaatagtcattgctttttattgctgagtaatattccactgtatggctatatcatttgtttgcccattcaactcttgatggacgtttgcactgtttctagttttgggctattaagaataaagctgccaaagtctttgtatagacatacgcttttatttccctaggagtagaatggctggattataaggtaggcatatgtttaacttttaaagaaacaacctcattgtttcyaatttggaagtcccattttacattccaccggcagtgtaagacagtcccacctgttccacatgttctccaacacttggcacctgttttagtcccttcaggctattgtatcaaagttccataaactgggtggcttataagcaacagaaatgtatttatcacaattctggaggctggaagtccaagattggggtgccagcatggttgggttctggtgatggctctttcctgggctgcaggctgctgtcttcttatagtatggccagtctttctaattttagccattctaataggtggctactt

SEQ ID NO: 102566 - DNA, 601 bp, Human
ccttcaggctattgtatcaaagttccataaactgggtggcttataagcaacagaaatgtatttatcacaattctggaggctggaagtccaagattggggtgccagcatggttgggttctggtgatggctctttcctgggctgcaggctgctgtcttcttatagtatggccagtctttctaattttagccattctaataggtggctactttaatttgtatctccctaacaactaatgatgttgagcatcttttcatgtgcttatttatcttctgtctatctttttttggtgaaatgtttctkcaaatattttgcccatttattaattggattattttcttattgagttttgggagttcttcatatattttaaatacaagtctttaatgagatatgtgacttacaaatattttctcacagtctattgcccgtcttttcatttactttgcagtgtctttgaaagagaagaagttttaaattttgatgaagtctagtttattattattatttttaattttatggttattgctttttcttcttctctctctctttttttttgtcccaagaaatcttcacctacctctaggtaacaaagatactctc

SEQ ID NO: 102567 - DNA, 601 bp, Human
attctttttactttccagggattacactatgcatccttgtcgtggtctaccttgaattaatcttgtattgcttcaagtataatgtaagatccttatgagagtacaattcaattcacctcccttctcatccttcatgtaattgttgtcatagttttcatttacgtgttttaaactccacaatacattgttatttttgttttaaatagtcacttgtcttttaagcaattaaggtgagaaatagtagtctctttttttttttttttctgagacggagttttgctcttgttgcccaggctggagygcagtggcgcaatctcggctcactgcaacctctgcctcctgggttcaagcgattctcctgcctcagcctcccgagtggctgggactacaggtgtgcgccaccacacccagctaatttttgtatttttagtagagacggggtttcaccatgttggccaggatagtctagatctcttgacctagtgatctgcccgcctcggcctcccaacgtgctgggattacaggcatgagccaccacgtccagcccaatgcctggctaattttttgtatttttagtagagacagggtctcatcatgttgg

SEQ ID NO: 102568 - DNA, 601 bp, Human
ttgttttaaatagtcacttgtcttttaagcaattaaggtgagaaatagtagtctctttttttttttttttctgagacggagttttgctcttgttgcccaggctggagtgcagtggcgcaatctcggctcactgcaacctctgcctcctgggttcaagcgattctcctgcctcagcctcccgagtggctgggactacaggtgtgcgccaccacacccagctaatttttgtatttttagtagagacggggtttcaccatgttggccaggatagtctagatctcttgacctagtgatctgcccrcctcggcctcccaacgtgctgggattacaggcatgagccaccacgtccagcccaatgcctggctaattttttgtatttttagtagagacagggtctcatcatgttggccaggctggtcttgaactcctgacctcaggtgatccacccccccatcggcctcccaaagtgctgggattacaggggtgagccaccgtgccggccagtagtcttttatatttagtaacatacttaccatttccatcgctctttattccttcttgtagacctaattttcatctaccagcattttctttcagactg

SEQ ID NO: 102569 - DNA, 601 bp, Human
acttgtcttttaagcaattaaggtgagaaatagtagtctctttttttttttttttctgagacggagttttgctcttgttgcccaggctggagtgcagtggcgcaatctcggctcactgcaacctctgcctcctgggttcaagcgattctcctgcctcagcctcccgagtggctgggactacaggtgtgcgccaccacacccagctaatttttgtatttttagtagagacggggtttcaccatgttggccaggatagtctagatctcttgacctagtgatctgcccgcctcggcctcccaamgtgctgggattacaggcatgagccaccacgtccagcccaatgcctggctaattttttgtatttttagtagagacagggtctcatcatgttggccaggctggtcttgaactcctgacctcaggtgatccacccccccatcggcctcccaaagtgctgggattacaggggtgagccaccgtgccggccagtagtcttttatatttagtaacatacttaccatttccatcgctctttattccttcttgtagacctaattttcatctaccagcattttctttcagactgaagaatgtcttcatt

SEQ ID NO: 102570 - DNA, 601 bp, Human
tgaagattttcttctgcagtgtctaatctgctatttatcttattcaataatttttaaaatttcagctattgtttcagtactaagatttctactgggttcctttttagagtttccatacctcttctaaaattcagattccccatgtctttgcccatgatccctatcttttcctgtaaattccttaacatatttatagcaaatctttgcttggtaattccaacatgtgggctgtctgaatctgcttctgctgttttttttttccttcttgacaagtgtcatgtttgctgcttcttcacatgtmtactagtatttggttgtacactggatactgcggagccagtggtagaaactctggattctcttgtcttctgttgaagagtgtagaattttgttctggcattcagttaaattactggcagatcaccttgttccctgaaagccttggttttaggctttttaagggtaggactacttgagttttgcctttagtcctgggaaatggtcttcactcctgaggcatggtcctttggggtttcagtggaaagctcaaggtatttgacaagctcctctaacttggcagaccttgaactctttttttttt

SEQ ID NO: 102571 - DNA, 601 bp, Human
tttccagagcttatataccttctttttttggaggggggggatggagtttcactcttttcacccaggctggagtgcaatggcactatctcagctcactgcaacctccgctttctgggttcaagcaattctcctgcctcagccttctgagcagttgggattacaggtgcccaccaccatgcccggctaatttttgtatttttagtagagacggggtttcaccatgttggccaggctagtctttaactcctcacctcaggtgatctgcccacctcggcctctcgaagtgttgggattacaggcrtgagccaccgcacctggcccagagtttatataccttctaagctacatgtctacgtgtaagtgtgcattcatctaaagacatgtgattaacttcttttaatctataactaaggtctgagtcctgaagaccttcctctggagcctcagtaaatttacttaatctagatgggtccaggtgctggggtgattacccttattttgtctcctgctaaatcatggaggtttggggagttcctccagacccccaataaacttgtctgtggaggtctggggagtttagacccccagtaaaacttgttta

SEQ ID NO: 102572 - DNA, 601 bp, Human
cctccgctttctgggttcaagcaattctcctgcctcagccttctgagcagttgggattacaggtgcccaccaccatgcccggctaatttttgtatttttagtagagacggggtttcaccatgttggccaggctagtctttaactcctcacctcaggtgatctgcccacctcggcctctcgaagtgttgggattacaggcatgagccaccgcacctggcccagagtttatataccttctaagctacatgtctacgtgtaagtgtgcattcatctaaagacatgtgattaacttcttttaatmtataactaaggtctgagtcctgaagaccttcctctggagcctcagtaaatttacttaatctagatgggtccaggtgctggggtgattacccttattttgtctcctgctaaatcatggaggtttggggagttcctccagacccccaataaacttgtctgtggaggtctggggagtttagacccccagtaaaacttgtttaatcctaaatgggtcctgttaagaattatttcataatcttgtcatgctttaaggcccaggaaaggcttgggcaaaactcttggtgggcttttgttaccttcc

SEQ ID NO: 102573 - DNA, 601 bp, Human
cctgcatcctgctgcccggacaggcaggatttttcctggggtgacctttggctgacggttgctccttttttctcttttctcctccttcccgactccccaccaccctgtccccgcagcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctrcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtg

SEQ ID NO: 102574 - DNA, 601 bp, Human
attggaaaagagaagcaagaatgaacgtgggccctcgggtgggaagactaggaatcggaagcttctagggcttcacatcccttcccctcccctccccttcccctcatcttccaggcaacagtgcctgcaaggcctgaattagagagacttccattggctaagtagttaagagccgtcccatttctcctggcggggtaacccattacaccgaagtcctttgttttctaccacaatcctcctcctcctctccaggggcctggaaacactaggattcaggaaggtaggcaggacgtgagagaasggagatgggagagagatttaagacaaagggtggcggtggttcctggggtctgagatgtgttaggaggcgtttaaaacaaagatccagttcatttactccacagttattcccagggctggccctagccacaaaggaactttagggcagggtagggaaaaaaggggcagcagggggtgtgtttgtggacaaataaatttgtaaagtccgaggattaaaaaaaaaaaaaggttaaaccggtttctctactgctggacttttcagagtctttcatatgctaacattcattgtgaatctcccaag

SEQ ID NO: 102575 - DNA, 601 bp, Human
ctacagggtgagagggcttttttgaagttacattaatagaaggcacttgttatttatgaatacagcaaacaaaaaccaggtattaaaaactttacagccattctgggttgtataaattctcaccaacactacattccaatgtagtatttgacttttggattttttatctttagtaagtcatttttataattattggcattttttggtgcttaaacttttttgaatgaaatttaagatgattctaaactaaaagatttgaagtgtatcatccaattttgatatcttaggctgatcacttaartgaaacatgctaagtttcagaaatcctatctcttatactaaggattagaaatgcacttctcgttgtacatatctagtctgatacttcaaattaatttcattcaaccttcactctgcatttctttgaggtgacattaaaacgtttttctctttttcactgtagagaaatgagtcttagttagaaggtcaactactaaatccaaaagacaaataactatgggtagcgattcaaactggtgtaccagccaaaagctttccagccctgaaaaagccaggtctgaaagaccagcctctactagaa

SEQ ID NO: 102576 - DNA, 601 bp, Human
gaatgtgtttccatttttgaactgtttctttccttgctactatcaggaaacccacctctagcagcaactctctttccaattttctgctttcaatttccaatggggaggcgggtagaactgtgcttacagaagagcaaggtcctaggaaatctcctatgaataaagttcatggttttgtgaaatttatcttggttactcagttttttgttgttgtttcttttgcaattctcagctgtttctctagcaagaacttatttaagagctttcttctggggcagaatttctattaatgtacagaaayaggctgtttttaaagacatttttgtctcaatgtgttttcacacctgtacttaagagaatgttaatcatcatctgaatgaagaactgactaggagtgaattccatcttgtagctatcataagcactccaaaaggtctcgacatgctatacaaagtatttactgtctgagaactacccaagtatactggagtcatcagggaaacccaatgttctctacagcctaccacaagctactggacagggcttcacagattcgttccttgaaaaccactaatgcaatctgcgcacaacaataccatac

SEQ ID NO: 102577 - DNA, 601 bp, Human
tttttcaaagaatcacattttatattaatggaattgctatttcccctcctttctcccaaagaaaggtacacaaatcatctgtatattgagaccagtcaacttacaacaacaacaacaaaaacccaaactaaaaaaacaccccaaaacaataataaagttaaattccagatggctttcaggatagtaaagatttatatcattacacacctccaatttatttaacgtctcagacagacatctttctacaatgtcttaaacatttctttaaaaaaagctgaacatactttagaccctttctggrtaagattcaattagaaacaaccactgttttgctgtgctgtaaccctctgtcagatgtcaaaatctgttgttgactctttcaacggcctaggggctatgcttttggagaatgtgtttccatttttgaactgtttctttccttgctactatcaggaaacccacctctagcagcaactctctttccaattttctgctttcaatttccaatggggaggcgggtagaactgtgcttacagaagagcaaggtcctaggaaatctcctatgaataaagttcatggttttgtgaaatttatcttggtt

SEQ ID NO: 102578 - DNA, 601 bp, Human
tgaggtggtaagaccactgtcaaaattttttgaaattaaagaggtaaagaattctaaaatgcctatgcttccgagctttaatatgaattaaaacactttaaaaacacagtagtatttgctctttgatatttttcaaagaatcacattttatattaatggaattgctatttcccctcctttctcccaaagaaaggtacacaaatcatctgtatattgagaccagtcaacttacaacaacaacaacaaaaacccaaactaaaaaaacaccccaaaacaataataaagttaaattccagatggytttcaggatagtaaagatttatatcattacacacctccaatttatttaacgtctcagacagacatctttctacaatgtcttaaacatttctttaaaaaaagctgaacatactttagaccctttctggataagattcaattagaaacaaccactgttttgctgtgctgtaaccctctgtcagatgtcaaaatctgttgttgactctttcaacggcctaggggctatgcttttggagaatgtgtttccatttttgaactgtttctttccttgctactatcaggaaacccacctctagcagca

SEQ ID NO: 102579 - DNA, 601 bp, Human
cttcactgaaaatagctatcactgcaaattcagaaatgttcaaaagaaaatgactttaagcacataatttttaaatgttttacttagcagtttattgccaatgctttgacaacctggctgcaagaacaaataaaatattacacagtaacccatacattgaaaatatatggttatatatcaaccgtctcaagttcaggacattacctggtaccctcttattctgctcaattaccattacacatacagtcaacacttgattatctgcagcaggatctgaacccttaacacttaccattctcayactgtctacaggggccttaacctattagcactaggaatgtactcccaacaccaccacaaaaacaacttcccaggttcaaaaacaaaaacaattagtgaaataacaaaccaccttacctcctttgccaggctagagattttatttctcttaaggttctgtctgttacctagtggttttcttgtaaaggggaatgagaagtgtgaattaaaagtcacacattgttttgtcctgagtcctaatcacagtgtaaaagcaaacaagtttatcaggaacagagaagtggcagatatcgggcctgat

SEQ ID NO: 102580 - DNA, 601 bp, Human
agatctcgccacatgccaccaataatcttgccaatctcccacaactttaggtcagggttggaagcctttacttggtcccagaccttaaaaagaaaacagatgaaatgttaatactgatgtctaaacgtatagacctttaaaaatagtttttaatgtggaaacttttcaacatacaaagcagagaaaacagtatcaaatttctaggtactcatcagcctacttcaaaaattatcaagaactggccaatctcaagttatctttgccctactggattactttaagatagatctcagacatcacrtcactcacttataaatacttcaatttgataagcaagaatatctccaatcactacagacacttaggatgagttacttcaataacatagtctacgtctctaaaagttcatgtgaatttagaagaaaagtgcttaatttgcataacacggtacatcatattatcaaatacaaatataatagtcaagatcaaaaggtttaacatttctagatagtggttataatgctctgccttttaataaagatattggctactttttttattttaagagtaatgtaggctcatcaccaaaaaaaaaaaaaaa

SEQ ID NO: 102581 - DNA, 601 bp, Human
ttgaactcctgggctcaactgatcctcctacctcagcctcagctggagtagctgggactacaggcacaagccgccatgcccagctaatttttaagtatcctgtagagataaggtcttgctgtgttgcccaggctggtctcaaactcttggccacaaacgatcctcctgcttcagtttcccaaagtattgggattacaggcgtgagccatggcgcctggcaatgtctatcttttgatagtcctctgttaaagaagtcagtagctgttgtacttcatgcagatgccacctttctgttatgtayatttgacatacatttccacctcccaagtattcctctttctaatcattttcgtactggtatgctaaagacattctcatattggcatcttaattgctacctgaatttactagcaactttaagacccaatctgaaagttaaaaacatcataggcccaagtttcagactgtttctgagtgaatctctttagtccttctcagtgttcatggtgttaatgaaagctttagttattttctacttacgttgctagcctttgtttcctcttgtactgacctccatcctcccaatatctgtagactggat

SEQ ID NO: 102582 - DNA, 601 bp, Human
acccaccagacagggaggaaccacacttaagaaaaccttgttacaggggaaaccctgttacagaggcctatgttgcgctgctatgtcagtttagcacctcccttattgtctggcacttaagtagttcctaaaattctcattattataaatactacagctaaaaactgttgtttttgtaaaaagttaaaaaaattacttttgtttccttttgagtaatttctttaggaaataaacttctgaaattaaaactactgggtaagatacagtttttttaaaactctgtaacctttctactttttargagtttttcacctttagggttatatatggtacatctgtgctacatctgtctaagttatctgtttttgttgttagcttttgttttcttctttcatttatatggccccagtgttgaccacagatggggacataaggtctaagcaatttgggcttgttcttctttgcatgttagtcgtctgcttccttttttgggggaatggcttctctggttatgatctaattgaacagctatttatcctatgatgaagaggctctcactgaataaaagccttcattgtcttgtgtggataattgcacatgc

SEQ ID NO: 102583 - DNA, 601 bp, Human
ctatcaccttcatagtttttcatatatctactaacagcctgtactatcgtttacttaatatttttctttaaactaactcacttaaaaaaaaaaagagctttctctttagtaatacatattaaaacaaacgctcctctctgaaccacttaatcacctcagtgacccaccagacagggaggaaccacacttaagaaaaccttgttacaggggaaaccctgttacagaggcctatgttgcgctgctatgtcagtttagcacctcccttattgtctggcacttaagtagttcctaaaattctcattattataaatactacagctaaaaactgttgtttttgtaaaaagttaaaaaaattacttttgtttccttttgagtaatttctttaggaaataaacttctgaaattaaaactactgggtaagatacagtttttttaaaactctgtaacctttctactttttaagagtttttcacctttagggttatatatggtacatctgtgctacatctgtctaagttatctgtttttgttgttagcttttgttttcttctttcatttatatggccccagtgttgaccacagatggggacataaggtctaa

SEQ ID NO: 102584 - DNA, 601 bp, Human
ttcattgttaaatgaatctgtgctttccaggaatttcctcttcttctcctggtgtcgttcctctatttgaagaagttcagcttctagttttcgctgcaagacaggatcaggcttcataattgtgtctcattttttaatggtccatactttcaaacagtgtaccaaataatgttttgaactttagatcatttatcacatgagtctagctaagatttaaaaaatacaaaatgcagcacaaagaaatgattatgatcaataggtaaatgttaaagaatactgtttcaggcctgagcaattcctygggaaaaaatatttagcatagcagtaaagattgataggatgcctcaaaattcttaagttcacacgtatttcttaacgaatatactttccattacaaggttctatattatagtttttaatgacaaacttattaaacatctgggaaaggtccacttccttaaacctcttctccaaatcaggaacaggttagattgacatatttaacaggtagatttaggcatggtgtaggaatcatatcacctgggatttgtggtataggcacatcttattgaaatgaatgttttatgactttacctgatga

SEQ ID NO: 102585 - DNA, 601 bp, Human
cagctctagcagttgtataatataggatattccagagcagctggtgaggcaaaatagtgaaagttctggggtatacataaggcttccgttttacattttgggctaccaactagatttccttgtctgaatgcaaagtgcaaattataaattacatttaatgacgacatttgatgaataaatcacaataaaatgaaagtaattaatgactgtatgggagtttaacatatcagagggctctagcatttacaggcctagaagatatgtgtatactctatgatatttcaaatttattgcaattttsccagagaatgggaacaatcttataaaaaaaggatcctacaggtttataataaagttagccctgtttcaaagtgaacaacattcaataaaaacactattttggaaaaaagaatgaggaaaaataaagtaacaggtatagtgataaaagtatagttaacatattaaacagatacccttttaagttcattgttaaatgaatctgtgctttccaggaatttcctcttcttctcctggtgtcgttcctctatttgaagaagttcagcttctagttttcgctgcaagacaggatcaggcttcataa

SEQ ID NO: 102586 - DNA, 601 bp, Human
taggcagtgttaaaacagtgccatgaggtaaggtgatctcaaaattacaagtgacgatcaatgtaatcagtactttatgtaagttttatttatacaagttattattatttttttttaccttgagggatgcttttaatcaggaaaatcagtatacctagaagtaagggtttttctaggacagagctggcaatttttttctgtaaagagccagatagaaaatattttagacttcgcaggccaggcagttgttgttgcaactactcaactatactgttttatccccaaagcagccacagacagtatgtaaacaaacaagtgtggctgtgttccagttttatttacaaaaacaagtggtgggcaggattggcttacaggtattactttgcagaatgctgtcctaggacaccaaagacaattaatcttaacggtaataaccacatcttgataaataatgtaagcatttaaaggttaaaatactgaatgtcaatatcatgtcaaatttagtactgggaatcaccctcagtggcaggtaccagaatacttgcacttagaaagaaaaacctaaattaaagacagccgtacaaagtcttggcactgcctc

SEQ ID NO: 102587 - DNA, 601 bp, Human
aggacagaatctgagtaaagacctgcaaaccttaagcataagacatgccccattcatagatgccaaaacagaggcaaaggactgagtgtttgtctagttgcaaaattagcaaaaatcagttattttaattttcaagctcgttttaaccacaaaaatgtgctcatgctccaaattcattacaataaaaaacacattcatacaaaacagaaagagactcagatactgaaacttaaaatatgaccatttcaaatgttaatctgctggattaaattttgcagaaatacctggtaaagatatctayattccattacatgttttccagatggttgtcatctgagtaccaagtatgactactgtccctcccacttcttgcaacgatgctccaggaagcctttggttttgttttccataactacttttagcttagtcctgtttacacagtgtactaggcagtgttaaaacagtgccatgaggtaaggtgatctcaaaattacaagtgacgatcaatgtaatcagtactttatgtaagttttatttatacaagttattattatttttttttaccttgagggatgcttttaatcaggaaaatcagtatacc

SEQ ID NO: 102588 - DNA, 601 bp, Human
cttctggtatgggatctgttggtggctcctccactgttgcactgttgctctccgagccagtgttactatcactggttccttcctctgccatactgtcgaccccctcctgcccactctccttgtcctcaggagtagacgtgccttcttcaccattctgttggctctctgttgtttcttcaaggtgtgtctcctctgtaatcacacatttgtcactgtcagttccaagatgaaattttactctagttatgctgacagtatacagctgtgctgtccaatatagaagccactagccacatgtggktattaaacccctgaaatgaaccagtgtgactaaagaacttttaagaatgttggaacaatttgggtatgaaaatctactttttagctgtaaatgaatgaaatttattaaataaatgcagatcaaatacttccgatgaaaatttagcttctgaattgagatgtgtataaagactgtttaaaaaaaggaaagctgattttaaaaatgttccttctgtgttgaaataattttatttaggatatgttgaattaaataaaacatattgttaaaacacttgttttgcttaacttttaaaaatatgtc

SEQ ID NO: 102589 - DNA, 601 bp, Human
gattctgataattattatgaaaaaaagtttcactctactacagtgttgatctcaaggattactgaaatactaagaactagtttttcccaactcatactggttctagatacatataatttttcatccatgtaccaacaattaatattagccctagtcacatctaatttgctgctttgaatatactgtattctagaatattagggaattcttgttagaactggatataaaaaaaagaataaatagaagaaaacgtaaggattttaaagacaatctatgaccatattattaagcttcactgcawatgtaaaggatatgtaatgttactataaattccagtggtttaaatttaaatatttcattcattagtaggttagatagtagttgacatgtgaggtatgtagtatatgttaacccatgaccattctgtcctgctcccaagttgtgataaactaaaacaatagtagtgaaatctacggttctaaatatatgatcgctaatcttctcaaggtctatctgcctgaataatgattctactcttgtatatgcgatcccagcactttgggaggctggggtggatcatttgaggccaggagttcaagac

SEQ ID NO: 102590 - DNA, 601 bp, Human
ttttaagatggggtctcactatgtggcccagaacagtctcaaattcctgggctcaaggaatcctcccaccttggtctcctaaattgctggtattaaaggcaagagccactgtgcctagccctctcaccattattaatataaatgttctacttggattatttagttcttctaactgaatttataaatacctttttcatttattttattttattttattttatttttgagacagagttttgctcttgttgcccaggctggagtgcagtggcacaatctcagctcactgcaacctctgctttcyggtttcaagctattctcctgccccagcctcccgagtagctgggattacaggcgcctgccaccactcccggctaattttttgtatttttagtagagatggggattcaccatgttggccaggctggtctagaactcctgacctcgtgatctgcccgcctcggcctcccaaagtgctgggattacaggcgtgagccactgtgcacagccataaatatctttagaaagtaagctgaagcaaatgtttggaacaaccagttgaaaggactgacctatttacaaaaatattaaaactaacactcat

SEQ ID NO: 102591 - DNA, 601 bp, Human
aagagtctgtttcatggctctagtaacttagctggcttctaacaccaataataaatactaaatagcatccatttccatagtaatatatgcttatcaacatttttacatttattatttcttttgatccttattataaccctgtaatacagatagggcattattatctcacctttatttcactgcttaaagatgaggaaactgttagctgcagaaaaagttaaatgactaaccaaaagtttcagagtctgaacatgattagaatttcaatgtggttcttcttacatctaataccatcctcatyccaatataaaagactgtcttttcatgaatgggtgccatttacaatgaggacaattaattcaaatagataggattatgaggaggatataacatttctatcagaaagtaacttcaagctcattctctaatgacaatggataacagatgaaagggaacactgcaatccatatcatgttctttttagagatgattaatctatatccatttccttaaaccagtactgatcacaatggctcactttgctagataaatatatatgaaaagtagagctgttcattataaacattcttatgaaaccact

SEQ ID NO: 102592 - DNA, 601 bp, Human
acacattctatgcatgtagcaaaaatcatatgtaccccataaatacgtacaaatattacatatcaataaaaaatttttaaagaaaagctatgttaaaagaatcaaaattgcttgtcatttgttggtatatttcaaatattattctctacatcacttcgattttccttttgcctgcttcacaatgtcaaactatctggagagtttccaattatctacaacctaaattgaaagatggacataaaatgatgaacccacaaaggaacggaaagagtcagcagtcatactctcaaacattatacartgtgtacacatagcaatgatcaacaaaagctagacaaagtaaaaaaactctagttttagtattacctttgaccaattgattctcttcatggacacttcaggtttatacatttttttctgcttcattccataaggtagattaagtgatattcctgggggaggaggaactcctccaaggggtggtggtggaggaggtcccccaaataaaagtggtggtgggggtggtggtggtatccccatcattccaggtaaaggaggtggtggaggaggaagaggagctcctccgggtagaggtggcgcg

SEQ ID NO: 102593 - DNA, 601 bp, Human
agaaaaaaattaaaaaatgtattaatgtaagtgaaaattaaaaaaacaatatatcaaaacctgtggaaagcaatgctaagagggatgttcatagcaataaacaactacttcgaaaaaatggaaagatgtcaaataaacagtttaattttgcacctgaaggaactaaaaaagcaagaacaaaccaaaccccaaatcagtagaaggaaaaaaataataaagatcagagcagaactgagccagacagagattaaaaatataatacaaaagagcaacaaaacaaaaagttaggttttttttttttgaaaagataaaactgataaaccactagctggattatccaagaaaagaaaaaaaaaaaaagaaagacctaaataaacagaatcagaaatggaagaggagaccttacaactgatagcacagaaatacaaaagatatcagagactactatggacaactatacattaacaagctgaaaagccagaggaaatggataaattactggacacatacaatctaccaagaaagtccccccagtaaagaaaagccccaggactaatgactttactaatgaattcttccaaacttgtaaaaaagaactaac

SEQ ID NO: 102594 - DNA, 601 bp, Human
aaaataaactattaacaggataaacagacaacctgcacaatggaagaaaatattcacaaactatgcatctgacaaaggtctaatacccagaatctataaggaacttaaagaaatcaacaaccaaaaaaacaaataaccccattaaaaagtgggcaaagaacatgaacagacacttctcaaaagaagacatatgggccaggcatggtggctcatgcctgtaatcccagcactttggaaggctgaggcaggtggatcacctgaggtcgggagttcgagaccagcctggccaacatggtgaaamctcgtctctactaaaaatacaaaaattagctgggcatggtggcgggcacctgtaatcccagctactggggagtctgaggcaggagaatcacttgaacccaggaggcggagattgcagtgagctgagattgcaccatcgcattccagcctgggcagcaagagcgaaactctgtcacaaaataaataaataaataaataaaataaaaataaaaagacatacaagaggctgacaaacatgaaaaaatgctcataacactaatcatcagggaaatgaaaaattgaaaccacaacaagataccat

SEQ ID NO: 102595 - DNA, 601 bp, Human
tctgtaatgttatgaagctaccttcaaaagagtcaaagtgaaaaattgatttcattactttatgcatctcaactatattaatatatcattaccaaatgcctaatgacatgaagaccacattccttccctcattattagaaaagacagacttcaagtcacggcaacgttttaccactgacagattctacatagaaaatgcctaaaaaaatctaaattatagaaagaaccttatttctttccatggataacgtacagcttcctagttttggtttgagctctgaagaactatctttagtgccakgataataggattacatatttcacaagataatacaatatatgtggaactatatgattaaccatatgaaaaagggatcagttaacagtgcaacaaaatgcacaaattactaagggcatagaagccattaaaagtcattgttacagcatacagaagtgattaagattaagaacaaacttgggctcaaatcaccattttgccacttactagatatgtaaacaaaatattgcttaatctcccagagtctcagtttcttaaccgacaaaacaacaatacaagtacctagggttggtatgaggttgg

SEQ ID NO: 102596 - DNA, 601 bp, Human
tctcctcctgaagaggtagtcagtgaaatgttccaaacatgggaatgccatgattatcacaaaacaggagagaaggcagaaagaccaattaggattctgttgaagtcatcaaagaaagagatatcataacatttgttaaaatcaaattgtatatatccatgtgagtatgcagcttcttaaatgactcccaaatgtttcctgcatcctggtagtcatgcccttgagtaattcccctatcagtgtgtaagggttgaacctagttacatgttattaatgacgaaattaggctataaaagactgkgacttccttatgaatgacttgctttcattctttgtcttcactccttggctttcactctgatgaagcaaatggacttttatgagctgccctactgagaggtccatgatcaaggaaccaagggtgggttctggacaacaaacatccaagaatgaaggccctcagtccaatcactctggaggaactgaatcctgccaatcatatgaatgagcttaggaacaaatcattcaccagtcaagccttcacacaggaccacaaccctgacaacatcttctatgcagccttgtgaggaactttgaaaca

SEQ ID NO: 102597 - DNA, 601 bp, Human
cggcctaagaatggacctacatagcaaatttcccaaaggcctagagcccattttttgctttgctgccaaaaggtacagatgatctttgaaaagatctctaaacaatccctaaatatctgaccagaggttgattgttctcactactccttttgcttcttactcctagtctaggggaacataaatagatctgagctaaagatactaaaatacaaaaataatattaccataaaaacatttaattacctttcccttccacatataccttcaaagttctgtacatttgttcccctctattaaaacwgataactgaaagaagctacatataccacataaatactaaattataaaaagagattacccatttataaccatttgcaaaattcataaaaaccagaacaaactcttaagaccactactttattagattctaactagggtccatcctaattaattaaacttagttcttggtaataattttcagggaaatattatgcaatatataaacactgaggcacaaatataaactgcccaccaaggaaagtgataatggtattttcaaaaacgttattaaattggaaagagttgattacaataaataatt

SEQ ID NO: 102598 - DNA, 601 bp, Human
agtattaagtctattgaatggtttatttaacgcatagctggtgccttcattaaaagttatcagtacatcaaagtattgtgtattttgactggcaaagagatgtctaatatttcatgtgccccaattgtcaatctctacatggtaagggaaagaggttgctttagtcctattaatttcagggtacatgtccttaagagtcaaggcattattaacacatttatgccttaaatcttgtatttctgttatgtaaatatgaataataaagcagggcatattttcatttcctctacaaagatatcartgatgaatttcaatgtgataagtaaaatattgacattctataaacagtcatgtcacaaactctaatgtcctggtaactctgttacttcctacatggaaagttggttggtcctaaagtcaacttcctcaatggcagtggtcaggctaaagtttgttcagaaatattaaaatcaaacaaattttaagtaactattgataggtttaattactcataatgttcaacaattaatatacatgcacattgttaatatttccatgcatcaaagtccttttatataacctcctttttgattactcaaat

SEQ ID NO: 102599 - DNA, 601 bp, Human
caggagtttgagaccagcctggccaacatagagaaaccccttctctacaaaaaatacaaaaaaatttagcgagacatgttggcgtgcatctgtaatcccagctacttgggaggctgaggcaggagaatcacttgaacctgggaggcagaggttgcagtgagctgagatcgtgccattgcactccagcctgggtaacaagagcgaaacttcatctcaaaaaaaaaaaaagagggactaataataagtaacctcaaaggattattgagaagataaaatgagttgatgcatgtaagacaattayaacaatgcttagcacagagtaaatgctatgtgtgagccattatcatgatttattttccaccttccacctgcaagtttatttaaattgaatttttttttaatgaacaaaattacatcattcactgagaagtcagaaagtacacaaactaccatttaagatgctgcattttgaaggaaggggttactgagaaaagagagaaagtactaagatatattccagactccagtgatattgataatgatagcaaatataactcttcaaggtaacatttaccttattccaacaaagataaataattaa

SEQ ID NO: 102600 - DNA, 601 bp, Human
agacagagaaaacaaactgttagttatatatgtgttcacatatatacagcaacctggtttttccagtcatccattatggaaatggggcttttataacgtgctaacctctaaaagcaatacagattaaacggcaaacctcttaaagctactgatgtgatgctactttatcctcaatgaatagcaggaaaacaaataagcaatgatttactgtaaagcttgatgaaaagttaaagagaaaataatattgaagcaattagcaaattcataaattataacatagtaaaaaaaaaaaaaaaaaaasaccataaaacaggataccttggtttcaatcactatgtccccatttattatctgtgttatcttgggcaagttatgtaatttctctttgccttattttcctcaggtataaaatgggactaataggccaggcacggtggctcatgcctgtaatcccagcactttgggagggcgaggcaggtggatcacctgaggtcaggagtttgagaccagcctggccaacatagagaaaccccttctctacaaaaaatacaaaaaaatttagcgagacatgttggcgtgcatctgtaatcccagctacttg

SEQ ID NO: 102601 - DNA, 601 bp, Human
tcaacagatacctccaatggtcctaaactccaaagaattccaatctggcttccatctacactaagtgttagaaaataatgcattaagatcaataacattcttgatactgccaaacctaaaatatatttgctgcctttatctgactttaagcaataatctacacgacgaaactagtccctcctttcttcctgaaacagtttcttctcccggcatttattatatcatattgttcttcattttgccacttctttgttggcattttctttgctggctgctcttcctcccattggcccttcaaatrttagcattcagcaattaatcctgggccctctttatttttctctttctacagttcttcttcaggtaattgatatggttaggctttgtatcctcaccaaaatctcatcttgaattgtaatccccataatccccacgtgtcaacggagagaccaagtagaggtaattgaatcatgggggcagtttcacccatgctgttctcatgacagtgagtgagttctcatgacatctgaatagttttataaggggctcttcctgcttcttttggcacttctccttcctgctgccttgtgaagaaggtgcc

SEQ ID NO: 102602 - DNA, 601 bp, Human
gaggaaatccaatgaaattcaagataacacagagaaggaatttggaatcccagcagaaaaatttaacaaagagacataaataattacaaataatcgagcagaaattctgaagttagaaaatgcaatgtcatactgaagaatgcatcagtctcttaagagcagaaatgataaagctgaagaaacaattagtaagcttaaaaacaggctatttaaaaatacacaaaggagacaaaagaaaaaagaataaaatagaatgacgcatgcctactagatatagaaaacagccttaaggccaggcacrgtggctcacatctgtaatcccagcactttgggaggccaaggcaggcggatcatgaggtcaggaaattgagaccatcctggctaacacggtgaaactccatctctactaaaaatacaaaaaattagccgggcgtggtggcaggcgcctgtagtcccagctactcaggaggctgaggcaggagaatggcgtgaacctgggaggcggagcttgcagcaagccaagatcatgccactgcactccagcgtgggtgacagagcaagactccatctcaaaaaaaaaaaaaaaaaaagaaaaaaagaa

SEQ ID NO: 102603 - DNA, 601 bp, Human
tgcatatgtgaattcatgttgttgcccagtgctttattgaagttttacagtatttatgacctttcacttaatgtactatttataatcttccaaaaagtagtgttcttctctcactaccatcaaacaaaggagaaaaaagataattctaaacaactaatgtatagtaaataaaattcatagagaaaaataagactaatgatatttacgatgttttcctcaaaggcctatattaaaaatatttagtgattatcaagtttgtattgagagacacacttcagggttaatgttttctggtaattaygttgacaaatattaaaataagcactttccagtagatgtgcctaaaaaattcctgcaattttcttcaggcagctccaaggaaggtgttaaaaacagaagtagtgcacagcttcatacccaccaccatgatggaggcccgtgacacacctcacagactgccagtcgtgccaaggatttaaaaaatagtcacattcaacattaaccagcaagactagaccaccaccacgtttctccgtgaaactgatatattctctttcttatcacacaaccatgaagacttgcagcatgagctgaggcagct

SEQ ID NO: 102604 - DNA, 601 bp, Human
tatttcaatttatctatatcatctcatgaaagcattaaaacaaggacagtggaacttacattgaacatatatgactgtaaaatgaacaaagaaggtcccaaattcttgagggtcacttcctaactcttcctccccattcaatgcatatgtgaattcatgttgttgcccagtgctttattgaagttttacagtatttatgacctttcacttaatgtactatttataatcttccaaaaagtagtgttcttctctcactaccatcaaacaaaggagaaaaaagataattctaaacaactaatgyatagtaaataaaattcatagagaaaaataagactaatgatatttacgatgttttcctcaaaggcctatattaaaaatatttagtgattatcaagtttgtattgagagacacacttcagggttaatgttttctggtaattatgttgacaaatattaaaataagcactttccagtagatgtgcctaaaaaattcctgcaattttcttcaggcagctccaaggaaggtgttaaaaacagaagtagtgcacagcttcatacccaccaccatgatggaggcccgtgacacacctcacagactgcc

SEQ ID NO: 102605 - DNA, 601 bp, Human
caagatcttaccttctggagtaaagacagactttttacttctcaaagagttaagaacatctgaagaaaccaagagtaatgtccatcttacttgcaacttcctcttggatggcttaaataatcttccttatatataataatatttgtcagtaggtgataatgagtacaactgcaaaatcaccttgctactacaaacaccacatgtccaaaagttaactataatagtccctccttatccatggtttcattttctacagtttcagtcacccatggtcaactgcagtccaaagatattaaatggraaaatccagaaataaacaattcataagttttaaattgtgtaccactctgagtaacatgatacaatctctcagtgtcctgctccatcccgcctggaacataaatcattccttcatccagcatatccacaatgtgtatgctactcatccattagtcgcttagtagttgtcttggttatcaaatcaactgtagaggtaacatgctagtgttcaagtaaccctattttataacggccctaatgcacaagagtagtgatgctggcatactgtttttattgttctactttattattatagctgtta

SEQ ID NO: 102606 - DNA, 601 bp, Human
aaaatgaaacagggaatggtgtctagtcaacagaagcctattagccttcttaagaagatttggtcagaattgatgagttaatctgtttttaacagatcaggtcattctcaacttaggaaagacatcagttattttgagatggaaatcaagaacagtcagattttattctggctttaatgatatgcctttcatattggctagttgctttgtttctttacctcttctaatcagatcatactcaggagaaataaatggaaatataagtgaatctattcatgtctgctactatagtatagctatracaaaatttatgtttgaacacaaacccccaagcactaacagggttgagggaaagaggacaagccttcttttgggtggaagagtgataaatcactgacacacacaaagagggtgactcttgcctccctaacctacacagactaaagcatgtctttctctgatgtgggaatgatctgaatccctatctgttttagagacactggctctggaatatgtgtagatatgaatacgctggatgttcatttgaaggtattaccaaatgttttagagacaccagggatctcacagaatttctccattt

SEQ ID NO: 102607 - DNA, 601 bp, Human
caatgaaattattagaggaaaacagaggtataaatttttgtgaccttagattaggcaacagttttttaaatatgacattaaaagcacaattaaaaaaacagatcaatttagcttaataaaagttaaaacttttgtgtttcaaaagacactaacatgaaaatgaaaacacaacccagagaatgggagatatctgcaacaattcaatgataaaatgatgaccccattaaaaatgagtaaagggggaagctgaggcaggtggatagcttgagcccaggaattggagaccagcctgggcaacatkgtaaaaccctatctctacaaaaaatacaaaaattagccaggtgtggtgacatgtgcctgtagttccagctactcaggaggctgaaatgggaggatcacttgagcctgggaggtggaggttgcagtgagccaaggttgtgccactgcactccagcctgggtggcagagcaagatcctgtctcactaaaaaaaaaaaaaaaagaaaaagaaaaaagtaaaggatctcaatagctatttctgcaaagtagatatacaaataggcaataaataaatgaaatgctgctcgaaatcattagccact

SEQ ID NO: 102608 - DNA, 601 bp, Human
aagtaatagagagtgttcagtagttacaatggtaatatattcctcctcaactgtaatgttctgaatctagtttttttatacgagaaaagaggaggttatgttaaaaaaaactcagtggtacaggggtctcaagtatggattaatttttaaatcgttacatgatggtagtctgatttctctctttcttctagtcctaagtcatgaaagaacattgctgcaggatgaagtttttgactttttttttttttagaatgagttctgtacaatcccaaggaaagatattttgcagacttgacaattycacattgatttccactttcctattttttggaaccttaggctaacaacattaaaaaaaatctgttctgtatataccatgtagattattttaaagatcactctatatcatacatacgtttctactcacaatatgattgaaactgttaattatctacatacataataataaaagtggactacaatgcttgttggaacacttatatttttcattgactttttaaaatcctaatttctataaacaaataattctgaccaaatcctatctggcaatatctggatccttttggttttcatttttagc

SEQ ID NO: 102609 - DNA, 601 bp, Human
cttattctttttaatggggacctctgagaccaacaatgtctagaaaaataccatgctcactgttacacagagactttcctagattactgtatccaatccacacatacacacttttaaaaaaattaagtaatagagagtgttcagtagttacaatggtaatatattcctcctcaactgtaatgttctgaatctagtttttttatacgagaaaagaggaggttatgttaaaaaaaactcagtggtacaggggtctcaagtatggattaatttttaaatcgttacatgatggtagtctgatttmtctctttcttctagtcctaagtcatgaaagaacattgctgcaggatgaagtttttgactttttttttttttagaatgagttctgtacaatcccaaggaaagatattttgcagacttgacaattccacattgatttccactttcctattttttggaaccttaggctaacaacattaaaaaaaatctgttctgtatataccatgtagattattttaaagatcactctatatcatacatacgtttctactcacaatatgattgaaactgttaattatctacatacataataataaaagtggac

SEQ ID NO: 102610 - DNA, 601 bp, Human
tgtctctgtcctggattgctcattaaatctgctatagttcatttgagcactgcatcactgtgactgaattagacatttcagaatccaaggcctatgattccttcctcttgtgtatttcttacaaaatcttacaagcaaagctgtggtagtgttgtagaaataatgcatacactagccgatatgttttgtaagtgtataaacaaggttatcacaaaggtagactggtatcctcaaaccctccattgtgcatgcaggtaatatgcccagtatctgacaaggtttgagaagtagcaactcttaytctttttaatggggacctctgagaccaacaatgtctagaaaaataccatgctcactgttacacagagactttcctagattactgtatccaatccacacatacacacttttaaaaaaattaagtaatagagagtgttcagtagttacaatggtaatatattcctcctcaactgtaatgttctgaatctagtttttttatacgagaaaagaggaggttatgttaaaaaaaactcagtggtacaggggtctcaagtatggattaatttttaaatcgttacatgatggtagtctgatttctctc

SEQ ID NO: 102611 - DNA, 601 bp, Human
cagctggctgcagttttcattttccttcttataggtaaactatcaagctaattaaagaaccccacattatccttaaaaatacattcagctatttaataggaatagccatctaattattaaaggctatagtaaatatatcctctgagctgttaaaattgcttgaggtgagtggccaattaaaaaaaaaaaagaaaaaaaaacaaagcaagacagttatatatcactaagacatcaaagaagtagtcatcccctgacaaattaaaccagagaatagatatctgcatctctagataaaattaaraatacttcaaattccagattctggaagcatctgctaaacacaccccccaaacccaccaagccagcagctgtgtgatctatttaaatattccccaaaccacctggaaaaaatgcaaactatacagccttgttcataaaagaaaataaatgaatgtctctgctgaatttctaccctccctgtattataaaagttaatagccctggcaagggagattgcataattaagaattaaaatcttaatgacttaaatattttattcagtctttgatatcaccttaatgatagtagatgtccagaaagg

SEQ ID NO: 102612 - DNA, 601 bp, Human
agtcactctatatgataagcagagccactgtgggtgatcctagagcctgaagtgactgcatgcaggcagctttcattcaatgccctctagtcctgaactgaaaaatcaaaaatcacatatatccacacaaagcacatgtacattcattactaaaggtccattaataagataatgatctgtgtagactgtattgatttttttcttagacttttctcttttaaggtatttcttttgtgaatggagaagggaagaattgtgtgaaagagggactggaaacttgaactatcgacagaacatagtkcttgcccatgaaatcacctcctgaatcactctgattcttcaataggtagttataatagcgtgtttccctattctaaaaatgagtattaataaaaaactaagttacatcagaaaaggccaggtaccataatttctgtattctagtaccaatatctcatgtttaggaaactataacaagaataaagtcattctgagatgtcacatgtccatgtaagaaggggtcaccttaatttctgttcctgaaagtatgatagaatatgtaccctgatatcaactacctgtgaagagaactgaacatgat

SEQ ID NO: 102613 - DNA, 601 bp, Human
ttccccttccttctcagcctactcaacatgaagatgacaagaatgaagacttttatggtgatccacttccacttaatgaacagtaaatatattttctctgtcttaaaattttcttcacaacgttttcatctctgtcctactttattgtaagaatacagtatgtaacacatgtaaaatacaatataaagtacaaaaacgtgttaatccactgtttatgttacctgtaagacttttggtcaatagtagactattagtaaagttttttgggagtcaaaagttattctcgagttttcaactgcawggcgggcggtcggcaccccaatctccatgttactcaagggtcaactatatatctagctttccacttagatttcgtggaactgaatctgataagacactcaaaaaggcagagattatatctgataccaggtgcactatttaaagaaaactgaagcacataagatgtaataggtataagtgagtacagaaaataaaatagttacttctaggtagcatcatccttgaagtcccgcctccaaaatatacacatttttaacatcttatggatatgacatgagctattgtgtacactgttattctg

SEQ ID NO: 102614 - DNA, 601 bp, Human
agaaaatctgctctgtagtacataacacaacactctataatagctcaataaatacttcccaaatagaaaagtgcaaatattgttaacagtaacccatgaaagccctctttataatatcttccaaatcttggaatctaacactgaaggcaatacttggtcaaccattggtctcataggaatgacaaataatgagattttatgaaagaacaaaggatcctcaaggtacactccgttaatttttaaatcaattacaaactagatatatcattgagggcaaggatcttgcacatatttgtaaaayctatcactgtgctagggatatataagttcttagaataagttagaataagaatgcataaaatgcattaattaaaactatttatgtaaataataaatactaaaatgaatataagataccactgcctctctccccttttataggtacaggtgtcacaggggtagagaagacgggaaaagaaaaaataataataatctgctgttgaaaaggaaatcaaaagcagttaaaaatgagcgtttttttttttttttttttttgagacggagtctcaatctgttgcccaggctggagtgcagtggtgcg

SEQ ID NO: 102615 - DNA, 601 bp, Human
ctgacatttttctggctatcccatttattcagagaacttcctgttattttaaatgtcagaattcctgtcacgaatcagtgagtccagcaatcaactccaagagctaagtgcatcaaacaaagtactaagaaaggcatatctgtaggaattgcgatgctacaaaaaccagtatcactaggccaataggacaattcttgttgagaatacagtctgggcattcatcacacacaggcttttctgatttgatatggtccatctcagcttggtgcagatcctacacacaattcagtttaatgctacrtacattaaccttgctgagtaagactcaacaaagtaacaccctgaaatatttgtagccataatctcaaattgacaatgtaggacttttcagactaggagactcacagttgcctcctacatattattactaaataatttgagataaaaaacttccgtggagatgctgagcataaccccgcactttaatattcctcatagagttcttccttgtggccctaatcaaagtgttttgctgtgccttcctgaatattaactcaaagctgtggtttcttctcattatacatggcttggtatccttatt

SEQ ID NO: 102616 - DNA, 601 bp, Human
atttgaagttacttggatgaaactaaaaagtttttttaagttttgatacaaaaacttcatgaattgattttatcatcaattgccctatggtcctcaggttcataatgaggcccacagtcaaacgagaccttccccgtacaaatgaaaaaacatattgcaaatgggtttgaatccaatatattgaattaatttgagtgtgtaaattggcactgctaatagaataataatgaaacattataaaatactgtctgtaggaagataatcctaataatgaagacatttatattattattaaagataygttaacatcaagatactcattatctaagataaaatgcccactgagtattcttatatttcctttaatacatggatttttacaagcaattgtactataaatgtattcctttacaactgagaaatgctcatcagcataaataaagtaaacatggttatattctttccccaatttaatataggcaatgttcaggaatctcctattaatttctgatatcccagtggatacacagaacatgtgacaagttattataatttgtagcaagtattaagatattttaaataggcaacattgcatgattta

SEQ ID NO: 102617 - DNA, 601 bp, Human
aaataattacagaccagtggctattattgcctttggccttcttgttttaaaagcattccttagggatcatgaccacaggcttagataaatagagaattcaaagaacagcaatgagacatcaaatatccctatagtgttcaacacatcatatgttaaaaattgcctgctttcatagtgacctcaaaatgtcacttatcctaggatacttttattctgtatgtttctaatggttacaaaacattaaataaatagcaattctataattatttgaagttacttggatgaaactaaaaagtttttktaagttttgatacaaaaacttcatgaattgattttatcatcaattgccctatggtcctcaggttcataatgaggcccacagtcaaacgagaccttccccgtacaaatgaaaaaacatattgcaaatgggtttgaatccaatatattgaattaatttgagtgtgtaaattggcactgctaatagaataataatgaaacattataaaatactgtctgtaggaagataatcctaataatgaagacatttatattattattaaagatatgttaacatcaagatactcattatctaagataaaat

SEQ ID NO: 102618 - DNA, 601 bp, Human
agatgttaccatcttggaagcaacattctacagaattcatcaaaatactggaagtccgttaagacttcctttgttttaatggtacaaaatacagaaaaattaaatgagcatgctacagaaataccagatattaataaaataaattacctggataactaaactcctaacagtgctaaattttaccagactggccaatctaaagttatgtgcagtctaaggagaatggataattatacttagaaattatgatcttatgagacatggcaagcagtttgccatgtggattcaacataatagtcaytgctactactggaagaaaagtgacttttaatgtatttctcttaaaatatattaaaagaatatattttatgttgatatttatctgtatatatttccaaatatgttttaaaatacattaaaacatatctcaaatattcttcaaaggatctttctaagagcatagagtctttcatatgcaataatcaacattttaatttattctaattgtcaagccagttccagcttaagacaattgtatacaagaaaatgacagtccaatagtcattccctttgtctataaaatgtgaaatatctgaatcat

SEQ ID NO: 102619 - DNA, 601 bp, Human
agtactgtaattttgaagcattaatgactgtaacagtattttaagatctctgccacaactataatgtgatatgaaaatatttattatttctattagtgaaaaacttagaggtactgttaatactactttggtctgttgcctatactcttaaataatatgctaaatattaattagaagataatgaaaataaagatgtaatattcttcgcatacaagttcaggaccccctgaattctctccatgggtccccaaagagggctttgaactccaggttaccaacctatgctttatcatatctttasaaattattctgcagtaataatacactatcttttatgttgatcatctttttttcacatattccttaagaatataagtataaactccctacctagaatcatttgcatgcactaaggatctcaaatagaacatacttttatttttcccttcacacatgcatcacttttttcaaaccgctcgtttcattactctgtcaatgctctatatgtgtgtctatacatatttctgttttaccactgatatcctaaaaagcactgactgattggtcttagatttttctctcaatagatcaaattcaatta

SEQ ID NO: 102620 - DNA, 601 bp, Human
atggattgaggagacaaaaacgagctctactattacacatgcatgagcttcctgactataagaataattatactctagaactggttaattgagggaagttgaagaatcttttttccctgcagaatcaatagatacccatctatctttgatgacttaggtgtagcattgcctggaatcaggggaatggactagatgatcttcgtgtcattctgattattctgtcggtatccaataataagttatatagatcatataatctgttttgagataaaaatcacatttgagaaaacataatcgtgtrgcaacctataaataccacacattgagtacagtgctggttactcaaatgggcttcagaaaagtaaaacagccaatatatgtagaaattattggtggggcgggggagggggattgtgggggatagaagcaagctggcatagtcccatgtatgcatcgtagagaaacatctatggaggtatttctgtagtttccaggtatggaggcatccaggagctgtatttcaccttaggtattattaaggaaaattaaggtctttcatcaaagaaagaatttacttaggaaggaaggaagaaaagaaggg

SEQ ID NO: 102621 - DNA, 601 bp, Human
tgaagccacattttagcactgccatctagctttgttagtccccaagtatttagtatattttgcaattctttattagaacaaatactcaaagttgatattaaatcctaactagttattctgaatgggtcacaccattcctgattaattatttaatatgacaaattcttggccggccgcggtggctcaggcctgtaatcctagcactttgggaggccgaggcaggcggatcacctgaggtcaggagtttgagaccagcctggctaacatggcgaaaccccatctctactaaaaatacaaaaaytagccgggcggtggtctgtagtcccagctactcaggaggctgaggaaggagaatcacttgagcccagaaggcagaggttgcagtgagctaagactgtgctgctgcactccagcctgggcaactaaacgaggctccatctcaaaaaaacaaacaaacaaacaaacaaaaattattctactgccaaacctttggaaaaggtcatgtttctacttttaggtactttgatttctatattcttctactgccaaaacttcagaaaaggtcatgttgttactttttaggtacttcgttttctacaaa

SEQ ID NO: 102622 - DNA, 601 bp, Human
agcacaatcactacctacagcagtctcaatctcctgggctcaaacaatcctcccaactcagcctcccgagcagttgggactacaggcttatgccaccaggcctggctgatttttaaaaaactctttatagtgacagggtgtcactatgttgcccaggctggtctcgaactcctgggctcaagcaattctcctgcctccacctcccaaggcactgggattataggtgtaagccactgtgcctggcctagaatagatttttaacagacaaaataggttgacagatatatgataccctgttaaygctatattctgctttcattagatatcatcctatcacggccatgacaaactgccacaaaccaatgctaggattcattattataaaatagtacatgcagatgcttccaaagctgaattctatcctcatattcaagacccctatcattacagcaccaaataaatcacttcaattagttcaaaatatttataatagaaactgccatacatgatgatcggctatcattatttagttctctgttttcatttaagtactagttaaaggtgcctgtatcgaaaacaaagtataagttatccattagac

SEQ ID NO: 102623 - DNA, 601 bp, Human
tcatgccagtacttggttctatacttattttctgttttattcatccattctgccaatatatactggatgtctaccacgtgactaccaccacattaacctctggagattctgccctcataaagatgacagggccaaaagggctgtgtatgttcttgtttacacaatggaacacaatcaacatatgactgagtaatttgccttccatttgatccaaaatacattttctgtcaggtggtgatggtacaatcttctccttttgatataaaattcctaacatttccaaaactcttgcatttgactycaagaatcgacatacatactgaagtatgttaaaatgctgattaccactaaagtatttgggggtggagcatttcaatccctcaacatgcagtcactattttcaaaaacacattagttaataaaataacacacaagcattgaaaatcgatgagaaaattcctgaccttgaagtaacaagtgtgtcttagaaataatcggggatttaaaggtttcctatctaatctttaatctagcccaggcagagaaacatatcctaaagaaatgatttgaaactctgacatttaacattcagattatactc

SEQ ID NO: 102624 - DNA, 601 bp, Human
atgatatcctgttcttgtgtcattccatggtgcttagttatttcagaggtctaaactatagcgaatattcttgcttcaacgtaatataatgaggcacagacagacccttaaattgaaatgtttgtatccactggtaatgaattatgaacaaatggtacagcatgtcactatattatatgatgacatttttaaatgcaaataccatgaatatgttcctttgcatttggtgtagcatagaatcttgcatcactgattagcaaccagtgactaggagagatcaccaaatgaaaactctttcccrcaaatagctccacagaaaggaaagtttaaaggacccccaaggagaaaaataaaagtttggaaatagggcttaacatttcatccccctccataaatgatcgagagtctaatcttccctttcacataatttttttcaagacaaattataacccacaaagtcattttcttctcagcaaattatcaaccacatctccctcaaattcaattaatgctaaatattgtctgataggaaaaagtatatttcagtgaagcaaaagagtcaatgaaaattctgaaaatagcatgatccactgaaatcatt

SEQ ID NO: 102625 - DNA, 601 bp, Human
ctatgaaaacagtcttcatggcgaactaagtaagacctacagctagttccataaatcatcattttttgtctgctctagcgctgaaaatgcttattgctgctcctgatatatggggtattcatcaagaacaaaaaaaatgtatttttgttaactagaggagtattcatctctgccagttatactattcaaccattaactgtatctattattgtttagtcacaacgacttcaacaagtatagctgtgacacagcattaatttgattactttttttgtattactctataaggataatttttttwaaatgaaagaaaatacagatgcattaattttcttatttcctgaaaatgtatctgtatttaatgagtcaaaaactaagccacaggtgagttctctacagaaaacaaattatacccttcattacagttctatacacaaatatatatggttgactttttaatgcttattattggtagaagataaggaatataatttggtaattcttagtttgcattcttttttttttttttttttttttttttttgagacggagtcactctctgtcacccaggctggagtgcagtggcatgatcttggctcac

SEQ ID NO: 102626 - DNA, 601 bp, Human
caaaaattagctgggcacggtggtgtgcacctgtagtctcagctactcgggaggctgaggcaggataattgcttgaacccaggaggcagaggatgcagtgagctcagattgcaccactacactctagcctgggtgacagagcaagacaagaaagaggaaagaaaagaaaagaaagaaaagaaaagaaaagaaagaaaagaaaagaaaagaaaagaaaagaaaagaaaagaaaagaaaagaaaagaaaagaaaagatggtatagacactttgaaaaacagtctctcttaaaattaaaactayactttccatatgacccaggattcccactcctaggtatttacccaagataaatgaatttatgtcttatacataaatgatgatagcaacaagtataatagaaaatttagaaacaacccaactgtccatcagctgatgaacagatgaacaaaatgtggcacagccatacaatggaatactacctcaaaataaaaatgaactaccaatacatgccacaactttacactaagtgaaaaaagtcactaacaacacaaagtaacacaaaggctctattactgtatgattccattcatatgaaattct

SEQ ID NO: 102627 - DNA, 601 bp, Human
gtagaggaatcaatgggaagctcacattcctaaagagaggtctttacctgggattactgtgtgatgtgtttacaaagtgcatcgtttttaagagtatgccggatattccaaataaaaaggaaattaacattttctttttccttagaagttcactaactacctaaatcctaaaattctggaaacattaagtgcttagaaaaaattgcaggtacatcttcccaaaggaaaggaaattcctatgtattttatggactctttggagtcataacataaatggagacaaaaacaatttttttttttwaaaaagaacacaattcaaaacaacaaaaacccacctagttttttaggacatcaaattgtacaagtacattatagtttacaataaaacgcacatggctaacactggaaaggaaatataaaaacagaaaaatagcactgtgctcatatgtcaattttatgggtgattttttttctttgtcacatgtgttagattgttttgtattaaaaaacatttcagtttttggcatgcatacttataagtgcttaattttcaaaaattgtatttattaataaatatttattcagtatctggtccactaac

SEQ ID NO: 102628 - DNA, 601 bp, Human
gcatcaaagtctctgtaacaaccattttctttctctaaagactaattggtatgccaatcttgaatgaaatgacccacagatttataatttaaccaagaataaaatgacaagagcaatgttattttattaactttactggtaataaagttacattatacaatttgcttctgaacttcatacggcctatgacaatgtttaaaaggaagtgatatactctctcttccctcaccttgcctactttcctcccttttccctgcaatagtcactaactaactgaataacaaactaaataaataaatamgtaaacttaacccaaaacaaaactgctctctaattcttcaggcaatgcttcataaacttttcccaccaaagtacccctaatggaagagaagactgaaaataatcctgtagggatctgctacaagtgggaaatttctttgaagtcatctgttttatttttaaaattaatgtggattttgaattctactccataatacatatctgttttaatgtaaaaatgatgtgtttttccccactatctttgagctacagaggtctagaaaaatatgccaagtttataccatagttttgcattttccaa

SEQ ID NO: 102629 - DNA, 601 bp, Human
tggggaaaaaaataattgtggttcaccaaaagaaaaaaaaattcaatgttttaaaggcatcaaagtctctgtaacaaccattttctttctctaaagactaattggtatgccaatcttgaatgaaatgacccacagatttataatttaaccaagaataaaatgacaagagcaatgttattttattaactttactggtaataaagttacattatacaatttgcttctgaacttcatacggcctatgacaatgtttaaaaggaagtgatatactctctcttccctcaccttgcctactttcctyccttttccctgcaatagtcactaactaactgaataacaaactaaataaataaatacgtaaacttaacccaaaacaaaactgctctctaattcttcaggcaatgcttcataaacttttcccaccaaagtacccctaatggaagagaagactgaaaataatcctgtagggatctgctacaagtgggaaatttctttgaagtcatctgttttatttttaaaattaatgtggattttgaattctactccataatacatatctgttttaatgtaaaaatgatgtgtttttccccactatctttga

SEQ ID NO: 102630 - DNA, 601 bp, Human
tttacagtgaacagtaattttcagactgttactctctatttgtcaacttcccacaatgtcttattttgaaatatgactgctgtactaaaatgatatgcaattaatttaataagcatttattaagcacttctacctcccttccaagaactgaccaggcaggaccctgtttagcttccaatatcaggtgcattcaggttggtatggccatagattgagcccctccgactgaggtgctatgatagcaccgagattgtaaggacaaaaagaatacagtctttgttactaagaaactcaagaggargtacagatagaagcaaataattaaataaaaagtgcaaatgtggtatgtgctctattaccaataacgctaaagggctgctgtgacacagagaaaggaatggttaattctgtcaaaatggagctagaaagattatggacaactacagagaaagtagcatttatacttccagtaagttttttatttggtcagcatctactttctatatgttttccagtatgtgagcatgagtctttgttgcatattttcgaccacaaaggaggtaaaaatgtggatgaaatatatgtaataactctaaacaag

SEQ ID NO: 102631 - DNA, 601 bp, Human
cactctaaaaacaggattttgttccacagatttttctttaatagattactaaaaaactcaaagatttttcaatgaaactaatagcagacaatatgcaattttttttttcaggtattaaacatagatgtttcagcagttagttacatttcacattgagacagtcactcccattaggtcctatgacttggtccttactgttcaccataaacctttgtggtttggtggcgtccataagtttaggtcctctccattattaacaaattgtttccaatttcaccatttcccttgaagaagcaaagtrtggactgggaaatattgttaaataccggtgtcctccttattctaatttaccttgtttctcctctcaaatttacagtgaacagtaattttcagactgttactctctatttgtcaacttcccacaatgtcttattttgaaatatgactgctgtactaaaatgatatgcaattaatttaataagcatttattaagcacttctacctcccttccaagaactgaccaggcaggaccctgtttagcttccaatatcaggtgcattcaggttggtatggccatagattgagcccctccgactgaggt

SEQ ID NO: 102632 - DNA, 601 bp, Human
cttattttaaagacagtcatttgtttagaaaaattaggactgacttggtgagagtgaggaagaaagaagtcttacagactggaaaatttatgtagataaatatgtatttgattccctaacatttaacaacgttcccctaaattttataacatatttatggtgttgctattgatagagtacaattcgttcagcaaaaattgtttaagttacttgaagtccttttttttttttttttttttttttttgagatggagtcttgctttgtggcccaggctggagtgcggtggcgcgatctcggctyactgcagcctctacctcctgggttcacgccattctcctgcctcagcctcctgagtagctgggactacaggtgcccgcgaccacgcctggctacttttttgtatttttagtagagatggggtttcaccgtgttagccaggatggtctcgatctcctgacctcgtgatccgcccatctcggcctcccaaagtgctgggattacaggcgtgagccaccgcgcccggcctgaaatcctatatatgaaaaaaatccaaaccaagctgaacaaacaagttaacatttttattaaaataatgtagta

SEQ ID NO: 102633 - DNA, 601 bp, Human
tgatgaataagctctagagatctgctgtacaacactgtaattatagtcaataataatgtattacacacttaaaaatttaagagggtagatctcatgttaagtgttcttaccaaaaataaaaataataataaaaaaaaattctgtgactgttttagacctcttattttttctcttattttaaagacagtcatttgtttagaaaaattaggactgacttggtgagagtgaggaagaaagaagtcttacagactggaaaatttatgtagataaatatgtatttgattccctaacatttaacaaygttcccctaaattttataacatatttatggtgttgctattgatagagtacaattcgttcagcaaaaattgtttaagttacttgaagtccttttttttttttttttttttttttttgagatggagtcttgctttgtggcccaggctggagtgcggtggcgcgatctcggcttactgcagcctctacctcctgggttcacgccattctcctgcctcagcctcctgagtagctgggactacaggtgcccgcgaccacgcctggctacttttttgtatttttagtagagatggggtttcaccgt

SEQ ID NO: 102634 - DNA, 601 bp, Human
cattgataacattgtttggtaatgactagattactgaacagcaagaagaaaacatgactttctttcctaagtccttttgacatttcacattaaaaatacattttcctgagcttatcttccttaactgatgaataagctctagagatctgctgtacaacactgtaattatagtcaataataatgtattacacacttaaaaatttaagagggtagatctcatgttaagtgttcttaccaaaaataaaaataataataaaaaaaaattctgtgactgttttagacctcttattttttctcttawtttaaagacagtcatttgtttagaaaaattaggactgacttggtgagagtgaggaagaaagaagtcttacagactggaaaatttatgtagataaatatgtatttgattccctaacatttaacaacgttcccctaaattttataacatatttatggtgttgctattgatagagtacaattcgttcagcaaaaattgtttaagttacttgaagtccttttttttttttttttttttttttttgagatggagtcttgctttgtggcccaggctggagtgcggtggcgcgatctcggcttactg

SEQ ID NO: 102635 - DNA, 601 bp, Human
aatccaaacggccatgatctctgcttcctttcactgctacctgaagatattgtttttactcactagtttcctctagaaatgaaaatgaattatgaaatgtttatatgttatgcattgataacattgtttggtaatgactagattactgaacagcaagaagaaaacatgactttctttcctaagtccttttgacatttcacattaaaaatacattttcctgagcttatcttccttaactgatgaataagctctagagatctgctgtacaacactgtaattatagtcaataataatgtattayacacttaaaaatttaagagggtagatctcatgttaagtgttcttaccaaaaataaaaataataataaaaaaaaattctgtgactgttttagacctcttattttttctcttattttaaagacagtcatttgtttagaaaaattaggactgacttggtgagagtgaggaagaaagaagtcttacagactggaaaatttatgtagataaatatgtatttgattccctaacatttaacaacgttcccctaaattttataacatatttatggtgttgctattgatagagtacaattcgttcagca

SEQ ID NO: 102636 - DNA, 601 bp, Human
acatgaccaacaccccagaagcccctacatattccattccaatcatgaacccaccctaagaataactattataatgaattctaaaatcatagactacttttgccctaaacaatcacttttaaagaatatgtttttgaagacatggttttctacttgtttaatgtgtaagaagttgaaattaaatatctgcaaatatattttagttactccaagcacccagaaaatttcactgtagggttgaataaagaaagcaacaaggattacgttaatgtttaataagcattcactgagctgaatttaytatgccgacactgtgttatagattttgtctgtaacactgtgacacagattttgtcctgaaaaagcagactaatgatatcatacataactgagaaagcatcatgccagtatgcagccataaatacagaaacctttacactgtagtgcaagagagtacaggatcagctaaaaggttcaaagtattatggaggaaactgagaagccattgaaaggtagaatagttggagaagctttttatagagtggtggaatttaaagtgggcctttaaaaagatacatgaggctcaaaaggacagagacaa

SEQ ID NO: 102637 - DNA, 601 bp, Human
ctttcttcatttgtctttcttccttcttcccttactctcacatctccccccttgacaatactactcagtatcagtacttcaacctcttgtatcaagtatgtccctgtgttttacttcaggagtcaatcaaattagaacatttgatatacgaatattcactttttaactaacaagcttaaatccacaatgagctaaagctgactaatattcctatatattctttttactgacattgaagcaaagataaaataataaaaatgacagcagcgacaggttattggtgaatattttaggtcagtawgtgccaaggattcaatgacatataagacagcataatattgacaagtatgatatagattaccatgatcttcacgtggtacataatgtggttggtggctctttttctttctttttttaaaataaagtacacctatccactcttagactaaaaaaaaaaaggtgtttggataaaatctttaggagacatacaacttcctaacaataattatttagaataacatcagattaactctgacagcagctgcctatttacacttatacaatgcatgtgatcactataactaagcatgggtaaaagcaa

SEQ ID NO: 102638 - DNA, 601 bp, Human
gtctttctctgtcacccagactggagtgcagtggtgcaatctcggctcactgcaacctctgcctcccgggttcaagtgattctcctgcctcagcctcctgagtagctgggattacaggtgggtgccaccacacccggctaatttttgtatttttcgtagagacggggttttaccatgttggtcaggctggtcttgaactcctgacctcgtgatccacccgcctcaccctcccaaagtgctggattacaggcgtgagccaccaagcccggcctatttcacatgttaatctccaaatagttaygtatgggattttgtgataatcaataatttatatagagaagcaaataattaatacataagcatctcacctataccacctgtactactgctgagaatacgatatagtttgatttttttaacctttaccaaattgatagctgaaacttatattttattgtttcatgtgcacttcttccattactggtgaggctaaatacgtttggaatgtttttcctacgaaaatgttctatccatgtgccattttcccatttaagagttaagaatcatttctactgaatttctgagtaagctgagatatcaa

SEQ ID NO: 102639 - DNA, 601 bp, Human
ccgtaaatcattttttcaaaaatgtcttttaaggctaagcaatatgtgtctttctggaggttaattctatgccaattattgattcatttattaaagtttatttattaaagatctgtcaatacggagaattctataacctgccttgctgctttcataaaacaatcatagagaaaaatttaaatatcagtgatgaattctgtatagtcccttcagataaaccatacaatacttctggtactggaccaactgtaactcaaaattagttggttatctacatgccgatggagtttataaggtgcawactgaaatttcacttttctaggctttatattggtgaatagcatttcccaagtaaaccaattagctgcactggcatttggctcacttatttcaggaagaactgctgtctaacatcattgctaactgtgcaaaagtgtcagagatatgctgctcaccgccacatgtcaatggtatcaggccttgaaagatgtaacaccaatcattaccacaaaccacttgtttcctatacatttgatctgtcccatgtttaaactctatccacttcctgaaatcacttgcctgttttaattcccttcagaat

SEQ ID NO: 102640 - DNA, 601 bp, Human
caagtttatcaagaaagtaaagtggtgaaagaacagctactccatagacagagtaggacattcccaaaagaggaggaatgcatctactgtaggtacaacgcttatatatatggggagatgtgctttgctacaagggtttgtgatacaggattaactttcttaattactatattttgcaagaattgatattattatctttaaagcaaaattaggaatgcctttgttctccagatatcaggacatctggacactcccaagtctgggtctgtttagtaaatattattataatcattattattatattattattattattattttgagatggagtttcgctcttgttgcccaggctggagtgcaatggcacgatcttggctcaccgcaacctctgccttctaggttcaagcagttctcctgcctcaacctcccgagtagctgggattacaggcatgcgtcaccatgcccagctaattttgtatttttagtagagatggggtttctccatgttggacaggctggtcttgaagtctcaacctcaagtgatctgcccacctcggtctcccaaagtgctgggattacaggcgtgagccaccgcgcccgg

SEQ ID NO: 102641 - DNA, 601 bp, Human
agcaagtttatcaagaaagtaaagtggtgaaagaacagctactccatagacagagtaggacattcccaaaagaggaggaatgcatctactgtaggtacaacgcttatatatatggggagatgtgctttgctacaagggtttgtgatacaggattaactttcttaattactatattttgcaagaattgatattattatctttaaagcaaaattaggaatgcctttgttctccagatatcaggacatctggacactcccaagtctgggtctgtttagtaaatattattataatcattattattatattattattattattattttgagatggagtttcgctcttgttgcccaggctggagtgcaatggcacgatcttggctcaccgcaacctctgccttctaggttcaagcagttctcctgcctcaacctcccgagtagctgggattacaggcatgcgtcaccatgcccagctaattttgtatttttagtagagatggggtttctccatgttggacaggctggtcttgaagtctcaacctcaagtgatctgcccacctcggtctcccaaagtgctgggattacaggcgtgagccaccgcgccc

SEQ ID NO: 102642 - DNA, 601 bp, Human
attacccagctagtaagtggcagagaaatgacttgaatctaggaagtctggcttcgaagtctttgcttttaaccaccacactatactgcttcttaatagatgattcgaaaagattgctagatacaggtaaagagagaattagtggggagaaaaaaagagaattagtgcattggaagataattctcaagaaattgataatattaaggtaatattaagagatattaagaagaaatactaagaagagctattaagaagtcatataaaaaggaataataaagagatactaagagatgcatacaacaaggaaaagttaaacttcggaggacagaatgagaaggttccaaatatctcttataaaaattacagatgaagagactataatgttacagaagtaaagaataacatgagtcctaaagattaaaaactgcaacataatggtaaaaccctggcagcttcttaactaaaacagaggtaatgagacagtcttcttttattgataatcatgatttttagagaaagacaaaagcaatgtacccccagctactgcttgccttttaaagatattttgatatcagtgctggaataattttcctagaatagc

SEQ ID NO: 102643 - DNA, 601 bp, Human
catgtaaataggccaggtacggtggcttacgcctgtaatcccagcactttgggaggccgaggcgggtggattgcctgaggtcagcagttcaagaccagcttggccaatatggtgaaacccgggctctgctgaaaatacaattagccgggtgtggtggtgcgtgcctgtaattccagctactcgtggggctgaggcaggagaattgcttgaaccggggaggcagaggttgcagtgagctaagatcgcaccactgcagtccagcttaaataacagagcgagactccatctcaaaaaaaaaaawaaataaataaataattttttaaaaaagaaaatcatgtaaatatgtctataatgtattttttgtttagaaaatgaatttataaaaatgcacagaaaaaaatggactccaatgctataaaccaaaatatctacagtggttatagttagttttttggaccatataaaatattttcttaagtttttcctaaattatctacaatgaacactattacttttgtaacaggtaaaaagcaatgtatttaaagaacatgttgaaaatttaagagctttagaagaaaatacttcttattaccaattcctc

SEQ ID NO: 102644 - DNA, 601 bp, Human
aaatcatgtaaataggccaggtacggtggcttacgcctgtaatcccagcactttgggaggccgaggcgggtggattgcctgaggtcagcagttcaagaccagcttggccaatatggtgaaacccgggctctgctgaaaatacaattagccgggtgtggtggtgcgtgcctgtaattccagctactcgtggggctgaggcaggagaattgcttgaaccggggaggcagaggttgcagtgagctaagatcgcaccactgcagtccagcttaaataacagagcgagactccatctcaaaaaaawaaaaaaataaataaataattttttaaaaaagaaaatcatgtaaatatgtctataatgtattttttgtttagaaaatgaatttataaaaatgcacagaaaaaaatggactccaatgctataaaccaaaatatctacagtggttatagttagttttttggaccatataaaatattttcttaagtttttcctaaattatctacaatgaacactattacttttgtaacaggtaaaaagcaatgtatttaaagaacatgttgaaaatttaagagctttagaagaaaatacttcttattaccaatt

SEQ ID NO: 102645 - DNA, 601 bp, Human
gggcagctttcctcttccactgaacccttacaatttttgcaacgtggacaactattcctaagccctctgtatgtatgataaggtttgcagaccgaccattatcagagtatttctcttctggacatatcccagtgggctaattgtcaaaatctttaagaatatgctaatgaaagactataattacatattgaaatgctcactgcaatgtttctaaaagaaaatgttgaaaagtgcctaataataggatattggctacatataaaccataatacataatataacgctacactaccattaaaartactaaggaaagacaaacatggtacattcttacgtgagaaaatcatgtaaataggccaggtacggtggcttacgcctgtaatcccagcactttgggaggccgaggcgggtggattgcctgaggtcagcagttcaagaccagcttggccaatatggtgaaacccgggctctgctgaaaatacaattagccgggtgtggtggtgcgtgcctgtaattccagctactcgtggggctgaggcaggagaattgcttgaaccggggaggcagaggttgcagtgagctaagatcgcaccactgcagt

SEQ ID NO: 102646 - DNA, 601 bp, Human
tcccaaagtgctgggattacaggtgtgagccaccgcgcccagcccggaaagtttcttatttaaaaaactgctgcacatacaaacaactgctgcaattctacccatatcttttctatggacaaggcctcttctgtcagagaactgcccttccctataaggactaccttctgctgctgggcagctttcctcttccactgaacccttacaatttttgcaacgtggacaactattcctaagccctctgtatgtatgataaggtttgcagaccgaccattatcagagtatttctcttctggacatmtcccagtgggctaattgtcaaaatctttaagaatatgctaatgaaagactataattacatattgaaatgctcactgcaatgtttctaaaagaaaatgttgaaaagtgcctaataataggatattggctacatataaaccataatacataatataacgctacactaccattaaaaatactaaggaaagacaaacatggtacattcttacgtgagaaaatcatgtaaataggccaggtacggtggcttacgcctgtaatcccagcactttgggaggccgaggcgggtggattgcctgaggtc

SEQ ID NO: 102647 - DNA, 601 bp, Human
gtgtccccacctaaatctcatcttgaattctagtcccataattcccatgtattatgggagggacctggtgggagataatttgaatcatgggggtggtttcccccatactgttctcatggtagtgaataagtctcacaagatctgttggttttatcaggggttttccacttttgtatctttctcattttctcttgctgctgccatgcagaaagtgcctgtgatgattctgaggcctccccagccatgtggaactctaagttcaaataaacctctttttcttcccagtcttgggtatgtcttyatcagcagcatgaaaatgtactaatacactaggcatatatccaaaggaatataaatcattctaccataaagacacatgcacacatatgtttactgcagcactatttacaatagcaaagacaaggaaccaaaccaaatgcccatcgatgagagaatggataaagaaaatgtggtacatatacatcatggaatactatgcagccgtaaaaagaaatgaggtcatgtcctttgcagggacatggatgaagctggaagccaccatcctcagcaaactaacacaggaacagaaaaccaaacacca

SEQ ID NO: 102648 - DNA, 601 bp, Human
cacatatatatatacatatatatatatacacatatatatatatatatttttttttttttttgagacagggtctcactctgtctcccagagtgcagtggtgcaattttggctcactgcaatctctgtctcttgggttcaggcgattctcgtgcctcagcctcatgagtagctgggattggtgacgggtgcctataatcctgggtcattttttctttttttttgtttttttaaatatttttagtagagacagggtttcaccatgttggtcaggctggtctcaaatttctgacctcaaatgatycacctgcctcggcctcccaaagtgctgggattacatgcgtgagccaccgcatccagccaagtacaaagaatatattttcaatgcagcaggagcccagacaaagtaaggaattccatgtcattggacatttacctctcaggggtattatacaacgtgccgctgcattagaaaaagtgattaaattagatgatcctctaaggttccttacaataaacaagatttcataattctatgaaacaagcattaggctaaattatttgagaatcacaatttcaaagtttcctaccatattccaatctg

SEQ ID NO: 102649 - DNA, 546 bp, Human
tatatacatatatatatatatacacatatatatatacatatatatatacatatatatatacacacatatatatatacatatatatatatacacatatatatatatatatttttttttttttttgagacagggtctcactctgtctcccagagtgcagtggtgcaattttggctcactgcaatctctgtctcttgggttcaggcgattctcgtgcctcagcctcatgagtagctgggattggtgacrggtgcctataatcctgggtcattttttctttttttttgtttttttaaatatttttagtagagacagggtttcaccatgttggtcaggctggtctcaaatttctgacctcaaatgatccacctgcctcggcctcccaaagtgctgggattacatgcgtgagccaccgcatccagccaagtacaaagaatatattttcaatgcagcaggagcccagacaaagtaaggaattccatgtcattggacatttacctctcaggggtattatacaacgtgccgctgcattagaaaaagtgattaaat

SEQ ID NO: 102650 - DNA, 601 bp, Human
atgggctaggccctgtaggctgcattagctagagggagattagaatcctgtagtatgcaagccagtttatttagatttcttataccttccctgtttcttccttaacaaatgtcttgataaaaatatcaacttttctcaattgtgttaaagaaaatgaagcactcccaactctgcctcatgcttgggtatgcccaaagtcttcataaatttataaatcatcatgctaaaaatcaagaagtagcatggattatgtaaaataactgatgccaaactactggcaactgtttcttagagaaaatcractggaaagtaaatgcataacatatttttattttgggtaaattctctgtggataccattgtgggaaaggaacacgcataagaactggatattagtacaggtgggtagattttaatttggtttaaaaattaaattaaaaggctattaataattagattggtgtcaaccagtaggaggtttatggtagttagttgcaggcatttcttgttcctttttcaaaaaaatcagtgacttaaaagaagctgtttgaaggtatacttgttaaatttacaaatgacacaaaacccaaagggactgcgaa

SEQ ID NO: 102651 - DNA, 601 bp, Human
atagctctaggaaagtaggtgtaggctgcaggctgctcaaagtatatctatatttctattaatatttgtattagcatgatatgttaattaccttgctaagtttggaaaataacccttaaaaacctacaattcattcattagcattctgtttatatgatcccaagtgtaacacaaacactttagttctcttaatttttgatttccaaaaactccttacttatattgattattatattccccagtctcttatattttatcatttgcctatttttaccagcgaactgtctataattcaatcacwttgctacaaactagttaaggtactcatcacatttcatatggaagataatataggtacttaggccaggcatggtggctcacgcctgtaatcccagcactttgggaggccgaggcaggcagatcacttgaggccaggagttcaagaccagtctgacaaacatggtgaaaccttgtctctactaaaaatacaaaaattagctgggcatggtggtgtactcctgttgtctcagctactagggaggttgaggttggagaatcacttgaacccgggagacagaggttgcagtgagcaccactgcac

SEQ ID NO: 102652 - DNA, 601 bp, Human
tagttttctaactttgggcgtgtcacttaactgcttagtacctcagtatttacatctctaaaattggatggttcttacctcataaggttctggtaaagattaaatgaattaattcatataaagtccttagaatagagtctgacatatactatgagcttaataaatgtgagctgccatcatcatcatcatcatcgccattcttgcgattactgttgttacaaacgtcccacagacgatcttaaaagatgtccataaaatccctaaaatgcttgctgaatgagtactttcaatctaacttggktttaaaatattaaagtgcttcaattgaacgctgtaaacattgttacatggcattaaagctatacgactggtaacatttttcacaatattggtaaagtactttcttcataagcgattagacaaaacatgcaaatacctagtttagctattaatttagccaaaaacaacaataaagatactgttagcatgacaaaggattgattagaaagagtgccaaaattccataagataacagtaggttcaattcatggtccatgacactggcagtagcaagtgagtagataacaggaggtcactacga

SEQ ID NO: 102653 - DNA, 601 bp, Human
aagaccatatcataattttactgactaaactctggcaattagcaacaatggcatttgttgccatagcctaattgaaaaaccgtgaaatgttgaaaactgattattttcagaaactgacaattaacaattggggtaagagcataccccaaacaaattaaacagcatcatgtgctatcgttaataagggtctaatttggtcaggaaatggttgctttttctgagtacatgctactccacttgatattcaagacatatccatctttttcatttaattttaaactaaaaaaacagtaaacaatamctttctctactttgaactagactcaaacaaaaacaaaaaactcagaaatacataattgctgcttcttgaattgctaatacaaagattcttctattcattcatagttgaccccaaaacaactaactatgaaaagttgagatatggtttaaagttgtttaaactaataggatattactaatttaaatcggtagaaatacaagctttactacacaatagagaatgtttattaaatatcaattgccctagaaattagaaatatagaaaattagaaaatataaggcaaaaaatagagacaggaag

SEQ ID NO: 102654 - DNA, 601 bp, Human
accttctcccagaaaccagatctgtttctgattatcctgttttccccagtggcattactactcttccagctgtcactgcttaaaaccacagagttagcttttactctttatcttttgtattaaccataaccagccagtcaccaagtctcatcaatcattttcaaaatgcctttggcatccacctttgtctgtgcattgcaattgccacttttaggaagtgcatctcacctaaaggttggaacactgcaactgttctacatgcattcaatccatatcacataatgcttccagaaaaaaaaaattcttaagacactgatgtcaccatatcactacttgattcaatgagttaaaattaaaaccttcaattacatttgaagtccccagagctaccataggttacagaatgcaattagaaactaatgaatatgactaacatcctgaacatgaatcaagaggtttttagaattgaacacatttaactaatacaaattagtgggaaatggcagtgctatcccaaatataaaaaatagtcacaatcgccatggtgaacatgaaaaggaaaagcttttataaaccccacataccagccttattgtctctg

SEQ ID NO: 102655 - DNA, 601 bp, Human
tctgaattaaatgtttctattcattgtaaccattgacaaattaacggagcacttcttacatctttgctctaagaaagaccaagtaagaatttactcttgcaagtctatatgtgaataggcccaaacatgattatataagtaccctgtaattttccttaactgaatatatttagttgaagaattactatcagcggaacggcataccattaaagtgactcatccggaaagcatatgtaaaaaagaaaaggaacattacaagcatcctgaacaatagacactgttgcattctttctcaagtgcrtttataaggtagtttcattttacatgaacgctgtacctggaaatgaagcaaatgtgtttatacagtaacaatagcaaaagctcatcactgtgagcttctttggcctttaaagaaaataaacggtaaatggtacccaaataaaaaatccctataatgaagaaaaatgtgagaaaatgactcattcttagggggaaaaaaaaaaaaaacctgttaaaaagtcaccttcacagaaaacacaactagaattcttattccataaaacttaaaaatgtgcattctaaatatgtgttcttaagtacc

SEQ ID NO: 102656 - DNA, 601 bp, Human
tagccaggtgtggcggctcacgcctgttatctcagcactttgggaggccgaggcgggcggatcacaaggtcaagagatcgagaccatcctggccaacttggtgaaaccccgtctctactaaaaatacaaaaattagccaggcgtggtggtgggcgcctgtaatcccagctactcaggaggctgaggcaggagaatcgctggaatccgggaggcaaaggttgcagtgagcctagatcgcgccactgcactctagcctggcaaaagagtgagactccgtctcaaaaaaaaaaaaaaaaaaaaatcagcctacttaaactcttatctattactcctaattttgcctcatagtagcactgatcaagtctactacctattttacaagaaatgtatcagttgaatcttcttaatctacccagcctatacatacccagttccttcaactagtccttctgtggtgtaagaattagccattactggccaggcgtggtggctcatgcctgtaatcccagcactttgggaggctgaggcggtcggatcacgaggtcaggagatcgagaccatcctggccaacatggtgaaaccccatctctactaaaaatac

SEQ ID NO: 102657 - DNA, 601 bp, Human
agttccagaacttgtcatagctttacaaaaaaaaaaaaaaaaatgctggttgtttagtgtctcaggttgtctccgtcagggctgacttcatggatatgcaacctgtgcagttgtacaagatcccatgctgcaaagggccctgcattttgtttaatactttgttgtcattttgaaattcttaataactttttggccaggtgcggtggctcaagcctgtaatcccagcactttgggaggctgaggtgggcagatcacgaggtcaggagatcgagaccatcctggctaacacagtgaaaccccrtctctactaaaaatacaaaaaattagccaggcgtgggggcgggcgcctgtagtcccagctactcgggaggctgaggcaggagaatggcatgaacctgggaggcggagcttgtagtgagctgagatcccaccactgcactccagcctgggcaacagaacaagactccacctcaaaaaaataaataaataaataaaataaaataaaaatttgcagtggggtgccacatttcattctgcacccggacccaaaaattatctagtcagtcctggtctccagataaaacaaatgtaacttagaaaa

SEQ ID NO: 102658 - DNA, 601 bp, Human
caattattatataagtagagaaagagagcagggacttgaaatctgcctaacaatatatagacgtggttcgggagatgcttagacaaatgggaatgtgaggaaagcggataaagtaaaaaaaagtaaagggcacctttctttcttaggctcctccattcttcccctctaatggattatttatattatgcctgaacaaaagagaataaaatattggagatgtaataatctgagaattctagcttatacagaaatttatggctgcattaaacaatgccattatgtaaagtgtttatctttgcatgggggaattatgttacctttgaggtaaaagtgacattaaaggagatttggaccagcctcttaaatttgaaaaactcaggttacagagtatcacagtctgagtccctgcaaaacatagcctaagttagagcttacttcttaaggccttgttggggtgagcgggatataatcccagagaagcaggcatgagggaaagacagcaaatacaagagggtaagttccagaacttgtcatagctttacaaaaaaaaaaaaaaaaatgctggttgtttagtgtctcaggttgtctccgtcagggctga

SEQ ID NO: 102659 - DNA, 601 bp, Human
tgatttgaagttaccataccaattattatataagtagagaaagagagcagggacttgaaatctgcctaacaatatatagacgtggttcgggagatgcttagacaaatgggaatgtgaggaaagcggataaagtaaaaaaaagtaaagggcacctttctttcttaggctcctccattcttcccctctaatggattatttatattatgcctgaacaaaagagaataaaatattggagatgtaataatctgagaattctagcttatacagaaatttatggctgcattaaacaatgccattatgyaaagtgtttatctttgcatgggggaattatgttacctttgaggtaaaagtgacattaaaggagatttggaccagcctcttaaatttgaaaaactcaggttacagagtatcacagtctgagtccctgcaaaacatagcctaagttagagcttacttcttaaggccttgttggggtgagcgggatataatcccagagaagcaggcatgagggaaagacagcaaatacaagagggtaagttccagaacttgtcatagctttacaaaaaaaaaaaaaaaaatgctggttgtttagtgtctcagg

SEQ ID NO: 102660 - DNA, 601 bp, Human
aagactttcacataggccgggcgctgtggctcgtgcctgtaatcccagcactttgggaggctgaggtgggctggtcacctgaggtcaggagttcgagaccagcctggctaacatggtgaaaccccttctttactaaaaatacaaaattagctgggcgtggtggcgtgtgcctgtattcccagctactcgggaggcggaggcaggataatcgtttgaacccaggttgcagtgagccgggatcgcgccactgcactccaacctgggttacagagtgaggctccgtctccaaaaaaaaaaaaaagagaccttcacatgacaggtgtcttttccccatacctgggggaagactgtcatacagagatacagaaaataatctgaaccagccttcatgggttgcccccagcttattaccattagatcatatccttttatccaccagtcatacttctgcacaactgcccataaaatacatggtttttccctgtttctttgagtcttcatttatggagtttcctgtgtcacataaaactcacattaaataaatttgtatgctttgctcttgttaatatggtattatagggtgtcagccatgaaccttcga

SEQ ID NO: 102661 - DNA, 601 bp, Human
ggttctgtgagttttttcatctacttaaaaattattatcttaataaataaaggtggaatacaattaacataatggcagtgcagtgaagaccccaaatctgttttgaattatctggaaaggataatgtgccttctcagtaacttgatttgtaaccacttcaaatgacttccctcatactatgaggaaatcccaagtgttgatagttagttgacagggtgttaatgtcattaacattctgtcagctcttcttgtcaatgtgttaatggtgcccctgctgctcagtcactctctgtcctccggwtggggaaatgatttaaccagcagtcaatcaaaaagctaagctgattttgggcaacagaaaaccctgccattgacaaaatctctgcaagtaaatgtggtaaggaatttgtcaactggatataagcagtaaggtcgacatcgtggttgatgtgcttttttagatagtttaagatgttaagaatggaccacaacacatatttaaaagtctaagaagtcctcttttaagaatgggtttcttttctgacagaagaagcaaggattggtaagtaaaaatgatgctttgacttttttaaaaaagtaa

SEQ ID NO: 102662 - DNA, 601 bp, Human
gtgatctacccaccttggcctcccaaagtgctgggattacaggcgtgagccaccgcgcccagccttgagtcctctttttgactaggcctcattcttaggctcagtccttggccctgacagtccagttttagcaagaatcctactgggtctgtttagcaaaaatcctccacccttcatatatggtcaaattcctcatcctccactcttcatatcttattagccttgcctgccttcagcaagaatcctatcaagttggtttagggggaatccccttatctttgatatctccttctagtaatgwtccattgcctgacttccaccctgcttcttggctataaatccccacttgcctttgttgtatcagaatgcagcctcgttgtatagtaaggtctctctcctattgcaatagttgctgaataaaattggcctttaccactttaacttctttctggctttgattttctttcataacagtttattactattattactgttttttttattattatttatttattcattttgagacagagtctcactctgttgcccaggttggagtgcagtggcacaatctcggctcactgcaacctctgctgcccgg

SEQ ID NO: 102663 - DNA, 601 bp, Human
acaaacaaacaaacaaacaaaaacagaagaaaagagcagggattactgaatgaaaagccaagtttacttgccatacttttcataagctatatgtcaaacacatcctaactagaaataagtaaacacacttttattatacaaaaacatactgatatatttttctgcattatgaaaacagtacatgattgagattttgcaccagagtatattacttgaggaattatactaacatcactattattacctgtaaactatgtatgcttaagataccacgtgtttcataattgaaaacttttaccamattttaaatcaaagcaaagaaaacaaattcacagattcattggtatgatatccaatttatagtcttataaataccaaaatggctttacatctacgaatagacatgtgcacatgctacatgttccttatgtgcatacacacacaaaaaaccacattcatattgggtaatttattctttcaagcttcttttttgtgttatttctactcaatatgaataaatcccacagaaaggtttttacatcttttaaaacttagcttctggtgagagcgattagaatttgtcaggttgagggtacattaa

SEQ ID NO: 102664 - DNA, 601 bp, Human
tgagttaatttatattacaaatcaactctatgtacagtccaagtggcagcatcctgtgtaagaaaatcaattcttttctatgtgcatgtgaaacagatcatttcttggtttgatagaagatattagagagcttattcttgtaggttagctgtactttgcaacctcaaaataagcagtctgttctatgccatggagtcttaaccacagtaaaggatgtgtcaaaaaatgagttctgctattcttcagaaaataaacaaaaatcacatttcatgtaccctgttttgactcaaagaattatcgygtcatttttgacagatgcagcaaagtgcagtaatttttctctaaaggtaaagccaaaatagattaggcaattaaaagcatgtgttagtcaaaaaacatcctacccacagtaaaaaataaaaactatatttataatcatatttcttgttttatactttaccaaaacaactgcaaattgaaacatgagatgctttaccaggataaagggtttgtgctctgtgtttctttctaaattttcttttactcccaccccactttacaaattagattatggcagagaattacataagtggagaagtta

SEQ ID NO: 102665 - DNA, 601 bp, Human
ttcctattgtaagacatttagaacattgtctggcaaattgtaaataatacataaatgcttgttaaataaatgacattgataagattgtgtcttagtatccacagagtgtttctgaaggaatttcccacacgttatcttgttttaccctaatttttcacttagttcccattttcctggccagagttcattgcttcctcttcctgtcagctatgacacttttgcatacctcacttgtgccacttatcccattgggaattttataattgtttgtgtgctgggcctttttcaccacaacactgtkgctcctcaaaataggaactctctcttgtcacatctccatccctcatttgtctgaacagtgcctgaggccgggcacggtggctcacgcctgtaatcccagcactctgggaggcggatgcgggtggatcacaaggtcaggagatcgaggccagcttgaccaacatggtgaaaccccatctctactaaaaatacaaaaattagccgggcgtggtggtgagtgcccgtaatcccagctactcaggaggctggggcaggagaatcgctggaacctgggaggcggaggttgcagtgagccgagatt

SEQ ID NO: 102666 - DNA, 601 bp, Human
tctgctgttatactagggtgactgcaggatactgaaggaaatcacagaattataaagtagcaacaatactaatttatactcaccaacctcagccaagccctcagcatcatctagaagcacttttcatttgtatgtgttttgtttttcctcctttgctgcacagataatactccaaaatcaccatcgttctaaaatcctgtatctagactctttcagtcaaacagaaaatccagatttgcttttaagtcttcctcaccataaacaagatatttgtctttgtgaaggcattaatttttttttyttttttttttttttttttgagacagagtctcactctgttacccaggctggggtgcagtggtgcgatcttggctcactgcaacctctgcctcctgggttcaagtgattctcctgcctcagcctcccgagtagctgggattaaaggtgcatactaggcccggccaattttggtattttcagtagagacagggttcaccaagttggccaggctggtttctttcttttctttactttttttttttttttttaaataattgacttttaaaacttctttttacacaggtcacaacatcaacttcaa

SEQ ID NO: 102667 - DNA, 601 bp, Human
aaagagtgatgcatgtaacataatttttaacatctgattaaaagaaaacagacatctttctacataaagatctttctggtagtacaaatttcatcatgtggatctctgtaatgagaggctttgaaaacacagtagacaataacttcagttacaatttaataaaatctactaaatactgtacaaatggatgttttaaaaattgcttctatattaggagggtgacacaggaggactgcttgagcccaggagttctagaccagcctgggcaacatggcaagaccctgtttctacaaaaataaasattaaaaaattagcctggtgtggtgtcatgcacctgtggtcccacctattcaggaggctgaggcaggaggatccactgcactccagcctgggtgacagagcaagactctgtctcaaaaaaaaaaaaaaaaaattgcttctataagtagctaataaaactagcagtattaatagagcagaaatatcagtagtgtaaatgtcagaagggctgattcaaatcctgtatacatcaatcactagtcatgtaatttttggcaagtgacttaactgtttccttatctgtaaactaaggataataaca

SEQ ID NO: 102668 - DNA, 601 bp, Human
agtatgatatatctaaattgttatattaagtgctattgatttttttcttgtggatgctctacattcctataatcatctgtgtgaaataaagtaagaaagactaatctgcctcctgtaactaatatgcacaaatataacttgaataactcaaagagaaatataatttcttaaaaaaactagacaaagtgctatagaaataatctgcatgtttggattccaatatgttacaaaatgttattcaatacagatgtaagtcacttcctctttctgggtctcagttttctcatccataaattaagascaacgaactggaatgtttctaaattactttccagtcctaataaataaggatgttatctttatagagatcttgcttagataggctggcactgggcagtgaaagaaaaccaaggaggcaaaccagtcaccatcagataatttatgggtgaaagtcaggggctgtctattacttaagaggcgaagtccagggtggacaacaacggctggcatgtgacaagataaactacgaacctacccaggataagaaggcaaggaatccattcaaatataggggtgaatggtggactagatattcaatcca

SEQ ID NO: 102669 - DNA, 601 bp, Human
ataatagaaagtgactagatgggaacaaatacattgtaaaagaagaaaatatggctgcgtatggtggctcaaccctgtaatcccagcactctgggaggttgaagtgggcagatgacctgaagttaggagttcgagaccagcctggccaacgtggtgaagccctgtctctactaaaaatacaaaaattagctgggcatggtggtgcacgcctgtaatcccagctactcaggaggctgaggcaggagaatagcttgaacctgagaggcggaggttgcagtgagctgagattaggccattgcaytccagcataggcgacaaaagtgaaactccatctcaaaaaaaaaaaaaagaagaaaatacagcatgtattaatttagcaagcaactgaatgcagtgattaagagccttaactatagagtcagattgtgtagatttgaatcttaactcttctgtttactagtcttctgaatttaggaaggtccctaatttctctgtgcctcagttgatccaactgtaaaatggagaccatagtaactcctaactcataggatagttctgaggatgaaatgttaaaggcctggcacatatttgattattttta

SEQ ID NO: 102670 - DNA, 601 bp, Human
ttttcttatctctattcctacttcagattcaaagcttaaagctagttcctttaaggtaagagcacaaagttccaaagcaaatgtttatctgttacaagtgcttccataaggctaatttggataagtaagaacaaatactcacgaggaaatgaatttgttactgtggccctccaaaaacagggcagtatcataaccacccagatacaaagaaattagagagtgtattggcatgtggagaagaaggaaaatgataaacggattgcaaggaaatggaaaaagagatgttgttccaggatacctrgcagtattggtaatgctgaatttggttcagagataaggaaggctcagaatttgtaaatatcccattaaatgagaacgtatatagattgcagaaattcttcctgaatggtaatgataggtctgtatgaaaaagagcagtgatacagcaagatttgaacattccagatctggtgacagcttacagaaaggggccaggaaggttatccctacataccacaaaccctccccacaacctcaccaccaccaatggccctgccccctgaagctactctgggggccaaagagagttatgctgaattct

SEQ ID NO: 102671 - DNA, 601 bp, Human
acattaagatgaaaaactaaaaaaggcaaaacttggtcttgtctaagacagctgagtaactgcccagactggacaactattgagcattataatgtccttcctactctctgtattaacaatcaactactaatattcaatgtagccattaaaagtaattctcaccagatggtcctatattcctgaagatatggatatgtattttctctccttgagcaatactattaggcaaattatggctataagaagcagagttgcagatgcagattgcactcatcagacataaggccaaccacagagcctmctccacacgcaggcagtggacaatggaggctgttcatttacctcttcatccacagccatgtgcacaaataacaatggtcatcaccagggtcaatgtttctacactctaagatgaatgatacatgtttaagaaaaataatttattggccgggtgaggtggctcatgcctgtaatcccagcactttgggatgccgaggtgggcggatcacctgaggtcaggagttcgagaccagcctggccaacatggcaaaaccccgtctctactaaaaatacaaaaattagctgggtgtggtggcaggtg

SEQ ID NO: 102672 - DNA, 601 bp, Human
ctctgccctaatgtcacttttttttgttttgttttgttttgagacggagtctctctctgtcgcccaggctggagtacagtggcgtgatcttggctcactgcaagctccgcctcccaggttcacgctattctcctgcctcagcctcccgagtagctgggactacaggcgcccgccaccacgcccggctaattttttgtatttttagtagagacggggtttcaccgtggtctcgatctcttgaccttgtgatccacccgcctcggcctcccaaagtgctgggattacaggcgtgagccaccgygccgggccctaatgtcactttttctatgaaggcctctctggccaacacaggcagagttaggcagttcctcctttatgttattatcgcaccttaacatatttctatggcagcacttatcaaattatattgcatttgtttgtctgtccccactcatggatagagagaaaccattctcttccttttatctgtgacccagagcattaccaaaatcaagttggttttcagtagttaatggaaaggatagtcagagaatggctaataatattctacatctgtatagcataggtttcaaggtctttt

SEQ ID NO: 102673 - DNA, 601 bp, Human
ttatcctgaggccacagggaagttatgaaagaatcttaagtcaggaaactaaggttatcttgtttggtttcttttgtttttaattttattctgactaaaatggggtgaatggattaggaaatggaaatgggtaagagaagaagacacagataccagtcaggaggtcattattatagtccggacgagagatggttgaagccaggaattcaaatagtgtcagtgggcttggagagaaatggatggattcaaaagttatctagggtcaggcaaagtggctcatgcatgtaattccagcactttrggaggttgaggcaggaggattgcttgaggccaggaaaacaagataagcctgggcaacacagcgagatctcatctctattaaaaattaaaaatttagccaggcatggtgatgcatgcctgtagtcctagttacttaggaggctgaggtgggaggatcacttgagcccaggagtttgaggatacagtgagctatgatcataccactgcactccagcctgggaaacagagcaacccggtctcaatcaatcagtcaatctgggaagtagaagcagcaagcctgaataatggcataaaacgctat

SEQ ID NO: 102674 - DNA, 601 bp, Human
ccccgtctcctactaaaaatacaaaaattagccaggcgtggtggtgggtgcctgtaatcccagctactcaggaggctgaggcaggagaatcacttgaacccagggggtggaggttgcagtgagctgagatcaagccactgtactccagcctgggcgacagagcaagactccatctcaaaaaaaagctcagatttatcctgaggccacagggaagttatgaaagaatcttaagtcaggaaactaaggttatcttgtttggtttcttttgtttttaattttattctgactaaaatggggtgartggattaggaaatggaaatgggtaagagaagaagacacagataccagtcaggaggtcattattatagtccggacgagagatggttgaagccaggaattcaaatagtgtcagtgggcttggagagaaatggatggattcaaaagttatctagggtcaggcaaagtggctcatgcatgtaattccagcactttgggaggttgaggcaggaggattgcttgaggccaggaaaacaagataagcctgggcaacacagcgagatctcatctctattaaaaattaaaaatttagccaggcatggtg

SEQ ID NO: 102675 - DNA, 601 bp, Human
ctatatcattaaagaagcacatcacggtcttgcagcttcttaaggttgttttcagaatattaccattttactggcaaagcaaagaggcaccaacttatgaggcatctaatagaaatttctggatgatgaaattctagatatcagaatttacattactgattaagacactactttgttaaacaatatatttggtttctcacataagcctaccatttttataatactgaagttttttttttttttaatgtcaagtgcttggtttaaaaatgtgtcaaaacaacttaagtcattttggatcagkgattatatacacaatcctttcatgtaaaaattcaccctcatttctttaaaggtaaattaccattaataaatgaatcaaattttctgtatattatcaatttagtctttcaagcctaactaaatgcagatatactcattgactttccaattatagtttagatttagacatgactgaggccttgtaaaagggaagatagcttaagagagatgagagattttcaaaattaattatctccataagccaacatggctacacagggagctctcagacaagtttaggtttttaaagaacaattactta

SEQ ID NO: 102676 - DNA, 601 bp, Human
cccatatttgaatgtgatgcctggaacaactacagccattgtgcaaccaagagccaacatgccaaggatggcagaacagaaatatctggaatatcctgggtccttaataatattactaagctactgaattaaccaaccctgtaactgccttacctctacacttcttgtgatgtaagagagtaaaaccatattcttaagctaattttagttatgttttatgtcactaggcagctaaaggcatcctaatacattatacaaaagaataaacatcaaaatatgctagtgcgttcaaaagcagagktaaatcaattattttcaggtacttacagaaaaacttgagcaataatatctacatacacaagcacttatagtaataattgaaaattaatttggcctattcattaaagactgttacctaaagagttacctaaaacatattttgcctaaataatgctcacatgaaacaagtctatctatttgaatatattctattctaaaacttttaatatagtatgaaataacaaccatataattaggatgtattaaaaaatgcttctggccaggcatggtggctcatgcctgtaattccaacactttggga

SEQ ID NO: 102677 - DNA, 601 bp, Human
atgctttgctatacatctcaccttttgtcagagcttcctgtctagaaacccatttcgggatgttattgtctatcttcttaaataagatatccgagttcccttgaggaagaagtagtgactgagactgaatctgtatttgttaggtttttttttttttttttttttttttttgaggcagagtcacgctctgtcacccaggctggagtgcagtggcgtgatatcggctcacagcaaccttcgccttccaggttcaagtgattctcctgcctcaacctcttaaatagctgggattacaggtgcragccacaatgccacgctaattttttttttttttgtatttttagtagagatggggttttgccatgttggccaggctggtctcgaactcctggcctaaagtgacccgcccacctcagcctcccaaagtgctgggattataggcgtgagccactgcgcctggcctagttggcgtttttaatagcaaaaatactgttttgctttgttttctcttgaacaaggaaaggttttaacttgcttaattaacaaaggcaagagccattgattttgaaatggcattaggaaaaggacagatttcttctca

SEQ ID NO: 102678 - DNA, 601 bp, Human
tgcttgtgtctgaggacagcaacttccaatcttctaaggtgcattcatgctaagtgccctaatacaggtgtaccatttttatttttaatatagtatttttattgttcctcttctgtttagatgtttagatacacaaatacttaccaatgtgttacatactgtattctgtacagtaacatgccgtacaggtttgtagtcgacgaacaacaggcttacgtataccgtatagtctaaatgtatagtaggccatagcatctaggtttgtataagtacactctgtcatgttcatacaacaatgaartcacctaacaatgcatttttcagactgtatccctgtcattaagcaacacatgattgtacctgtacttcacagtgttggtttgcgatttaatgaggaatcacatataaagctattaataacagtgcctggcacataaaacatgttcaataaatggtggtggttattattatattattccacatttgggcaatacaaaggtcccatgcatttcagggtctgtactccatttcctccaatccaggaccatgtccacatatgtgcgtgcacactggggagaaagaagaattctttttgatatga

SEQ ID NO: 102679 - DNA, 601 bp, Human
aggaaccgttttgcaagatctcccaaaactctgtcccttgcccccactccagcatagggatgcgagggagcttatcttgtcattttaatgaaacatctttgaggtatgatttcactggggagagatttagaaatcaaagcttaagcagagcttgtgaaagtaagttatgcagtactgagcaaaacacaatctctagaactcattttttccctcagcaagcattaatgaatgtcaagcctttatagattagttaatatacttagagatagagaatacatgtttatttttccaaaaccttgaktcagccagtaactcactgagaattgaataaataaatccactcattatagtgcttttcagaggaaaacccagcaatatttgcaaaaaagtcaaatttatttttttctatcgtaagcacatgaaataatgacaatattatctagaatatcgatatatctgccatgtttgcactttctcattaactggaattttatttctgtgtattagaatttatcaggtaggagaacaaaccaaccaactcagctcaaacacctaattacattttttcatgctctttgtcattttagtgagtttcttgtaa

SEQ ID NO: 102680 - DNA, 601 bp, Human
aagtttctactgtttagaaaagcaattcattttagtatagtccaaatgctgataaattatctcagataaatgtcataaagggagaaactgctaattatattaaaagatattcaagactatgtttattttgcttgttcgtgtaacagtcataatttttaatattcttaattatttttactcttttttatgtaaaaaaaaattcaaaaacaaatatctgttactctccaaaaaatggagttaaaaagtggtatttgccaaaatggttgagagcaaggaggttactaaaggttccttggcaaaratttaggaccaggcaatattttgttctttttatgagttgctcacctaaactcatcagtgaaatctttgcatactatatctgatttcattcaaggctgtttatttcctatttatagcctatatcaacagggggaaattgcagtccacaaagaaatgataagaaccatttttcactcagcacttctacggcagctggtgatttttagtataggggaaatttatccccatcctttaaaaggaatacactacttatactcttacgacgtatggaatcctgggtcttcaataggactatgatttc

SEQ ID NO: 102681 - DNA, 601 bp, Human
accttatccagcttcaatttccatggcttcagttatccacagtcaactatggtctgaaaagattccatggaaaattccagaaacaaacaattcatacattttaaattgcatgcctttctgagtagcatggtgccctttgttcagtgtctccatgctacagatgctccttgcccaggagtcagttagccaccatctcagtgatcagttaattgtcatggtatcctggtacttgtttacaagtaacccctattttgctgaattgttttactttattattgtggttgttaatcacttactgtgyctaatttataaattaaactttatcataggtatgtatgtatggagaaaaaaaaaaacattgtatacagggtccaggcatccactggggcaggggcagaggggcagggtcttggagtgtatccttctcagataagtgggggttactgtaacaactttattctattttttacgccggaacttaactgtttcttatttttatttattatttttttaagacagagtccttctctgtcacccaggctggagtgcagtggcacgatctctgctcactgtggcctgtgcctcctgggttcaagcgatt

SEQ ID NO: 102682 - DNA, 601 bp, Human
gacagagtgagaccctgtctcaaaataaataaagtcaagtgggaataaaaataaatacctttgcttaatttagtagttgctacctcactatacttgtcgaaatattatgctagagcaacgtctctcaaccttttttcattattgtcttcctcccactgggagtctttttagatattttttctaatgacccctattgttaacatttaatgccacagatatcttgtacgtctgtttatgtaccgcggtcctttggaaggctacaaaccattgcaatatctaagatgtttttccacccacattsccaagaaccagtattcatcccttttggggtaatattgtcccttctgagaacatatatgccaaatagttctgctaaaaaaaaaatttttgtaaatatcactgatgtattaaaggaaagaaatgtaggcttcagtcccccattactttttcttttgctccacgataactttcaaagaagctgagtatttttcataaaatgtctaaccttactgaatcaaggttttatgaatataatcatgggattgattatatttcagttagtcttcctaaaacaaaatggaagtcaacatgatcctttgaa

SEQ ID NO: 102683 - DNA, 601 bp, Human
ggtgacagagtgagaccctgtctcaaaataaataaagtcaagtgggaataaaaataaatacctttgcttaatttagtagttgctacctcactatacttgtcgaaatattatgctagagcaacgtctctcaaccttttttcattattgtcttcctcccactgggagtctttttagatattttttctaatgacccctattgttaacatttaatgccacagatatcttgtacgtctgtttatgtaccgcggtcctttggaaggctacaaaccattgcaatatctaagatgtttttccacccacwttcccaagaaccagtattcatcccttttggggtaatattgtcccttctgagaacatatatgccaaatagttctgctaaaaaaaaaatttttgtaaatatcactgatgtattaaaggaaagaaatgtaggcttcagtcccccattactttttcttttgctccacgataactttcaaagaagctgagtatttttcataaaatgtctaaccttactgaatcaaggttttatgaatataatcatgggattgattatatttcagttagtcttcctaaaacaaaatggaagtcaacatgatccttt

SEQ ID NO: 102684 - DNA, 601 bp, Human
gagattaaggagaggagtttagatgaccagggataaacaagtatgagaaaatgtgatctattttatatatctaagaaatatataagtagaaataatgaaaaagaagttggaaatgtgggtccgaaatgcaaaagtgaactctgggctggagctaaagatttgggtgtcattggatggtggatgagattacctaccctgaaaaagtatattagaagaaggatagaatagaagatgcaattccagagaacctcaactttttaaaaaatatttaagaatttttaattgacaagtaaaaattatccacacacacacacacacatatacatacacacacacacccagtatatgattttttttttttttttgagaccgagtctccctctgttgccgaggttggagtgcagtggtgtgatcgaggctcactgcaacctccacctcccaagttcaagcgattctcctgcctcagcctcccaagtagctgggattacaagtgtgcaccaccatgcgggagctaattttttttttgtatttttagtagaaacaaggtttcaccatgttggccaggctggtctcaaactcctgacctcaagtgatcagccaa

SEQ ID NO: 102685 - DNA, 601 bp, Human
ttctcctgcctcagcccaagtagctgggattacaggcgcgtgccaccacgcccagctaatttttgtatttttagtagagatgtggtttcactatgttggccaggctggtctcgaactcctgaccttgtgatccccctgcctcggcctcccaaagtgctgggattacaggtgtgaaccaccgcaccccacccctggctaattttcaaataaaaatttttgtagagacaaggtcgccctgtgttgcctagggtggtcttgaactcctgggctcaagagatcctcctgccttggctctacaaastgctgggattaaaggtgtgagccactgtgcccaactcctattcatttttggcaccttttccatcctaccctcttctaccctgttaactcaagaatatctctcctctaccctcaatccagtccctctttgtatgagccataaatgttcttcattttaacttatgagagtaaaactctacattggaggctatgaattacatatcacacaactacaaatcactaggcatgctaaggtagtttagctaaatcacacagtatatgctcaacaaatgcaactgaattaagcagggggcatcacata

SEQ ID NO: 102686 - DNA, 601 bp, Human
gtggccagagctgagaatcactgccataaatgtttcttttctccagggttctgtcttaggatcactgctctactcattctccagagattatctgacccaccctcatgttattaactatcacctggatgtttatcatttctccgagactcctggactcatgctgctgagaaaactaagtggctagcataaggatatctgatttgcccctattcgaccacctgcttccctcccatcaagagaattacatatgtactaccacccacctgctcctgactttcaccctttgcaaaccagttaattytgaagttgacaaagattttcttaaggtggccccacccaccccccgcccctcttttattttgagacagagtctggctctgtcacctgggctggagtgcagtggcacgatcacagctcactgcagcctcaacctcctggactcaagtgattctcccaccacagcctcctgagtagctcggactacaggtgtgtaccaccacacctggctaattttcttttcttttctttttttttttttgagacggagtctcgccctgtcgctcaggctggagtgcaatggcacgatctcggctcactgcaa

SEQ ID NO: 102687 - DNA, 601 bp, Human
ataagtgtatctcttcatgtggtacaattccttttcacagtcatgttggtcaccatcaaaatccaatgtaaaaagagaacaagaacctctagcacttgagaataagaatctacccacagtcatttctaaggatggtcaaactctagatgacctcagcaggaagtcctagtatcactttttacagaatgctaaatttgtcatttgaagataaaccctagacactgatagcttctgttcataagtttcatgaaagcaaatgaaacactaaaatattaatgttatatttctgcctctaatagarctatgatggctgtggccccctctaatcacaagacttaaaaatacatttgtctctagtaatgaacacttcaatcagaaaaacaagatgaaatctttatagagatactataggatgtatgcacaagttgtatttcttagacacatatttgactatattcgtttctttttttaagagatattatttttgcagtccatttctaactaaaacatctgaagcttcaatctatccaagcaaaatattggtgttatatatttaaatatttttcctagattgaaaaataatgagataaaaaaacaactg

SEQ ID NO: 102688 - DNA, 601 bp, Human
acaaatcactcatataccatggtatagccacaaagactattaatattttggtgtatttcactccaattttttaattagcagctgcgtatatatatacctatttcttttttttacatagttgagaccaattatacagtctgtattctgctttttgttttttaagatattatctgctttgataattatttcatctcttccactatagtcaagatattaactatcacgtcttagtgcttccagtgagtcttaaagtatctgtctacctctcaatcctggtatgtatgctgtttcccatttgctrgacggtgaaaaaaatagaaaatccaatttgatagaactatgtctaacataataaatagattttgagtaaggtacttggaagactctcttttgataaaagtctacatgctgctttttaaggacttgatcacattcctttcgcctgttgagggatatttttgtttttgcttactttcaggtttactgccatattttgaagagatagatagcatttccaggtaggtacagttgctggaagagtggactttcagagaggtgaagtgttcctgtgctgcaatgttacagaataccataaatctga

SEQ ID NO: 102689 - DNA, 601 bp, Human
ggctggagtgcagcggcgcgatctcggctcactgcaagctccgcctcccaggttcacgccactctcctgcctcagccttgcgagtagctgggactacaggcgcccgccaccacgcccggctaattttttgtattttttagtagagacggggtttcaccgtgttagccagatggtctcgatctcctgacctcgtgatccgcccgcctcggcctcccaaagtgctgggattacaggcgtgagccaccgcgcccggcctgaggattgcttttaagttcaaggaggacatgagcatttctgtagraagaagtcaatttaaagaaagacattaagaaggaaagaagcatgattctgaaggaggtaagaggaatgagattaggagcacaaagtttgcctcgggaagtgacactgagggaaatgaagggaacttgaaaaagatggtcatttactaaaactgtcaggtgcaagtttcagtttgagggactacagagaatagagaaaatctggaagaatagcagaggcatatgattcagtaaacaatgaacaaggagactgctaaggagtgatgaagatgcaactaaagctacaaacatacttcaaacat

SEQ ID NO: 102690 - DNA, 601 bp, Human
gctcccagagggagataactctattatgtatttaagaaatccttacaaaaccctgttctaaacacaatgttaactcatatagttctcaaaacacccacgaggaaaatcctactatcatttccattttacatgtgagaatactgaggcagaaaggtaattcactgccccaaggtcacaaagctagtaagtggcagagccaagatttagacccacacagtctaactccatagtgtttgctataactatagcactaagcgagactctcaactctccttaacccaatggactaagacaagcatcyttacaacatggcagctggcttgagagtaaacttgagacacccatggcctgtgagaatagcatagatgcatatagccacagtaagtttaaaaaggtgttttctagtgtagtgttccccaaacttgtcagctgaagaggagtatctagagattaaaagaaaaaacaaaaacagaatccttggccccctcccatacctaagtcagactctgggaatggagattggtagaagttaatagaggaccaaattagaatcacataggaagcgttttcaagatccccatgaccagcacctatccctgga

SEQ ID NO: 102691 - DNA, 601 bp, Human
cttgtaaaaatgaatctatctcccaggagtttaatcatctgccttcgcctagaaatcaactgttttctattctgctcatctttgtggcgagacaactctccttttctctcctcctgaagatttatttatttattaaggcatttattgaaatacatgtattcccttccttattggcaacttcagtctctccttttttactgctgctttttctttaaactctaactaataaaaataataatagcagtaataataacgagctagtacatacaaagtatttattattgagacagtcaggtgggarggggtccctggagaaactccaaacagcctgcccactaaggtggagcctcgttaagtttacactggggaggagcctggcccctccttttcctgtgtggaagttgggattctaacatcctgctctagcaggatgtttcccccttttcttccttttcaccaaataaaaccctgcttgttcaccattcaaattgtctgcgggcctgaatttttgtggctgtgggacaaagaactctgtctttagctgaactaaggaagagttctgcaacattttgtgctagggaccattttaggtgcttagaaa

SEQ ID NO: 102692 - DNA, 601 bp, Human
ataggatttttgtgaggattaaatttgttattatataatacaaatagtagaggccgggagcataatcccagcatttgggaggctgaggtgggcagatcacctgaggtcaggagttcaagatcagcctggccaacatggtgaaaccctgtctctactaaaaatacaaaaattagccaggtgtggtagtgtgtgcctatagtcccagctacttggggggctgaggcaggagaatcgcttgaacccgggaggcagaggttgcagtgagccgagatcacctcattgcactccagcttggtgacaragtgagactcagtctcaaaaaaataataataaaaataaacaaataaataaaatggtaatagctgattgaatcagggaaggaccccgacctacaggggaaccatcctaggcttgtcaaagacttggggcctggtgcaaaaaaaaaaaaaaaaggattcagataacattcctgtcacaggaacatagaattgggacccaagaatctttgtcaggaggtagaaggagcagttagatgaggataagtgaagtctcgtttcaagcactagattaaaggcccatgaactcatgatgtgaaggacca

SEQ ID NO: 102693 - DNA, 601 bp, Human
ctgtttaaaacagcactcaggccgtttatgtagctgatcttggattagcccttgttgcacagggatgatttaccactgcagaaaagaagaaataaagagaaaaattatttgaaatgtataaataaaaaaacataatgcacctagaacactgaataagacaaaaccataaacagctcatttataatactgatttaggattgtgctactgtaacttaaaatgagaagttcaacaaattaggccacagataatacacaaatctcatatttatttcattagttatcatgcaggtcatgataaacrtgtcacataataaaggaatgaactgcgtattgccagcactccatctcaagctgcattcttgcttgtttctttggaaagttgtaagttaatgaatagatgcgactttctatgatacggatgtccttcactactcgaatctattgaattcagcaatgaatacatattcatgaatgtgaactcttctcaaaacagggatttagacagtctattccattaaacataagtttatttttcttccaggtgtcagctaggaaatcaacattttggtcagtggccttttcataatgtttgtcctaatgg

SEQ ID NO: 102694 - DNA, 601 bp, Human
taaagtactattttcctaaatgggattacttaattccatcccaatgattcatttcccagaattttttttccttttgaaataagcaagttcatataacatctacctaataagctgactttcaactaaaatgggatgtctaatttctaatcgagtttagtacatattagagctgtcttcaaaatctacttcacatagtgaaagcaaggtagtacagtcaaagttacattaggccctgtggggagataaaaaaaatgataaaaaaaaaaattggctcctactctcatatagtttacagccttgmggtttcacagcatagaatgcttgcaatggaagggatcaaagatcatctattctaaaccattcattttatagatgaggcctttgaggcccagtgaggttaactaatttgcccagggctcacaaagttaattggggaaatagaacatgcaagggaaacaaatgaagggcacaattttaaagaaatccagctactcttctgcttttgtgtatgaggtacacagtgaatgctgatgatgtgccatagagattagatcgaagtctggcagtcaaaagcaattctggagtagatgccaaggctctt

SEQ ID NO: 102695 - DNA, 601 bp, Human
tgaataatttttagtcaatgcttagaatggccacaggtagcacaccaggaaatggctaggaagtgctcccactgcctgggtaattttataagtcatttgtaacatatatactgttctggtaacagataaaaccctaggttaggtttatctttcatttcttatagctctttttctctagcacgagaatccaaaaagtacttagagaacactggcacaaagaagggtgtatcaaaaacaaatgttactcttttggtctagagtaactttagaggataagtttaggacactaaaactataggtrtgctggaagttccataattgactttcaaatgctattttccagtagtcaaaactactcatttgcttaagttatggagtatataacattgcaattgaataataattatgaaagacattgccatttccatcaatatttttattttaaattacaccgggtatcttatttttttaagagaagcccaaattaaatgcagtttatttttcttgaaaagaaatgctgatctctattcatagcctgctaatagcattatttctttttttttttttattttcggtacacacagaggaacagaagggaggg

SEQ ID NO: 102696 - DNA, 601 bp, Human
tcaagccagtattaccctaatacaaagtcacagacactacaagaaaactacagaccagtatcttcgatgaaaacagatgtgaaaattcccaagaaaatattagcaaaccgaattcaacactaagttctaaaaaatcatacatcatgatcaaatgggacttatccctaatatgtgaggatggcttgaacatatgcaaatcaattaatgtgctacaccacattaatagaatgaaggataaaaatcacacaatcatcccaatagatgcagaaaaagcatttgaaaaaattcaacacctttccaygataaacactatcaataaattagacatacaaggaatttacctcaacacaattaaggccatatatgaaaagcccactgctaatatcaaactaatgataaaacacaaagtttttcttctcatatcaggaaatggaaagaatgcccaccctcaccatttatattcaagatagtactggaagctctagctggagcaactagacaagaaaaagaaaaataaaagacattaaaattgggaggaaaaaaaaaagaagtaaaactatctctgtttgccgacacgtgatcttacatagagaaaacccta

SEQ ID NO: 102697 - DNA, 601 bp, Human
gataaaatagcagaagcaaggtcactctcaccttccccttgcccttctctcttgaagcaggccataaaaccttcattccagaggtacccccaaaccccacattcagaggaaaggaacatccttatctctgaagatacaaggacacagaaaagaatcagaaaacacaggccttgttaagtcccccacactttattattattagatcatatcccctttgtccagtcatatttctccactaccctccacttcttcatcaaacctaagcataagaatacacaggtttgggttcctgagccaagayggctgaataggaacagctctggtctacagctcccagcgtgagcgacgcagaagacaggtgatttctgcatttccatctgaggtaccgggttcatctcactagggagtgccagacagtgggcgcaggacagtgggtgcgcgcaccgtgcgcaagccgaagcagggcgaggcattgcctcactcaggaagcgcaaggggtcagggagttccctttcctggtcaaagaaaggggtgacggacggcacctggaaaatcggatcactcccacccgaatactgcgcttttccgacgggcttaaaaa

SEQ ID NO: 102698 - DNA, 601 bp, Human
ccaggctgatctcgaactcctgacctcatgatccgcccgcctccgcctcccggtgtgctaggattacaggcatgagccacggtgcccggccttatggcttattttatatgtttattattatgagtataatccttcagatgtagaattcactaatctaccagcttttcagagtgagaagtcccttgttttgctactgatggggttcaagacccgctaccaacagtatgtcaccttggcatttgataaaatagcagaagcaaggtcactctcaccttccccttgcccttctctcttgaagcasgccataaaaccttcattccagaggtacccccaaaccccacattcagaggaaaggaacatccttatctctgaagatacaaggacacagaaaagaatcagaaaacacaggccttgttaagtcccccacactttattattattagatcatatcccctttgtccagtcatatttctccactaccctccacttcttcatcaaacctaagcataagaatacacaggtttgggttcctgagccaagatggctgaataggaacagctctggtctacagctcccagcgtgagcgacgcagaagacaggt

SEQ ID NO: 102699 - DNA, 601 bp, Human
caacaccttggataataaagtaggcaagccccacctgaatctgtcatgtaaagtgttaaaagtcttgcattatttgcttgtgattaccagctccattttcttgtgcccttagttcaggactgccgctgcttaacagacagaccactagggaggtctgtgaacaaacagtatcttatttctccaaatagggaaagaagtgttcatgggcaggaggtaaataaatatactgtttgcagtaatgcaatgatagttctccttctccaagcaaaaataagaacaaacaaaatattaataatgaccrtaaggacaaaaaaaaatgagggttccatttgcctaaaaggcatagtataactcaattttatcagtaaaatgcagttcctagttttgcctctctgaaatacagaattcaactaattaaagcactaatgaaagcagtcatgattttaaccagataaacctcaaattatgaacctcatagttcagaagtatttcttgactgaatgcatcaacaactcattaatctgccagacactttcactatgaaacttgaaagtctgggccagatgtgtggtggctcacgcttataatcccagcactgtgg

SEQ ID NO: 102700 - DNA, 601 bp, Human
aacaaaaactaaagacagactgattaaatatagttcaagttattctcagtagtattaagatacagaatcctagtggagtcttgaatctatgtatggggcaactttctttattcagtgttttagagatggatctacttagatagaaatcaaccacaaacgaaaagtcaatttagtttatcttcacttttgactttatttgagagggagtttctggctagcacagcatccttttcaatttgtttcagtataatgtgcagcagatacacttgattaatgaactgattagcaacttctttaattmttttccagtagttttttcattatcaaagctgcagtgaatccataaagttagtgttctttaactttagtaaaaactttataaacaaatttttttttcctaaaaaggattaacagaaaatattaaaaatgtttaatttcaaaataggtttctaagacctctcttacatataaatcctgtatctttcatttctctaaaagctgtaaatgcaagggatcacaaagctttcacaatataatagttaagattatactaagcaatatggagaaaattctagattttatttataattcagtaatcttt

SEQ ID NO: 102701 - DNA, 601 bp, Human; identical to SEQ ID NO: 102589

SEQ ID NO: 102702 - DNA, 601 bp, Human; identical to SEQ ID NO: 102590

SEQ ID NO: 102703 - DNA, 601 bp, Human; identical to SEQ ID NO: 102591

SEQ ID NO: 102704 - DNA, 601 bp, Human; identical to SEQ ID NO: 102592

SEQ ID NO: 102705 - DNA, 601 bp, Human; identical to SEQ ID NO: 102593

SEQ ID NO: 102706 - DNA, 601 bp, Human; identical to SEQ ID NO: 102594

SEQ ID NO: 102707 - DNA, 601 bp, Human; identical to SEQ ID NO: 102595

SEQ ID NO: 102708 - DNA, 601 bp, Human; identical to SEQ ID NO: 102596

SEQ ID NO: 102709 - DNA, 601 bp, Human; identical to SEQ ID NO: 102597

SEQ ID NO: 102710 - DNA, 601 bp, Human; identical to SEQ ID NO: 102598

SEQ ID NO: 102711 - DNA, 601 bp, Human; identical to SEQ ID NO: 102599

SEQ ID NO: 102712 - DNA, 601 bp, Human; identical to SEQ ID NO: 102600

SEQ ID NO: 102713 - DNA, 601 bp, Human; identical to SEQ ID NO: 102601

SEQ ID NO: 102714 - DNA, 601 bp, Human; identical to SEQ ID NO: 102602

SEQ ID NO: 102715 - DNA, 601 bp, Human; identical to SEQ ID NO: 102603

SEQ ID NO: 102716 - DNA, 601 bp, Human; identical to SEQ ID NO: 102604

SEQ ID NO: 102717 - DNA, 601 bp, Human; identical to SEQ ID NO: 102605

SEQ ID NO: 102718 - DNA, 601 bp, Human; identical to SEQ ID NO: 102606

SEQ ID NO: 102719 - DNA, 601 bp, Human; identical to SEQ ID NO: 102607

SEQ ID NO: 102720 - DNA, 601 bp, Human; identical to SEQ ID NO: 102608

SEQ ID NO: 102721 - DNA, 601 bp, Human; identical to SEQ ID NO: 102609

SEQ ID NO: 102722 - DNA, 601 bp, Human; identical to SEQ ID NO: 102610

SEQ ID NO: 102723 - DNA, 601 bp, Human; identical to SEQ ID NO: 102611

SEQ ID NO: 102724 - DNA, 601 bp, Human; identical to SEQ ID NO: 102612

SEQ ID NO: 102725 - DNA, 601 bp, Human; identical to SEQ ID NO: 102613

SEQ ID NO: 102726 - DNA, 601 bp, Human; identical to SEQ ID NO: 102614

SEQ ID NO: 102727 - DNA, 601 bp, Human; identical to SEQ ID NO: 102615

SEQ ID NO: 102728 - DNA, 601 bp, Human; identical to SEQ ID NO: 102616

SEQ ID NO: 102729 - DNA, 601 bp, Human; identical to SEQ ID NO: 102617

SEQ ID NO: 102730 - DNA, 601 bp, Human; identical to SEQ ID NO: 102618

SEQ ID NO: 102731 - DNA, 601 bp, Human; identical to SEQ ID NO: 102619

SEQ ID NO: 102732 - DNA, 601 bp, Human; identical to SEQ ID NO: 102620

SEQ ID NO: 102733 - DNA, 601 bp, Human; identical to SEQ ID NO: 102621

SEQ ID NO: 102734 - DNA, 601 bp, Human; identical to SEQ ID NO: 102622

SEQ ID NO: 102735 - DNA, 601 bp, Human; identical to SEQ ID NO: 102623

SEQ ID NO: 102736 - DNA, 601 bp, Human; identical to SEQ ID NO: 102624

SEQ ID NO: 102737 - DNA, 601 bp, Human; identical to SEQ ID NO: 102625

SEQ ID NO: 102738 - DNA, 601 bp, Human; identical to SEQ ID NO: 102626

SEQ ID NO: 102739 - DNA, 601 bp, Human; identical to SEQ ID NO: 102627

SEQ ID NO: 102740 - DNA, 601 bp, Human; identical to SEQ ID NO: 102628

SEQ ID NO: 102741 - DNA, 601 bp, Human; identical to SEQ ID NO: 102629

SEQ ID NO: 102742 - DNA, 601 bp, Human; identical to SEQ ID NO: 102630

SEQ ID NO: 102743 - DNA, 601 bp, Human; identical to SEQ ID NO: 102631

SEQ ID NO: 102744 - DNA, 601 bp, Human; identical to SEQ ID NO: 102632

SEQ ID NO: 102745 - DNA, 601 bp, Human; identical to SEQ ID NO: 102633

SEQ ID NO: 102746 - DNA, 601 bp, Human; identical to SEQ ID NO: 102634

SEQ ID NO: 102747 - DNA, 601 bp, Human; identical to SEQ ID NO: 102635

SEQ ID NO: 102748 - DNA, 601 bp, Human; identical to SEQ ID NO: 102636

SEQ ID NO: 102749 - DNA, 601 bp, Human; identical to SEQ ID NO: 102637

SEQ ID NO: 102750 - DNA, 601 bp, Human; identical to SEQ ID NO: 102638

SEQ ID NO: 102751 - DNA, 601 bp, Human; identical to SEQ ID NO: 102639

SEQ ID NO: 102752 - DNA, 601 bp, Human; identical to SEQ ID NO: 102640

SEQ ID NO: 102753 - DNA, 601 bp, Human; identical to SEQ ID NO: 102641

SEQ ID NO: 102754 - DNA, 601 bp, Human; identical to SEQ ID NO: 102642

SEQ ID NO: 102755 - DNA, 601 bp, Human; identical to SEQ ID NO: 102643

SEQ ID NO: 102756 - DNA, 601 bp, Human; identical to SEQ ID NO: 102644

SEQ ID NO: 102757 - DNA, 601 bp, Human; identical to SEQ ID NO: 102645

SEQ ID NO: 102758 - DNA, 601 bp, Human; identical to SEQ ID NO: 102646

SEQ ID NO: 102759 - DNA, 601 bp, Human; identical to SEQ ID NO: 102647

SEQ ID NO: 102760 - DNA, 601 bp, Human; identical to SEQ ID NO: 102648

SEQ ID NO: 102761 - DNA, 546 bp, Human; identical to SEQ ID NO: 102649

SEQ ID NO: 102762 - DNA, 601 bp, Human; identical to SEQ ID NO: 102650

SEQ ID NO: 102763 - DNA, 601 bp, Human; identical to SEQ ID NO: 102651

SEQ ID NO: 102764 - DNA, 601 bp, Human; identical to SEQ ID NO: 102652

SEQ ID NO: 102765 - DNA, 601 bp, Human; identical to SEQ ID NO: 102653

SEQ ID NO: 102766 - DNA, 601 bp, Human; identical to SEQ ID NO: 102654

SEQ ID NO: 102767 - DNA, 601 bp, Human; identical to SEQ ID NO: 102655

SEQ ID NO: 102768 - DNA, 601 bp, Human; identical to SEQ ID NO: 102656

SEQ ID NO: 102769 - DNA, 601 bp, Human; identical to SEQ ID NO: 102657

SEQ ID NO: 102770 - DNA, 601 bp, Human; identical to SEQ ID NO: 102658

SEQ ID NO: 102771 - DNA, 601 bp, Human; identical to SEQ ID NO: 102659

SEQ ID NO: 102772 - DNA, 601 bp, Human; identical to SEQ ID NO: 102660

SEQ ID NO: 102773 - DNA, 601 bp, Human; identical to SEQ ID NO: 102661

SEQ ID NO: 102774 - DNA, 601 bp, Human; identical to SEQ ID NO: 102662

SEQ ID NO: 102775 - DNA, 601 bp, Human; identical to SEQ ID NO: 102663

SEQ ID NO: 102776 - DNA, 601 bp, Human; identical to SEQ ID NO: 102664

SEQ ID NO: 102777 - DNA, 601 bp, Human; identical to SEQ ID NO: 102665

SEQ ID NO: 102778 - DNA, 601 bp, Human; identical to SEQ ID NO: 102666

SEQ ID NO: 102779 - DNA, 601 bp, Human; identical to SEQ ID NO: 102667

SEQ ID NO: 102780 - DNA, 601 bp, Human; identical to SEQ ID NO: 102668

SEQ ID NO: 102781 - DNA, 601 bp, Human; identical to SEQ ID NO: 102669

SEQ ID NO: 102782 - DNA, 601 bp, Human; identical to SEQ ID NO: 102670

SEQ ID NO: 102783 - DNA, 601 bp, Human; identical to SEQ ID NO: 102671

SEQ ID NO: 102784 - DNA, 601 bp, Human; identical to SEQ ID NO: 102672

SEQ ID NO: 102785 - DNA, 601 bp, Human; identical to SEQ ID NO: 102673

SEQ ID NO: 102786 - DNA, 601 bp, Human; identical to SEQ ID NO: 102674

SEQ ID NO: 102787 - DNA, 601 bp, Human; identical to SEQ ID NO: 102675

SEQ ID NO: 102788 - DNA, 601 bp, Human; identical to SEQ ID NO: 102676

SEQ ID NO: 102789 - DNA, 601 bp, Human; identical to SEQ ID NO: 102677

SEQ ID NO: 102790 - DNA, 601 bp, Human; identical to SEQ ID NO: 102678

SEQ ID NO: 102791 - DNA, 601 bp, Human; identical to SEQ ID NO: 102679

SEQ ID NO: 102792 - DNA, 601 bp, Human; identical to SEQ ID NO: 102680

SEQ ID NO: 102793 - DNA, 601 bp, Human; identical to SEQ ID NO: 102681

SEQ ID NO: 102794 - DNA, 601 bp, Human; identical to SEQ ID NO: 102682

SEQ ID NO: 102795 - DNA, 601 bp, Human; identical to SEQ ID NO: 102683

SEQ ID NO: 102796 - DNA, 601 bp, Human; identical to SEQ ID NO: 102684

SEQ ID NO: 102797 - DNA, 601 bp, Human; identical to SEQ ID NO: 102685

SEQ ID NO: 102798 - DNA, 601 bp, Human; identical to SEQ ID NO: 102686

SEQ ID NO: 102799 - DNA, 601 bp, Human; identical to SEQ ID NO: 102687

SEQ ID NO: 102800 - DNA, 601 bp, Human; identical to SEQ ID NO: 102688

SEQ ID NO: 102801 - DNA, 601 bp, Human; identical to SEQ ID NO: 102689

SEQ ID NO: 102802 - DNA, 601 bp, Human; identical to SEQ ID NO: 102690

SEQ ID NO: 102803 - DNA, 601 bp, Human; identical to SEQ ID NO: 102691

SEQ ID NO: 102804 - DNA, 601 bp, Human; identical to SEQ ID NO: 102692

SEQ ID NO: 102805 - DNA, 601 bp, Human; identical to SEQ ID NO: 102693

SEQ ID NO: 102806 - DNA, 601 bp, Human; identical to SEQ ID NO: 102694

SEQ ID NO: 102807 - DNA, 601 bp, Human; identical to SEQ ID NO: 102695

SEQ ID NO: 102808 - DNA, 601 bp, Human; identical to SEQ ID NO: 102696

SEQ ID NO: 102809 - DNA, 601 bp, Human; identical to SEQ ID NO: 102697

SEQ ID NO: 102810 - DNA, 601 bp, Human; identical to SEQ ID NO: 102698

SEQ ID NO: 102811 - DNA, 601 bp, Human; identical to SEQ ID NO: 102699

SEQ ID NO: 102812 - DNA, 601 bp, Human; identical to SEQ ID NO: 102700

SEQ ID NO: 102813 - DNA, 601 bp, Human
ttcgagcagggccctcgccgaggcaggacagggccacattcggaagtgagagttctctgagtcccgcacagagcgagtctctgtccccagcccccaaggcagctgccctggtgggtgagtcaggccaggcccggagacttcccgagagcgagggagggacagcagcgcctccatcacagggaagtgtccctgcgggaggccctggccctgattgggcgccggggcggagcggcctttgctctttgcgtggtcgcgggggtataacagcggcgcgcgtggctcgcagaccggggagacgggmgggcgcacagccggcgcggaggccccacagccccgccgggacccgaggccaagcgaggggctgccagtgtcccgggacccaccgcgtccgccccagccccgggtccccgcgcccaccccatggcgacggacgcggcgctacgccggcttctgaggctgcaccgcacggagatcgcggtggccgtggacagcgccttcccactgctgcacgcgctggctgaccacgacgtggtccccgaggacaagtttcaggtgggctccccgcccgccccccgctgcccccaggccctgtgagccaggg

SEQ ID NO: 102814 - DNA, 601 bp, Human
ggggctgtgggggtctcctctgggtactagacccacacactggaccagcctctcagctccctcctgcctgaaggctgagctccccggagctggtgaagtaggcgggcgggtctcatttcccttttactgatgagaaaccagagcccggcaaagggactacccagcactggaccgccccctccacgccctcccaccgcgggcccctgcccaccggcactcacccccactgagaggggaggccaggctgcccccagctcccccattcaggctctcaactgaaggccaagccccccaagaagcyggagagcagcgcagagcagcagcgccttccactcgggaacggtgagcggggcccagtgggagcgcctcccttctccctggccaggggcaaggggtcaggggtcagagcagggcctgccctctgagaccctgtcctaggggctggggacgtgctggcctggtgtgtcattccaagggcctaagctgcaccaccagacccaggaaggggacaccttgggtctaagcatgatcttgccagtcgcccctgcccccactgcaccctggttctgggacccccttctcaggcaccttctctgcccgt

SEQ ID NO: 102815 - DNA, 601 bp, Human
cctgcccccactgcaccctggttctgggacccccttctcaggcaccttctctgcccgtccactccctatccttcaggaccagcctagacatagcttcctccagaaaatcatccctggcccccagctgcatgcaggctgaacccttcctgtccccttctccttccttcccagggcactggactccagagaccccctatctccctgagggcagagcctaggaactctgtgtccctcccggcacaatacagggcccatgtcatgggggggtgggtctggtcattggtcatgccttcctatccaytgtgccagctctgctgacactgccaccccccagcacacgcacacttgggtgcacacacgaacacacacattctcatgtctctgcacttacctgtgggctgtctgcacatggcagggctgggtcccctccttggcctgccctggctggaaggaaagggctctgcagcccagtgctgcctgcttctggcatagagtatgtgcttgggaacagtcttccccacgggtgaccccaatgggtgttccctttcccagggattcagaccatgtcagcttcagtccagagagctgtggccatgtcctc

SEQ ID NO: 102816 - DNA, 601 bp, Human
cttctctgcccgtccactccctatccttcaggaccagcctagacatagcttcctccagaaaatcatccctggcccccagctgcatgcaggctgaacccttcctgtccccttctccttccttcccagggcactggactccagagaccccctatctccctgagggcagagcctaggaactctgtgtccctcccggcacaatacagggcccatgtcatgggggggtgggtctggtcattggtcatgccttcctatccattgtgccagctctgctgacactgccaccccccagcacacgcacacwtgggtgcacacacgaacacacacattctcatgtctctgcacttacctgtgggctgtctgcacatggcagggctgggtcccctccttggcctgccctggctggaaggaaagggctctgcagcccagtgctgcctgcttctggcatagagtatgtgcttgggaacagtcttccccacgggtgaccccaatgggtgttccctttcccagggattcagaccatgtcagcttcagtccagagagctgtggccatgtcctccggggacgtcccgggagcccgaggggccgtggaggggatcctcat

SEQ ID NO: 102817 - DNA, 601 bp, Human
tgtgccagctctgctgacactgccaccccccagcacacgcacacttgggtgcacacacgaacacacacattctcatgtctctgcacttacctgtgggctgtctgcacatggcagggctgggtcccctccttggcctgccctggctggaaggaaagggctctgcagcccagtgctgcctgcttctggcatagagtatgtgcttgggaacagtcttccccacgggtgaccccaatgggtgttccctttcccagggattcagaccatgtcagcttcagtccagagagctgtggccatgtcctcyggggacgtcccgggagcccgaggggccgtggaggggatcctcatccagcaggtgtttgagtcaggtagacgctgtggcggggagatggggctgatggggagacccaggctccaagatggaaggaggaccacgcccctttgcatcctggtggtcccacagcagaccggactgttgctcaggtagccagagtttctgcctgtggttctgctgactttggaggaggagggtgagcactgaagtctccctgtcgggggaccttctgcaaggccagcggtccaggcccacatccccacccgggat

SEQ ID NO: 102818 - DNA, 601 bp, Human
gcggtccaggcccacatccccacccgggatgtacagcactccccagtcacctccatccatgtgcatgggccctcctgggccatggggttgcatccttagaaagttctgcctgtgctgctgagaccctccagggtatcggcattcttcaaccaggacagcctgtagcatagcgtccttgccccccataccctggccagcctgcagcatcctcgcccgccattccctggccagccgctgaccccatgcaatcaccagtgccatctgaccagggcacagcagggccgctggtggcagacccacygtgccatcggggcattccatctcaagtccctgacacggtgtctcctcggtgctggacatgggctgggaacaccaagcacagccagggccctggtcttgcacctctggatggtcccaaggcccactgtgttacttcctaaggctgttggttaaattggcacaaactgggaggcttgaaatgacagaaatgccaacatcgaggtgtctcggggccacactccctctggaggctccagggaagaatccttccttgtgtctcccagctgctggtcattatgggggtacccctgtgctccttgtt

SEQ ID NO: 102819 - DNA, 601 bp, Human
ttcctgataatacgcaatggtaatagtttaaatgagtcagagaaagtgaggtcttctcaggctcttaagagcatggcgtttggtccaggctgtacccgctgctctcagctgggcccgtgggtgggccgggcgcccctgctatagccaggaggtcaaggatccactgggaatgccatgctcatctttcgtccccagcatggtttcttaatggggtagaagcagtgtggggggtgcctgccgtggtgggttacagatcttgaccacttggcaccaggggctctgtggggccctggcacttagsagtgacaggagccagtcctgccctgcaggagcacccgggctggtgggcgtctgggggattgttagaatgagtgaggtcattgccgtgcaggaccagcctagcctggctgtctggggggattctggaggaagtggtacctgggagacccctgaaggcacagcaggcaccatccaggcagggcacaaggacggtgggggctgcaggtggaggattcagcaggcgctgaggtcgggagagacctccctgggcctggccccactgccctgtgaggaagggttcatgtggttggtgtacagttcc

SEQ ID NO: 102820 - DNA, 601 bp, Human
gggtgggccgggcgcccctgctatagccaggaggtcaaggatccactgggaatgccatgctcatctttcgtccccagcatggtttcttaatggggtagaagcagtgtggggggtgcctgccgtggtgggttacagatcttgaccacttggcaccaggggctctgtggggccctggcacttagcagtgacaggagccagtcctgccctgcaggagcacccgggctggtgggcgtctgggggattgttagaatgagtgaggtcattgccgtgcaggaccagcctagcctggctgtctgggggsattctggaggaagtggtacctgggagacccctgaaggcacagcaggcaccatccaggcagggcacaaggacggtgggggctgcaggtggaggattcagcaggcgctgaggtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaattt

SEQ ID NO: 102821 - DNA, 601 bp, Human
caggggctctgtggggccctggcacttagcagtgacaggagccagtcctgccctgcaggagcacccgggctggtgggcgtctgggggattgttagaatgagtgaggtcattgccgtgcaggaccagcctagcctggctgtctggggggattctggaggaagtggtacctgggagacccctgaaggcacagcaggcaccatccaggcagggcacaaggacggtgggggctgcaggtggaggattcagcaggcgctgaggtcgggagagacctccctgggcctggccccactgccctgtgagraagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaaga

SEQ ID NO: 102822 - DNA, 601 bp, Human
ttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccaggtgagcctgcacctctgccagcgcaaccaggccaccccggttcacggccgcctccacccactgaccctgaagggaagccaccccaagcctctcccatccaagatggaarggggttctgagtcaggtcactgggccgtggggccggggcctggggttttcccaccctgccacctgcctcccggtctggccacacctgctgcccagcctggacagctgggcccctgagggcagcaaagcagaacagaggcccagggcgaagatgccaccctgtccaagctcatcccaggctgcagcccacgcccccatgggtagccggcccccacccccaagccccaccccagagtcccactccagacagggctggggagcacagaggccacagagctgtgccccccagggcaggtgggag

SEQ ID NO: 102823 - DNA, 601 bp, Human
tgacggctgccctcgggccttccacctggcctgcctgtcccctccgctccgggagatccccaggtgagcctgcacctctgccagcgcaaccaggccaccccggttcacggccgcctccacccactgaccctgaagggaagccaccccaagcctctcccatccaagatggaaaggggttctgagtcaggtcactgggccgtggggccggggcctggggttttcccaccctgccacctgcctcccggtctggccacacctgctgcccagcctggacagctgggcccctgagggcagcaaagcagaacagaggcccagggcgaagatgccaccctgtccaagctcatcccaggctgcagcccacgcccccatgggtagccggcccccacccccaagccccaccccagagtcccactccagacagggctggggagcacagaggccacagagctgtgccccccagggcaggtgggagtttgtccaccaatgcacaggacgccgggcttagtgggggcgggaggcctcctctgcgttcacatcccggtgctccttccccacggcccaccgagccctgcccccattccaaccccacaggacgtggcag

SEQ ID NO: 102824 - DNA, 601 bp, Human
agggccaccccacgaagggtaaatgtccccctgctgggctctcccttcctgtgtctctgcccatctctctgctgtgcctcggttccccctctgtgaaaagacatggtcggagccctggagctccacccgtgggtttggggatctgtcacccgctgtcttgttctgcatgtctctgactggtggacacacgagcagtgggacctggaggtgctccagctgcctgcaggcaacagtccaggaggtgcagccccgggcagaggagccccggccccaggagccacccgtggagaccccggtatgrccacgccccctcctagccgggccacccctcctgtccacatggccacgccccctcctaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgagggta

SEQ ID NO: 102825 - DNA, 601 bp, Human
tctgcccatctctctgctgtgcctcggttccccctctgtgaaaagacatggtcggagccctggagctccacccgtgggtttggggatctgtcacccgctgtcttgttctgcatgtctctgactggtggacacacgagcagtgggacctggaggtgctccagctgcctgcaggcaacagtccaggaggtgcagccccgggcagaggagccccggccccaggagccacccgtggagaccccggtatggccacgccccctcctagccgggccacccctcctgtccacatggccacgccccctcmtaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgagggtagtaggtctactgtgcacagacccagtgttccctctgacagccctgagggccaggg

SEQ ID NO: 102826 - DNA, 601 bp, Human
ctgctgtgcctcggttccccctctgtgaaaagacatggtcggagccctggagctccacccgtgggtttggggatctgtcacccgctgtcttgttctgcatgtctctgactggtggacacacgagcagtgggacctggaggtgctccagctgcctgcaggcaacagtccaggaggtgcagccccgggcagaggagccccggccccaggagccacccgtggagaccccggtatggccacgccccctcctagccgggccacccctcctgtccacatggccacgccccctcctaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgagggtagtaggtctactgtgcacagacccagtgttccctctgacagccctgagggccagggggccccccgtgtg

SEQ ID NO: 102827 - DNA, 601 bp, Human
tggccacgccccctcctagccgggccacccctcctgtccacatggccacgccccctcctaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgaggrtagtaggtctactgtgcacagacccagtgttccctctgacagccctgagggccagggggccccccgtgtgtagacgggggaggagggaggaccacagagccaggaagtgccacagcctttcccactcagtgtggacgccttccaccatgccagccctccgcccccaccatgccaggcctctgcccccaccctgctgccctgggtttcagggtcccagcagtcactgactcctgggtggtgccgggcaggcgcccgctgcccctctgatgctgacccttgggttccagctccccccggggc

SEQ ID NO: 102828 - DNA, 601 bp, Human
ggaccacagagccaggaagtgccacagcctttcccactcagtgtggacgccttccaccatgccagccctccgcccccaccatgccaggcctctgcccccaccctgctgccctgggtttcagggtcccagcagtcactgactcctgggtggtgccgggcaggcgcccgctgcccctctgatgctgacccttgggttccagctccccccggggcttaggtcggcgggagaggaggtaagaggtccacctggggaacccctagccggcatggacacgactcttgtctacaagcacctgccggcyccgccttctgcagccccgctgccagggctggactcctcggccctgcaccccctactgtgtgtgggtcctgagggtcagcaggtgagcggggagtgggggtcagggtgggctcttcaaggagcccaggacctacggggcggatgaattcacctgaaacaggaggagagggaggccaggcgagaaaggctccgggaggcacagggcctggggctgtggggggagcgtggggggctgcggggggaaggggacgctcctagacctccactccagctcctggccctgggcattactgctcccccc

SEQ ID NO: 102829 - DNA, 601 bp, Human
ggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcaggtgagcggggagtgggggtcagggtgggctcttcaaggagcccaggacctacggggcggatgaattcacctgaaacaggaggagagggaggccaggcgagaaaggctccgggaggcacagggcctggggctgtggggrgagcgtggggggctgcggggggaaggggacgctcctagacctccactccagctcctggccctgggcattactgctccccccacaaggcaggacaatgaagggggggatgtcccagcacacgtgggagccctcccctccctgcctcaattcccttccctgcacccctgtgggcaccgcctttcaggagactcccgcactcagccccaaaggaggccaggcccgccaagcaggagagaggtgcgggcgccaggcttgcaggcagcagcctgagggtgcttgggtcgcccctgcctcctgggg

SEQ ID NO: 102830 - DNA, 601 bp, Human
gctccactggcccatgctctttcccagctgtgcctccgccccgtatacaccgtgtgggtgacaggccaccccggcgtggtactccccaggagggtgacagcctaccccagcgtggtactccccgggcaggtgacaggcttccccggcatgcaggctctggcctggcatggcacaagcctcagacccagccctgcccttggggcttttgtggaacagtggcgtggcccacagctgtcactgtccccttccttctagaagcctccctcctcacaccacccatctggagtcaggagcccagccrggcatatacgcagatgcccctccctaaccccaggcagctttcctgcaactgctcccgcagcgggtacctcgtcattaacctcctgggttctgtctctgaacagcagagacctctttcttgtcatcgtgatgtgaaatgtaacgccatgtcagaggaaaagttctggctggccttggcctcccccctcagcctgcccccttcctccagggtggttggacgtggccccagaccccatcctgagcagctctcccaccccctgggagcatccttaggaccggggagcatccaggggctttcccc

SEQ ID NO: 102831 - DNA, 601 bp, Human
tcactgtccccttccttctagaagcctccctcctcacaccacccatctggagtcaggagcccagccgggcatatacgcagatgcccctccctaaccccaggcagctttcctgcaactgctcccgcagcgggtacctcgtcattaacctcctgggttctgtctctgaacagcagagacctctttcttgtcatcgtgatgtgaaatgtaacgccatgtcagaggaaaagttctggctggccttggcctcccccctcagcctgcccccttcctccagggtggttggacgtggccccagaccccrtcctgagcagctctcccaccccctgggagcatccttaggaccggggagcatccaggggctttcccctccagaccgggcagcccctccctcagccatgcagggctgccgggcctcgcagcgccagtgttcacccgagtggaggagctgggatgtggctgtttggggccacaaatggggaattccacagggttcaatgtaatatggtctcctctctgctgggggtgcctgcctggggaccttctcccactctggtcgctcacctatagtgtgggctggccctggtggtgcttgtcgggggcg

SEQ ID NO: 102832 - DNA, 601 bp, Human; identical to SEQ ID NO: 102813

SEQ ID NO: 102833 - DNA, 601 bp, Human; identical to SEQ ID NO: 102814

SEQ ID NO: 102834 - DNA, 601 bp, Human; identical to SEQ ID NO: 102815

SEQ ID NO: 102835 - DNA, 601 bp, Human; identical to SEQ ID NO: 102816

SEQ ID NO: 102836 - DNA, 601 bp, Human; identical to SEQ ID NO: 102817

SEQ ID NO: 102837 - DNA, 601 bp, Human; identical to SEQ ID NO: 102818

SEQ ID NO: 102838 - DNA, 601 bp, Human; identical to SEQ ID NO: 102819

SEQ ID NO: 102839 - DNA, 601 bp, Human; identical to SEQ ID NO: 102820

SEQ ID NO: 102840 - DNA, 601 bp, Human; identical to SEQ ID NO: 102821

SEQ ID NO: 102841 - DNA, 601 bp, Human; identical to SEQ ID NO: 102822

SEQ ID NO: 102842 - DNA, 601 bp, Human; identical to SEQ ID NO: 102823

SEQ ID NO: 102843 - DNA, 601 bp, Human; identical to SEQ ID NO: 102824

SEQ ID NO: 102844 - DNA, 601 bp, Human; identical to SEQ ID NO: 102825

SEQ ID NO: 102845 - DNA, 601 bp, Human; identical to SEQ ID NO: 102826

SEQ ID NO: 102846 - DNA, 601 bp, Human; identical to SEQ ID NO: 102827

SEQ ID NO: 102847 - DNA, 601 bp, Human; identical to SEQ ID NO: 102828

SEQ ID NO: 102848 - DNA, 601 bp, Human; identical to SEQ ID NO: 102829

SEQ ID NO: 102849 - DNA, 601 bp, Human; identical to SEQ ID NO: 102830

SEQ ID NO: 102850 - DNA, 601 bp, Human; identical to SEQ ID NO: 102831

SEQ ID NO: 102851 - DNA, 601 bp, Human
ctactatgtgccaaggcagtatggtgggtgctgccacaaacagcagctcatgtgacctttccacacagccctgtggggcaagaatcatcacatccgtttcacatatttgaaaattgaggctcacagaggttgggacctggaggaaggttctcagctagcaggtgttggaggtgggacagcctggctttgcactggcatctcagcgctaaacccgagtctaacacacactagaatgctgggaatgtctgaggaagaagcagcatgagaagattaagtggagacgttttggcatcatttgtcmggaggaccctctgagcacctagctggccaccaggaaatttctacaccagctgagagtggataggttggcatactggggccaaaaattcataggtgcaatagactagcccctaagggtctggcctaggttctcatccaagcttccttcacttattagttgtgcgatcttaggcaagtttccttccctctgcacttcagtttctccatggctaaattagggtattgataactagtccccacctcattggctgctgtgaaaatcaaatgtgctagaacatggaaagtgcttagaaggtgccag

SEQ ID NO: 102852 - DNA, 601 bp, Human
atattgctagggaatcatctctttggtaaaattgtaaaggcaagcaaggaaatgatgacttcaaagtttcatgcagcaggtgcctttgaaggagtgatgggtgcacagatgttcattaaaaaaatctgttttttaatgtatatgtaacatatactctcatgtatgtatatgttttattgttggaaaaaaaacttaaaaagtaattgtaagtagaagtcctggcattttcttcctgctgtcaatggagtacatgtatcccactccgggcatgactggcctagaggatgtgtgcgactattaygaggagaattcctatcttcctcaactattcactgatatatatcggatacccatcatgtgccacgtaccatgctaggagacagctgtgcacctgacaggcaatgccctgccctcaaggaactagggagggtgacaacacagatgtcacaaatgaataaaacaggccatctcgacagtgatatgtactatgaagaaagtaaaggaagatgctgggatggcaactggggtgtgggggtggtgaggaaagtgagggccactttagctgaggtgatcaagaggacttccttgaggagttgacatt

SEQ ID NO: 102853 - DNA, 601 bp, Human
ctctctctgacccttttccaccagacttttgttatagttgcttcagaagtcaaatgtgtggctcaaaactctgtgtgtatgtatgtgtctgcacacgccattcccataaaacagttgcaaagtcaaaagcccacaggagtcaagcggatcatgtcacaggaatgcacaggacgggcagcagtagggagtggtggggactgcggcagtgaatgggttgcccattcactgctgcaactaaagggagttgtgttctcagtttaaggtctttgcaaccacatgggcacacatgtaaattaagagwagatctgccaacttttcaaaagaaaccagaaattcctatattttaggtgaaacaacaaattttaaaatttgggcttcaattcaaaacacaacaccagcactgtatcagaggttaacatttgggtcactggttgctggtttgcacctctgtcaataaacgattgagggggtatggattcaaccagagacctgaccctcactgagagtcctgaatgcaagtcaatgcacctgcaggaccccatactgagggatattctagcaggggcaggtgagggagttccagagggcacctgagggtatt

SEQ ID NO: 102854 - DNA, 601 bp, Human
gcccagatgtgacagcagtgtgacctgaggaggaggcggcaggatacccaaagatatccaaggctgacctggctttcagggaagttcacagtgcagaagccagcctgtggcagtttctggtcccctaatgcacacgcacacaagccagaagacacacagcacggcctcctgccactgaccagggcctcctggagaccagcattgctctctctgacccttttccaccagacttttgttatagttgcttcagaagtcaaatgtgtggctcaaaactctgtgtgtatgtatgtgtctgcacacrccattcccataaaacagttgcaaagtcaaaagcccacaggagtcaagcggatcatgtcacaggaatgcacaggacgggcagcagtagggagtggtggggactgcggcagtgaatgggttgcccattcactgctgcaactaaagggagttgtgttctcagtttaaggtctttgcaaccacatgggcacacatgtaaattaagagtagatctgccaacttttcaaaagaaaccagaaattcctatattttaggtgaaacaacaaattttaaaatttgggcttcaattcaaaacacaacacca

SEQ ID NO: 102855 - DNA, 601 bp, Human
agcccagatgtgacagcagtgtgacctgaggaggaggcggcaggatacccaaagatatccaaggctgacctggctttcagggaagttcacagtgcagaagccagcctgtggcagtttctggtcccctaatgcacacgcacacaagccagaagacacacagcacggcctcctgccactgaccagggcctcctggagaccagcattgctctctctgacccttttccaccagacttttgttatagttgcttcagaagtcaaatgtgtggctcaaaactctgtgtgtatgtatgtgtctgcacaygccattcccataaaacagttgcaaagtcaaaagcccacaggagtcaagcggatcatgtcacaggaatgcacaggacgggcagcagtagggagtggtggggactgcggcagtgaatgggttgcccattcactgctgcaactaaagggagttgtgttctcagtttaaggtctttgcaaccacatgggcacacatgtaaattaagagtagatctgccaacttttcaaaagaaaccagaaattcctatattttaggtgaaacaacaaattttaaaatttgggcttcaattcaaaacacaacacc

SEQ ID NO: 102856 - DNA, 601 bp, Human
atgtaaaaggatgatcctgcctgctgggtgcagaagggactgcaggatggccaggagcaacagggcaatgagatgggggagcgtgggacagcctgggagcccagatgtgacagcagtgtgacctgaggaggaggcggcaggatacccaaagatatccaaggctgacctggctttcagggaagttcacagtgcagaagccagcctgtggcagtttctggtcccctaatgcacacgcacacaagccagaagacacacagcacggcctcctgccactgaccagggcctcctggagaccagcatygctctctctgacccttttccaccagacttttgttatagttgcttcagaagtcaaatgtgtggctcaaaactctgtgtgtatgtatgtgtctgcacacgccattcccataaaacagttgcaaagtcaaaagcccacaggagtcaagcggatcatgtcacaggaatgcacaggacgggcagcagtagggagtggtggggactgcggcagtgaatgggttgcccattcactgctgcaactaaagggagttgtgttctcagtttaaggtctttgcaaccacatgggcacacatgtaaattaaga

SEQ ID NO: 102857 - DNA, 601 bp, Human
ccatgtaaaaggatgatcctgcctgctgggtgcagaagggactgcaggatggccaggagcaacagggcaatgagatgggggagcgtgggacagcctgggagcccagatgtgacagcagtgtgacctgaggaggaggcggcaggatacccaaagatatccaaggctgacctggctttcagggaagttcacagtgcagaagccagcctgtggcagtttctggtcccctaatgcacacgcacacaagccagaagacacacagcacggcctcctgccactgaccagggcctcctggagaccagcwttgctctctctgacccttttccaccagacttttgttatagttgcttcagaagtcaaatgtgtggctcaaaactctgtgtgtatgtatgtgtctgcacacgccattcccataaaacagttgcaaagtcaaaagcccacaggagtcaagcggatcatgtcacaggaatgcacaggacgggcagcagtagggagtggtggggactgcggcagtgaatgggttgcccattcactgctgcaactaaagggagttgtgttctcagtttaaggtctttgcaaccacatgggcacacatgtaaattaa

SEQ ID NO: 102858 - DNA, 601 bp, Human
ggtcaggggcatggggctgaggaaaggagctaaggcagaagaaatagctggtgtccagtgtggtgtgtttgggaaaaaggacaaggctgagtgagcaaggtgaagggggaagatggcagcagaggtcagcagcagctagatgagcagtggggatttcattctgatgcaagaaagcctccagaggggtttaagcagcgcagtgacatgatctgatttccatgtaaaaggatgatcctgcctgctgggtgcagaagggactgcaggatggccaggagcaacagggcaatgagatgggggagcrtgggacagcctgggagcccagatgtgacagcagtgtgacctgaggaggaggcggcaggatacccaaagatatccaaggctgacctggctttcagggaagttcacagtgcagaagccagcctgtggcagtttctggtcccctaatgcacacgcacacaagccagaagacacacagcacggcctcctgccactgaccagggcctcctggagaccagcattgctctctctgacccttttccaccagacttttgttatagttgcttcagaagtcaaatgtgtggctcaaaactctgtgtgtatg

SEQ ID NO: 102859 - DNA, 601 bp, Human
tcggaatggattgagacagtgtgaagtgcttggctgatgggatggagctttgaggtgagaggggactttcgacaaggtcgaaaaggtctagaagacctggacagggtcaggggcatggggctgaggaaaggagctaaggcagaagaaatagctggtgtccagtgtggtgtgtttgggaaaaaggacaaggctgagtgagcaaggtgaagggggaagatggcagcagaggtcagcagcagctagatgagcagtggggatttcattctgatgcaagaaagcctccagaggggtttaagcagcrcagtgacatgatctgatttccatgtaaaaggatgatcctgcctgctgggtgcagaagggactgcaggatggccaggagcaacagggcaatgagatgggggagcgtgggacagcctgggagcccagatgtgacagcagtgtgacctgaggaggaggcggcaggatacccaaagatatccaaggctgacctggctttcagggaagttcacagtgcagaagccagcctgtggcagtttctggtcccctaatgcacacgcacacaagccagaagacacacagcacggcctcctgccactgacca

SEQ ID NO: 102860 - DNA, 601 bp, Human
aagtcaatgcacctgcaggaccccatactgagatcctgtctacagttctgtaaggtgcaaataagaaggcactcacagaatatggtgacaaaaccaggcctgctgcagggatgggtaaggctgtgcttccttccaaaaggcaaggggaagaaagcgttcagtggtaagcatgggagtagagcccctgccctcatgaagctgacattgcaaaccagttcggaatggattgagacagtgtgaagtgcttggctgatgggatggagctttgaggtgagaggggactttcgacaaggtcgaaaasgtctagaagacctggacagggtcaggggcatggggctgaggaaaggagctaaggcagaagaaatagctggtgtccagtgtggtgtgtttgggaaaaaggacaaggctgagtgagcaaggtgaagggggaagatggcagcagaggtcagcagcagctagatgagcagtggggatttcattctgatgcaagaaagcctccagaggggtttaagcagcgcagtgacatgatctgatttccatgtaaaaggatgatcctgcctgctgggtgcagaagggactgcaggatggccaggagcaacag

SEQ ID NO: 102861 - DNA, 601 bp, Human
cctctgtcgataaactattgggatggtatggattcaactagagacctggccctcactgggattcctgaatgcaagtcaatgcacctgcaggaccccatactgagatcctgtctacagttctgtaaggtgcaaataagaaggcactcacagaatatggtgacaaaaccaggcctgctgcagggatgggtaaggctgtgcttccttccaaaaggcaaggggaagaaagcgttcagtggtaagcatgggagtagagcccctgccctcatgaagctgacattgcaaaccagttcggaatggattsagacagtgtgaagtgcttggctgatgggatggagctttgaggtgagaggggactttcgacaaggtcgaaaaggtctagaagacctggacagggtcaggggcatggggctgaggaaaggagctaaggcagaagaaatagctggtgtccagtgtggtgtgtttgggaaaaaggacaaggctgagtgagcaaggtgaagggggaagatggcagcagaggtcagcagcagctagatgagcagtggggatttcattctgatgcaagaaagcctccagaggggtttaagcagcgcagtgacatgat

SEQ ID NO: 102862 - DNA, 601 bp, Human
tgtttccaactaaaaagtgagccctgggcttgggaagagggaaaagcagggcagacggtgcaaggcaaaagtctacacaacaaagaccctggaaaaggtttgcctctggaaagatcctctgccaacttcaccagtggcccaaatgtcacctggtgacatttgtcaccaggtgtcatttgggtcactggttgctggtttgcacctctgtcgataaactattgggatggtatggattcaactagagacctggccctcactgggattcctgaatgcaagtcaatgcacctgcaggaccccatastgagatcctgtctacagttctgtaaggtgcaaataagaaggcactcacagaatatggtgacaaaaccaggcctgctgcagggatgggtaaggctgtgcttccttccaaaaggcaaggggaagaaagcgttcagtggtaagcatgggagtagagcccctgccctcatgaagctgacattgcaaaccagttcggaatggattgagacagtgtgaagtgcttggctgatgggatggagctttgaggtgagaggggactttcgacaaggtcgaaaaggtctagaagacctggacagggtcaggg

SEQ ID NO: 102863 - DNA, 601 bp, Human
atgtgacccgggacagtcccattctctctctgggcctctgtttccaactaaaaagtgagccctgggcttgggaagagggaaaagcagggcagacggtgcaaggcaaaagtctacacaacaaagaccctggaaaaggtttgcctctggaaagatcctctgccaacttcaccagtggcccaaatgtcacctggtgacatttgtcaccaggtgtcatttgggtcactggttgctggtttgcacctctgtcgataaactattgggatggtatggattcaactagagacctggccctcactgggaktcctgaatgcaagtcaatgcacctgcaggaccccatactgagatcctgtctacagttctgtaaggtgcaaataagaaggcactcacagaatatggtgacaaaaccaggcctgctgcagggatgggtaaggctgtgcttccttccaaaaggcaaggggaagaaagcgttcagtggtaagcatgggagtagagcccctgccctcatgaagctgacattgcaaaccagttcggaatggattgagacagtgtgaagtgcttggctgatgggatggagctttgaggtgagaggggactttcgaca

SEQ ID NO: 102864 - DNA, 601 bp, Human
gtgtgttatctgagtagaagaaagcacaaaaaccacaagcgacaagcaaggggaggctcacaagacagattaagcaacctaaactggagtctcagtgttgatgccactcactatgtgacccgggacagtcccattctctctctgggcctctgtttccaactaaaaagtgagccctgggcttgggaagagggaaaagcagggcagacggtgcaaggcaaaagtctacacaacaaagaccctggaaaaggtttgcctctggaaagatcctctgccaacttcaccagtggcccaaatgtcacckggtgacatttgtcaccaggtgtcatttgggtcactggttgctggtttgcacctctgtcgataaactattgggatggtatggattcaactagagacctggccctcactgggattcctgaatgcaagtcaatgcacctgcaggaccccatactgagatcctgtctacagttctgtaaggtgcaaataagaaggcactcacagaatatggtgacaaaaccaggcctgctgcagggatgggtaaggctgtgcttccttccaaaaggcaaggggaagaaagcgttcagtggtaagcatgggagta

SEQ ID NO: 102865 - DNA, 601 bp, Human
tcatttgacttgacttcgagcaagtcccttatgagcctcagtttcctcatctataacatcttatatatcagaagccacaaatttaaaacaatgctggagcccatgcctgggtcccaggaattttgtgtgtgtgtgtgtctgtgtgtgttatctgagtagaagaaagcacaaaaaccacaagcgacaagcaaggggaggctcacaagacagattaagcaacctaaactggagtctcagtgttgatgccactcactatgtgacccgggacagtcccattctctctctgggcctctgtttccamctaaaaagtgagccctgggcttgggaagagggaaaagcagggcagacggtgcaaggcaaaagtctacacaacaaagaccctggaaaaggtttgcctctggaaagatcctctgccaacttcaccagtggcccaaatgtcacctggtgacatttgtcaccaggtgtcatttgggtcactggttgctggtttgcacctctgtcgataaactattgggatggtatggattcaactagagacctggccctcactgggattcctgaatgcaagtcaatgcacctgcaggaccccatactgagatcc

SEQ ID NO: 102866 - DNA, 601 bp, Human
cactggcctctgctcctccctggtgtgcgctggcagtattcctcctcagcctctcttctacaaccatggccagctgggggctgctcaacaggagaggatccttgtccaggcactgccctgcactgcagccctcctgctccaccccagacctctgtggggactattccaatgccagttgatatactgactgttctgagactgaaaattatacgggaatgaacccagtcctgagaggccctgccactcatttgacttgacttcgagcaagtcccttatgagcctcagtttcctcatctataayatcttatatatcagaagccacaaatttaaaacaatgctggagcccatgcctgggtcccaggaattttgtgtgtgtgtgtgtctgtgtgtgttatctgagtagaagaaagcacaaaaaccacaagcgacaagcaaggggaggctcacaagacagattaagcaacctaaactggagtctcagtgttgatgccactcactatgtgacccgggacagtcccattctctctctgggcctctgtttccaactaaaaagtgagccctgggcttgggaagagggaaaagcagggcagacggtgcaagg

SEQ ID NO: 102867 - DNA, 601 bp, Human
tagaagtctagaccagagtgactccctccttcctagcaggcctttaggttgtcaccctccctccctcctggctggcctttaggttgtcaccatccctccttcctagctggcccttagtttgtcaccctcccttcttcctagctggcccttagtttgtcactctccctccttcctggctggtggatttcaaagcaggtctccatggctatcactgaggctgagccaccatcacctccttcctggaagactcgaccagactccagacccccactgccaccctaccctgcagttcatgcttttsccagcagccagagtgatgctgctaaacccaaagtcggatactgtccctcccttattgtctcccctccagaaggtctccattcccatgaagggaaatccagaccccctgccctggcctgagggatgctgcaccacccagctcctggcacttccccttcagccttcctcactctactccagccaccccagcccctcgctgttccttaagccacccccaagcacgttccacctcagggcctttgcatctactgttccctttgcccgacatgctctttccccagacatgcccatagctcacctc

SEQ ID NO: 102868 - DNA, 601 bp, Human
ggtctcatgtccactctgaatacaagattacgcttcccagcttcccttgcagctagatgtggccatgtgactaagttctggccaatgatatgtaagcagaagtatggggtggagctttggaaagtttctctttaaaggcagacaatgggtcctggtgctcaaagtcaggacttaatggccacagctccaaaggccagatttttacccctgcaagacagcccttgttagctggtcattcccagaaagtggcaaccccatgggggtgagagcactgaggaggagcgcagtgaccctaaatgtsatgcttgcttcttgatgtcctggagcaggacacctgtctatatatgaggaaacctaagctcaggggcatttcagactctcagggctctcatcttgactcatcttcctcttcccactgccactaccctagaagtctagaccagagtgactccctccttcctagcaggcctttaggttgtcaccctccctccctcctggctggcctttaggttgtcaccatccctccttcctagctggcccttagtttgtcaccctcccttcttcctagctggcccttagtttgtcactctccctccttcct

SEQ ID NO: 102869 - DNA, 601 bp, Human
tggggttcaatttctagcatgcaaggggaccttgcctggtacctgcccattgctgcctctcagctctatgcaggaaaactgaatactcagaagggagccaggcatgcgatgaagaactcttcctcttcagtcacagagtccagctggtctcatgtccactctgaatacaagattacgcttcccagcttcccttgcagctagatgtggccatgtgactaagttctggccaatgatatgtaagcagaagtatggggtggagctttggaaagtttctctttaaaggcagacaatgggtcctggkgctcaaagtcaggacttaatggccacagctccaaaggccagatttttacccctgcaagacagcccttgttagctggtcattcccagaaagtggcaaccccatgggggtgagagcactgaggaggagcgcagtgaccctaaatgtgatgcttgcttcttgatgtcctggagcaggacacctgtctatatatgaggaaacctaagctcaggggcatttcagactctcagggctctcatcttgactcatcttcctcttcccactgccactaccctagaagtctagaccagagtgactccctcc

SEQ ID NO: 102870 - DNA, 601 bp, Human
ctagagaaaggccaatgctctttctgggggtacttgaatctggaaggtgtggcactgcaggtgcaaaggccgtcccgctgccccaagaggtggccctggggttgccggatgccaacgctacctctggtccagtccatttcgaaagtcagcaccatgccctggctctccagttccttaggcatacataagtccccctttcaccagaggtggcttgaattggggttcaatttctagcatgcaaggggaccttgcctggtacctgcccattgctgcctctcagctctatgcaggaaaactgaayactcagaagggagccaggcatgcgatgaagaactcttcctcttcagtcacagagtccagctggtctcatgtccactctgaatacaagattacgcttcccagcttcccttgcagctagatgtggccatgtgactaagttctggccaatgatatgtaagcagaagtatggggtggagctttggaaagtttctctttaaaggcagacaatgggtcctggtgctcaaagtcaggacttaatggccacagctccaaaggccagatttttacccctgcaagacagcccttgttagctggtcattcc

SEQ ID NO: 102871 - DNA, 601 bp, Human
cgtccagcttctgaaactggacaattcatttctgctgtttaagctacctggtctgcagggctttcttctgacagccctagcagactagtacactcgtgagcagttcctctcccctgagagatggtctgggtggggctaccaggctgggccagaaaaagcactgttgcccttggccactgtgattagtttgggatgggcacacaaccaaaagtaaagccccattagctggtccaatccgagtgaatcttagaacttctccaagtgctgctagagaaaggccaatgctctttctgggggtacytgaatctggaaggtgtggcactgcaggtgcaaaggccgtcccgctgccccaagaggtggccctggggttgccggatgccaacgctacctctggtccagtccatttcgaaagtcagcaccatgccctggctctccagttccttaggcatacataagtccccctttcaccagaggtggcttgaattggggttcaatttctagcatgcaaggggaccttgcctggtacctgcccattgctgcctctcagctctatgcaggaaaactgaatactcagaagggagccaggcatgcgatgaagaac

SEQ ID NO: 102872 - DNA, 601 bp, Human
ccctgctgacacctggatggcagacgtccagcttctgaaactggacaattcatttctgctgtttaagctacctggtctgcagggctttcttctgacagccctagcagactagtacactcgtgagcagttcctctcccctgagagatggtctgggtggggctaccaggctgggccagaaaaagcactgttgcccttggccactgtgattagtttgggatgggcacacaaccaaaagtaaagccccattagctggtccaatccgagtgaatcttagaacttctccaagtgctgctagagaaargccaatgctctttctgggggtacttgaatctggaaggtgtggcactgcaggtgcaaaggccgtcccgctgccccaagaggtggccctggggttgccggatgccaacgctacctctggtccagtccatttcgaaagtcagcaccatgccctggctctccagttccttaggcatacataagtccccctttcaccagaggtggcttgaattggggttcaatttctagcatgcaaggggaccttgcctggtacctgcccattgctgcctctcagctctatgcaggaaaactgaatactcagaag

SEQ ID NO: 102873 - DNA, 601 bp, Human
gcacagctcctcttgaatcatgccacaggggtctttcctaggcactagacctagtcaacattttttatcccattttgagccaatgcagagatggacaggatagctaacaggatggttgatcaaattgacattaaaaagatcttgatgagtgaggctgcccagctagaatggagctcaatgaaaatgtgcagacatgaacgtgcagttttttatttggggtgagaagtaaacagccgtcactcacgcaacagagaaaacggagcacctgctgtgcatgaggtgctccccagacccgtcattyggaagataaacaaggccaggcctgtcctcaagggctcggagcaactggggccacacaaggtagaaaggagctggcctgcctgggggccatacacttcttcacgtgttccatgaggacctactgtgtgccaggccccaggacacatgctggcggtctggggagaagaggatcagcagatctgggccccatggagcctcatgatggcagagaagactaatgtcagatgggttcttgcaaaagtaaacaaagtcacttccaaaagtggtaagtgctgcaaagacaacagtgcagggtgccctg

SEQ ID NO: 102874 - DNA, 601 bp, Human
atgtccttttctccccggggcagctggcagtaggcggcaggtggagcctgggaacgggcacagctcctcttgaatcatgccacaggggtctttcctaggcactagacctagtcaacattttttatcccattttgagccaatgcagagatggacaggatagctaacaggatggttgatcaaattgacattaaaaagatcttgatgagtgaggctgcccagctagaatggagctcaatgaaaatgtgcagacatgaacgtgcagttttttatttggggtgagaagtaaacagccgtcactcaygcaacagagaaaacggagcacctgctgtgcatgaggtgctccccagacccgtcatttggaagataaacaaggccaggcctgtcctcaagggctcggagcaactggggccacacaaggtagaaaggagctggcctgcctgggggccatacacttcttcacgtgttccatgaggacctactgtgtgccaggccccaggacacatgctggcggtctggggagaagaggatcagcagatctgggccccatggagcctcatgatggcagagaagactaatgtcagatgggttcttgcaaaagtaa

SEQ ID NO: 102875 - DNA, 601 bp, Human
catgctgagttcccccattttattgtccaagggaatgtccttttctccccggggcagctggcagtaggcggcaggtggagcctgggaacgggcacagctcctcttgaatcatgccacaggggtctttcctaggcactagacctagtcaacattttttatcccattttgagccaatgcagagatggacaggatagctaacaggatggttgatcaaattgacattaaaaagatcttgatgagtgaggctgcccagctagaatggagctcaatgaaaatgtgcagacatgaacgtgcagttttktatttggggtgagaagtaaacagccgtcactcacgcaacagagaaaacggagcacctgctgtgcatgaggtgctccccagacccgtcatttggaagataaacaaggccaggcctgtcctcaagggctcggagcaactggggccacacaaggtagaaaggagctggcctgcctgggggccatacacttcttcacgtgttccatgaggacctactgtgtgccaggccccaggacacatgctggcggtctggggagaagaggatcagcagatctgggccccatggagcctcatgatggcagag

SEQ ID NO: 102876 - DNA, 601 bp, Human
cactgggcagtcagtgagtccaaggatggaaatgagtggaccctctagattgagtcagctcaagctgctgtcttatctacaggacatttcagcacctttaatatgccggcaggcaccctgactctccaggagcagggagtataacatgctgagttcccccattttattgtccaagggaatgtccttttctccccggggcagctggcagtaggcggcaggtggagcctgggaacgggcacagctcctcttgaatcatgccacaggggtctttcctaggcactagacctagtcaacattttttatcccattttgagccaatgcagagatggacaggatagctaacaggatggttgatcaaattgacattaaaaagatcttgatgagtgaggctgcccagctagaatggagctcaatgaaaatgtgcagacatgaacgtgcagttttttatttggggtgagaagtaaacagccgtcactcacgcaacagagaaaacggagcacctgctgtgcatgaggtgctccccagacccgtcatttggaagataaacaaggccaggcctgtcctcaagggctcggagcaactggggccacacaaggtagaa

SEQ ID NO: 102877 - DNA, 601 bp, Human
ctataaaccacattctgagtatggtcaagctgtgagggtctccagggtgatattccccagtgtgtgtgcccctaagagcagctccactgggcagtcagtgagtccaaggatggaaatgagtggaccctctagattgagtcagctcaagctgctgtcttatctacaggacatttcagcacctttaatatgccggcaggcaccctgactctccaggagcagggagtataacatgctgagttcccccattttattgtccaagggaatgtccttttctccccggggcagctggcagtaggcggcrggtggagcctgggaacgggcacagctcctcttgaatcatgccacaggggtctttcctaggcactagacctagtcaacattttttatcccattttgagccaatgcagagatggacaggatagctaacaggatggttgatcaaattgacattaaaaagatcttgatgagtgaggctgcccagctagaatggagctcaatgaaaatgtgcagacatgaacgtgcagttttttatttggggtgagaagtaaacagccgtcactcacgcaacagagaaaacggagcacctgctgtgcatgaggtg

SEQ ID NO: 102878 - DNA, 601 bp, Human
gataaatctgggttcacatcctgaccccctcttcctgacagcgggaccttgaatgagctaactcacctctcaaggcctcagtttcctcatttgtaaagtgggaatacaaaatgtctacctcccagggttgttgggaggattaaataagccaatgcacatgacaagctcagcccgcacttggtaagggatcgataaacagtagctcttactagatgcgttattggttagcaccttatccatcaagccatggctcccaagttccctactctgaggggcctcccagatgtcccctccctccacytgtggcccagcaccctgtccatccttactttgtattgaattgaatgatcagtctctcgccactaggttgtggggacctggattatttatctgtgaagcctcaacagttgaatgaatgaatgaatgtgcatgtgaaagcaagtgtgtgtgtgtgtatgtgtatgtgtgtgtgtgtatgtgtatatgtgtgtgtgtgtctgcatgttgcatgcgcacgcacgcctgcctgcctgcctgtctaccacatgaaagctgggaagagaacattataacaaaagagtcatctcagagaatagtgtca

SEQ ID NO: 102879 - DNA, 601 bp, Human
aggtgagccagggcggcaccggaggaggtgaggctgtgggcgggtgtggattctgccagcccttcctctccccagaatcagagaagagattcctagagccacagaaacaaagccagggggctcctactggaatgatagcttcaaggagaatgggagacttgctcaaggtcaccagtgactcagcaagaccagaagatcccctggctccctcacctcccccatgccctccttacctctcaatccatccacatctccaggtaaacttttcatccagaagccaagagaccttccctcctgtgayatcccaggtgacttcagctcagaactcagataagacaaaacccgtcagtccctcctgtctacttctcattcactgggggagccccaagcaaggactctgcctctctgagtctcagcttccccatctgtgaagtgggaacccttaggaggacattgccaagttgtgaaaattaaatgagaccactgtggaatgaagcctctatggagctcccagaaggtgctggataaagaacgatacatattatcactgagacgaaaatggggagcccagctgacgccctctgtggttccagctccataa

SEQ ID NO: 102880 - DNA, 601 bp, Human
cagctgaggactttgaagaaggtgacacagggcagtgatgggagtggggatatctggggtggtgccttgagtggggaggtcatgaggctctctaggggcaaagaaggcatcaggccaaggggtagcctgagtgatggccctggtgtggtgtggtcagctagtggcgggagcaggtgagccagggcggcaccggaggaggtgaggctgtgggcgggtgtggattctgccagcccttcctctccccagaatcagagaagagattcctagagccacagaaacaaagccagggggctcctactgraatgatagcttcaaggagaatgggagacttgctcaaggtcaccagtgactcagcaagaccagaagatcccctggctccctcacctcccccatgccctccttacctctcaatccatccacatctccaggtaaacttttcatccagaagccaagagaccttccctcctgtgatatcccaggtgacttcagctcagaactcagataagacaaaacccgtcagtccctcctgtctacttctcattcactgggggagccccaagcaaggactctgcctctctgagtctcagcttccccatctgtg

SEQ ID NO: 102881 - DNA, 601 bp, Human
ttgaggaaatggaggctctgagttagagtgatttgctgaggtcacccagctagaaactggccagaactggaattcaaggcccaagttggtcagtgtccttcctcagccccaccccagctcccttcctggcccaccagtgcatggaaaccccatggttagagattcttctggcttaagacatcaactcttgtcagaatgcacttacttctaaaacgagatggcattcagttgttatcaattaaaacttatcaataaataatttatcaaaaccattcaaatcggatggcttgctgagctgagracagggtttgatggtagaaagcagaaaagcctcctggaatcttaaaataaatctcagactccatccatgtctgcttcctttactcatcctaggtaagatagggaaactgaggcttggggagatgaggtgacttgcccaggaagagttaggatgcaaatctggaggtcacctgctgtgcctaaccactccagagaactcccttggaccctggtcatgctcactgctccgagaacagcccttctctcagctgtacggggaagccccttcattcaggtgggtaatttcccgaatgcctaagat

SEQ ID NO: 102882 - DNA, 601 bp, Human
ctagcccattcatcaaatcaagactgccccaaggcatgagcacagagttagccagacacttgggtttttttttttaaggaagatgggaaagagtagagagaaggtaacatttgttgggcacctcctaggttccggacccatgcttggtcctctgtgaaggtgtttcacaacattccccagtgtagatgtcattccccatggttttacagttgaggaaatggaggctctgagttagagtgatttgctgaggtcacccagctagaaactggccagaactggaattcaaggcccaagttggtcwgtgtccttcctcagccccaccccagctcccttcctggcccaccagtgcatggaaaccccatggttagagattcttctggcttaagacatcaactcttgtcagaatgcacttacttctaaaacgagatggcattcagttgttatcaattaaaacttatcaataaataatttatcaaaaccattcaaatcggatggcttgctgagctgagaacagggtttgatggtagaaagcagaaaagcctcctggaatcttaaaataaatctcagactccatccatgtctgcttcctttactcatccta

SEQ ID NO: 102883 - DNA, 601 bp, Human
ggaatgaataaatgaatgaaagaaagctctgacttggtctccacagactgtgtgccttcaaccacatggtctttcttgggtgctttttgtttgccagactccatgctcagcatgttagaagagaatgcccatctattccctaggaaagcaaccctcaagggaggtaataacagcctctctgctttacagatgggggaactgaggctccaagaggatctaaccaggcaggtgtggaacctgtgataaactccagccccttatagcccatctcctagcccattcatcaaatcaagactgccccaaggcatgagcacagagttagccagacacttgggtttttttttttaaggaagatgggaaagagtagagagaaggtaacatttgttgggcacctcctaggttccggacccatgcttggtcctctgtgaaggtgtttcacaacattccccagtgtagatgtcattccccatggttttacagttgaggaaatggaggctctgagttagagtgatttgctgaggtcacccagctagaaactggccagaactggaattcaaggcccaagttggtcagtgtccttcctcagccccaccccagctcc

SEQ ID NO: 102884 - DNA, 601 bp, Human
ccatttccatcccacccctgaggtggggaagggcagctgcaccttggggcacatttcacccccccgagctccagatggagagctttcttccccacagcccagagtgaggtctcatcaagtgccatggccttcccctccccaccaagctgggcttcctcagcacccactgcccctgacaagcgaaggctgtagtcaagacaccgatgagggccagtcattcttggcttcagagctctcagggacccaggtactggctggtaaagtccagtccttctggatgtggaagagtcacttttgactmttgccattaactttgacgttggccttacctgcccacattagactgggatgatccaatcccactccacccccacactaccatggaggaaactaccctgggcatccagctggctgtgtgactaacgtcagggctgttaacctctttgacccttcgttgcttcctctgtgaaatgggtacaattacacagcacctatgtgtctaagtgaactgaattacaaaacaaggggtgttgagcggtgctgagcacagtgcctggcatgccgtgagtgctcagtaaacatcagccgttgcgttgtagtt

SEQ ID NO: 102885 - DNA, 601 bp, Human
ccttggtaaagagatagagcctcatggatagatcctcgggcaaagaaacggcagacagacaggaaaagtctgcacctgtccccaccctccagcaaagctagacaggcacacaggtccacaccagccagcgcaggaggtgggcaggtggggttggaggaagccagaatctcctggaaattgatcgccacttcctgcatttgcatagatttgaggctcaaatatatccccctgcatgctccaagggctccaaggcaagtgggaagactcacccccggtccagtgattccccgagagcctagargagcaaagagaaagctctccaaccccaggcaccagctcacactcgagagtatcaaactcacaagaaaaccaaaccctcagggagacagtcaatatccagaatagaccctcaaggacgtgagagaaaaggacaatcagatggagggcagggaagaaatctgttccactgctttccagctgtgtgaccttgggtgagtcacctaacctctctgtgctccagttcccccattgtaaaatgtgatgataaaaattaacaatggtagagcacttagcacagaggttggcatgaggaagtggcccc

SEQ ID NO: 102886 - DNA, 601 bp, Human
gcacagggcagcaaggacaggggagccatggggcacaggaacaggctcgatttctggtccagcaataaaacccaacaatgcctttgctgcatgaaatcaagaaatgctgtgtaagatctgcatgctggaccaggccataggaggacaagggaagctgtctcagccacaggttgaagacagaactgccagcaagataggtgggaatagacgcatgttgctgagctctgccaaggagggagctttggaattaagcccatgaggtgtcaggagaccaggctttgagtgctgctgaggcagggcsttggtaaagagatagagcctcatggatagatcctcgggcaaagaaacggcagacagacaggaaaagtctgcacctgtccccaccctccagcaaagctagacaggcacacaggtccacaccagccagcgcaggaggtgggcaggtggggttggaggaagccagaatctcctggaaattgatcgccacttcctgcatttgcatagatttgaggctcaaatatatccccctgcatgctccaagggctccaaggcaagtgggaagactcacccccggtccagtgattccccgagagcctagagg

SEQ ID NO: 102887 - DNA, 601 bp, Human
acagggtgaagactgaccaaagcaacctatgggaagccctgtgtgtggtataagccctgaggagcactgggcaagttcactctcatgtagcctgggtgggtttcagggaaggcacctggaagaagaggccctggaacccagagcaggcaaaggggggccagagaaggtgtttcagaatgccaggatggagacggcttaagcagcaagtgaggaggcagatgacttgctccaagttgcttccagcctcaggtcactctgtcccatgctcagggaggtccttccccacccaccttctcattcrccttgggacctccctccccaggagggggagacagacacaaacaacttgtccccccaccccatcgctgccctcccaccctgcagaaggtaggcctgtccacctgctggactggacagcttccccatgccagggctgtctttgccgtggcgtgccatgccagcccacccatggtgtccctgctaacacagaggctctggagtcagaatgcttgggctcaagtcccagctccgccactgactgactgggacttgggcgagctccttctcctgtccgcatctcagtctggagagtgccagcgcc

SEQ ID NO: 102888 - DNA, 601 bp, Human
ggcctaaatatggtgctgccacctcgcctcttagcctctttgggcctcagtctcctcacctgcaaaatgggttcaagggctacgtctgctttacagggtgaagactgaccaaagcaacctatgggaagccctgtgtgtggtataagccctgaggagcactgggcaagttcactctcatgtagcctgggtgggtttcagggaaggcacctggaagaagaggccctggaacccagagcaggcaaaggggggccagagaaggtgtttcagaatgccaggatggagacggcttaagcagcaagtraggaggcagatgacttgctccaagttgcttccagcctcaggtcactctgtcccatgctcagggaggtccttccccacccaccttctcattcaccttgggacctccctccccaggagggggagacagacacaaacaacttgtccccccaccccatcgctgccctcccaccctgcagaaggtaggcctgtccacctgctggactggacagcttccccatgccagggctgtctttgccgtggcgtgccatgccagcccacccatggtgtccctgctaacacagaggctctggagtcagaatgc

SEQ ID NO: 102889 - DNA, 601 bp, Human
gtggccactactactctttctgtgtgtcacctgctatttcagatgtccatcccctcccttcttctgtggccccctcactggactgtgagtatctccagtggtagggcagggtcctgagcagctggggtgcaggagacagcgtgggacaggcagtcactcagagttggcctaaatatggtgctgccacctcgcctcttagcctctttgggcctcagtctcctcacctgcaaaatgggttcaagggctacgtctgctttacagggtgaagactgaccaaagcaacctatgggaagccctgtgygtggtataagccctgaggagcactgggcaagttcactctcatgtagcctgggtgggtttcagggaaggcacctggaagaagaggccctggaacccagagcaggcaaaggggggccagagaaggtgtttcagaatgccaggatggagacggcttaagcagcaagtgaggaggcagatgacttgctccaagttgcttccagcctcaggtcactctgtcccatgctcagggaggtccttccccacccaccttctcattcaccttgggacctccctccccaggagggggagacagacacaaaca

SEQ ID NO: 102890 - DNA, 601 bp, Human
gtgggctggttgcccaggatctggaaggccagatgtgggggacccctctagcccatcagtccccactccccactcctgagcacacttgacgtaaccatgtaaactgcacacgtgcataaagctcacagcatcgtaaagcagcgtttccccaacacccacagaggacactggctctggggccagaaggcctgagtttaaatcccaggaacatcaatccctggatctgtgactattggccaaggactactcctccctgcatctcagtctctctggctgtaaaatggggacatatcattggtamctttctcatggcaatgagggagaataagagtttgtccatggaaagctcttggccccatgtttcattcatggaacctgactgcaccctacctcttgttttcgtggccactactactctttctgtgtgtcacctgctatttcagatgtccatcccctcccttcttctgtggccccctcactggactgtgagtatctccagtggtagggcagggtcctgagcagctggggtgcaggagacagcgtgggacaggcagtcactcagagttggcctaaatatggtgctgccacctcgcctcttagc

SEQ ID NO: 102891 - DNA, 601 bp, Human
agcatctccgcgagcgccgcccagctgccctccctggcttcctacctttcggcctgcctcgttgttgtgcaagttcatgagagtccgggcattctgcttgatctcccgggcatccacaaagaccttggcgaagccgatgccgtagcggatgtcggcagagcagccaccccacttccagccctcgtcccggtggtactggccttgcttctctttgtcgcagccacagtcgctcaggttgccctgggtacaggcagctgtgatggcgtgggccacgccggcggcaatgatggcgtaggtgaaygcagcctcccggctccctgcgaggaggagagaagaggagacaagttggggtcaggtcccaagcatctgagaggaggctgggcctgactgaagagtgaggctgagctcaatgcaatggctctccaaagctcgactgagtacccgttcctaacttccaacaaagctcccttttagggtgatgagctgagcacctcccattacacacacatccattcaaccccagaacctggggagtcaactgggcagtaaaggaggaaggtatgtgggctggttgcccaggatctggaaggccagatgtggg

SEQ ID NO: 102892 - DNA, 601 bp, Human
cagtaactgacaagcttcgtgccatacacaaatcctgaccagctacaagctgatgccagcaccaagcagaatgaggctgagggcagagccctgtggctcctcaacagacacccagcaccagatgttacaaacaagccattttgcagcatctccgcgagcgccgcccagctgccctccctggcttcctacctttcggcctgcctcgttgttgtgcaagttcatgagagtccgggcattctgcttgatctcccgggcatccacaaagaccttggcgaagccgatgccgtagcggatgtcggcrgagcagccaccccacttccagccctcgtcccggtggtactggccttgcttctctttgtcgcagccacagtcgctcaggttgccctgggtacaggcagctgtgatggcgtgggccacgccggcggcaatgatggcgtaggtgaacgcagcctcccggctccctgcgaggaggagagaagaggagacaagttggggtcaggtcccaagcatctgagaggaggctgggcctgactgaagagtgaggctgagctcaatgcaatggctctccaaagctcgactgagtacccgttcctaacttcca

SEQ ID NO: 102893 - DNA, 601 bp, Human
ggcagggcctggtaatttcccccaggacaccatcctggggcagaccaggtgagcaattcccctgtgtgactcaccaaggccacctgtgaggctctgacacacaggatgtggccagaagcctgagaagagggaggaagggaaggagggacggagggaaggagggagggagggagagaaaaaaggagggagagaggcaggaagggagcaagggagaaaggctaatttggtccctcccaaggataagagttcacatctgtccctctttccatcttgctgagtaacattcaattcgtcttaaggsagactcaattatccaacctcttcagtaactgacaagcttcgtgccatacacaaatcctgaccagctacaagctgatgccagcaccaagcagaatgaggctgagggcagagccctgtggctcctcaacagacacccagcaccagatgttacaaacaagccattttgcagcatctccgcgagcgccgcccagctgccctccctggcttcctacctttcggcctgcctcgttgttgtgcaagttcatgagagtccgggcattctgcttgatctcccgggcatccacaaagaccttggcgaagc

SEQ ID NO: 102894 - DNA, 601 bp, Human
gagactagacaggcagggcctggtaatttcccccaggacaccatcctggggcagaccaggtgagcaattcccctgtgtgactcaccaaggccacctgtgaggctctgacacacaggatgtggccagaagcctgagaagagggaggaagggaaggagggacggagggaaggagggagggagggagagaaaaaaggagggagagaggcaggaagggagcaagggagaaaggctaatttggtccctcccaaggataagagttcacatctgtccctctttccatcttgctgagtaacattcaatycgtcttaagggagactcaattatccaacctcttcagtaactgacaagcttcgtgccatacacaaatcctgaccagctacaagctgatgccagcaccaagcagaatgaggctgagggcagagccctgtggctcctcaacagacacccagcaccagatgttacaaacaagccattttgcagcatctccgcgagcgccgcccagctgccctccctggcttcctacctttcggcctgcctcgttgttgtgcaagttcatgagagtccgggcattctgcttgatctcccgggcatccacaaagac

SEQ ID NO: 102895 - DNA, 601 bp, Human
agctgtgtggctcacagaacacactcccacgggatccatcctgaccctgacttgctgcgggccacgtgctattctctcctttaattctcaccatggcccagccagggagccgtgggtgaggaaattgaggctgggagagggaagccacgtgtcctcctcctgtctgcctcaaggaagtgagggcttcaaggcaggagggagcctgggacctgggacctgcagggtgattggaccacaaaaacagggaggagggagcagctgggaccactgcagggatgcaccaccctgggcaggagctccyagccatgagactagacaggcagggcctggtaatttcccccaggacaccatcctggggcagaccaggtgagcaattcccctgtgtgactcaccaaggccacctgtgaggctctgacacacaggatgtggccagaagcctgagaagagggaggaagggaaggagggacggagggaaggagggagggagggagagaaaaaaggagggagagaggcaggaagggagcaagggagaaaggctaatttggtccctcccaaggataagagttcacatctgtccctctttccatcttgctgagtaaca

SEQ ID NO: 102896 - DNA, 601 bp, Human
aaggctgcactcttcggccccaacctgcaggggttcccttttcagggcctcacagactagccagtgtggtccctaactggccccctgcccctacctctgggtctgtgtccattcctcccccactcaccagatcttggctgcttccacctcctttccctgcctagccaaacctcgctcatctctcgaggcctgtctcctccaggaagcccactgagattggtcttacagcctctgacagttcccagtgtctgtgttgcccacgggctcatggcagtatgacagagcaacagccacaagcctmatgcccagtggagctgtgtggctcacagaacacactcccacgggatccatcctgaccctgacttgctgcgggccacgtgctattctctcctttaattctcaccatggcccagccagggagccgtgggtgaggaaattgaggctgggagagggaagccacgtgtcctcctcctgtctgcctcaaggaagtgagggcttcaaggcaggagggagcctgggacctgggacctgcagggtgattggaccacaaaaacagggaggagggagcagctgggaccactgcagggatgcaccaccctgg

SEQ ID NO: 102897 - DNA, 601 bp, Human
ttcctgctccaagtcccctgagtcctggctgcaagcctttccattcgcaagggcaagaacccacacctgtgcccaggggcggggcaggaatggagggcacggcagactgaggatgcctccttccagcctggcctggccagtcagcttcgggctgggcggggcctggctcctcaggccctcgacatgccaccactggccactctatctggtcaaatatgcaagtggccctcgggacagcagagaggagcatagctgagcaggccttatctgggctccgccccagctgccaggggctggtccytggtgtcccctgactcacaggcctgcctgcggccagggcaggggtgggaatccagctcccaggagcacccggaccagacggggcagggcaggaagggacaagaccgacacccctccgtgtgcaagaggctgggcagggactgggaggtgacttttcacttcggcggaattccatccccctgagctcacctcccttggagcaagaggcgcattccagcaggggccagccccgtcccagctgggcccccatccccagggctgcctctcctgggctcagtcaccacactctcatgaaggggtt

SEQ ID NO: 102898 - DNA, 601 bp, Human
taggccatcactaccctgtggtgctgaccctgcagtgggaggcaacaagcaataaagacacaaagagctgtgcaaatgagatcattctgtgcggtggtttcacatgcaagtaaagtagggtgatggagagagatgagacagacagcaggggagggaagtcagggaggacttccccattaaggcaacatctgagccaggaattgaaggaatacaaggagctagttctgcaaagattcaaggaaagagctttgcagacagagaaagcggcctgtgcaatggccctgaggtgcgaacaagcttsgttgactgcaggagtgtgtggttggaaggtggtgtgtgtgggagagaagctgcagacagggttggggtacaatggtcccaagaaccccatgtcattccccagcccacatgtcagacctggagaccctcctgggagcaaaggaaagaagcccctgccatggaagaaaccaaggccctgaaaggctgagatgtgtgcaagaccattcctgctccaagtcccctgagtcctggctgcaagcctttccattcgcaagggcaagaacccacacctgtgcccaggggcggggcaggaatggagggc

SEQ ID NO: 102899 - DNA, 601 bp, Human
ttcttataaagctaaacatacagccatcagacatttgtgctcttggacatttattctagggaaatagaaccttacattcacacacacaaaaaaaaaacctgtacacacatggacacagcagctttatttgtaatagtcataacctgcaaacaacccagacatccttcaagaggtgaatggcaaaacaaactgtggagactctgtgccctggaatactactcagcaaggtaaaggaaccggctactgatacacaacacttgaaggaggcttgagggaattgtgctgaatgaaaagaagctcrtctggaaaggttatactgtaagacccacctatgtaacatcgttaaaataatgaaagtatacaagtggagagcaaattagtgcttgctggggattcggaaggggaagggaagtagaagtggctatacaagggcaacctggggaccattgtgtgctctgcatcttgactgtcctagcatcagcatcctagttgtgaccctcgtcctatagttttgcaagctgtcaccattgggggaaactgggcaaagggtacacaagatctcttcatattccacaattccatgtgaatctacaattatctc

SEQ ID NO: 102900 - DNA, 601 bp, Human
atatattcaacatcattagccattcaggaaatgccaatcaataccacaatgaggtataacatacatctatcagaatggcaaaaaaattttaaaaacagtgatgtcaccaaatgctggtgaggatgtggagcaactgtaccactcacacattgctagtgggaatataaaatgacacacccactctcccacaaaatggaaaatggtttggcactttcttataaagctaaacatacagccatcagacatttgtgctcttggacatttattctagggaaatagaaccttacattcacacacacamaaaaaaaacctgtacacacatggacacagcagctttatttgtaatagtcataacctgcaaacaacccagacatccttcaagaggtgaatggcaaaacaaactgtggagactctgtgccctggaatactactcagcaaggtaaaggaaccggctactgatacacaacacttgaaggaggcttgagggaattgtgctgaatgaaaagaagctcgtctggaaaggttatactgtaagacccacctatgtaacatcgttaaaataatgaaagtatacaagtggagagcaaattagtgcttgctg

SEQ ID NO: 102901 - DNA, 601 bp, Human
ggagatggaaagtggggatggcagcacaacagtgagagtgtgcttgatgccactggggtgcacacccaagaatgcctaacatggcaagtttcatgccaagtatattttatcacaattaaaaataaataaaaacgtaacatacaatttaaaaaagaaattttcattgatttttttaaattaatgaattttttaaaaaaaacaggtcacagagttaaatgctaaacataaaacttttaggaaaaaaaatatggcaaaatctttgggatctagggctgagcaaagagtttttagatgataccaraggtacagtccattcaaagaaaaatagatacattggaccttatcagttaaaacttatcaaggttaaacacttttactctgtgagagaccctatgaagatgataaaaaagacaagctacagtctgggaaaacatatttgccaaccgcatgtctgaccaaatactggctgctagagtatataaagaaatatccaaactcaccagttaaaaaagtaaactacctacttagaaaataggcaaaaagacattaacagatgctacactgaaaaggctatccagatggcaaataagcatatgaaaat

SEQ ID NO: 102902 - DNA, 601 bp, Human
caggaggtgccctggtccctgcaccaggtgtgggtctctgtctggccatctccttgtccagtctcatcctgaacccccatgacagcctggggcccctcacctgccaaggtggcacacagaatcccctcttctcactcacaaccgggttcctccctggccctgatgtgtcctctcccaggcagaaggtggtggctcaaggactgccccaaggccacagtgaccagagtaggagaggatgcacgtgtgcgtgcctggataacccacaacccaaatgaccacatagtggggccttctaggggcygaggactgtagtctccaaattcctcaaatcagagcatctgtgaatcttaggttaacatcttggaatcacagggtttcaggatcaggagactgtggggataaaggcatctgagtccaagactcctgagggtggtaggatagtttgaggttaagacctggatctggagctaggctgcttgggtttatatcccagcacagcacctgccagctgtgtggcattaagcaactttcttaacctctctgtgcttccgttttcttatttgtaaaacggagagaacagggaatgttgatctcataagac

SEQ ID NO: 102903 - DNA, 601 bp, Human
tcccagacaggagctccctgagacatgaggagcagctctggcctctcccgacctgtgttggcgtccagcgtgcaggagctggtgtccaagaggctggactggcctgaaccaaggttccacgctgccccgcaacagcccccggatgtgtgtgcaaagacacctctgagatattctgttcctgcctttggtggtgtagaggttttccagtcgggcaaatggaaatacaccccggttatctctatgcgtctgcagttcccagctgagggtgcggtggggcctcttcccctgggcagagcaggtggggggcatggttgagaaataaccaatttctcagtgctctgagctacaaggagctgctgcaggagtggagacccagggcccagagggacgtgggtttctctctcagctgtgcggcttcgggtcctcaccctcctgctgtctctgaggttctgtcagcaccatgtaggcctgctggctggtgcatgtgcaggagcaacagtggacctgaaaggtcctctgaaaccacggtgtgcggaaggaactgaagactcccacagcagaggaagaggttttaaagtcccttcttcaagccccagctctg

SEQ ID NO: 102904 - DNA, 601 bp, Human
tggccagctaccaaagaagccctatgaacttcccatcccagacaggagctccctgagacatgaggagcagctctggcctctcccgacctgtgttggcgtccagcgtgcaggagctggtgtccaagaggctggactggcctgaaccaaggttccacgctgccccgcaacagcccccggatgtgtgtgcaaagacacctctgagatattctgttcctgcctttggtggtgtagaggttttccagtcgggcaaatggaaatacaccccggttatctctatgcgtctgcagttcccagctgaggktgcggtggggcctcttcccctgggcagagcaggtggggggcatggttgagaaataaccaatttctcagtgctctgagctacaaggagctgctgcaggagtggagacccagggcccagagggacgtgggtttctctctcagctgtgcggcttcgggtcctcaccctcctgctgtctctgaggttctgtcagcaccatgtaggcctgctggctggtgcatgtgcaggagcaacagtggacctgaaaggtcctctgaaaccacggtgtgcggaaggaactgaagactcccacagcagaggaag

SEQ ID NO: 102905 - DNA, 601 bp, Human
cccagcaaggccctgcccaggtggccagctaccaaagaagccctatgaacttcccatcccagacaggagctccctgagacatgaggagcagctctggcctctcccgacctgtgttggcgtccagcgtgcaggagctggtgtccaagaggctggactggcctgaaccaaggttccacgctgccccgcaacagcccccggatgtgtgtgcaaagacacctctgagatattctgttcctgcctttggtggtgtagaggttttccagtcgggcaaatggaaatacaccccggttatctctatgcrtctgcagttcccagctgagggtgcggtggggcctcttcccctgggcagagcaggtggggggcatggttgagaaataaccaatttctcagtgctctgagctacaaggagctgctgcaggagtggagacccagggcccagagggacgtgggtttctctctcagctgtgcggcttcgggtcctcaccctcctgctgtctctgaggttctgtcagcaccatgtaggcctgctggctggtgcatgtgcaggagcaacagtggacctgaaaggtcctctgaaaccacggtgtgcggaaggaactga

SEQ ID NO: 102906 - DNA, 601 bp, Human
tggtagcctctgatgagaacaccatcctctgccctgtcctctgaggccccagggcacccactgcctctcagccccgccaaaacccttctgtgaacacttaaaatgtcaggtattccaggacgacaccaagcccattcctgccccaggactccacagcagctgatccttctgcctgtgacacccttcctccagttcctcagctccggctcagcaacgtaaagccaccctggatggccccctctccacagtgccccgcatcagcccctctcacatccccctgtctcacatccccccggccacytgaggtactttgggatgacttgcttgctctcccctcccctcctgaatgtcagctccagaaacacagagcccccatctgctgtattcgggagcatctagaggaggtctgcctcccaggagacacccagcaagcattttctgggtgagtgaatgaatgaatgaatgaatgaatgaatgaattcacctttgctcaggagtctagatagccattctttcatggtgggttattgtagaagaggccctgacttagtccacagaagatcaaggctgaagcatcccggaaagtctctggggcagggac

SEQ ID NO: 102907 - DNA, 601 bp, Human
ctgagtgaaagatgctggacacaaaagaccacagcgtgtatgcttccaggtgtatgcaatgtccagaacaggaaatccatagagacagagagcagaggagttgctgccaggggctgggagagagggaatgaggagtgactactagtaggtacagagtttctttgaggggtgctgagaagtttcaaaattgattgtggtgacggttgcacaactgtgaataccctaaaaaccttggacttgtacactctaagaggatggattgtatggcatgagaattatatctcagtaaagctggtttttaaaaaaaaaaaaaaaaaaaagacaagagaccccattgggccagtgtccctaggaacttgggccatggagcacagctgctcgtgcaatgacaggggtgtcggccctcgtgtgggcatgcagggctcagccctggcctccagatgggcacagcagcatccgcacgctctccccaggctctgcttcagagtcatctgcagaatcccagcctttcagaatctgctgatgcctggaccccacccccagaggttaggatttcactggtctcaggtgtggccaggtgtctgctattttaaaaagcttc

SEQ ID NO: 102908 - DNA, 601 bp, Human
gctgagtgaaagatgctggacacaaaagaccacagcgtgtatgcttccaggtgtatgcaatgtccagaacaggaaatccatagagacagagagcagaggagttgctgccaggggctgggagagagggaatgaggagtgactactagtaggtacagagtttctttgaggggtgctgagaagtttcaaaattgattgtggtgacggttgcacaactgtgaataccctaaaaaccttggacttgtacactctaagaggatggattgtatggcatgagaattatatctcagtaaagctggttttwaaaaaaaaaaaaaaaaaaaagacaagagaccccattgggccagtgtccctaggaacttgggccatggagcacagctgctcgtgcaatgacaggggtgtcggccctcgtgtgggcatgcagggctcagccctggcctccagatgggcacagcagcatccgcacgctctccccaggctctgcttcagagtcatctgcagaatcccagcctttcagaatctgctgatgcctggaccccacccccagaggttaggatttcactggtctcaggtgtggccaggtgtctgctattttaaaaagctt

SEQ ID NO: 102909 - DNA, 601 bp, Human
tgctgagtgaaagatgctggacacaaaagaccacagcgtgtatgcttccaggtgtatgcaatgtccagaacaggaaatccatagagacagagagcagaggagttgctgccaggggctgggagagagggaatgaggagtgactactagtaggtacagagtttctttgaggggtgctgagaagtttcaaaattgattgtggtgacggttgcacaactgtgaataccctaaaaaccttggacttgtacactctaagaggatggattgtatggcatgagaattatatctcagtaaagctggtttwtaaaaaaaaaaaaaaaaaaaagacaagagaccccattgggccagtgtccctaggaacttgggccatggagcacagctgctcgtgcaatgacaggggtgtcggccctcgtgtgggcatgcagggctcagccctggcctccagatgggcacagcagcatccgcacgctctccccaggctctgcttcagagtcatctgcagaatcccagcctttcagaatctgctgatgcctggaccccacccccagaggttaggatttcactggtctcaggtgtggccaggtgtctgctattttaaaaagct

SEQ ID NO: 102910 - DNA, 601 bp, Human
gagacctgggctctgtcagggacaaccccaaagatggtggacttcaaagagggatgggacctccccacgaggctgggggaacactaacaccagaaacacactcacacacaaacttgtccacaaatgtcaataacagcattattcataataaccaaaagatgaaacaactcaaatgtccatcaatggatgaatgcgtaaacacaatgttgtctttccatacaatgaaacgttattcagccataaaaaggaatgaagtactgacacaggctgcaacatggatgaaccttgaagactttatgcygagtgaaagatgctggacacaaaagaccacagcgtgtatgcttccaggtgtatgcaatgtccagaacaggaaatccatagagacagagagcagaggagttgctgccaggggctgggagagagggaatgaggagtgactactagtaggtacagagtttctttgaggggtgctgagaagtttcaaaattgattgtggtgacggttgcacaactgtgaataccctaaaaaccttggacttgtacactctaagaggatggattgtatggcatgagaattatatctcagtaaagctggtttttaa

SEQ ID NO: 102911 - DNA, 601 bp, Human
agggcagaaggaagcagggagcagtcaggaaacaggaaggagggcagtgggccaggctggagggccggcggggtctttgtcctgatggttctcgctggggtcagaggagcacatgtggaatggcattggagaagctctctcaggtgtccacgcagaggacagactagagacctgagcagaaaggtcctgcgatgcaggaagaagcagggtgggggctcagtcaggtagaaccagagagagaacgggaaagcacgcagaaaccagaggaccacccgcctggccagctccgagggcaaaaccrctgtgaacccctttggtggtaaatcagctacaaactgtgcatctgatgagggctgagccagcgtcctcagctcctgctggcctgcctggctctggccacccccatggggatgcagagcaatgggacacagagctagaggacccagagcacgggccccctacatcagttcagacccttctctcttggccagagacctgggctctgtcagggacaaccccaaagatggtggacttcaaagagggatgggacctccccacgaggctgggggaacactaacaccagaaacacactcacacacaa

SEQ ID NO: 102912 - DNA, 601 bp, Human
agccagagagaggttttctggtctatactgggggccttctgaaactcagtgtttgccaggttacaactgcttagatgctgtctatggctcctgaggttaaagcccagattcctctgcctggctttcaagaccctccatgaactggtctctgcccaactttggggtatcttaggagcccgagaactgtggacacacagcccctcaccccagattcatctctttctaggctcctacccccccagtaacctgtgtggcctgcacacagtcacatcccaccatgtgctcacacatacacaacctycccaggcatggccccatgcaaccccccacaggctcacaccctcacactcatcagcacactcaaagcacacactcttacgcctgtgcgcacactcacacactccctcacaggtatgcatgacacatatgctcacacacaggtgcttctcatgccgtccatccctacacaacatatgcacagatagcccttcacacacagtcctgcccacatacttcccggcacacaagcgcacacacacacaccctcaaacatgaagggagcccatatggtggtggctagcagatggacccactgcacact

SEQ ID NO: 102913 - DNA, 601 bp, Human
tgggagctgtctcacccaagaccactccccctccctgggcagccccccagccaaagactggttggtgctgggtacaaaggcccatctccctgcctccatggggctaacccagctccaggtttctcatgggaccagcataagtccctgtggctgctgcatcactggccaacttctctcgatgcccagggctgccttcctcactgccttataggtgtatctccccagagtcccgcccaggacctgtcctgcttgcaaatgtccaaaccagggaccctttccaaggcactgaataaagacaacrtggaggtcagcgggcaggcagccttggacccccaaccccgggagacaataagtgtggatacccacaccaggataggtgctacaggctcccatccagagctgccaccacctgctcccctcctgttcctgctcctgcttctcctgctcctgatgatattcctcctcctcctccccctcttcctcctcctcaggctcctcctgctccccctcctcctcctcaagatcctcctgctcttcctcctgctcctccttctccttctcttgctcttcatgctcctccttctccccctcctcctcctct

SEQ ID NO: 102914 - DNA, 601 bp, Human
ctactgtgattatgtaggattgtgccattgttcaaggctctgcaggaaatgttggtgttggtgtcaggatcagagtgaggacaatttctcggcctagggctcaatgccggcctcaagcccaagctgctcagtgtcacttcttcctacgtgtatgcccaaacctctcagcagactgagcggcacaagggcaggatccatgcccacctctaataaaagccgctgcctccgaggtagctgcggtgtccagtgcctgacacgaatgcacacagaaaccttatgaggaaggttgaccatcatcagmccatttcacagatgagcagactggggagacaaggggtggcagtgcggaccacagtcacacagtcaggaagcatggaactggtattggagtccagcaatctggctgtagagctgtaatgtggccgaacagaaggaaggtgggtgggctaggatggccttgctccctcggtgatggtcacttgggctggcttgtgtagtggacactgtcgcatgccactgggatctgtccttcaggaccagacactccctctgcagctgctgggagtgttgctgctgatggctagcagctgagttcctccct

SEQ ID NO: 102915 - DNA, 601 bp, Human
catcatcctctgtgtgtggcagaaggtgtccctggctgctgctcacccctgctctaccctgggaggctgagctgtgtccctccttgccctccagcttcccagtgggtgatcccacagggactggagggcaggagaagatacaggcaggacttttacaccctggactccctgtccatggaccacatggtggctgtgactgtctccctctgcctagaaccacagcgcctgccaggaggccccttttccccaagccacactttctctactaacactgccctccagggcagacagagctccccartgttgccagccctaaggcctttttaggattccttaaatcctgcccacatccctgtagtcatcctttacctaaacttgcctctgtcacccctgactacgccatctcccagactctggtgggcacactgggtaagtgagtccctccttgagctccagctttgtctcctcatgacatgggctcaatggaacacacctggtgatgcagcagctgggttaaatgaccgaaggtggagttccaggggaaggaggcgctcataatcactactgtgattatgtaggattgtgccattgttcaaggctc

SEQ ID NO: 102916 - DNA, 601 bp, Human
agccccagcccttcatcctttctcctgccttctccaacacccaggtcaactcaccccagaacccctgtcctattgcaaacaccctcccagcgctggaagcatgtctgtgctgctgctgcctggcatggcaaccccagggcatctttaagcagcccctgcaatggctgcctttgttctcccctcacacaatgtgctcctggtccccgcagcgtcttctcccatccacattgctggtactgctatctcccatgctcagaccccagccaccctcccccaagcaggaggctcgttcctgaacctyctccaaaaagatccaagccagctgatcacatggtaaaggtgggccccggtcaaaaagatggacagaaagcaggtgggagctttgctggatgtggaggcccctcaacctcaggctggagggctgatggcttagttttcacagaaagccatgcctgggtcagactccagagacttgaggcaggagatggtcaccaagttccgctggcttcctctcctgtgccccatgccccatctgttcatgtttcttgtctccaagcacccaccctgcaccaaccaagtgaaacacgggtccatcatcctc

SEQ ID NO: 102917 - DNA, 601 bp, Human
ctggagctcgagactctgggctcgttgagtatctgctgcttcctcccctctgaaacccctctgaggttggccagcctggctcctctgcagggagtggtcagttctggactacttgtacctcaggttataagcagtgacctgggcaaccagaatcagtctccacgaaagtatgatgtggccaaaggcagcctgaagcagaagggcaggcactgtggcagagtcaggtcacccaagaagctcagttcaaatcccatccctgccaccacatgctggtgatggcagaaatggcccaagggaacayggcacactctctggctctccatttcctcattgctgctggcctacctctgaccacggaggccgaaagcataacacatcgcctgaaaaaaacagagacccggaaaagcaacttctccctttctatctttggatgctgtggtgtaagaatgtgattcctggagcttaggcagtcatcttgtgaccattaggcaagacctatgaggctgacaaggtgacaatggcagaatggaagggtgaaaagagctggggcccaagaaaagactgttgagcttctgaaagaaaccatatccagatttttatt

SEQ ID NO: 102918 - DNA, 601 bp, Human
cagatccccaataaatagctgggaccggaaactccatctcagcctctgcttccagagaaccccaccggccacactcctcgggccaggtcattcaccttgaaatcccccgcctctgatgaagagccttgtgtgcaagcggtgctgcccggtgtttgcaaggggaacaggacctagggcatgtctgtccacgtaggctttcactcatgcacctgtttcacagtgaggacctactgtgtggtatttggcgtcacccctgctggggagttcccaggaagactatgacacaaggaggtgctgctcyggttttctctgagcttccggtccccaccttccctgagtttgcagtccttgccacctctgagcttgtgattccaaaccagaagtaactgtggaattaataattcccctgaatctaatcatacattggtaagtgctatgaaggagtgaaagcaacagagaaggaaacttgaacccgtgagatgctcctgtgtgcatctcaaggaagcctcccccaagaaggccagggctgagctggagtcagataacgggagggataaattagaactggccaaactcaggtagatggggaaaaggcatttca

SEQ ID NO: 102919 - DNA, 601 bp, Human
gttaagagagcaaagcaaggtgtagaaaggcttgcagcttgggagcttgtttgtatgagaaagaagactcatccatgtatgcttgtaagagcacagggtatttctggaattacatgaggggaattggtaagagcagctgtctctggggaggacaccagtgccaggggaccagctggacaaacaggagtcttacttttcatgggattgtcttttgtagtgtttgaatattctgccatgtcaggaaaaaagtcagctcctcacaaagccttccctgattgtcaggatagacagtgactccctyatggtttccatggctggcctgtgctgttagagtccttgtctccttagcactgtgatgacctgcctatacgtcagcattcccccaggccaattgccctccaagggaggacttgcttcatagctacatgtagtggtatgttgctcaaactggctctcgaaagaaaaaacaaaaagccctgttacgtagtgtttcccaatttctgaggaataaattaaatgttcccaccatggctgactttaagctaccagcagtttaacaattgacaaatcctgaatatttagtagcgggtcttccagccca

SEQ ID NO: 102920 - DNA, 601 bp, Human
tcttggccctgcacatgctgttccttatctggaaggccaatctttatcaccatgacagacgatggcccaacaattccactactgaatatgtaccctgcggggaggcttgtgcttgtgcaagatgtcaaagagcctcacagggaccttatctgaaatatccaaaggccaaaagaatctgaagatccaccagtggggactggttatgtaaattacggcacatctatgagttggaatgccctatagctgctaaagagaatgaaatggctcttactcactaaccaaggacactgtgcaaggtccrtggttaagagagcaaagcaaggtgtagaaaggcttgcagcttgggagcttgtttgtatgagaaagaagactcatccatgtatgcttgtaagagcacagggtatttctggaattacatgaggggaattggtaagagcagctgtctctggggaggacaccagtgccaggggaccagctggacaaacaggagtcttacttttcatgggattgtcttttgtagtgtttgaatattctgccatgtcaggaaaaaagtcagctcctcacaaagccttccctgattgtcaggatagacagtgactcc

SEQ ID NO: 102921 - DNA, 601 bp, Human
agtggtctctttctaaactctccttaattccccagtctgaatgtgcctgtggcatccagccatgaccacagtggatacacctggctcctctgcagcagggccgagccgagccccaccctcctggcccccaggcccatgctctctccgcagcagctgcctccgcttgagcaagctcaccccttccatgcctcttggccctgcacatgctgttccttatctggaaggccaatctttatcaccatgacagacgatggcccaacaattccactactgaatatgtaccctgcggggaggcttgtgyttgtgcaagatgtcaaagagcctcacagggaccttatctgaaatatccaaaggccaaaagaatctgaagatccaccagtggggactggttatgtaaattacggcacatctatgagttggaatgccctatagctgctaaagagaatgaaatggctcttactcactaaccaaggacactgtgcaaggtccgtggttaagagagcaaagcaaggtgtagaaaggcttgcagcttgggagcttgtttgtatgagaaagaagactcatccatgtatgcttgtaagagcacagggtatttctggaa

SEQ ID NO: 102922 - DNA, 601 bp, Human
tagtatgtggcattttgcgtctctagcttccttcactcagcataaagttttcagggtctgtgcatgttgtagcatgtgttacaattcttttccttttcatggctgaataacactccatggtacaggtatgccacattttatccacgcatccatcggtcattggacagtggtctctttctaaactctccttaattccccagtctgaatgtgcctgtggcatccagccatgaccacagtggatacacctggctcctctgcagcagggccgagccgagccccaccctcctggcccccaggcccrtgctctctccgcagcagctgcctccgcttgagcaagctcaccccttccatgcctcttggccctgcacatgctgttccttatctggaaggccaatctttatcaccatgacagacgatggcccaacaattccactactgaatatgtaccctgcggggaggcttgtgcttgtgcaagatgtcaaagagcctcacagggaccttatctgaaatatccaaaggccaaaagaatctgaagatccaccagtggggactggttatgtaaattacggcacatctatgagttggaatgccctatagctgc

SEQ ID NO: 102923 - DNA, 601 bp, Human
tgcttcagtgtcaggaggtctgagggctttcaggctcaggctctaagatgacacggctccatgcagcttcccagtgcctggcatacagccggtgcgcagaaaatgccagaaggtaattcaccaagggggtgcattcaaatcactccacaagcagtatgccccaggcccgagcaattgtcagttgaatgttcagggtcccacaggccctgccaagctagccaggcatcaaccctccattgctggatataggtgaagttgagaggattcaaggaaaagccatggcaaaggtgggggacaatcraggggcttggagcagctggcagaatgtcagtattttatattagtggctgcaccactgggttgcaggttaaagaccagctgcatgaaactgctagagtttgccattttgccatcttgtgatgctgagatatcacaatatatgagaaaaataaatgaggaagtaaatctgtgaatctggtgtctggcctcagtaggcccttccagatggtttggcctgtggaaggcactggcaggaaatcggagggcaggaggaaagttctgggagttattccccctggttgctccctgctgggcccttcag

SEQ ID NO: 102924 - DNA, 601 bp, Human
tcacctccccacttgaagagcctgggctctgtgcttcagtgtcaggaggtctgagggctttcaggctcaggctctaagatgacacggctccatgcagcttcccagtgcctggcatacagccggtgcgcagaaaatgccagaaggtaattcaccaagggggtgcattcaaatcactccacaagcagtatgccccaggcccgagcaattgtcagttgaatgttcagggtcccacaggccctgccaagctagccaggcatcaaccctccattgctggatataggtgaagttgagaggattcaargaaaagccatggcaaaggtgggggacaatcaaggggcttggagcagctggcagaatgtcagtattttatattagtggctgcaccactgggttgcaggttaaagaccagctgcatgaaactgctagagtttgccattttgccatcttgtgatgctgagatatcacaatatatgagaaaaataaatgaggaagtaaatctgtgaatctggtgtctggcctcagtaggcccttccagatggtttggcctgtggaaggcactggcaggaaatcggagggcaggaggaaagttctgggagttatt

SEQ ID NO: 102925 - DNA, 601 bp, Human
tttatggttacatggatcatgctttgtaactattcttttaagtgaacagggatgctttgtgtacttttttcacataagcaatatctcaatttataaaaatgcaatggatacaatcaatggccaacaagcacatgagaagatgttcagcagcactggtccccagggaaaggcaaatcaaaaccacaacgacatgctcctttacactcactaggaggctaagacaataacaagtgtcggcgagggtgtggagccatcagaaccctcttgcactgctggtgggcatctgaaaggaggcagccaytctggaaaacagtctggcagctcctcagaatgttagacacagaatgtgtgactcaacaattccacccctaggcgtatgcccaagagaaatgaaaacatgtccacaataaaatgagtacatgattgctcatagcagcattattcataacagccaaaaagtgagcggaataactccctcaactattaatggataagcaaaatgaggtatacagtggaatgttattcagccataaaaaggaatgaagtactgatacacgctacaacatggatgagccttgaaaacattatatgctaagtgaaa

SEQ ID NO: 102926 - DNA, 601 bp, Human
ccatccaccaatatcaagacaaggttattcccagggcggggaggggctgtggttggccaggggcacccagctgtcttctgggggtcctggcaatattctgctccttgatatggtttatggttacatggatcatgctttgtaactattcttttaagtgaacagggatgctttgtgtacttttttcacataagcaatatctcaatttataaaaatgcaatggatacaatcaatggccaacaagcacatgagaagatgttcagcagcactggtccccagggaaaggcaaatcaaaaccacaacracatgctcctttacactcactaggaggctaagacaataacaagtgtcggcgagggtgtggagccatcagaaccctcttgcactgctggtgggcatctgaaaggaggcagccactctggaaaacagtctggcagctcctcagaatgttagacacagaatgtgtgactcaacaattccacccctaggcgtatgcccaagagaaatgaaaacatgtccacaataaaatgagtacatgattgctcatagcagcattattcataacagccaaaaagtgagcggaataactccctcaactattaat

SEQ ID NO: 102927 - DNA, 601 bp, Human
tcagggtgctggaagagaatgagacattcaaaaaactcgctagtcttgcctctggccctgggcccgttcaagatgctggggatactgaggtgacaagattaagtccctgactctgagaattgggtccatgttcagggtcctcctagccctaagagctctccttccaggagaggtgaccagtgtttggtcaacagaaccaccagggagggagagccaccacatttcaacctcagtatctgcaatcaaatgagccagtgatgccacaggcatccaaagtgttcaggaacaggactggctggtkgaaggctctggttccagaacacctggcatcacagagtacctcctgtaggcagcagtctcccaggacccccccacacgcagcccatgctggatgagcagccccttcaaatgcaggctgcgtcccacaaatctgtgtccccaaaacaacacagatatccccaacacaggttgtcagtgaggggatagttcccaaatctccagcctgccttactgccttggcttaagaagcaggagaaagagcaaaggcttggaggtgtgatgacacaattgggggcagagtgaggcaggtgtttctgatgca

SEQ ID NO: 102928 - DNA, 601 bp, Human
cataaaaataggccaatatgttgaagaaatgctacactactaaatctcaccctgaatatatacacacacaatctgtatctatttactctgaaatatctaatcttaaaaaagacttaaaaaaataaacagcaaaagataccattggcataagttcaaaagtatgaaataatgtgtgttaatgtgttgatcacactctatgaagacatcaagtttaaatagacttaccactgagaacagcatttaggaacgatatataaattactatagtagacactttttcttcagtgtagtgaaggagaaycttatgtaacagatttgatttatatgttgttattaagaccatattctaccctgatgtcagtggaatatgtgactaggtattgataactgtgtatagacagttaagtgtaaccgctttttagataatttaagtgaaaataagccttttctcaagttaattgtgagttctggaattcaactttaacagtattttgatgtttcaaaggggtcttgaaaaagaaaggatttttatcataaaagaaaaacaacaaatacatttagtattacaacaaagtagaaatctcccttattttaaggatgg

SEQ ID NO: 102929 - DNA, 601 bp, Human
ttctggcacttaccctccaaatatcagaagctgctctctgaatctagccctacaggagatgtctgaaaaagtagtctttgatgaggtgacaatgatgaagttctctctggcactgctagcaaggcagaaacatccccaaatgaggtggttaccagttgcctgtgaagcagctggaccattactgcagttctgagggtgcgtcacaaatcaggtcatagctctgggtagagtccacccacttcacccagtataacgccctctacttcctgcacacctgggggaaaggggtgcggggggcggrcagcttaagtccacataggtactagtaaaggcacagcgaggtgcagcctgacatctgcttcttccgcaagcatttcagcctcatctggggacctgcacccctaggtattcaaaaatgtgtgcaacaataagcaggctctaaaatgagtgaggagtgtaataaaatattgcacagttaaatgttttatccagcgaaatcttttctccactggaaactgaaccaactcttaatttttgattacaagccacttctctaccaaatgtcaaataactggactgaataaatttcagcagaaaccag

SEQ ID NO: 102930 - DNA, 601 bp, Human
ggggagtgctctgtttgactccggtattgtttgttaccacaaccaaacaccaaagaatgaagctgagcaggcacacttaacctaatactgaaggtcagacaatgaggatagaacagagacccaggtgctaccaaaaaaaaaaaaaaaaaatcatccaattatccagaaaatgaggcatgtgcagattaagtgttcagataaccctagtaaaaacagaaaattagaaagaaaattctctttgccaataaatctttatcggcacaagctacattttatattttatcattaatttagcaattcwttaatgagtgctcaatacgtacaaggcacagaatgctaactatgaactttctgttttatataacacagacataccttattacttacttacttttttgtagtttaatacttacagaaatatatagcagcttctacaaacttcagaaagtgggaatactagtgcgtttttaagagccatattacgaggttacaagatctacaaattcaaatcaaccaagataactcaaatagttaaccaatttgatagaattgtctaagtaagcctaagtccagctttaaatccctctagtttcagtaaccc

SEQ ID NO: 102931 - DNA, 601 bp, Human
agcatcttgaaggtttactcatgtatatatttctgcattccctttgacaatcttaggacgtaaaaccaggtactgagatcacaatccagatgtccaggctgaaccccactgcaattaaatcagaatggctgaggatgaggagaagacattcagttttttaaagctctcaaggtgattctcatatacagccaggtttggcatctaccaggttaggtgatgttttagagacagagaatcaaatactcaggacatctctgaggtggtttttaactcactcctggagtcacttggaaaagctaasctgttgtatgaaccagcagtagaccaaaatttgagaaatgtatatgtgggcaagctacttgtttcaaatttctaaaaaggcaataaaagtgggggcaggaagctactggatcattgatttggcaaataaatacatgctatttgaggaaccataataaactagcatttgggcacttgtttgagatttactggggtgccagaaatcctgtgcaggtatgttatttatcatgatagacattaagtgactaaccacaaaattatacatggaagtacagttctcaaaccagtctattatttactg

SEQ ID NO: 102932 - DNA, 601 bp, Human
tctgctatcttctttaatgtgcagcttgatttccccttgtcagtccgaagccttctccagttgttagttatttccttctccatgctccatcacactgcctgaatgcaatgtgacatttcatatctatctatatgtctgcctctccaaactgcaagactctaagcatcttgaaggtttactcatgtatatatttctgcattccctttgacaatcttaggacgtaaaaccaggtactgagatcacaatccagatgtccaggctgaaccccactgcaattaaatcagaatggctgaggatgagragaagacattcagttttttaaagctctcaaggtgattctcatatacagccaggtttggcatctaccaggttaggtgatgttttagagacagagaatcaaatactcaggacatctctgaggtggtttttaactcactcctggagtcacttggaaaagctaagctgttgtatgaaccagcagtagaccaaaatttgagaaatgtatatgtgggcaagctacttgtttcaaatttctaaaaaggcaataaaagtgggggcaggaagctactggatcattgatttggcaaataaatacatgcta

SEQ ID NO: 102933 - DNA, 575 bp, Human
gggggaaatcgtaaaaacaaagcaaaacccgttatgagctgtacactgtgatggtgctggggaaacgacgtggtgactgaggattctcttaaaaaaaaaaaaatcactgcggacaaggtctccaaaaaggaaaaaaggtctcttcgcgtctctccctccctcctgctcactcgggttcttcggtgtgaggacagaaagtctacttctggctgtcacttgcaatattattcttcaataaccccgaataacgcgcattgggaaggccacctcgcctcccttccaatcacccccaccccccccycgccaacaatcgcgactaatattaacaaaccttaaacttttccccacagcctcgcacccccaacgagggcatctagcgggggacagcgagggtggggggcagggggtcgcgagaaaagccccggaaaggcactaaaatgccacttttgattctgccctcgctgacaacagccgcaaggaccctctccctgcccattgacgcggggctgtgagcgtctggggtcccagcaagtgaggagagaagaggttcggggggagggggaggaggaggaaga

SEQ ID NO: 102934 - DNA, 601 bp, Human
aaataacaaaaacaaaggagatttcctttgcagcccgggttcttgaagagaagttcaagactgatgttttctatgtcctttttttttttaattaaaaaaaaaaaataaaaaagcagcagacctgaaggcgacttcccctgaaattgtattattttcctttcccctacccccgcccccctaagcgggggaagggcagaaataaacgtctagaagagtagccatgagaaaggggtttaaaaaaaaaatcacaattcgaaaaccaacatataggggtttgtaaaatgtctaacctcagagaacrgggtttgcgatggggaggaggggagagtgggaagcagggaggaggaagaagataaaattgatctgacaagtgattcgttggggggaaatcgtaaaaacaaagcaaaacccgttatgagctgtacactgtgatggtgctggggaaacgacgtggtgactgaggattctcttaaaaaaaaaaaaatcactgcggacaaggtctccaaaaaggaaaaaaggtctcttcgcgtctctccctccctcctgctcactcgggttcttcggtgtgaggacagaaagtctacttctggctgtcacttgc

SEQ ID NO: 102935 - DNA, 601 bp, Human
cgcccccacacaaccccataatcacattttaagattgtgcccttatccattccatatggccggcacgatccaggccaagctttcactgtgaccttttaaagagacaaagaagcaaagtactatctagaaacagaaacactgcagttttactgagtgaaattagcaaaaccgacctgaaactcaccacttcaaaacttgacagcacataaataacaaaaacaaaggagatttcctttgcagcccgggttcttgaagagaagttcaagactgatgttttctatgtcctttttttttttaattaaaaaaaaaaaataaaaaagcagcagacctgaaggcgacttcccctgaaattgtattattttcctttcccctacccccgcccccctaagcgggggaagggcagaaataaacgtctagaagagtagccatgagaaaggggtttaaaaaaaaaatcacaattcgaaaaccaacatataggggtttgtaaaatgtctaacctcagagaacggggtttgcgatggggaggaggggagagtgggaagcagggaggaggaagaagataaaattgatctgacaagtgattcgttggggggaaatcgta

SEQ ID NO: 102936 - DNA, 601 bp, Human
ttacaggaacaacactgttaaacacagtccaagttgttaaactgcatcaatttaatattggtagaaaaaagtcacacagttacacatcttccccttataaacttgcctaaatctgttctttcttcatcaaaaatacccaattaaaacaaaaataaaaaactagaatcatcagattttttactgctaatgaatttgctcttaagaaaataagccacaaaaaataacattaccaaacttctacataagatgtccaagatctctgaaactgccctacaactaagaatcttaggaagaagctagrgtaactctcaaatcacctaagtgttttattcttaatcaggttagtttgaagaaacagctgcctacaatcctcgactacaacaccttttgaatggaccctgccaaaactaaaaccattatatttaattcagtccttattacccaaaatgttccatgattccagtctacagtagaacgctccacccaagcatggaggctatactttccaacgtgattgatactaaggacccagaatgtaactaatgtacgatcataaggagaataaaggcagagtatacaaaacatgttctgccactccacc

SEQ ID NO: 102937 - DNA, 601 bp, Human
tttatacagccccagtgcttcacagtacaatattaatgcactctgtttgaaaagccgtaataaattatatttttaatgctcttaccctggctttcttaagatgcatacattcttggcaaacaatcaataaatagggtaatcatgagtagaggccaaagaatttgctgaagtgctgttttcccatttttaatagataaagatctaacaatacggactgctgtgtctgttcatttcaggatcaatatattctttgttttcgccaaaccaaggaaaaaataaatgattgtatgataaatgttaygcatcaaacacaatgaaattcctctgccttctaactttatctacttaatattcttggttgctaaaatatagcatttttatccattgcttagcaaatgtaaggaaaatctgattcctatacatgttattcagacacaaaatgaagctccttatgaggcacatgcattacacccagggtaggcactgctttacaggaacaacactgttaaacacagtccaagttgttaaactgcatcaatttaatattggtagaaaaaagtcacacagttacacatcttccccttataaacttgcctaaatc

SEQ ID NO: 102938 - DNA, 601 bp, Human
agaacccgtcggggatcagaagacaacttggggagaccacagcaaaaatagcaatatgcaaactggcgattccttccttggcttgaaggtattctggcaaaatcgcctaaacaaataaaaccattcaatccctttttcttagtagtgttttctcatctcagccataattttcatttagcacctatcagacagaaaccatgcacatgaaaaataagatgaaaatgttaataaaaacccacaaaaagactttagtaattttgttatttggagtatctgagaccctcctacaattaaactgcakttttagaatacatccaaaacaaaacaaaacaaaaccaaaaagcatttgagcaggaagtgaatttactgtacttttagttttcctcctcctgtcctgatatcttcaaagagttgggtaagtacaacaaaaatgtacacattcatttttccttttgtaggatgaatcagatgtattctacaatatgcttttccttagatctatgaaataactgcagggttttcaaactattgaaatatattggatttattgtggattttattgatcatgtttagaggtaccctaaaataataaagacggcta

SEQ ID NO: 102939 - DNA, 601 bp, Human
tactttaacagggcacccaggatccacaattagtcctacaatactaatgcctctataagctctgtcctctggactcacagaatcctaccaacttctgaagatgacttagtgcacaccaaccgtagctaaaaatcaggatttcctactgacaccagagaggcccttcaaagattctctatttgcttgtttctgctgaacaaaagccggcaataaaacagctacatctttctacatgtgagtcttcaccaaagctttagtgaactgttcacaagagattctaggtctgacaaaaccctttagrtttacttagaaaaactcacaaactcattcggaggtaccaataggctaggcatgaaaaacaagccgcagagcttgccaatatttttgtcattcattcagctgttttataccagagaaagaacccgtcggggatcagaagacaacttggggagaccacagcaaaaatagcaatatgcaaactggcgattccttccttggcttgaaggtattctggcaaaatcgcctaaacaaataaaaccattcaatccctttttcttagtagtgttttctcatctcagccataattttcatttagcaccta

SEQ ID NO: 102940 - DNA, 601 bp, Human
acaagggttactttaacagggcacccaggatccacaattagtcctacaatactaatgcctctataagctctgtcctctggactcacagaatcctaccaacttctgaagatgacttagtgcacaccaaccgtagctaaaaatcaggatttcctactgacaccagagaggcccttcaaagattctctatttgcttgtttctgctgaacaaaagccggcaataaaacagctacatctttctacatgtgagtcttcaccaaagctttagtgaactgttcacaagagattctaggtctgacaaaamcctttaggtttacttagaaaaactcacaaactcattcggaggtaccaataggctaggcatgaaaaacaagccgcagagcttgccaatatttttgtcattcattcagctgttttataccagagaaagaacccgtcggggatcagaagacaacttggggagaccacagcaaaaatagcaatatgcaaactggcgattccttccttggcttgaaggtattctggcaaaatcgcctaaacaaataaaaccattcaatccctttttcttagtagtgttttctcatctcagccataattttcattt

SEQ ID NO: 102941 - DNA, 601 bp, Human
agaaataaatgtatcttctctaatttgctatgagtagtatacagtatgcaaacataactcaccatttatcttcagaagaacccacctttctactgcttacatgattttgttaataataaacttttcctgggtttgtgtccaaacaaattatcttcgaccacgaaattttcattttcttccttttttagatattaactctaactggttccacaaatcattttcttccttttttagatattagctctaactggttccacaaaaagtacttaaccaaactggtgctcataatacacaatttcartatctgcataatgtagaaaaataacatttgcttttatgaatactcatttaacctacctaactaaaaagagagcacggtacccataagtctttaaaatcaacaatctttgttacagtaaataaggtaaaaatgagagatagaaaaggaaactgacatactaggataaaggaatctgcatagatttggtgtgctctctctttatatattttaatccaatacagtaactcagtagctagatgattaataagcaccggccacactactattagaaagaggcttcttctagaaattgatattacg

SEQ ID NO: 102942 - DNA, 601 bp, Human
ctttctcctgagccatcatgaaaagctttaatgtattaaccgatttcctttcattactctgttcatatgaattaaaaatcataaaaaaataaataaataaataagactgtggtaatagtgaataagacagtctttcacaaaatgtacacagatggcactgttcatgatatgcaaaaatatttttttcttaagtaaactttatgtaaaatgccttcttgtgatgcattatttaattgactaaacgtaaaaagtcttgtcttttgataacctgcacaaacctacacattttttgtgtgtgtgkggggggggattgcttttaaattatacattgaagttaggaaaaaaggcagaaggatagggtaacaaaatcgatctgtattaacctttctgaaacacagactaaaaaaaaattgaaggtcgaccagagagaaatgcttcatttcaaaagaccaggtaagaagaatgtttcaccctagatttgctgtcttgactcacctgtgtaactgaattttcaatgtgaccacatgatacacatcttgaagcatatctgctactgtagcatcaggggcatctgtcacgtaagacagtggaactggattcc

SEQ ID NO: 102943 - DNA, 601 bp, Human
cagacccaagaaattcatctgcccactatttctaatgaaaatgactaatgttaccttggggttcaaaacaaagggctattagcataattatgcctactggtcttgagaatatgaaagaataggaaagagaagtaactgcacagaactataccggcaaatcttctggaacgtcccaaataccaagttatcccaaaagtcagttcctgtctagatcacccatgattaggggcttgatatgacagcaatgtacttttaaaacaagacaacatacaaacaaaaaatcaaagacacaaaaccaaarcacggtaaagaaaattttcagcaatgagaataaatacacttggaaaactacaagtagttatcactactttagagaaatcaaagcatattataaaacctatccaattcatctgagaggctttcattttgtcttttttaaacttcctttatctgtggtatgtgatgaaaaggctacttggtgaagctcccgggctctcggtatgaagtctcacccttgtgcttcaccagcgatgtagccatggacgctcactcatgtcaacattctgtgcctcaggttcctcatttaaaaatggggatataa

SEQ ID NO: 102944 - DNA, 601 bp, Human
agggtgctttacaatcattatgagttaaaattaaaactgaagcacatacaattcctaatagaatcattttaaaaatgctaaacagaacaaataacttttaagtctagatttaaaagtcccaacagccagagcgttccttacttcaattggcaatgagctgcagaaccagggctgaggctctcctctgttatgttaaaggctctcttatgtttttcatactcagagcacgttataatcaagcagtttccaatgaaagagggggaaattgagttcgtgtatctgtttgttttgattatcaggtttttttttttttcctggagttgggggttgttcatggtttgcccaaatctggcatgaaatgaagcagatctataaagcaaatccagatagagcccaacttcaagtttaactagtaattgagaaaaaaagatgtctaaaatatactctaaaactagttctgttttagcaagaaaatcagtttgagtagcatgatttgtttaagttgttttttaaaaccattagaaaatagcatttaataggctttctctcaggccatgtctactcctaagccttgggagtatttattattctaagcatcagg

SEQ ID NO: 102945 - DNA, 601 bp, Human
gacaagcctgagagagttggtggtatccagtaatgaagtaccatgtcttgttattcagataagaatgtgatctcaaatagtgctagcaattaaagctttaatcttttcttaacttccaacctatcaactggtttgcatcttcaacctgagtaaactaaattagattagcatttctatgggaaaatattacaatagaaaataatcaatttttttaagagagaaagatgatgactaaagagaacaaagtttcagagtaagaatgagagaaaaagactgctaaagaagtcagccaccttctctrccatgaggaattctgcaatcttatgaattgtccatgatgaaactccagcaccccgtaagactgcatattagaacacaatacaatcttatatttctgtagcgcccttcatgcaagcatcccagggtgctttacaatcattatgagttaaaattaaaactgaagcacatacaattcctaatagaatcattttaaaaatgctaaacagaacaaataacttttaagtctagatttaaaagtcccaacagccagagcgttccttacttcaattggcaatgagctgcagaaccagggctgaggctc

SEQ ID NO: 102946 - DNA, 378 bp, Human
tgtggttaaatcgctcatcctctctagagattacaatttctagtatctggaaagataccaaattcgtgttaagttccagaggtcctaaatagagccttttaaaaaaacaaaacaaaaccaaaaaacccttaaaccacagagcgaaaacaagaactaaagtactttgagcaattcattttccaaaagtaaatattagaattaggttctgtaactcttcacaggaagactttatattacctctttgcattccttctgtacaggagcatattagatttttaagccatactgcctaaaaattggrggtaaaatacctcctggcttttagctctttacagggccacagaactaattctggaaattacataaaacctatgaaag

SEQ ID NO: 102947 - DNA, 601 bp, Human
ttgagtctttttaatgtagaatgaagtatactgattaaattattaagttacaagttggtacaaggaatagtaaaggaaaacaccacggggaaatatttctttccttctcatactccaatttggtggtgttttctgaagctggcctatatctggtagaaagcatcaagaaggcacaccactcctctggcttggatgcacggcccatgccctctcccatctctagctaacagctgctcatccttcaggatacagcctgggcatccttgcttccatgaggcctttcctaacttcccaaacctcytgcagcagagcactcatcctgctgtttattttgcactggactgtgggccttaggtctcatctgaatatatcctggactcatcagagggctggacacagactaggtgatcaataaaaagggtcactgaaacaagccaccagaaatcctcttccccttttttccccttaaaggtcaaacataatagcagcttaactatgacacgaatctttcaaatccatcgctttggctgtcgtgatagaaatcatagtttcaagaacctttgttcattaatttgcaagagatcccttcccaggtttttca

SEQ ID NO: 102948 - DNA, 601 bp, Human
tgtctatttttattggacaatatgcaataatctgtccaattagattgctcctatagccacttcatgaggtgtatgtgtgtgggcgtgggcgtgtgtgtgtgtttcaggtggtaaaattcctactaaaggcttaggcatagcattggagtagaccagccagccggtttcaatggcaggaaagagactgcagaattttgtggtgcacatggcatttgaaaaatcatatacagtagtgtaatcttaaatttagaatatcaggaaaaaaacacgtaatgttttgataacacaaataaaaaagtcrtgattggtaaaattttcctaggtggtgggatgtacagatagtaggccaagttccatgttagaaaggcttgggattcttgtgtcacttaaaaggaggtactggtttaaaaagattgcactaagctgtgagttcacgtaggtctggggcaccatattattttctagctcaatgcctggcatgcattaatataaacactaaatgttcatctgacaaaacagaatagaaataaacatatattcaagtgaggatgtgtcacacactggtagtatgaccttgggtcaaatagttgaccattccatc

SEQ ID NO: 102949 - DNA, 601 bp, Human
tgtgtgaaaaaatgtctgaaatagttttataaaactagaacctatatgtaatagtgctatacagtttattattattcgtacatggaaaataatatccatatgtgcatcattgtcaaagcttccccctaccctacttaaccctaaattggtaggttctgggcttaagtgcttttctgtcacatggtgtatgcttaggaaactctgattaatgtaaataatagcctaagcaagacttaaatcaaaaggctaatccgtaacttataatgcatgacaaagcaactttttggattccctatctttytgtgcttttgggtgactgggaaatatttcctaattcaggtaacttggagtcatgtctatttttattggacaatatgcaataatctgtccaattagattgctcctatagccacttcatgaggtgtatgtgtgtgggcgtgggcgtgtgtgtgtgtttcaggtggtaaaattcctactaaaggcttaggcatagcattggagtagaccagccagccggtttcaatggcaggaaagagactgcagaattttgtggtgcacatggcatttgaaaaatcatatacagtagtgtaatcttaaattt

SEQ ID NO: 102950 - DNA, 601 bp, Human
tctatcaagagaaaaacattctgcaatcttattactggcttcatcaatagtaaagcttaagttttgaatttcaaaccgatcataaaaattttaaatttatacatttcatgcttctaaatttctcaaggataccacaaaaagatgacctattgtgacttatctttatcctgcttttaataaatgcccggaaaactgtcagccctttaacatacaaaaatgaagaaaaacatgattttaatgaatcactaggagggtttctttttttaaatcattttcaatcttcccagcaaattttggttayggtaatttcaatgactaaattcatggtccatattaacctgttacccatattctctagtaacagctaacttaatttcctaccgagtcttaggagtaagattttgtagcaccaatctatccctcacccctatgtgcagaaacatgagaactcacatttcagacatcagttggtctatggtgaaataatttatagaaggcagcattgttcaggaggcagtgaacaaccagaaaagccagtttggggacaaaagtatttttatataattatcttctttaagttacctctaatgtaaagctcttt

SEQ ID NO: 102951 - DNA, 601 bp, Human
gatcccaggggattcacatgtatattaaaatttgagaaacagaacttgcactttccactctattatttggatttaaagtggacgcgcattaacactgatcaaaggttaactgaccgtatttgagaagaaacaaactattcacagagatcctctatcaagagaaaaacattctgcaatcttattactggcttcatcaatagtaaagcttaagttttgaatttcaaaccgatcataaaaattttaaatttatacatttcatgcttctaaatttctcaaggataccacaaaaagatgacctatygtgacttatctttatcctgcttttaataaatgcccggaaaactgtcagccctttaacatacaaaaatgaagaaaaacatgattttaatgaatcactaggagggtttctttttttaaatcattttcaatcttcccagcaaattttggttatggtaatttcaatgactaaattcatggtccatattaacctgttacccatattctctagtaacagctaacttaatttcctaccgagtcttaggagtaagattttgtagcaccaatctatccctcacccctatgtgcagaaacatgagaactc

SEQ ID NO: 102952 - DNA, 601 bp, Human
cattcattgaatctccatcaatgccatctattactaggctgtcaaactcactggtcccaataaatccaaatacatgaagatgactttataattgtgactcataaatatacgagacttcgcgattttttgactggactctacatcttttctactcaaagtatagaccagggaccagcaatatgggcatcacttggaagcttgttagaaatgcagaatcttgggccctaccccagaccagtgcacttagcagctgaattttaccaagatcccaggggattcacatgtatattaaaatttgagmaacagaacttgcactttccactctattatttggatttaaagtggacgcgcattaacactgatcaaaggttaactgaccgtatttgagaagaaacaaactattcacagagatcctctatcaagagaaaaacattctgcaatcttattactggcttcatcaatagtaaagcttaagttttgaatttcaaaccgatcataaaaattttaaatttatacatttcatgcttctaaatttctcaaggataccacaaaaagatgacctattgtgacttatctttatcctgcttttaataaatgcccg

SEQ ID NO: 102953 - DNA, 601 bp, Human
gaaagagaacagtaataaaaattaaaacattaaccttaatcacagtgtttgcttttgtgaacattaacaaactcaacagagagaaaatgccatcatctaaatgcttaggtaccatacacaacttttatctatcattttacactgcagataattttagtgtacttcttgcataacaaatattcacctaaagttatgtgttaagatagaatgctaccttggaattaaaagttcagaaatgatgcaataattgttctggtatggatggtaaagcaatgtgcttatcaaagtgcccatccatggsggctgggggttagagctataaaaatcacttgatctctactgtggaaactataaatagtttaatttaagaagtttaatttcctttaaaattgggtgtaaaaataggcactttctcattcaaccagacaaaaacaaaaaacctaaaagcaagacttatcagagaaagaaatcacagctaatattagttattcaaggcctggttaggtcttcactgagttgttaaaaaatgacagctcccctcccaacgcctcaatttcctgcatgtctgacaaccaagtcagtttggctgatttaaacacaa

SEQ ID NO: 102954 - DNA, 601 bp, Human
tttaaaatatatgttttggagggtaaaagtaggtgaaagagaacagtaataaaaattaaaacattaaccttaatcacagtgtttgcttttgtgaacattaacaaactcaacagagagaaaatgccatcatctaaatgcttaggtaccatacacaacttttatctatcattttacactgcagataattttagtgtacttcttgcataacaaatattcacctaaagttatgtgttaagatagaatgctaccttggaattaaaagttcagaaatgatgcaataattgttctggtatggatggtraagcaatgtgcttatcaaagtgcccatccatgggggctgggggttagagctataaaaatcacttgatctctactgtggaaactataaatagtttaatttaagaagtttaatttcctttaaaattgggtgtaaaaataggcactttctcattcaaccagacaaaaacaaaaaacctaaaagcaagacttatcagagaaagaaatcacagctaatattagttattcaaggcctggttaggtcttcactgagttgttaaaaaatgacagctcccctcccaacgcctcaatttcctgcatgtct

SEQ ID NO: 102955 - DNA, 601 bp, Human
tctggtcgataacagaataaagtttgctgatgcctggtctagacaatgaatttggaagacaatagcatgagggagcgcacacagcttacaaatattttatgttaataagtcatataatattttttcaaaatggctgcttagaattaagtggattattgcttccaaggtgttaacaacaacaaacaacaacaacaacaacaacgctgcagtagaactttaagagggaacatttatatacctaagtttgatatgggtagtaacaacataaatggaaaagacaataggctagaagcctggaatmctgccaatagccttgactgagtcatgaaacttttcttaaccatctactatagcttatgattccattatataaaagcataagtaatgccagtttaaagtacgtttgacatttaattagtctttcaaaggccctgaattgggatcaatctgcacataggttcccttgattcagaagtatatcataggaaaaggagtggtaaaattgaggctccaccaggaataggtaatatgatcacatgaagagagagagaaaatgttagtacagaagtaaaagaataaactttagttatagatgggacta

SEQ ID NO: 102956 - DNA, 601 bp, Human
agaggctttgtcaggtctcctaactccccatctagttaaggcacgccaaaaataagtcacagctgggattctcctaggtatggaaactctgcaaactaggaattaatactagattacttctgtaccagaattttattctcataatcataatcatgtaataaacaaaataacttaaatatgaaaggaaaatgtgagtcaggccaaaaaataagataaattgacaaaagaaagaacagtggtaaaacaaaagagctgaaaaggcataatgtccttcttctaatcaaagttacgcggtttttcrtttttgtttgttttttggttttgttgttgttttttgttttgttttagtgtacctgggccaaaaataaacaccatatatatcacgtatcatactagtttccaaacaaagaaaaaaattcttctcattcacagttcaacagagtcaatttgtttagggcttctcaaatatctttatcttatgacctctcatatatatcactttttctccatgaccctcttaaacatcttccaggctgatagatagtaccttcacaggaattgggccaggaagacaaaggtgtgcacattaggggtataagca

SEQ ID NO: 102957 - DNA, 601 bp, Human
tttaacctgagacatagccttgtgcaactgccttttcaaaaacagacgaacgtacaaaaaaaaaaaaaaagatgaatcgactgaaaacaaacactgaattagaggctttgtcaggtctcctaactccccatctagttaaggcacgccaaaaataagtcacagctgggattctcctaggtatggaaactctgcaaactaggaattaatactagattacttctgtaccagaattttattctcataatcataatcatgtaataaacaaaataacttaaatatgaaaggaaaatgtgagtcaggycaaaaaataagataaattgacaaaagaaagaacagtggtaaaacaaaagagctgaaaaggcataatgtccttcttctaatcaaagttacgcggtttttcgtttttgtttgttttttggttttgttgttgttttttgttttgttttagtgtacctgggccaaaaataaacaccatatatatcacgtatcatactagtttccaaacaaagaaaaaaattcttctcattcacagttcaacagagtcaatttgtttagggcttctcaaatatctttatcttatgacctctcatatatatcactt

SEQ ID NO: 102958 - DNA, 601 bp, Human
ttattgaaatgttatgtagagacctactttttttggcctagtacggagaattattagtacttactatatttactaaaataaagaatgctaccagaaacaggaatatttagagggttgacttttgagccattcattttcaataattatcccccaactgaatataggtgtcatattaagttcaccagctaatgatgaacacagttttttaagctataaagatatagaactaggtaaaaccatacaattttaacctgagacatagccttgtgcaactgccttttcaaaaacagacgaacgtacaaaaaaaaaaaaaaagatgaatcgactgaaaacaaacactgaattagaggctttgtcaggtctcctaactccccatctagttaaggcacgccaaaaataagtcacagctgggattctcctaggtatggaaactctgcaaactaggaattaatactagattacttctgtaccagaattttattctcataatcataatcatgtaataaacaaaataacttaaatatgaaaggaaaatgtgagtcaggccaaaaaataagataaattgacaaaagaaagaacagtggtaaaacaaaagagctga

SEQ ID NO: 102959 - DNA, 601 bp, Human
gtagatattgtggaatttgtccttttaaggaccaaaggcagaacaaatggccaactcctcatagtaatggctgtaacatcataaacccaaaaggagaaaagctgtaatgatgggtgacaactttatcctcacttctctgagttctactgtcttagcattcttcactatataaaggacacttacttagtgctttaagaaataactgctcaatttttaagacaccagtaactatatatatacacatatatacatatatatacacacacatacacacacacatatatatacacatatatatacrtatatatataatttgtgtctatgtcatgatgtctttgtgggcttttaactcaattcaaaaaagcattattgaaatgttatgtagagacctactttttttggcctagtacggagaattattagtacttactatatttactaaaataaagaatgctaccagaaacaggaatatttagagggttgacttttgagccattcattttcaataattatcccccaactgaatataggtgtcatattaagttcaccagctaatgatgaacacagttttttaagctataaagatatagaactaggtaaa

SEQ ID NO: 102960 - DNA, 601 bp, Human
agatgataagaaaattctcaatagttaaaacctaagacccagggttttaaagttatacagagcttcaatgactaaaataaccctcaattcatacaagtgttttctatcatattaaggtcttaatgccgtttataagaaacagtatcttcatctgaccctatcatgtaactttgtatttgtatgtacatattttacattaatttttttttattatactttaagttttagggtacatgtgcacattgtgcaggttagttacatatgtatacatgtgccgtgctggtgcgctgcacccactaastcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttaatgttttaaaagttggagttggaactgcacattgtactaggtgcacacaaatgtgtgatgtgtgatttaactctgcagagctccttgtctatacatacgcattagcatgtgtattttcatactccacactcacaccataccc

SEQ ID NO: 102961 - DNA, 601 bp, Human
tcttttaaaaatcaaagggtattaaggaatgtatttgcatgtatcagaaccattaaatagcaataagatagagaagtgaattgaaaagtagaaatctagaagctttggcaattacttttagccataggtttccattaaaaagacatcaagtaggcataactgaatgaatgacatatgctaaaagctgatatcttcaacggcaattaaagaacccatgcccatcaattcagaaggggaaaaattccttaaaacaagtaactatgtaagtttaccataaattttcagaaaaggtaggcttaaraaaaaagccatgtgcgaaagtcttgggagggtaatgtgttaatatagggaaccctattaagatgataagaaaattctcaatagttaaaacctaagacccagggttttaaagttatacagagcttcaatgactaaaataaccctcaattcatacaagtgttttctatcatattaaggtcttaatgccgtttataagaaacagtatcttcatctgaccctatcatgtaactttgtatttgtatgtacatattttacattaatttttttttattatactttaagttttagggtacatgtgcac

SEQ ID NO: 102962 - DNA, 601 bp, Human
gccacagagtgggatcagagttaaactctgaattttattcttttaaaaatcaaagggtattaaggaatgtatttgcatgtatcagaaccattaaatagcaataagatagagaagtgaattgaaaagtagaaatctagaagctttggcaattacttttagccataggtttccattaaaaagacatcaagtaggcataactgaatgaatgacatatgctaaaagctgatatcttcaacggcaattaaagaacccatgcccatcaattcagaaggggaaaaattccttaaaacaagtaactatrtaagtttaccataaattttcagaaaaggtaggcttaagaaaaaagccatgtgcgaaagtcttgggagggtaatgtgttaatatagggaaccctattaagatgataagaaaattctcaatagttaaaacctaagacccagggttttaaagttatacagagcttcaatgactaaaataaccctcaattcatacaagtgttttctatcatattaaggtcttaatgccgtttataagaaacagtatcttcatctgaccctatcatgtaactttgtatttgtatgtacatattttacattaattt

SEQ ID NO: 102963 - DNA, 601 bp, Human
ctcaggtgtttcagaaacctttgggtttttttttttttttttttggcccagagctttcaatgaggggagtgccccctggtggaaatgcttgaaaatattgtcagaaaacattttgattagtgataattacttaaaaaaaaaagtcactttagaataattttggatgcaaaatgactgctatcagatcccagatatgggaatgtatgttttggtcctgttcaggttgttgttacttgaatagctgcactcatatttatatgctgaattcaagatatatgtggccaccagttcccatatcctrtaattgaagacatagtacagacttgccaaggtcatttgtagtactgcccacacagtggacagtaagcgtgaccttttaccaaaaattcttcatgctaaaaaatagtatgaaaaggccatcatgtaccttatttatgtcatagaatatgctgaaacatcaggactaaaatatgtcatcagtatcaagaatcattggcgctcaataaatttgttgaattaaattaaacaaaatcattagtcattcttgtgtctgaaaagaacctgagaacttgtatgttatgtaggaagttaccagtacctc

SEQ ID NO: 102964 - DNA, 601 bp, Human
ctaacatataagactaagtcatttccatatggttgagattggaaggtagttatgtcacttgggagaaaattttaaaagttctctacctatattttgatgttggtgtgacttcctatttaagcatacaagtgtttttaggggcaaagcattttactaccacttaattattctactggaacaaggttttttgttcgtctgaaatatgttgatggtataaagtgatgtttcaaaccctgaaacactcaaagagctttaaagcagccagtgtagacagtctcaggtgtttcagaaacctttgggtttttttttttttttttttggcccagagctttcaatgaggggagtgccccctggtggaaatgcttgaaaatattgtcagaaaacattttgattagtgataattacttaaaaaaaaaagtcactttagaataattttggatgcaaaatgactgctatcagatcccagatatgggaatgtatgttttggtcctgttcaggttgttgttacttgaatagctgcactcatatttatatgctgaattcaagatatatgtggccaccagttcccatatcctgtaattgaagacatagtacagacttg

SEQ ID NO: 102965 - DNA, 601 bp, Human
gtagcttaacttgccatgaaatctttcacagagagacgatccagggaagttaagaataaacgaaatccttataatgcaacagcactgaactgtatagttcccaagctgcctagacaaaggcagtgtaatgcctacagcccaatatgtaaagatacaaagccatttctagagaagtagaactttcaaagaaaataccagaaaatgaattttaacatattagaacaaaggttattactaaagcatcacctaaggtttatgctgtattttcacaggcaatgtttaaaattattccttaaactcygacttatcaaagtacatgacactacgtgaccctttcaatttaccattttcagagaacctcactgattatcacaaatgattctaaatactatcttgctgtattataccactgggtaacaggtttaaattttgaactttaaaaaccatagacaagatttgaaatatattaactaattttcaacattgcgaaagtccatcacagcatgccaaggaaaagagtatcaaattctgtaattatcaaatttcttggggaataaaaattgttagtgatagaagaaatttataaatcattagaaaactc

SEQ ID NO: 102966 - DNA, 601 bp, Human
aataagacacggagacaaagtacagagaaagaacagcgggcccaggagaccggcactcagcatacggaggaccagcactggcaccggcctctgagttccctcagtttattgattaccattttcagtgtctcagcaagaggaatgcggtaggagagcagggtgtcagcaagaaaacctgtgagcctttcctttcgctgctgcggccgcagccatgagcatgctcgggcctcagaagaggctcgcctctagtgtcctccgctgtggcaagaagaaggtctggttagaccccagtgagaccaaygaaatcgccaatgccaactcccgtcagcagatccggaagctcatcaaagacgggctgatcatccgcaagcctgtgacggtccattcccgggctcgatgccggaaaaacaccttggcccgccggaagggcaggcacgtggccataggtgagcagaagggtacagccaatgcccgaatgccagagaaggtcacatggatgaggagaatgacgattttgcgccggctgctcagaagataccgtgaatctaagaagatcgatcgccacacgtatcacagcctgtacctgaaggtgaaggggaat

SEQ ID NO: 102967 - DNA, 601 bp, Human
agaagaaggtctggttagaccccagtgagaccaacgaaatcgccaatgccaactcccgtcagcagatccggaagctcatcaaagacgggctgatcatccgcaagcctgtgacggtccattcccgggctcgatgccggaaaaacaccttggcccgccggaagggcaggcacgtggccataggtgagcagaagggtacagccaatgcccgaatgccagagaaggtcacatggatgaggagaatgacgattttgcgccggctgctcagaagataccgtgaatctaagaagatcgatcgccacaygtatcacagcctgtacctgaaggtgaaggggaatgtgttcaaagacaagcggattctcatggaacacatccacaagctgaaggcagacaaggcccgcaagaagctcctggctgaccaggctgaggcccgcaggtctaagaccaaggaagcaggcaagtgccctgaagagcgcctccaggccaagaaggaggagatcatcaagactttatccaaggaggaagaggccaagaaataaaagctccccctttgtctgtacatactggcctctgtgattacatagatcagccatgaaaataaaac

SEQ ID NO: 102968 - DNA, 601 bp, Human
aagggcaggcacgtggccataggtgagcagaagggtacagccaatgcccgaatgccagagaaggtcacatggatgaggagaatgacgattttgcgccggctgctcagaagataccgtgaatctaagaagatcgatcgccacacgtatcacagcctgtacctgaaggtgaaggggaatgtgttcaaagacaagcggattctcatggaacacatccacaagctgaaggcagacaaggcccgcaagaagctcctggctgaccaggctgaggcccgcaggtctaagaccaaggaagcaggcaagygccctgaagagcgcctccaggccaagaaggaggagatcatcaagactttatccaaggaggaagaggccaagaaataaaagctccccctttgtctgtacatactggcctctgtgattacatagatcagccatgaaaataaaacaagccttaaaaaaaaaaaacatgtgagcaaaggaatctgtgtcacaaataagttcaagggacggtactatgcctggatgtgcacgtaggccagatttatgttcctctccacccaaacatctcagtggagtaaagaataataaagcagcattgctgcca

SEQ ID NO: 102969 - DNA, 601 bp, Human
acagccaatgcccgaatgccagagaaggtcacatggatgaggagaatgacgattttgcgccggctgctcagaagataccgtgaatctaagaagatcgatcgccacacgtatcacagcctgtacctgaaggtgaaggggaatgtgttcaaagacaagcggattctcatggaacacatccacaagctgaaggcagacaaggcccgcaagaagctcctggctgaccaggctgaggcccgcaggtctaagaccaaggaagcaggcaagtgccctgaagagcgcctccaggccaagaaggaggagwtcatcaagactttatccaaggaggaagaggccaagaaataaaagctccccctttgtctgtacatactggcctctgtgattacatagatcagccatgaaaataaaacaagccttaaaaaaaaaaaacatgtgagcaaaggaatctgtgtcacaaataagttcaagggacggtactatgcctggatgtgcacgtaggccagatttatgttcctctccacccaaacatctcagtggagtaaagaataataaagcagcattgctgccaacatgtctcacctcccgccacagggcggtttttctc

SEQ ID NO: 102970 - DNA, 601 bp, Human
acatggatgaggagaatgacgattttgcgccggctgctcagaagataccgtgaatctaagaagatcgatcgccacacgtatcacagcctgtacctgaaggtgaaggggaatgtgttcaaagacaagcggattctcatggaacacatccacaagctgaaggcagacaaggcccgcaagaagctcctggctgaccaggctgaggcccgcaggtctaagaccaaggaagcaggcaagtgccctgaagagcgcctccaggccaagaaggaggagatcatcaagactttatccaaggaggaagagrccaagaaataaaagctccccctttgtctgtacatactggcctctgtgattacatagatcagccatgaaaataaaacaagccttaaaaaaaaaaaacatgtgagcaaaggaatctgtgtcacaaataagttcaagggacggtactatgcctggatgtgcacgtaggccagatttatgttcctctccacccaaacatctcagtggagtaaagaataataaagcagcattgctgccaacatgtctcacctcccgccacagggcggtttttctcctatctcaaaactgaacaaatgtacaatca

SEQ ID NO: 102971 - DNA, 601 bp, Human
agcctgtacctgaaggtgaaggggaatgtgttcaaagacaagcggattctcatggaacacatccacaagctgaaggcagacaaggcccgcaagaagctcctggctgaccaggctgaggcccgcaggtctaagaccaaggaagcaggcaagtgccctgaagagcgcctccaggccaagaaggaggagatcatcaagactttatccaaggaggaagaggccaagaaataaaagctccccctttgtctgtacatactggcctctgtgattacatagatcagccatgaaaataaaacaagccttaaaaaaaaaaaacatgtgagcaaaggaatctgtgtcacaaataagttcaagggacggtactatgcctggatgtgcacgtaggccagatttatgttcctctccacccaaacatctcagtggagtaaagaataataaagcagcattgctgccaacatgtctcacctcccgccacagggcggtttttctcctatctcaaaactgaacaaatgtacaatcaggttttataccgagacattcagttcccaggggcaggcaggagacagtggccttcctctatctcaactgcaagaggctttcctct

SEQ ID NO: 102972 - DNA, 601 bp, Human
gctgacaattttctagttcacattttcctgtggtggcataccttgtgtgtccaattccaagatttgaaacatgtcattttttcaaattgtcttcagtaaagacgtgatttacaagacccattcccttgtgtgatttgaatgttggcgctgaactcccgtcactagtcagaataccagcactctcctgaccccggcgctgcggcgtcccagagtgatcacatgcggcacatccagctgcgtgggccactctcctgaggcgatgcaccggaacacgccacattcctctcggatccccgactcmtccagctccaggtcgccgccgaaagcacgtggagggacctgccgctgcggccaaggtgtaagcaccaaccagctgccagctcggcccatcgagctcagaagctcgcgctcgcgacaggcgcttccttcccgaggctggctcccctcttttgttcttaatgtaaattttcaccctaggttaacttgcagcctttagtgtcatttaacagaaaggtagtccccattatcccatcccacaagtatttttctttatattcttgctagtggtgggaagggagtctagtataattgagtagaaggg

SEQ ID NO: 102973 - DNA, 601 bp, Human
actgtctggtcttgcaaaataaacatattcaaagatacaaaaagccatagggtttccttcagaccttgatataatatcaagagttcggacattacgtctggatatttccacaatttctccaggcaagacttcacggtaatatcttgcaccaatagataagaagctacaagattctgaagacaccacccgtccttctgtttccgatgtttttttctctttgtcatttatatcagacgctggaataagacgatcaacgcataagggacgatttccataatgatctcatactgcgtaaataacrtctctgggcattttaagcagggagtatgctgtgggtgtttccttcatcaagtttttaatcctggctacccagtctggggtgtcatcttgttcctgaggaggggtatacgccagtaactgggtaatcacttcactatcagaacttgtggacagatcaataccatgacgcagaagctttttccttaatcgagcagcatttgccaattggccattatgtgccacagctatcttcccataaagtgtttcagcaacaaagggctgacaattttctagttcacattttcctgtggtggcatacctt

SEQ ID NO: 102974 - DNA, 601 bp, Human
ggccacgacggtattttattgtataaaccatttggtcttcaaacatactgtctggtcttgcaaaataaacatattcaaagatacaaaaagccatagggtttccttcagaccttgatataatatcaagagttcggacattacgtctggatatttccacaatttctccaggcaagacttcacggtaatatcttgcaccaatagataagaagctacaagattctgaagacaccacccgtccttctgtttccgatgtttttttctctttgtcatttatatcagacgctggaataagacgatcaaygcataagggacgatttccataatgatctcatactgcgtaaataacatctctgggcattttaagcagggagtatgctgtgggtgtttccttcatcaagtttttaatcctggctacccagtctggggtgtcatcttgttcctgaggaggggtatacgccagtaactgggtaatcacttcactatcagaacttgtggacagatcaataccatgacgcagaagctttttccttaatcgagcagcatttgccaattggccattatgtgccacagctatcttcccataaagtgtttcagcaacaaa

SEQ ID NO: 102975 - DNA, 601 bp, Human
acacagcacctccacatatggaagtccacacttccctgcatgagcaagagcagcaggcgtagcagattctggaacagagctaaccaaatctgcatccatagtgcttcaatagctagctgctggccacgacggtattttattgtataaaccatttggtcttcaaacatactgtctggtcttgcaaaataaacatattcaaagatacaaaaagccatagggtttccttcagaccttgatataatatcaagagttcggacattacgtctggatatttccacaatttctccaggcaagacttcayggtaatatcttgcaccaatagataagaagctacaagattctgaagacaccacccgtccttctgtttccgatgtttttttctctttgtcatttatatcagacgctggaataagacgatcaacgcataagggacgatttccataatgatctcatactgcgtaaataacatctctgggcattttaagcagggagtatgctgtgggtgtttccttcatcaagtttttaatcctggctacccagtctggggtgtcatcttgttcctgaggaggggtatacgccagtaactgggtaatcacttcac

SEQ ID NO: 102976 - DNA, 601 bp, Human
ttgtaggaatgtttattcccatgaagcatggatatttaattggtggtgaagctactggaatgtgttcctcttttgcaccagattctttgagcaattttatgatagttgagatggtattgcctctcacaattgagtcatctacaagaacaattcttttgcctttaaagttgtctgacaatactccaaatttttttgcaacaccaagttgtcttaacctcatgtttggctgaatgaaggttctccctacatatcaggttttacacagcacctccacatatggaagtccacacttccctgcatragcaagagcagcaggcgtagcagattctggaacagagctaaccaaatctgcatccatagtgcttcaatagctagctgctggccacgacggtattttattgtataaaccatttggtcttcaaacatactgtctggtcttgcaaaataaacatattcaaagatacaaaaagccatagggtttccttcagaccttgatataatatcaagagttcggacattacgtctggatatttccacaatttctccaggcaagacttcacggtaatatcttgcaccaatagataagaagctacaagattct

SEQ ID NO: 102977 - DNA, 601 bp, Human
aattagaaatgttcggttggttatcccactttggtatccttttcagaaaaaaaaaatctcaaaacttataaaggtaaacataagcatggcattttacattgtaccaactgagtaacagtaaatagatgaggtgtgaccactataacttcttgaccacctttctatcttgaaactacacacatccaaccctaccagctaccattctaattctacaggatattttccagtgagacaagctgtacaatgaccactcttttcaaaacattccagaccatttccattttcttggatcataatatcrtgctttttctctttctgttttttaaactgtatcccttcttgcacagatgaaaccagtccttctactgacagatacacaacactgtttgctcctagatattctgcaaggtgatcaaattctggtttattggcaatgagctcttcttttgtaggaatgtttattcccatgaagcatggatatttaattggtggtgaagctactggaatgtgttcctcttttgcaccagattctttgagcaattttatgatagttgagatggtattgcctctcacaattgagtcatctacaagaacaattctt

SEQ ID NO: 102978 - DNA, 601 bp, Human
ttgtattatatgcaattagaaatgttcggttggttatcccactttggtatccttttcagaaaaaaaaaatctcaaaacttataaaggtaaacataagcatggcattttacattgtaccaactgagtaacagtaaatagatgaggtgtgaccactataacttcttgaccacctttctatcttgaaactacacacatccaaccctaccagctaccattctaattctacaggatattttccagtgagacaagctgtacaatgaccactcttttcaaaacattccagaccatttccattttcttrgatcataatatcatgctttttctctttctgttttttaaactgtatcccttcttgcacagatgaaaccagtccttctactgacagatacacaacactgtttgctcctagatattctgcaaggtgatcaaattctggtttattggcaatgagctcttcttttgtaggaatgtttattcccatgaagcatggatatttaattggtggtgaagctactggaatgtgttcctcttttgcaccagattctttgagcaattttatgatagttgagatggtattgcctctcacaattgagtcatctac

SEQ ID NO: 102979 - DNA, 601 bp, Human
taaccctaacttcttgcaaaccctttaaagcatggacatggcaaatgtcagtgaccacctgccttctctgaccaggttaaaaaggctagccaatgcttgtgtaaaaaaaagaacaccacatattgttgtattatatgcaattagaaatgttcggttggttatcccactttggtatccttttcagaaaaaaaaaatctcaaaacttataaaggtaaacataagcatggcattttacattgtaccaactgagtaacagtaaatagatgaggtgtgaccactataacttcttgaccacctttcyatcttgaaactacacacatccaaccctaccagctaccattctaattctacaggatattttccagtgagacaagctgtacaatgaccactcttttcaaaacattccagaccatttccattttcttggatcataatatcatgctttttctctttctgttttttaaactgtatcccttcttgcacagatgaaaccagtccttctactgacagatacacaacactgtttgctcctagatattctgcaaggtgatcaaattctggtttattggcaatgagctcttcttttgtaggaatgtttatt

SEQ ID NO: 102980 - DNA, 601 bp, Human
tccctgggaagctgagcgccgcgtagcttcgccggggggagtggggtaggcgcggtgaggccgtgggcccccacacctggcggaccacaggggccagaagccctggagccccgccagggaagggctgcgtcgctggccaggaccgagcgcggtagagcctcagctgctcacggggtcgctggagttgggggtggccccaggagaaattaaaggtgaaaagccttagcagcagagggaagaggaagatggaggcagagcgagtgaccgaacttggaagggacagccgggcgcaacagggcagggggcgtctgactgttggaaacatggctgacgtctggaggctgcagccagtggtccgtaagtcaggtcaaggacccacagaagaccccagcatgtcttcacctggcccacagaagccctgacatccagttacaactgccccagcctagtgagcatttcggcacccactcctcaattcctacccccagcctaacttcgaaggggcggtgagccacagcaagccggaggagaaagttggaagagagagtggacaaaagaatacccacaggcaccttccccacagtggaatagcggggtttta

SEQ ID NO: 102981 - DNA, 601 bp, Human
aggccgtgggcccccacacctggcggaccacaggggccagaagccctggagccccgccagggaagggctgcgtcgctggccaggaccgagcgcggtagagcctcagctgctcacggggtcgctggagttgggggtggccccaggagaaattaaaggtgaaaagccttagcagcagagggaagaggaagatggaggcagagcgagtgaccgaacttggaagggacagccgggcgcaacagggcagggggcgtctgactgttggaaacatggctgacgtctggaggctgcagccagtggtccstaagtcaggtcaaggacccacagaagaccccagcatgtcttcacctggcccacagaagccctgacatccagttacaactgccccagcctagtgagcatttcggcacccactcctcaattcctacccccagcctaacttcgaaggggcggtgagccacagcaagccggaggagaaagttggaagagagagtggacaaaagaatacccacaggcaccttccccacagtggaatagcggggttttagacaatcaaggataatcacctcttcctatcccagttcagaaacggatgaaaaagaca

SEQ ID NO: 102982 - DNA, 601 bp, Human
ctcaattcctacccccagcctaacttcgaaggggcggtgagccacagcaagccggaggagaaagttggaagagagagtggacaaaagaatacccacaggcaccttccccacagtggaatagcggggttttagacaatcaaggataatcacctcttcctatcccagttcagaaacggatgaaaaagacacagcaataagatgggtgggtatcaaaatatcagctttgccacaaattaaaaacctagcttgaaggacaaggcttaaatctgcaagcaagagggcaagctactaaatcacccgtaagtcagacaaacatatcccccagcctctaggccatgaaactgcctcaccaagcactatgcaattgagtgcccaccagaagacacccctccagtcaacccacagaccccagaaagagtacccagaggagcctgagcacactccaccctatctgttctctgaaattcaatcaaatgagtcactctacttctctggaagcagaaagaggctggaagtttttctccaggtaagttcctccatgtagaaacatgaagaatagggataaggggcttcagcctggatggaatctcacactgaacct

SEQ ID NO: 102983 - DNA, 601 bp, Human
tttgtgaggaacagtatgaccatagatcccctctcctacttgggtggaggaagtctccagtagttgaatcagagtaggtgttacctcaggcatgaggcatagctgaggaccactgaaagcagacagattgagttaaagtctacacatgtgggtccaggctcacttctcccacttagccagatagcatgagatagtgggaggatccctctggagcagctggcccacaagagtcctgcaaacactggcaactatgacctagtagaaaaacaaacctattagctggcagactgtacccattgayagtttccaacaagcaccatcatcagcatgagccagacatttggggaaaacagtgcaacattacctccagccatgcaagtgatccatcttggaccactgacccagtcaagccttcagatgactataacctcagccaatacctgactgcagctgcatgagagatcccaacagaaagctgcccagctgaatcctcctcaaatttaagctactatatttggggtaatttgttcaatagcaacaaaaaaactagaaaaaaggactacaaagtgcccagcacaataaattgggcaggggttgggga

SEQ ID NO: 102984 - DNA, 601 bp, Human
gtggaggaagtctccagtagttgaatcagagtaggtgttacctcaggcatgaggcatagctgaggaccactgaaagcagacagattgagttaaagtctacacatgtgggtccaggctcacttctcccacttagccagatagcatgagatagtgggaggatccctctggagcagctggcccacaagagtcctgcaaacactggcaactatgacctagtagaaaaacaaacctattagctggcagactgtacccattgacagtttccaacaagcaccatcatcagcatgagccagacatttgrggaaaacagtgcaacattacctccagccatgcaagtgatccatcttggaccactgacccagtcaagccttcagatgactataacctcagccaatacctgactgcagctgcatgagagatcccaacagaaagctgcccagctgaatcctcctcaaatttaagctactatatttggggtaatttgttcaatagcaacaaaaaaactagaaaaaaggactacaaagtgcccagcacaataaattgggcaggggttggggagggaatggggaggcaacatatgaagtaatgtcattgagaaatt

SEQ ID NO: 102985 - DNA, 601 bp, Human
ctccagccatgcaagtgatccatcttggaccactgacccagtcaagccttcagatgactataacctcagccaatacctgactgcagctgcatgagagatcccaacagaaagctgcccagctgaatcctcctcaaatttaagctactatatttggggtaatttgttcaatagcaacaaaaaaactagaaaaaaggactacaaagtgcccagcacaataaattgggcaggggttggggagggaatggggaggcaacatatgaagtaatgtcattgagaaatttgagaacaccaggaatagagrtgatctcaaaaatttccagcaacaaaaaaagcaaaaacacaaaggaacgatttccaatctaaaattctattctcattcaaatgatgaatcaaacgtaaggatagataagtccaaaaaacaaaaaaaaaccatttctttactctcacaacatccttttggcaccagatgtagagaatttctccccaccgacaagcaagcattcagctgtacagcagacaccagctgggtatccgcttcaatcctgcaccgtctacctggagatagcagcagatcacacaagttgaggactctgtgccgcaa

SEQ ID NO: 102986 - DNA, 601 bp, Human
accttcctggaagcccccacacatttggctatccacaagctctctgaaccctgtccttttgggtttttaggagccctcattacataggcatgattgattaaatcattggccactggcgatcaacgtcactttcagtccctctcccccaacctctgggagtttggggggtgggctgaaagtttcaacccctctaatcatgccctggtctttcagatgtccagtccctatcctgaagctacataggagctgtccgccatcagtcatcttactagcatacaaaaagacatcactttagagatcycaaggattttaggagttgtatatcagaaggcagagacaaagaccagatatatatttgataatattacagtagaaataaagacattttagatattcaagctcaggaggctactaaaggacaggctccatcaagaagagaaaaccaagcaagaggaaaatatgattcagaatccaggaaatgtccaagttatggcaagaagacagggggttctcaggaacatctcgaagagaaagtggagcatattacctgatgcacatgactttgttgggaagagctttacatttagggcagcgacttttg

SEQ ID NO: 102987 - DNA, 601 bp, Human
gacatcactttagagatctcaaggattttaggagttgtatatcagaaggcagagacaaagaccagatatatatttgataatattacagtagaaataaagacattttagatattcaagctcaggaggctactaaaggacaggctccatcaagaagagaaaaccaagcaagaggaaaatatgattcagaatccaggaaatgtccaagttatggcaagaagacagggggttctcaggaacatctcgaagagaaagtggagcatattacctgatgcacatgactttgttgggaagagctttacayttagggcagcgacttttgggtaaagtagtgacaagagcatagaaaaccaagcaaatgagaaaaacaatgtaattaactccaggaaaaatcaaaagttgtacctaaaggaaatgtaatcataaaccaataaagggctcaacaggaaatggtaaacatacagttatactaaactgtgaatgcaggtttcagccaatatcaaactgcttagggagactaataggagaggaaatgtgggtgtcgagggtgggggtgataatatgttgtgggaaagacagtgtaagagaagctaactcctcttcc

SEQ ID NO: 102988 - DNA, 601 bp, Human
ctgagttgagtagtgtgtgtttggagaagcagggattgatttggtggaggaagaggttctcttcttagtgctgttgttttctcagtgaaataaggaggacatgatctaagaatgttggaggtttgaagagaatgagaagacatgaaatagagtctggggatgtaggattacagtcaggagatgctgagtgccagtttaagattggtggtcatacgcaacatcaccaagtctattaatacctctttctgtatatggctcaaattttatcccctctcttcacaccaattgctaacaaactcasgcttattccctttgaatttcacctggatggctgcagcacccacctctcaagattcctgccctacatgccattcttaaaagaaaatgtgaccagatcacttctctgcctaatcttcaacaacgggttctcacagctctcagaagaaggtgacaagaatctctgacctcaccctgctggcctgttcccctcacctggccacacaaccaagctggtacctccacgctttcatcatgtcctctcaagtacactgtctccagctacacccctgcactcctctccgggaattctgtttctcctcta

SEQ ID NO: 102989 - DNA, 601 bp, Human
ctaccaattcaggcccacgcctcatgcacattctctgagaattatgtacataagtacctgactctcctggatgtaagctgggtgggcttagcaggcagaggccctgtgtcttactttatctctgcatcactgatgtctggcacatcaaggactgcaagtttgctgagagaatgaatcgccttttatacatggaaatgtaagctctaaactgcctcagagcatatgctggtgggtgacaatctgaggaggtcatgaatataggagaatattgaagaggtcacacaggggaaacaacttttcmttatgaaaaactgggagactgacatttaaatggtttatctgcatgattaaattaatcacatttccaacagtgcatcaagcatctgagaataacattattttgagtaaaaacagaaactcttcgggagagaccccctccccacaggtcaggctgctcaaatgtccaccatgtctagcagcgcagagagatggagctcagaggcaacttcctcttcccttgaactccggatcagcctttccaggtgctttagtcgttcgcctagacacgttcctgtcgcctctgacagctgcagttgctccc

SEQ ID NO: 102990 - DNA, 601 bp, Human; identical to SEQ ID NO: 29101

SEQ ID NO: 102991 - DNA, 601 bp, Human; identical to SEQ ID NO: 29100

SEQ ID NO: 102992 - DNA, 601 bp, Human; identical to SEQ ID NO: 29099

SEQ ID NO: 102993 - DNA, 601 bp, Human; identical to SEQ ID NO: 29098

SEQ ID NO: 102994 - DNA, 601 bp, Human; identical to SEQ ID NO: 29097

SEQ ID NO: 102995 - DNA, 601 bp, Human; identical to SEQ ID NO: 29096

SEQ ID NO: 102996 - DNA, 601 bp, Human; identical to SEQ ID NO: 29095

SEQ ID NO: 102997 - DNA, 601 bp, Human; identical to SEQ ID NO: 29094

SEQ ID NO: 102998 - DNA, 601 bp, Human; identical to SEQ ID NO: 29093

SEQ ID NO: 102999 - DNA, 601 bp, Human; identical to SEQ ID NO: 29092

SEQ ID NO: 103000 - DNA, 601 bp, Human; identical to SEQ ID NO: 29091

SEQ ID NO: 103001 - DNA, 601 bp, Human; identical to SEQ ID NO: 29090

SEQ ID NO: 103002 - DNA, 601 bp, Human; identical to SEQ ID NO: 29089

SEQ ID NO: 103003 - DNA, 601 bp, Human
gatttagtattgtcagacccaccactttgagaagaaatgggtagggggaagttagggcagggacctggcattcgtaagtgaggccactaaaaagaagcaagatggcttcagggaattaagatgggatcttccctattcaagccacaagccaaaggccagagctcacagttttcactgtattctgaaatggaaagctgtcaagaacttagaacaataccttccacctcacttccaaatcctcacccttcccaacacgatgtttactaaaacctcagagatacatttcatgtctcagttcccyagctggttttctgagtttcttaaatgtgggttttagtttcatttatacatttgggattcctctaaaccaagattttctttgtaggttactttttttcataatgctctaaaaattcaaaacccctatcagaggtctcagctgctgaacatacacattaggtcagagacagatacacggcatgcctttctcccattctgggctgaggctcctggagctcagcctcttttctccctcccatgtctcagcatctcctacaactctcagtctcatccagcgtgagcactggggagctattcaatg

SEQ ID NO: 103004 - DNA, 601 bp, Human
ctaggcacagaatgaaacctcctgctttgcttcctaaagtagacatgctggccgtgagaccaaagttagttctgaccatgatttgtataccacaaagaccgaggggctgtgtcagctgctgttccatctcaaagagtgttgccttttcacagccctgccttgctcaccccacccttgggcaggacagcccagcacccgcctcagaccacttgttcatcatctatatatacacgatttgcagcactcgagggagatttagtattgtcagacccaccactttgagaagaaatgggtagggggmagttagggcagggacctggcattcgtaagtgaggccactaaaaagaagcaagatggcttcagggaattaagatgggatcttccctattcaagccacaagccaaaggccagagctcacagttttcactgtattctgaaatggaaagctgtcaagaacttagaacaataccttccacctcacttccaaatcctcacccttcccaacacgatgtttactaaaacctcagagatacatttcatgtctcagttccctagctggttttctgagtttcttaaatgtgggttttagtttcatttatac

SEQ ID NO: 103005 - DNA, 601 bp, Human
gagctgagattgcgccattgcactccagcctgggtgacaagagtgaaactccatctcaaaaaaaaaaaaaaaaaggaatgaagtaccaatttatactgttatgtggctgaacctcaaaaacattattctaagtgaaagaagccagaaacaaatggctacatagtgtatgactctatttataccaaatggacaaaataggcaaatccatggagaccaaaaatagttcagttgttgtcccacgctgggtgctgagacaaaatgaggaacgactggtaatgggtacagggtttcttttgagagygataaaaatgatctaagatcgatttgggtgatggctgcatagctccgtgagtatgctaaaaaccattaaattatatacttcaaaagggagagttttatggtatatgaactctattttaattaaaaatttaaaaagaaaaaaaaaacccatttcaaatttcaaagacaggctaaggcttgtaagtgacagggtcccaatcaacttgataaggtgacagtccatggaatttccagaacttcagctacactaggcacagaatgaaacctcctgctttgcttcctaaagtagacatgctggccg

SEQ ID NO: 103006 - DNA, 601 bp, Human
tttagtctcactcacagctatgacttattacagtgaaacacactcagcaaagaaaaaaggcacatgaggcaaagtctagaggaaactaggcacaagcttcaagtcctcttccagggaagtcacataggatacttacttctcccagcaacgagttgtgtgacaatacatgtgaaatgctgctaactagggaagctcattaaagcctcattatccagtttttatttggggctggtcaggtaggtactatctgtctggaacatatcaaaattccaggctcccagaaaaaaaaaaacaaacccargggtttatcatcaaccataatgtttgtctaaacggtttaagcatagtaagccaattctgggaatagtgagaacacttcagaaatcaaagttcccagatgccagccaagggctagacttataagcaggcctttcaaagaatcacagccaggccagctttgttaactgttttctgcaaagaggcaggagaggtgaacctcacagccttcttctatcaagggggctgacagctcctactaggaaagcaagatcccctgggccaatcaaagcaagatacctgcaacatcaaagagcatactgct

SEQ ID NO: 103007 - DNA, 601 bp, Human
gcaaggataaatggacaagtatggtgagctgggcggctgggaagtacagtaagtcacctgccaccaggccttagctatttagggaagcaacaaagccaacaggacctggacacaagggggagatagaaatccatactctagcaatccccgtgaggtagagcaagggaagtgctaggagaagaggttgtggtcagtatggtgactcggaaggagcaggcaacaaactcctgagtgtggcccctgaggtcactggctcatgtagagctgagttagagggctggagctgaagagatcccagagmtgagtctcaagggtgcagtgagatgggcttggatgcggacatccaaagctacaagaggacagtgagcaggccagagttcaaggggaacacagggctgagaccagcacatgcaggcatcagggaggccctctgagtcatgctgtccactgtgtgtaaggaggggactaagagaacttgaaggagatagctccgtgcagccgacacggtcctagatacttctacatgctctctttggttcttgctgaaaatctctaaagtaggtgttatcatggaaaaactttacctaccttgtttcagttt

SEQ ID NO: 103008 - DNA, 601 bp, Human
atcacctggtagattttacagatctagtggttcactagattgatgagctgtcaaaatggaaaatgtgccccccacaaagaaggctgagtccctaccaaaagtgcgcatcgagggaaaggattctcctcgtctgttacgggggcagccccttactctaagctctggagcaggctcttgtagactgtaccacagccctccccatcttggggatgcacctgttcctttgtccatcatcatcccacaaggctccttgtggacaggggccatacttgtcaattctggttctgtcactctttccccrcccagagtatgggagatgttcagaaagcgtgtgctgaccacaaaatgttgagaagaaattccaacacaaggcaggaagggggggtctgtgtaacccccaaagcctatgattcaataaagtggttcacatataaactaaaggtgatcttactgtcaagcaatatcatttcagcatattttatacctggctccatcaactgtgaggcggaatcaaaagggtcgaggtaagggaaaagcttctcgcctgcctccggaagtgaagccgtccttccaggaacatagaatatcaggggaacatggg

SEQ ID NO: 103009 - DNA, 601 bp, Human
gttaaggatggattaaatgcttaagtccagaaagggggcaatctggtttagcatagttcatagaagaggcactccaaaaagagcaaacgtcatacgtcatttcagagacagtgtacaacctgtccctgaaatgcactgggcagatcaagtcaggatagaactcacaagaacccatacaggttgcccacacatccaggaggggtatctggtccaactggtattctggaagtgctttctcaaactgaaactttttggaagacagagaccaggacaaccacgcgtctaaacactaccttgtgaygaatggttgaagggctggggatttcagcctagagaagagaagatattggtggatggacagggtcgggggcatcagtgctgttttcaaagctttgaaggactggcacatggaagtcaaagtaaacttgcccttcactgctggggagggcagagtagaatcacctggtagattttacagatctagtggttcactagattgatgagctgtcaaaatggaaaatgtgccccccacaaagaaggctgagtccctaccaaaagtgcgcatcgagggaaaggattctcctcgtctgttacgggggca

SEQ ID NO: 103010 - DNA, 601 bp, Human; identical to SEQ ID NO: 103003

SEQ ID NO: 103011 - DNA, 601 bp, Human; identical to SEQ ID NO: 103004

SEQ ID NO: 103012 - DNA, 601 bp, Human; identical to SEQ ID NO: 103005

SEQ ID NO: 103013 - DNA, 601 bp, Human; identical to SEQ ID NO: 103006

SEQ ID NO: 103014 - DNA, 601 bp, Human; identical to SEQ ID NO: 103007

SEQ ID NO: 103015 - DNA, 601 bp, Human; identical to SEQ ID NO: 103008

SEQ ID NO: 103016 - DNA, 601 bp, Human; identical to SEQ ID NO: 103009

SEQ ID NO: 103017 - DNA, 601 bp, Human
atgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagrggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaa

SEQ ID NO: 103018 - DNA, 601 bp, Human
tatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaaggggatgggggtaacatactctgcaagaaatatgacagttgtcagctttaagaaaattttagctgaagatacagatccttatatgaacrtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataata

SEQ ID NO: 103019 - DNA, 601 bp, Human
cagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagamgatagaattccataactttgggggagactaataaacatgcttatccagatgatttccctgtcaacttcttagattgagactgcaaaataaatttgaaggacctttcataaaaccatctatcttcactgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagtt

SEQ ID NO: 103020 - DNA, 601 bp, Human
ccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagartggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcac

SEQ ID NO: 103021 - DNA, 601 bp, Human
ttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtggragagaagctatctctccagctgtaagtttcctttccctgggatggtatgtggaatgccacgtttaagaggtaacatccctctcaccgtcactaaatagtatctctggaggtatttggaagcgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcc

SEQ ID NO: 103022 - DNA, 601 bp, Human
ttttagaaacaacctgcccaagagagcgaaggttggcatgcagttccaactgcctttccactttgcttctctgggtcaaggcatgccagaaggaggcatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactsctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaag

SEQ ID NO: 103023 - DNA, 601 bp, Human
aagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaarccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattct

SEQ ID NO: 103024 - DNA, 601 bp, Human
tattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtggrccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctc

SEQ ID NO: 103025 - DNA, 601 bp, Human
gtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaraggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattt

SEQ ID NO: 103026 - DNA, 601 bp, Human
ctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggt

SEQ ID NO: 103027 - DNA, 601 bp, Human
ggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagaygttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgaca

SEQ ID NO: 103028 - DNA, 601 bp, Human
gagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcrtggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattatt

SEQ ID NO: 103029 - DNA, 601 bp, Human
tttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggakaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggttggtttttctctaggaggtgttgttggtttggagaggctcatcaactccatgatttattatttt

SEQ ID NO: 103030 - DNA, 601 bp, Human
aggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcargggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctct

SEQ ID NO: 103031 - DNA, 601 bp, Human
aatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgmacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctgg

SEQ ID NO: 103032 - DNA, 601 bp, Human
ttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgsctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcag

SEQ ID NO: 103033 - DNA, 601 bp, Human
aaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccacgcctgactcctgagtcccaatgcttaaccatattatctcgatataaaagrgcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaacccc

SEQ ID NO: 103034 - DNA, 601 bp, Human
aataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgakccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatct

SEQ ID NO: 103035 - DNA, 601 bp, Human
gatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaasctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatca

SEQ ID NO: 103036 - DNA, 601 bp, Human
aagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttrgtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgt

SEQ ID NO: 103037 - DNA, 601 bp, Human
agtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggmttcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagta

SEQ ID NO: 103038 - DNA, 601 bp, Human
tccattgtggtcatccagatgagaagtgatggcagctttggactaagctggagatggagaaaaagaggtggagttgaagtatactttggagacagaattgacagaacttggggacagattgactgtgggatgtgaaggagaggaaggattcatggatgattactatgtgtttggcttgagagattgggtaagatggtaagatggtgatgccatttactgaggtgactggacaggaggagacttagttttgaggagcagagatcttgcctacctctaaacacccacagaacccttctgtccrtgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggta

SEQ ID NO: 103039 - DNA, 601 bp, Human
ccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaayaggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccatt

SEQ ID NO: 103040 - DNA, 601 bp, Human
gaggtgacagctggcagggttgcttttgctctgaccttctattgctttttatcaagctccttgagggaattaaccctcactaagctgaatatctagtttttaatgaataggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggtygttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaag

SEQ ID NO: 103041 - DNA, 601 bp, Human
ctaagctgaatatctagtttttaatgaataggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgamttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtc

SEQ ID NO: 103042 - DNA, 601 bp, Human
aattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccytcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatc

SEQ ID NO: 103043 - DNA, 601 bp, Human
ggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacayccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttc

SEQ ID NO: 103044 - DNA, 601 bp, Human
aaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactamgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcataca

SEQ ID NO: 103045 - DNA, 601 bp, Human
gaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcatttkcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgc

SEQ ID NO: 103046 - DNA, 601 bp, Human
tatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaaktgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatg

SEQ ID NO: 103047 - DNA, 601 bp, Human
agagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagasaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggca

SEQ ID NO: 103048 - DNA, 601 bp, Human
ccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaycagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatac

SEQ ID NO: 103049 - DNA, 601 bp, Human
tgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccgrcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaacccta

SEQ ID NO: 103050 - DNA, 601 bp, Human
agcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgwtcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataa

SEQ ID NO: 103051 - DNA, 601 bp, Human
tctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagamtcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatcta

SEQ ID NO: 103052 - DNA, 601 bp, Human
ctgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacayccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaa

SEQ ID NO: 103053 - DNA, 601 bp, Human
ctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcmgctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaa

SEQ ID NO: 103054 - DNA, 601 bp, Human
attaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgg

SEQ ID NO: 103055 - DNA, 601 bp, Human
tactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcrtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatac

SEQ ID NO: 103056 - DNA, 601 bp, Human
accttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaat

SEQ ID NO: 103057 - DNA, 601 bp, Human
agaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtgggkttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaag

SEQ ID NO: 103058 - DNA, 601 bp, Human
tgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgrtactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttg

SEQ ID NO: 103059 - DNA, 601 bp, Human
tagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacraatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattc

SEQ ID NO: 103060 - DNA, 601 bp, Human
gaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaaca

SEQ ID NO: 103061 - DNA, 601 bp, Human
cctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatccacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaa

SEQ ID NO: 103062 - DNA, 601 bp, Human
ttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcacgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttata

SEQ ID NO: 103063 - DNA, 601 bp, Human
gtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacatyggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccatttttt

SEQ ID NO: 103064 - DNA, 601 bp, Human
ttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccmttttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataat

SEQ ID NO: 103065 - DNA, 601 bp, Human
tgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaatacygcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatggg

SEQ ID NO: 103066 - DNA, 601 bp, Human
cactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtaktacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctccta

SEQ ID NO: 103067 - DNA, 601 bp, Human
ttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattayagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattccctta

SEQ ID NO: 103068 - DNA, 601 bp, Human
gtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagayacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggcc

SEQ ID NO: 103069 - DNA, 601 bp, Human
tgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacrcagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggcca

SEQ ID NO: 103070 - DNA, 601 bp, Human
gttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacasagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaa

SEQ ID NO: 103071 - DNA, 601 bp, Human
taggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaatyaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaag

SEQ ID NO: 103072 - DNA, 601 bp, Human
tgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgygtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggt

SEQ ID NO: 103073 - DNA, 601 bp, Human
tttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatrtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatct

SEQ ID NO: 103074 - DNA, 601 bp, Human
aagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccrtggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaaca

SEQ ID NO: 103075 - DNA, 601 bp, Human
ctgtttatcatctgcagttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgytggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggca

SEQ ID NO: 103076 - DNA, 601 bp, Human
aagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttggaagaaagaagagaraaaaaggaatgataaagagtttgtacaatagagaagcagttttcagtcccagctcttcatcttgtaaagctagtaaagtgaagattataaaatttacttacaagatgaaggttatagcacatagctcacttttattatcatttcaaaggtcataaaatatattttattattaactcagaaaatctagttctttattattacagataacaagagcattgtatattatttgatgtacgtattttgcagtgctttttatatgtctgttttcctcttgttgctaatttactttcattaacttca

SEQ ID NO: 103077 - DNA, 601 bp, Human
ctgacacagccacagtccattagcctcaatacaatggcacagtgtaatttccataaattactgtatttttctccacattgtcaagtagacaatgcataaactaccattagtattcacagcagcaaaatatacctctttccatatcaaactgtgattctggaattactccaaagtcagttttctccttggtctggcaaaacctcatcattccaaataaaaatgacagtcacagttctgtcccaaatgaacaacagataataaacaataattatacaaatatgtttggttttcatgccactayatttctcagtgtttggagaaaatttgtaccttctataacttgcacaccattttggattttcttatacaaaatacgggtattttatactacaaaaatgtgggtatttctctcctagtgtataagtttaaatgttttattttctattctgcctctctgtgcctcagtttctttatctgtaaaatacctctgtttgcttatctttaaaatagtacctaaccatagggatagagaattaaaatagttggcacaggtaaagcaattagaacagagtctggcacacaagaagtgctcaataagtat

SEQ ID NO: 103078 - DNA, 601 bp, Human
tttcttcctatactgccaatctcgctgctttcctgactgtggagaggatggtttctcccatagagagtgctgaagacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctactycattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacata

SEQ ID NO: 103079 - DNA, 601 bp, Human
ctggtagaaggttttatgagaacttaaatgctctcttctggaaataggcagtaattctagaatcccagaaaatttaaatccatgtcaatttgatatgtttggacagttgacagggaaatagtactgttttaattccatgtatatagggcataaagacacatattaaaataagaaataaggaccagatcagaatgaagcaccataatgttaatgaaagcaataagttcaagggataattttataaaactgtcattagagtatttgccaaagagagagttgcattatctctatcatatctctyatttcactataccagagcctgcataactgcagtgattattttaggacttaagacaaatactttatttattctaagaacacattgatatacaacttatatatcacatataagaagtcaattgtctctttttgtattagttttgatcagttagctgatgaagtctttgagtcttaccccaatgccggatgccagatttcttttccagatacttggccatatccccattacagaaagtttgggggataaaaggaattcttttttaaaaatgaaatgtttaacattaatttaaacctctttaag

SEQ ID NO: 103080 - DNA, 601 bp, Human
tcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaamcttgataagaattttttccccaaaagcctactagatgatgtcctgcagtcagattcattctagtcttcaacatcattcacactttggtcagagagtaaatgtattgaatgtttatcatagcaatttaggcaccaggtatacagtacaggaaacattgacagaacccttaccttcaaggagcttgcattctgttggaaggagacaaaccataaacacataaaaaatagatgtatagaataattccaggtacggataggtgctccaggatgctataataaagaatgacttagggttagaaaa

SEQ ID NO: 103081 - DNA, 601 bp, Human
atagcctgatttatttgactctcaactttacttcctttgagtctggtctgggttacagactattatttttatgagaaatattttattttgtttttttttttaattaaggtatgttacaaataaaacttacatatcctgtcattcttggcaatatgaattcaccttgagggcattatgctaagagaaataagtcaggtattgaatgaattatctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtccagtacccaatagttatcttttctcctctcctctccctcttccaacctttcatcctcaagtagaccccaatgcctgttgttcccttctatgtgttcatgtgtgctgatcatttagctgccacttataagtgggaacacatggtatgtggttttctgttcctgcatcagtttgctaaggataatagcctccag

SEQ ID NO: 103082 - DNA, 601 bp, Human
agagattttagatcaatgtaagaagaacattctaatatagcaatccatagataaaatgagctatattcatagatagtgaggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttraagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctctgtgttcctgtcagggattgagaaaaaggaaaaacctttcctctaatcaacagggacca

SEQ ID NO: 103083 - DNA, 601 bp, Human
ggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttgaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctctgtgttcctgtcagggattgagaaaaaggaaaaacctttcctctaatcaacagggaccagtgggagataattgtttcaggggctggaatctgaggtcgaattggcactgtcgcattgatgctttgccaaaggtttagg

SEQ ID NO: 103084 - DNA, 601 bp, Human
tgccccacctcaagatgctaattccatgcatctgtgtttttccaataatctgtgtttttgaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctstgtgttcctgtcagggattgagaaaaaggaaaaacctttcctctaatcaacagggaccagtgggagataattgtttcaggggctggaatctgaggtcgaattggcactgtcgcattgatgctttgccaaaggtttagggagccccaaatgaagatctctatagggaagctcaagtaatggtatctggctgaagactatgaacaataacacaccctgaaaactaaaagtaagagcaaaattaaactgcaaagagagaaatcatggccaaaagccttgaaaggtttacaattttgatcttct

SEQ ID NO: 103085 - DNA, 601 bp, Human
gacataagcaacttcataaaaagaaagaagaaaatggagtagaggagcagactggtcaggagcttggcaacttatgccaacctaaagaagctgtcccactggccctttctgagacctaagggtctcaggtggtgaggacttctatgttggtgtttttacagaggttttaggatggacaaaaagaagagctacccttcacaaaggaaagttcattaaaatatggttggaagctatgggcaagagaaaggtccttaaaaatgaaaagggacagaatgagagattgcaccaagagctttgaacycttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggatgtaaatgttatcaggaaaagaaacagattttaaaactgatacagaaggaaaagaaccaggagccaggaaattcctgccct

SEQ ID NO: 103086 - DNA, 601 bp, Human
tggttggaagctatgggcaagagaaaggtccttaaaaatgaaaagggacagaatgagagattgcaccaagagctttgaacccttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggaygtaaatgttatcaggaaaagaaacagattttaaaactgatacagaaggaaaagaaccaggagccaggaaattcctgccctgtagccagaagcacaaccctaatgcacaactccttattccttactccctttctctttgcctatttgacctgctgggtgtgggcattgggtaatcaatgcagttgcattcatttacaaaggcactgaggagaccaggggtccaaccttccccacacagaagacttgtgggtggacagccccaagtgactgaatggcagggtgaagcctcctgagagtaagt

SEQ ID NO: 103087 - DNA, 601 bp, Human
cttgaaaataggttctgcaacttttacactgttggtgggactgtaactagttcaaccattgtggaagaagtcagtgtggcgattcctcaaggatctagaactagaaataccatttgagccagccatcccattactgggtatatacccaaaggattataaatcatgctgctataaagacacatgcacatgtatgtttattgcgacactattcacaatagcaaagacttggaaccaacccaaatgtccatcaatgatagactggattaagaaaatgtggcacatatacaccatggaatactaygcagccataaaaaaggatgagttcatgtcctttgtagggacatggttgaagctggaaaccatcattctgagcaaactatcaaaaggacagaaaaccaaacaccacatgttctcactcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacatatgtaacaaacctgca

SEQ ID NO: 103088 - DNA, 601 bp, Human
tcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacatatgtaacaaacctgcacgttgtgcacatgtaccctagaactgaaagtataataaaaaataaaaaataataaaaaaagaaaataggttctgcaatctaaaggtgaaggtacatagcaaagtcaggttttcaaaacacacacacacacacacacacacacacaaacttctcctccatacccaattaatgtgtccaccattaggctatcattcctttagctgtggtttgatcctgtgaggagatcacacttttgtatattgttcatcatttctacctcagtgtgaatgtttccaattcttttctgagcacaggatggggtggggagggcatcttttacctgataaggcaaatgaaagagaggtggtactacccacgcaggggagtggaaaatgaggagcatctgtgaaaataaaagttgactcacagtcttggct

SEQ ID NO: 103089 - DNA, 601 bp, Human
agcagactctggagcctgaatgagttcccagatccaccacataccagctgtgtggcattaagcaaactacttaactcctctgtgcctctgtttctgcatgtttaaatggggtaatatataatagtataatctatttcatagagttgttgtgagaattacatgagttaacacatgtaaaacccttgaaatggacctggaacaaaaagtatgtattcaattaaatgttagttatgatgggttttcttacttaaagatggcttaatcaaagtccatatagcagagtttctcaaccttagcaccrttgacatttggggccggataattactggtggtgggggctgtcctgtgcattgtaagacatttaacagctccgctggcttctacccactagataccagtagcactcctctccccaagttgtgacaatgaaaagttgttgccaaacgtctcctgagaggcaaagttgttgcttactgagagacacaggggtagagggtactgtttcccttcctccattctcccagaatagagcaatggtaccttagaaacattttctgaaagaatgtgttgactctagctttcaaagtcacatggccactgg

SEQ ID NO: 103090 - DNA, 601 bp, Human
tttatactgagggggtagattcatggaaatgagtgagtaggctaaagcccactatggcacctcttggcattgccactgcacttaccctcccttaccctcagttccatcttttataaaatgggaattcattctttcattcaatatatatttatggggcactactgggcacacacactgttctcagtgctggggagtaagcagtgaaaaaacaatagctactgcacccacctcacagggctgctgtggggtttaaatgagatggtgtgtgttaaatcaccctggcacccagaaagctttatgsaaatataaagtttaaagatattcagctatctcctgcttctagtcatgacaaatctaaggcctctctgaataagggagtatttgaaaagttgtatggcaggtaattctcaccacaaaaatctcctcttcatgagtctaaaccaagtgcttgagatttccacagttggagtcttaacttaaagaacttaatttctgtagacctgagacttgtgactacattaaagaacttcagaatgggcccaccccagccacaccttacccctcccttatagtcctaccccacccaccctagtaggacatg

SEQ ID NO: 103091 - DNA, 601 bp, Human
taattaaagaaccgttgtacattaaaaaaaagaaccgttgtaaaaagggacagaattattttacatagctctaggggatagtaccgggggtgggggtgtggattaaaatactacctattgaatacaatattcacaaactaggtggcaggatccgtactccataccttagcatcacacaatattcctatgtaacacatctgcaaatgtaccccctgtgtctaaaataaaagttgaaattgtaaaaaggaatgggagttatagaaaaacaaagatcatctcagaataaggaggtactttcttrcaataattgatatctcatgctggactgggctgactaaaatagctgtacactaccttataatggtctttgattaggcatatcctgctacgattagataaacatagcaggatattgtagaggagattttttcattgagaggaaggttgaactaacaaagtgtttttcaaataagattgcaaccaattagtggggccatgaaatccatttagtgggtcctgagcaacattatttaaaatgaattagaatagaatagaaaatatcagagagcatcacacatagcaaggatgagtgtggttttga

SEQ ID NO: 103092 - DNA, 601 bp, Human; identical to SEQ ID NO: 103017

SEQ ID NO: 103093 - DNA, 601 bp, Human; identical to SEQ ID NO: 103018

SEQ ID NO: 103094 - DNA, 601 bp, Human; identical to SEQ ID NO: 103019

SEQ ID NO: 103095 - DNA, 601 bp, Human; identical to SEQ ID NO: 103020

SEQ ID NO: 103096 - DNA, 601 bp, Human; identical to SEQ ID NO: 103021

SEQ ID NO: 103097 - DNA, 601 bp, Human; identical to SEQ ID NO: 103022

SEQ ID NO: 103098 - DNA, 601 bp, Human; identical to SEQ ID NO: 103023

SEQ ID NO: 103099 - DNA, 601 bp, Human; identical to SEQ ID NO: 103024

SEQ ID NO: 103100 - DNA, 601 bp, Human; identical to SEQ ID NO: 103025

SEQ ID NO: 103101 - DNA, 601 bp, Human; identical to SEQ ID NO: 103026

SEQ ID NO: 103102 - DNA, 601 bp, Human; identical to SEQ ID NO: 103027

SEQ ID NO: 103103 - DNA, 601 bp, Human; identical to SEQ ID NO: 103028

SEQ ID NO: 103104 - DNA, 601 bp, Human; identical to SEQ ID NO: 103029

SEQ ID NO: 103105 - DNA, 601 bp, Human; identical to SEQ ID NO: 103030

SEQ ID NO: 103106 - DNA, 601 bp, Human; identical to SEQ ID NO: 103031

SEQ ID NO: 103107 - DNA, 601 bp, Human; identical to SEQ ID NO: 103032

SEQ ID NO: 103108 - DNA, 601 bp, Human; identical to SEQ ID NO: 103033

SEQ ID NO: 103109 - DNA, 601 bp, Human; identical to SEQ ID NO: 103034

SEQ ID NO: 103110 - DNA, 601 bp, Human; identical to SEQ ID NO: 103035

SEQ ID NO: 103111 - DNA, 601 bp, Human; identical to SEQ ID NO: 103036

SEQ ID NO: 103112 - DNA, 601 bp, Human; identical to SEQ ID NO: 103037

SEQ ID NO: 103113 - DNA, 601 bp, Human; identical to SEQ ID NO: 103038

SEQ ID NO: 103114 - DNA, 601 bp, Human; identical to SEQ ID NO: 103039

SEQ ID NO: 103115 - DNA, 601 bp, Human; identical to SEQ ID NO: 103040

SEQ ID NO: 103116 - DNA, 601 bp, Human; identical to SEQ ID NO: 103041

SEQ ID NO: 103117 - DNA, 601 bp, Human; identical to SEQ ID NO: 103042

SEQ ID NO: 103118 - DNA, 601 bp, Human; identical to SEQ ID NO: 103043

SEQ ID NO: 103119 - DNA, 601 bp, Human; identical to SEQ ID NO: 103044

SEQ ID NO: 103120 - DNA, 601 bp, Human; identical to SEQ ID NO: 103045

SEQ ID NO: 103121 - DNA, 601 bp, Human; identical to SEQ ID NO: 103046

SEQ ID NO: 103122 - DNA, 601 bp, Human; identical to SEQ ID NO: 103047

SEQ ID NO: 103123 - DNA, 601 bp, Human; identical to SEQ ID NO: 103048

SEQ ID NO: 103124 - DNA, 601 bp, Human; identical to SEQ ID NO: 103049

SEQ ID NO: 103125 - DNA, 601 bp, Human; identical to SEQ ID NO: 103050

SEQ ID NO: 103126 - DNA, 601 bp, Human; identical to SEQ ID NO: 103051

SEQ ID NO: 103127 - DNA, 601 bp, Human; identical to SEQ ID NO: 103052

SEQ ID NO: 103128 - DNA, 601 bp, Human; identical to SEQ ID NO: 103053

SEQ ID NO: 103129 - DNA, 601 bp, Human; identical to SEQ ID NO: 103054

SEQ ID NO: 103130 - DNA, 601 bp, Human; identical to SEQ ID NO: 103055

SEQ ID NO: 103131 - DNA, 601 bp, Human; identical to SEQ ID NO: 103056

SEQ ID NO: 103132 - DNA, 601 bp, Human; identical to SEQ ID NO: 103057

SEQ ID NO: 103133 - DNA, 601 bp, Human; identical to SEQ ID NO: 103058

SEQ ID NO: 103134 - DNA, 601 bp, Human; identical to SEQ ID NO: 103059

SEQ ID NO: 103135 - DNA, 601 bp, Human; identical to SEQ ID NO: 103060

SEQ ID NO: 103136 - DNA, 601 bp, Human; identical to SEQ ID NO: 103061

SEQ ID NO: 103137 - DNA, 601 bp, Human; identical to SEQ ID NO: 103062

SEQ ID NO: 103138 - DNA, 601 bp, Human; identical to SEQ ID NO: 103063

SEQ ID NO: 103139 - DNA, 601 bp, Human; identical to SEQ ID NO: 103064

SEQ ID NO: 103140 - DNA, 601 bp, Human; identical to SEQ ID NO: 103065

SEQ ID NO: 103141 - DNA, 601 bp, Human; identical to SEQ ID NO: 103066

SEQ ID NO: 103142 - DNA, 601 bp, Human; identical to SEQ ID NO: 103067

SEQ ID NO: 103143 - DNA, 601 bp, Human; identical to SEQ ID NO: 103068

SEQ ID NO: 103144 - DNA, 601 bp, Human; identical to SEQ ID NO: 103069

SEQ ID NO: 103145 - DNA, 601 bp, Human; identical to SEQ ID NO: 103070

SEQ ID NO: 103146 - DNA, 601 bp, Human; identical to SEQ ID NO: 103071

SEQ ID NO: 103147 - DNA, 601 bp, Human; identical to SEQ ID NO: 103072

SEQ ID NO: 103148 - DNA, 601 bp, Human; identical to SEQ ID NO: 103073

SEQ ID NO: 103149 - DNA, 601 bp, Human; identical to SEQ ID NO: 103074

SEQ ID NO: 103150 - DNA, 601 bp, Human; identical to SEQ ID NO: 103075

SEQ ID NO: 103151 - DNA, 601 bp, Human; identical to SEQ ID NO: 103076

SEQ ID NO: 103152 - DNA, 601 bp, Human; identical to SEQ ID NO: 103077

SEQ ID NO: 103153 - DNA, 601 bp, Human; identical to SEQ ID NO: 103078

SEQ ID NO: 103154 - DNA, 601 bp, Human; identical to SEQ ID NO: 103079

SEQ ID NO: 103155 - DNA, 601 bp, Human; identical to SEQ ID NO: 103080

SEQ ID NO: 103156 - DNA, 601 bp, Human; identical to SEQ ID NO: 103081

SEQ ID NO: 103157 - DNA, 601 bp, Human; identical to SEQ ID NO: 103082

SEQ ID NO: 103158 - DNA, 601 bp, Human; identical to SEQ ID NO: 103083

SEQ ID NO: 103159 - DNA, 601 bp, Human; identical to SEQ ID NO: 103084

SEQ ID NO: 103160 - DNA, 601 bp, Human; identical to SEQ ID NO: 103085

SEQ ID NO: 103161 - DNA, 601 bp, Human; identical to SEQ ID NO: 103086

SEQ ID NO: 103162 - DNA, 601 bp, Human; identical to SEQ ID NO: 103087

SEQ ID NO: 103163 - DNA, 601 bp, Human; identical to SEQ ID NO: 103088

SEQ ID NO: 103164 - DNA, 601 bp, Human; identical to SEQ ID NO: 103089

SEQ ID NO: 103165 - DNA, 601 bp, Human; identical to SEQ ID NO: 103090

SEQ ID NO: 103166 - DNA, 601 bp, Human; identical to SEQ ID NO: 103091

SEQ ID NO: 103167 - DNA, 601 bp, Human
tgaatgacaaaagaccacgacgccgatcacccgaagaaaccccaggtaaaagcacgccacaactgtcctgaacaggtagcctcacagtcttgagctgagtcacacttcccgtacctgtgcccactctatccgaccccccgcggcctagctaaaccaagaatccgaaattaaactccgaaacgttccttcccgggagacgaaactctctcccacccctccccctcacagatccttccctccccgaaactggggctgggggcggggaggggagtcgcctcagaaaagcgcatcttgattctgrccgctgcggtctcccgtgaggaccccggcactcggaactgagctgggatccaggcccaggggagtcacaggccccgtcctcacagctcccccaaaaaccggccccaggtgagaagacggaagatcgcttactagtgggagctctgccaaaagttccctgccatggaacacagcttgccctgataaaaaagcaccagccggcggagcggcccgcggagcgaccatagacccagcccgtccggtaaccgcgctcctcgatcaaatcagctcggctcgactccgctccgcggcggcgacggcg

SEQ ID NO: 103168 - DNA, 601 bp, Human
caaatttaagattacatctaggattcatcattatttcatatgctatgaaagcaactgccatgctgatttcaaagatgttaaagtgtgaaaacgtgcatcttagaagcatgaaatatagcatatttaatatcaattgccctctttcaccaaattcacctaagacaatggcctttcataatcttttcgtttgtttttccagaattgtcttgtcttccacactcgttaccttttccagataagaaactccatgactgctcaagggatttgagcaaggcaaagtggtcccttcttttaggactayttgaattgggagaaaagaatagtttcaaagaagtacacttaactttataataattttatatttgaaaagtgaaaacatatttttagaatgctatgaataaatgaaagcataatgagaacactattgaaaataaggcaggatcttttttttttaagttgaaaaactgaaaaatcaacagtcagctacttgtcaattctctcagcttctttcagagtttatcagaatatctcttctccactacctaaactttttttttcaggagctctaactccaatacctaaactttcgatactttaattt

SEQ ID NO: 103169 - DNA, 601 bp, Human
gaaatggaacaatttcaaaaggagattctcttgaaagatggaaagtatttacccatgaaataacacatagctcttgggtaatactcttaacttgctttggctttcaaatttaaaaccctggagataacccaaaagtacccctgggtttacttttctcattcctaattttgtatttttgtatcattcctttttcccctgatttaactagcagtagtttggtctactgtttttatttactctaagaattagcttttataatttttttccttttaatatattagcatcgttatctattttaagtctgtttctttaggtttatttcatgtttccttcttaatattattaaatagaatatttctattatctctcaattattcaggatattgattttctaatacattcaagctttggttacattccatatatggtactattatgatgttattttctagatagtaagtaactgtattttcagtttcctgtggataccaataaagtatccacagttagttttgtagtttttatttttgttacttgttcattaatgcattcaattaaccagcaaatacttagtgcccttctagttcattttggtcacaga

SEQ ID NO: 103170 - DNA, 601 bp, Human
tttccacgtattgataattttgtccctgttttgtcattctttctatatctcctttgtatcaactgtattgactagcatattggtaaaatcttaaataggcaccctaattatctcaatgtttcaccactgctgatgctttatgtttttcatgttaaggaagcatcctatttctgttttagtaagagctttagtcaaggataaatgttgaattgtattagttttttaatacctttactgcttgatttcttaatattgactatatttctataataaaatccaatgtcatgttttatactttcartgtaatgttagactgcatttggtaataattcatttacaatgtttgcattaatattcaaaagtgagactgtttttagtgttccctttgctagatttttctgtgttatcatggcttcataaagagaattagaaagcttttcttctttctgtatgaaatggaacaatttcaaaaggagattctcttgaaagatggaaagtatttacccatgaaataacacatagctcttgggtaatactcttaacttgctttggctttcaaatttaaaaccctggagataacccaaaagtacccctgggttta

SEQ ID NO: 103171 - DNA, 601 bp, Human
taaaaaagaatatccattcaaattttgtgattacattacatttaaagatcaatatggggagaaatgacatcttaccaagaattcaaactctattaaaatctgtatgtgccactatggacttttaaagttttcttcctacaggttctgtatatttctttatatttttccctctgtatattttctgttgctaatgtaaattatacttctctatccatttttaaaaagcttttatttttgcattttataactggtcaccttcctaaacctttattatttctaataacttctcaattaactgagwtttctcattaattttatttccacgtattgataattttgtccctgttttgtcattctttctatatctcctttgtatcaactgtattgactagcatattggtaaaatcttaaataggcaccctaattatctcaatgtttcaccactgctgatgctttatgtttttcatgttaaggaagcatcctatttctgttttagtaagagctttagtcaaggataaatgttgaattgtattagttttttaatacctttactgcttgatttcttaatattgactatatttctataataaaatccaatgtc

SEQ ID NO: 103172 - DNA, 601 bp, Human
taaatctaccttttactttcatgtttgtcaggcatagcaaggcctttcctgattcaaaacgataaaaaacaattcacccatattttctaatacccttaagagcttttttccttcaatttatgatccatctggaatttattttggtacagagtataaagcagggatccagctaaatatgttgtcaaatgcttatccaaatgtgctaaggtatttcctgatttataattctatcattatacttggatcttctttataatttcctatttttttcttcttcatatgctgtgctactttaaaacayagaaaattaagtaattaataggtgatatgaaaaatactcccttctattcttctgaaaatttctgactattctatcacaattattctaagacctaaactttagaagcattatgtcgagtcctaaaaaagaatatccattcaaattttgtgattacattacatttaaagatcaatatggggagaaatgacatcttaccaagaattcaaactctattaaaatctgtatgtgccactatggacttttaaagttttcttcctacaggttctgtatatttctttatatttttccctctgtatattt

SEQ ID NO: 103173 - DNA, 601 bp, Human
ttcccttcaaagcaaagttctaagagaaacgaccactataggatgtcaatccaaagaatcatttatcctcaaagtactttgctttagccaaccttgaactgggtctaataattattataaagtcttagggagattaggtaacactttcaaattgtcttgagtgcctgtgatatgtaaaattcacacaaaaaaactttatttggatcactaaaaagaaagataaatgaatatgttgtaaaaagaatacctgtataagcaaaaatgttaggtatgcactaaaacagttcacaaattaccacacaaaaacatttttattcagaggtaaccaactatacaatttgaaccaatttttaaaaaagtttaccatttgtaaaaaatatttgtaacttccaatattcttcctctgagagaaactttaaatccttttggcgctccttcaacagatcttgtttatccaaaatccattgcaaactagaaaagacatgttacagaaaatcaacaagcaaggtcagaggaaacactctaagattgaacacattgttcatattctgagaagtacaaagtgcaaaaagtaaccttaaagacaattatttctcacatt

SEQ ID NO: 103174 - DNA, 601 bp, Human
gacagagtctcgttctgtcgcccaggctggaatgcagtagcacgatcttggctcactgtaatctccacctcccaggttcaagtgattcttgtgcctcaccacgcccagctaatttttgtatttttagtagagagggaatttcaccatgttggccaggctcatctcaaattcctggcctcaagtgatctgcccacctctgcctcccaaagtcctaagattacaggtgtgagccaccacacttagctttatacagctcaccaaaataaataaataatacataaaaatccataatgaatcctcaaaaaaaagataagtttacaaaatagtgaaccgaaagttaaaaaaattatgtgacaaacctactacatgtcagagtaaagatctatccctacatcttcttcccttcaaagcaaagttctaagagaaacgaccactataggatgtcaatccaaagaatcatttatcctcaaagtactttgctttagccaaccttgaactgggtctaataattattataaagtcttagggagattaggtaacactttcaaattgtcttgagtgcctgtgatatgtaaaattcacacaaaaaaactttatttgg

SEQ ID NO: 103175 - DNA, 601 bp, Human
ttgttttgagacagagtctcgttctgtcgcccaggctggaatgcagtagcacgatcttggctcactgtaatctccacctcccaggttcaagtgattcttgtgcctcaccacgcccagctaatttttgtatttttagtagagagggaatttcaccatgttggccaggctcatctcaaattcctggcctcaagtgatctgcccacctctgcctcccaaagtcctaagattacaggtgtgagccaccacacttagctttatacagctcaccaaaataaataaataatacataaaaatccataaygaatcctcaaaaaaaagataagtttacaaaatagtgaaccgaaagttaaaaaaattatgtgacaaacctactacatgtcagagtaaagatctatccctacatcttcttcccttcaaagcaaagttctaagagaaacgaccactataggatgtcaatccaaagaatcatttatcctcaaagtactttgctttagccaaccttgaactgggtctaataattattataaagtcttagggagattaggtaacactttcaaattgtcttgagtgcctgtgatatgtaaaattcacacaaaaaaac

SEQ ID NO: 103176 - DNA, 601 bp, Human
cttttcatagtatctttataataaatataaaaagaaaatattagacacctatgaaacttgttaatactaccactttttttgttgttttgagacagagtctcgttctgtcgcccaggctggaatgcagtagcacgatcttggctcactgtaatctccacctcccaggttcaagtgattcttgtgcctcaccacgcccagctaatttttgtatttttagtagagagggaatttcaccatgttggccaggctcatctcaaattcctggcctcaagtgatctgcccacctctgcctcccaaagtsctaagattacaggtgtgagccaccacacttagctttatacagctcaccaaaataaataaataatacataaaaatccataatgaatcctcaaaaaaaagataagtttacaaaatagtgaaccgaaagttaaaaaaattatgtgacaaacctactacatgtcagagtaaagatctatccctacatcttcttcccttcaaagcaaagttctaagagaaacgaccactataggatgtcaatccaaagaatcatttatcctcaaagtactttgctttagccaaccttgaactgggtctaataatt

SEQ ID NO: 103177 - DNA, 601 bp, Human
gggaaagatgtcatggataaccttaaatcatggctaaaacaaaactaaatcaaagtgggtgccaaaaggaatgtaaacttactaggtaaaaatcacattcaatattcaagaatacaactctaagaatacaactctaagacattatccaaaaatagaaacataatgcaaagatttcacaccaccaaagactacattatttatgaaaaacagccaatatctgctattattttctggactttagctgagctctttcaaaaatactacaaaggtaaaacagttgaacagaaattcagtctctgcygcaagttcctatctatcttctctcccttacctaatttctctacgctcacaacctcaacttttacttgttagactctatatagctatagcttcccctaatccttgccttccttctggcttggtaggcagccaatcatcaggatgatgggagggaagacaggagaagataagcatatgggtgagaagcataagggacattctcaggttatggtaggcaagctgtggtacttactgaatactactcagtgccaaacaatagatgtctcaaaggcagcagaggaaagtagttaagaacacagga

SEQ ID NO: 103178 - DNA, 601 bp, Human
aaatcaaatattacatagaattattagaattagaaaactcaatccataataaggaccttaactgattctgccttcttaaactaccactcacaattagaaaacataaacttctagaaagcttgtcttaatattatttctaacagagtcaattgtcattatttaggtaacagttgggaaagatgtcatggataaccttaaatcatggctaaaacaaaactaaatcaaagtgggtgccaaaaggaatgtaaacttactaggtaaaaatcacattcaatattcaagaatacaactctaagaatasaactctaagacattatccaaaaatagaaacataatgcaaagatttcacaccaccaaagactacattatttatgaaaaacagccaatatctgctattattttctggactttagctgagctctttcaaaaatactacaaaggtaaaacagttgaacagaaattcagtctctgccgcaagttcctatctatcttctctcccttacctaatttctctacgctcacaacctcaacttttacttgttagactctatatagctatagcttcccctaatccttgccttccttctggcttggtaggcag

SEQ ID NO: 103179 - DNA, 601 bp, Human
tttaacaagtaagatagattaaaatcctcaaattaatctacaagattaaatgtttataaagattttttgtcttggtcctccatactgcctgtgcttaagagactttaaattattacatggtaatatttaaataaaatcaaatattacatagaattattagaattagaaaactcaatccataataaggaccttaactgattctgccttcttaaactaccactcacaattagaaaacataaacttctagaaagcttgtcttaatattatttctaacagagtcaattgtcattatttaggtaayagttgggaaagatgtcatggataaccttaaatcatggctaaaacaaaactaaatcaaagtgggtgccaaaaggaatgtaaacttactaggtaaaaatcacattcaatattcaagaatacaactctaagaatacaactctaagacattatccaaaaatagaaacataatgcaaagatttcacaccaccaaagactacattatttatgaaaaacagccaatatctgctattattttctggactttagctgagctctttcaaaaatactacaaaggtaaaacagttgaacagaaattcagtct

SEQ ID NO: 103180 - DNA, 601 bp, Human
atccacccgcctgagcctcccaaagtgctgggattacaggtgtgagccactacacccggcctaggaataattctttatccaaaactcaaagggaaaactttcattcagtaaatcacatcacagagttctactcagtaaatcacataacaatatttaacaagtaagatagattaaaatcctcaaattaatctacaagattaaatgtttataaagattttttgtcttggtcctccatactgcctgtgcttaagagactttaaattattacatggtaatatttaaataaaatcaaatattacayagaattattagaattagaaaactcaatccataataaggaccttaactgattctgccttcttaaactaccactcacaattagaaaacataaacttctagaaagcttgtcttaatattatttctaacagagtcaattgtcattatttaggtaacagttgggaaagatgtcatggataaccttaaatcatggctaaaacaaaactaaatcaaagtgggtgccaaaaggaatgtaaacttactaggtaaaaatcacattcaatattcaagaatacaactctaagaatacaactctaagacatta

SEQ ID NO: 103181 - DNA, 601 bp, Human
ttttgccatgttggttaggctggtctcaaactcctgacctcaggtgatccacccgcctgagcctcccaaagtgctgggattacaggtgtgagccactacacccggcctaggaataattctttatccaaaactcaaagggaaaactttcattcagtaaatcacatcacagagttctactcagtaaatcacataacaatatttaacaagtaagatagattaaaatcctcaaattaatctacaagattaaatgtttataaagattttttgtcttggtcctccatactgcctgtgcttaagagaytttaaattattacatggtaatatttaaataaaatcaaatattacatagaattattagaattagaaaactcaatccataataaggaccttaactgattctgccttcttaaactaccactcacaattagaaaacataaacttctagaaagcttgtcttaatattatttctaacagagtcaattgtcattatttaggtaacagttgggaaagatgtcatggataaccttaaatcatggctaaaacaaaactaaatcaaagtgggtgccaaaaggaatgtaaacttactaggtaaaaatcacat

SEQ ID NO: 103182 - DNA, 601 bp, Human
ctaaagccttcacttcattttaaaataaaaaaatcaagagttggtttcttatccaacaaaaggagctaaactaaaaatctatttaaataccttcagcctacatccttatcctgtgtaggggaaatgtatgtgtactaatatatttgttttacatttaaacctccaactataataactgaaaagaaaaagtaaaagcctgagacatgttcttaaatgagctttccatacaatttccataaaactagagaaaatacagaaagatttggtcacagagataaaaaaaaaaaataataatgctacraccaaatctgaaagactacattctctttctcaggaataattctttttttttttttttttgagatgcaatcttgctctgtcacccaggctggagtacagtggcatagtcttggctcactgcaacctccacctcatgggttcaagcaattctcatgcttcggcctccctagtagctgggattacaggcatctgccaccacatccggctaatttttgtatttttagtagagacggggttttgccatgttggttaggctggtctcaaactcctgacctcaggtgatccacccgcctgagcctcc

SEQ ID NO: 103183 - DNA, 601 bp, Human
aaacgtttcaaattttggagcatttaggattttcagattacggatattctgcctgtattacctctcccccaaattgctacaacttaagacatattttaaaataattttataatttaataacaataaaaggtaccaaattagaaaccaagccttaaggttacagtgtcagtttttccatttaaattagtttccaagaagattgtttacattctatacttaattgcaagaatattaagtatgtttcctattcaattcaacctgtattaacagatacttcatgccattctatggtaaaacagtygaatttgtgaataagataaaccttaattaatcaccaaaagaactaaaaaaaaaaaaaaaccatataaatagttactatcctttttagaacagggagacaggaattacgtaagacttccaaagtcagttcccatttcctctttcaactgaacaaccaccattgtgaaaatactaaaatttattatgatccaccttatatatactgtttcatttattgcctcgtaagatttctaaagccttcacttcattttaaaataaaaaaatcaagagttggtttcttatccaacaaaaggagctaaac

SEQ ID NO: 103184 - DNA, 601 bp, Human
aagcaggtacatgttaacccaatgaatctaagggtatctgaactctattcaaaacaggatttccttgctcctgtttacaatctgttcaccttctaactacttgaggtgtgaagtacttacactcctaaatgtacaggctgattaccccttatctgacatgcttaggatcagagatttttctgatttaggaatattttgcattacactggttgagcatccctaatctaaaaatctgaaatgcaaaatgttccaatgagcattcctttgaatgtcatgttggccctcaaaacgtttcaaattktggagcatttaggattttcagattacggatattctgcctgtattacctctcccccaaattgctacaacttaagacatattttaaaataattttataatttaataacaataaaaggtaccaaattagaaaccaagccttaaggttacagtgtcagtttttccatttaaattagtttccaagaagattgtttacattctatacttaattgcaagaatattaagtatgtttcctattcaattcaacctgtattaacagatacttcatgccattctatggtaaaacagtcgaatttgtgaataa

SEQ ID NO: 103185 - DNA, 601 bp, Human
tctaaaagcttatattaactcatttggtcctcataacaacccaacaacacaggaacgggtttgcacatagatattaatatctacccataagaatgacataatagtcattagaaaacaataaaatacaataaaattcggaaacagaattttttctttactcttacaagattaaaagccactgagttgatgtttttggattgataattactatccattttaacattaaaagtaatatctttatatctttttaaaaaaaaaccttttagcttgatttttttgccagatacactagatataaagktatcctcaggaaatttaataaagccaaccaatctcatatgtctcataaactaaaaaaaaaaaaatctatgtactctggagctttctttagaattacatccttaaagcagatatactttttgcacttacatacagaagtagcagcagcaatcaatcttgtatttgaaactactccaaattcctaaagaaagaaaagcaggtacatgttaacccaatgaatctaagggtatctgaactctattcaaaacaggatttccttgctcctgtttacaatctgttcaccttctaactacttgaggtg

SEQ ID NO: 103186 - DNA, 601 bp, Human
aaaccaggagtgtgtgtgctcacagaaaggtccatgtaagaatagccagacaccttgatcttggatttccatgctctaaaactgtgagaaaatacgcttctgttgtttaagccacctgttctgtggcattttgttatggcagcctcagcaaagtaacatactaagcaaggcactgttctaaaagcttatattaactcatttggtcctcataacaacccaacaacacaggaacgggtttgcacatagatattaatatctacccataagaatgacataatagtcattagaaaacaataaaatmcaataaaattcggaaacagaattttttctttactcttacaagattaaaagccactgagttgatgtttttggattgataattactatccattttaacattaaaagtaatatctttatatctttttaaaaaaaaaccttttagcttgatttttttgccagatacactagatataaaggtatcctcaggaaatttaataaagccaaccaatctcatatgtctcataaactaaaaaaaaaaaaatctatgtactctggagctttctttagaattacatccttaaagcagatatactttttgcac

SEQ ID NO: 103187 - DNA, 601 bp, Human
ccccaggcaaaaaaacctcaaaacacatttctgactcttcttaaatcccttctttttataagaactgctgactctatcgctcaaatctggcttgtttgttcttgctggctgccaatattcgtttaagccttcattagtgttcactgggatgacttcagcaacttaaaaattattttttccactttaaacttgttaggttttatttctcatagcaccctgtggtaagtgacagcactcaatacagtttgcagttttactgtatttcagaaggtttttgtttttaaattgtgttaagatatayaaaatttttgcaaaactgaaactctgtatccattaatcactccctataccacccttcctccagccctaccattctactttctatctttattaatttgactaagtattccatgtaagtgtaatcacacaatatttgtctttgttactggcttatttcacttaccataatgtcctcaaggttcatccatgttgtgggatgtaaataacttcaaaatttgtctaattctacctgccctctcctccaattcatcttacataattctgtcagatttaccttcctaatgcacaatgctagcattac

SEQ ID NO: 103188 - DNA, 601 bp, Human
atgtcaacacctttcccccaattcccttcactgaagttgtttcatatatttttaatatagttagactattcctttctcagcacctacttgcttcttaattccttgcaatctggcttctacctccacccccacattgttaatgacactatgttctctctcaaagatgtttttttctttggttcacatctttttctatgcagcataagacattgtgcaactcttttttttttaatttttagggacagagtcttactccattgcccaggctggagtgcagtggcataatcacagtttactgcarccttgaactcctgggcttaggcaaccctcccacttcagcctagttgagtagctaggactacaggtgtgtgccaccatgcccagttagtttttctttaattttttgcagagctggaatcttgctatgttgtccaggctggtcttgaactcctgttctaaagcaatcctcctgctccagcctcccaaagtgttcggattataagcaggaaccaccatacctggcctgtgcaactcttaaatgttatcaaattccaaatttctactgctggcctcacatttttaagaggatgttctactaaca

SEQ ID NO: 103189 - DNA, 601 bp, Human
cttgtgtatttcttgccccagtcctagaatcaaccatttctccaaggagccctggtaccttttattggagaatgatattagaaaccaagatatgggtactaggtgagctcattgctactgggatgtcattgcttatagaccctttcagctgagaaagccaagaaatacacacactaacccatgtatatacacttatctataaatatttctatatgtaactaaccatctatattgtattaaggtacacgagttcatgctgtttccagccctttgcttatctgtaaattcccgctccaacaaygagaaacccggctctcaaacatttgctattgatttacgtaattgtttaattcccatatacatgtatagcattatcagaattgttaacttgtacacccatgggtaataactttatcaactagagtacagtgcttatgtgtagttccttttgcctttactcttacactcttaatcatttccaaagctacttatgtcaacacctttcccccaattcccttcactgaagttgtttcatatatttttaatatagttagactattcctttctcagcacctacttgcttcttaattccttgcaatct

SEQ ID NO: 103190 - DNA, 601 bp, Human
aggtttccccactgtaaagttacctttttcctccctttccatatgtacacactagcaggaagttaacatgtatagccagcaccttaggagtggggagttatgctccctctacttgagggcagaatagttacatatattatttggaattcttcagcatggaagacatgtctcttctccctcatttatttatatcagtatggactcatggatatttagtttatactttgagttattatccaatgctatttttaaaattttgatgctcaaattctttcagctttggtcagtgggagctctcttmgttagctcctatatccttttgacatatcctcatcaatagacgtttttgtttttcttgtttgttttgaatacttctttattactggcattaagagatggtccaggtccatcttgtgtatttcttgccccagtcctagaatcaaccatttctccaaggagccctggtaccttttattggagaatgatattagaaaccaagatatgggtactaggtgagctcattgctactgggatgtcattgcttatagaccctttcagctgagaaagccaagaaatacacacactaacccatgtatataca

SEQ ID NO: 103191 - DNA, 601 bp, Human
agccacccagtctatggtactttcttatattagcccaagtggactaagacatgccttcacccagcttcccctactattaacatcttacattagtatggcgcatttgttacaattactgacccaatattgaaatgttattattaactaaactgtacttttttcagatctccttagtttgtaccaatgtcctttttctatcctagggtcttatctaggataccacattatatttatttgtcatgtttccttagactgtttggctgtgacagttttctagcctttccttgtttttgatgacttwgacagtttttaggagtaccagtcaagtattttgtcaaatgcccctctactggaatttgtctgatgtttttctcattagactagagaaaatgggtttttgacaggaagaccaccgagataaagtaccatcttcatcatatcacatcaatgatacatgatattaatgtgatttatcactgttgctactgaccttgatcgcctggctaaggcagtatttctcaggtttccccactgtaaagttacctttttcctccctttccatatgtacacactagcaggaagttaacatgtatagccagca

SEQ ID NO: 103192 - DNA, 601 bp, Human
gaggatagtacaccaaaaaaatgttaacagtggttatttgtgagatttaagaactttttactaatctgcactttctaaactttttacaatgaccaggtatttatcaaaatatatattttaataaaagcattaatatatatgcaaaggtctcgagttactcataaagtagtagtagtaacacataaagttagtactctattatctattactttattggttagtcactaaataaagtacaaatgaaaaaaaaatgttaaccatcaatcccccatctccttaaaatggtgtgagcatatacacrtaagtactatttgagaaactgtattcaagccattatgacacatttaattcaaccaagtaactactgacaggtcctaaaaaatgtttagtgtcagcttccatttgtacaaagcccaagtgatttcactgaaattaaaagaaattccatttctggccaggcacagtggctcatgcctgtaatcccagcactttgggaggccaaggtgggtggatcacctgaggtcaggagttcgagacctcctggacaacatggtgaaaccccatctctactaaaaatacaaaaattaggcgagtgtagtgg

SEQ ID NO: 103193 - DNA, 601 bp, Human
cttccttcctacctatgcagatcccagtattcctacccactgggtaggacaccactcaaaatcctttcaaatccagtcctttcagggaactgccagtaatacagaagtgtaagtataacctatttgtcagccctgatgtaagaaggccaagaaacatcaacatttaaggaataattgaacaactgaacaaagacaaaccaatggaaaataagaggggaaaatcaagaggatggagttataaaaatcaatagaaggggctggggcgcagtggctcacgcctgtaatcccagcactctgagaggccaaggagggtggatcacctgaggtcaggagttcaagaccagcctggccaacatggcgaaaccctgtctctactaaaaatacaaaaattagccaggtatggtggtggacacctataatcctcctgtaggcaggagaatcgcttgaacccaggaggcagaggttgcagtgagccaagatcacaccactgcactccagcctgggagacagagtgagactccatctcaaaaaaaaaaaaaaaaaatcaatagaaggaaaaggaacaaaaattaacaagtgcccaatatataacaggcattat

SEQ ID NO: 103194 - DNA, 601 bp, Human
cagggatggcaaagatgtgacacatgttctgttatcccttccttcctacctatgcagatcccagtattcctacccactgggtaggacaccactcaaaatcctttcaaatccagtcctttcagggaactgccagtaatacagaagtgtaagtataacctatttgtcagccctgatgtaagaaggccaagaaacatcaacatttaaggaataattgaacaactgaacaaagacaaaccaatggaaaataagaggggaaaatcaagaggatggagttataaaaatcaatagaaggggctggggygcagtggctcacgcctgtaatcccagcactctgagaggccaaggagggtggatcacctgaggtcaggagttcaagaccagcctggccaacatggcgaaaccctgtctctactaaaaatacaaaaattagccaggtatggtggtggacacctataatcctcctgtaggcaggagaatcgcttgaacccaggaggcagaggttgcagtgagccaagatcacaccactgcactccagcctgggagacagagtgagactccatctcaaaaaaaaaaaaaaaaaatcaatagaaggaaaaggaac

SEQ ID NO: 103195 - DNA, 601 bp, Human
tcactgaagagctgatatctaagccaagtcttacaaaaaaaaaaaatgagagtgggagaagagaatagtatgtatatcaattgggagacgaatttggctagctccgggtttctcaatcttggcactactgacatcttaggttgaacaattctttgacactgtcttgaatactacaagatgcttggcagcatccctggcttctacccactagatgctagtagcaccctaccctagttatgacaactaaaaccaaacattgccaaatgtcccctcggggcaaaattatccccaggtgaaaccrctagcctagctcaacagtttggaagatagacaggctctctgaggatgggagtgctggaggctaataagccagttaggagactgctgtggtaacatggatagaaatgagaagatgactatgagattacagaaggaacaatcgagaggaaggcacaaaatgtactggtaaacaactacatgtgggtattgagggagatgaaagggcctaactgctgggtttccaactaaggtatataactagtgctattcaccaaactggcaaagacattaaaaggaggaacatattttggggcaaagtgat

SEQ ID NO: 103196 - DNA, 601 bp, Human
caatgttgactatgtttccacatttcagttaaaagcagtgttgcctggccttttttcttccttttcattattagcacatgatcaagttatgtgaaagctgggcacatccttacagaattcagtgttgtaatcaaataaaggttagaaaataaatgtaatatactgtatacaatattagttatatatgttatatacaatataaactaacaaaagagaggaatctacatcataattttgcctaaaacaatttctactgagcagcctgtatacccttaacccactccagcttaagttatactcygtggtctggttatccatgtctttgctaaggatgacattctaggcaaatagcaactcaaatgtgaactgacacactggttgccctaagtcaagcaaagctatgagtagggcttaggtcaagaagaggttaaaaaaaaccaaatgactgacatgataaaaacaggaaattaaaatacagtggacaatgctattaacatgggcatgcatagagtacactgaagattgaggaagcatcctaaacccagactgaggtgatgctgaaagggtgggggagggtcactgaagagctgatatctaagcc

SEQ ID NO: 103197 - DNA, 601 bp, Human
agcagaaaagggaagttatccctgagtagtgtacaaagtagccgttaaactgcacccagaagtcagtgtgacaaaacaaaacaaacaaaaatgttaattaatatactaggttttaacaatgttgactatgtttccacatttcagttaaaagcagtgttgcctggccttttttcttccttttcattattagcacatgatcaagttatgtgaaagctgggcacatccttacagaattcagtgttgtaatcaaataaaggttagaaaataaatgtaatatactgtatacaatattagttatatctgttatatacaatataaactaacaaaagagaggaatctacatcataattttgcctaaaacaatttctactgagcagcctgtatacccttaacccactccagcttaagttatactctgtggtctggttatccatgtctttgctaaggatgacattctaggcaaatagcaactcaaatgtgaactgacacactggttgccctaagtcaagcaaagctatgagtagggcttaggtcaagaagaggttaaaaaaaaccaaatgactgacatgataaaaacaggaaattaaaatacagtggacaa

SEQ ID NO: 103198 - DNA, 601 bp, Human
ttaaacagctacatatgagagttaccactgaccatctcatcaatgtaatccgagacagaaaaaattactagattacatcaagttcttgacatctggtcctcactgcgtgctagtcatggtgcagttgccttgagagtcaggcacgttaaagaggaaaaacatccaatgaggagagcagaaaagggaagttatccctgagtagtgtacaaagtagccgttaaactgcacccagaagtcagtgtgacaaaacaaaacaaacaaaaatgttaattaatatactaggttttaacaatgttgactrtgtttccacatttcagttaaaagcagtgttgcctggccttttttcttccttttcattattagcacatgatcaagttatgtgaaagctgggcacatccttacagaattcagtgttgtaatcaaataaaggttagaaaataaatgtaatatactgtatacaatattagttatatatgttatatacaatataaactaacaaaagagaggaatctacatcataattttgcctaaaacaatttctactgagcagcctgtatacccttaacccactccagcttaagttatactctgtggtctggtt

SEQ ID NO: 103199 - DNA, 601 bp, Human
attttaaacaacttaatcgggggtagtgcacaaaagatgttttgattctctgttactacacatacattaaggtgctcaaaaactggcagctacaaatttgaaacaactagttaacaaattagctatttttttcccacctgagtagaacctaaccttaggattaattttaatgcatttaacacttgagcagaaaagctagaaacacagcaaaagccattctgccaggagataggctatgttacagaagttcacagtagtattcagtggttaccagggagcttttaaaataatcctgggaatkagaggctactttgcaaccaattaaaccaaaagtttaccattctgtttaatcctaaactgaaaagagatacataacttaaataatcagcattaactcttcctaccaaactttttttttttttaaacggagtctcgctctgttgcccaggctcgcgtgcagtggcacgatcttggctcactgcaacctctgcctcccaggttcaagcaattctgtctcagcctcccgagtagctgggagtacaggtgcatgccaccacacccagctaatttttgtattttcagtagagacggggtttcacca

SEQ ID NO: 103200 - DNA, 601 bp, Human
taagggagttaagtctatgctgaaagagggaaagggagacgaggacataaaaacaaatttgtttttctataccacaaggcttttgtgccaaggtggccatgtgtgtcaaagtcagggaatccctcctcctggaagccaagaggaagtctctcaaaactagaagggaaaggtgttttctccacatcaatccagctttggagacattctattagcgacatatgccccttcccccaaaaacaacaatgaagtgttctatgtgctaacaacatagctttaaaaaaaataaaataaaataaaacamaattctgcatttttataaaacttgataaaaaatagtatttcaaactgtacagtcaccagaagtacacagttatcaaaaatgcacacacttcacttggcatctccagcaccttcagctttctgcgcctggtctgttttggcatctccatttcctgcagggttatttccctccttgccagcatcagcttttccctttttccctttgggtaccttctctcccttctttgcaggggccttttaggcgtgggctctggctttggaggagcaggtttagcagacaacctcgcggatcttctctgtg

SEQ ID NO: 103201 - DNA, 601 bp, Human
tcatgcctgtaatcccagcactttgggaggccaaagcaggagaattgtttgagcctaggagttcaagaccagcctgggcaacctggacaacatagtaagacccagtctttaaaaaaaaattaaaggccgggcacggtggctcatgtctgtaatcccagcactttgggaggccaaggcgggtggatcacgaggtcgggagatcgagaccatcctggctaacatggtgaaacccgtgtctctactaaaaaatacaaaaaaattagccaggcatggtggcgggctcctgtagtcccagctactsggaaggctgaggcaggagaatggcgtgaacccaggaggcagagcttgcagcgagccgagatcgcgccactgcactccagcctgtgtgacagagcgagattccatctcaaaaaaaattaaaaaattagctgggtgtggtagcatgtacctgtagtcctgctactcgggaggccatggcaggaggatcccttgaacctggaggttgaggctgcagtgaactgtgattgcaccactgtactctagcctgggtaacagcatgttaccctgtctcaaaaaaaaaaaaattgtggtgatgtattgg

SEQ ID NO: 103202 - DNA, 601 bp, Human
tgcctgtaatcccagcactttgggaggccaaagcaggagaattgtttgagcctaggagttcaagaccagcctgggcaacctggacaacatagtaagacccagtctttaaaaaaaaattaaaggccgggcacggtggctcatgtctgtaatcccagcactttgggaggccaaggcgggtggatcacgaggtcgggagatcgagaccatcctggctaacatggtgaaacccgtgtctctactaaaaaatacaaaaaaattagccaggcatggtggcgggctcctgtagtcccagctactcggraggctgaggcaggagaatggcgtgaacccaggaggcagagcttgcagcgagccgagatcgcgccactgcactccagcctgtgtgacagagcgagattccatctcaaaaaaaattaaaaaattagctgggtgtggtagcatgtacctgtagtcctgctactcgggaggccatggcaggaggatcccttgaacctggaggttgaggctgcagtgaactgtgattgcaccactgtactctagcctgggtaacagcatgttaccctgtctcaaaaaaaaaaaaattgtggtgatgtattggctt

SEQ ID NO: 103203 - DNA, 601 bp, Human
tccttttctactgtttttatacttaaagaaaatatctgatatcatatatattgttttataatttctttatgcttaataatagtttatcaacatctttccatgtcccttttttttttttttgagatggagtttcgctcttgtcacccaggctggagtgtaatggcacgatcctggctcactgcaacctccacttcccgggttcaagcagttctcctgcctcagcctcctgagtagctgggattacaggcacctgccaccatgcccatttaatttgtgtatttttggtagagactgtgtttcrccatgttggtcaggctggtgtcaaactcctgacctcaagtgatccgcctgccttggcctcccaaagtgctgggattataggcgtgagccactgtgcccggcctccatgtccttaatgttaaactaaattgtttgtaatggctatatgtattctcttctgtctaaacgtcttgtagtttattaatcatctaatgttggactgttaggttatgtaattttttttattaataacaacactgtgatgaatgtctttgtaacgaaatttttgttcatatttgtaatcattttcttaagatacatt

SEQ ID NO: 103204 - DNA, 601 bp, Human
aggattaagtttgaagatagttatactgacaagctgagataaaattttgtgcatttactatatagattttcatttggtgcctgactttaccttttaggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtgtaagttggcatttatatatttgccagtttaaaaatacatcatargtaaggcaatgagaagagttttaaggacaattagtgataccttttgggtcaagcatgagcatttttgggtaacatgtgcttgcttctctaacatatactgtgtagcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcaggtgtgtgagtggatttgtatgtacagttatatctatt

SEQ ID NO: 103205 - DNA, 601 bp, Human
cagtcaagagaccacctttgaagctgacctcttcaagatttgtctttaagaacaccaatataatttcagtactttgggaggccaaggcaagaagattgcttggggtctggagtttaagaccagcctgggcaacacagtgagatgctatctctacaaacaataaaaaaaaatagttgtgcatagtggcacacacctgtggtcctcgctacacggtaggctggggcaggaagttagcttgagcctaggagcttgaggccagcttcggcaatgtagcaagaccctgactccattcatccatccrtctgtccgtccgtccgtctgtctgttttcaatttaggatattttctgcttatgtggggtttacagcctaataaacctatcaaaagtcaaggagcatctgtataagctttaaaattgccaataaacagtatggcagttcaacaacttaaacatgaaattaccatatgatccagcagttgcacttccgggcatatacccaaaagaactgaaagcagttctcagagagatatttgtacagctatgtttgtagcagcatttttcataatagccatgaattggaatcaaccttagtgttcgttgt

SEQ ID NO: 103206 - DNA, 601 bp, Human
tgctaaatgcccaaacctgcaatgcactttgggtataatcatatttgaaaaacacagatattcgttctagcaccaagacaatatttaccactcaacctgtcttttctgaataaccaatgagatgggacagagaaaaaagtacgaaatacagtacttgcctttcaagagcttataatctggtggaagaaatcaaagtagtgcgttagagaaaaattaagtactaaactgtgtagtacaaactttaagagcaagaggagcatagaaaagactacaaccagcatgggattgactaatttgaaawttgccgaggtgagagaacctaaattgaaccttgagagacggtaggtacaacctggttaggtgcaggtaagggagaggggcagggaagagagaatgaacagaaacacaaatgtgggaacaagcacagcatgtagaagcaggcatcagtatggtttgtgccaagaagaaaggaacctaactggaacagagaattcccttgttgactgaaacagtatcagacaagaagtgtgataaggagcatgttatgttgaaaggcttgaaaccaaggggtgggggtagggggtgtaggagggggctgcat

SEQ ID NO: 103207 - DNA, 601 bp, Human
gttagttaactatcattattacatttttaaaaatttaagtacccaaatttacatcttaacagatattacttgctgcccacccctccctcccattgcccagtctggggttagcagctatgagtcacagtatccctttgaaggttttgctttgtttccacataaggaattctctgtaactaagcaaaatacaattttccagagaagatagcaaacacgctgattaaatgttttagttacaggccacaaaaatcattatggaggcttcctttcaagcatagcacatatagagtctgggatagayagcccttttgagggaaagttgttgaaaagaattctaatgagcaaagtaggaatagccacttcaagtatcaactgcagctggaaataggagtcttgaagactaaatactaccttatcaccatttctagctatgcccacattttccaattagaattgatagtaaaatatgacacatatggtgagagtagagatggaaaagcaagaccatggcatatcccctctttgagtttgtgaggaaaaaattaactctccattcacaaatttatcgattgccccaaatagtcttaaaggtttcagacag

SEQ ID NO: 103208 - DNA, 601 bp, Human
aatttagcataaaagactattaatacagaaatatagcaaaaacccttatgacatatcaactccctctatatattcatgtattttacttaagcctagcaaactaacaaatcactaaactgccaaaaaagctttccttagtttgacttttcttaactcatctgccataccatcagtagtactttccctgaaatattacttcatggctttgagacaattttcaaaataaggcgagcttcttattttttacctagctttcaccaaaaataaccatcatcataagctaccatctataccgtataaygcagatttgtcatttctcacattcttaccaaactcagccacgatagaggcaaggccgccatatacaaagggtttccaattcagaccagacatctcatgacttacagtggtacttttctggtgctaaaaataaacacaaatcagaacaaggcacaagagtgaggagcatttgttagcatctgatcatataatttagataaacaaaattggcaaataaaatagatgtagaagaaaaaccccaccaagtggaatgacacaaaaatgggggatcctgttttatgtgctggatgatcatgagttt

SEQ ID NO: 103209 - DNA, 601 bp, Human
attactatcattttagtccagaaagactgtctcatatttttatccatcaaccaccagtggtttatttcatgtgtgttgtttttcatgtctttctctctgttctcaaacccctctctgaattgcaataaatagatctctcctttgctaacctagccacttgtggtttcactagtggtcaaatttaaaaaagcatgtgtcctcttacttttttctcgcaatccccttaaaataatttgttaaaactttgggttcccctcacttattttaatcctatatttagtgcttttaactaatcataagyttaaatacgttaataagtagaaaatatttaccattttatgaaataagatgaaaatttatattaaaagaaatgtttcagtctgtgacttgaaaaaaccttaaagaaatccaactatactcttaacaagtcagcaccaccaacctatactattctggttctgaattcagaatattccaatacaggccaaaatataccatgtttaaagccaaatctcaccctgaatagaaatattaataagacagggaaagacagaggcattacagacttaagatacccaaattggttactaaaataggcttc

SEQ ID NO: 103210 - DNA, 601 bp, Human
ttgagttctatttataaaaagcataatattatattctgccaagtggcctttgagagctgcaagaaggaaagatagcattaaatggccatgtaaaaggtttggtacaatttcccacagactctgcacacatacaatcctagtagtcagtcactaaatactagcggcccaaatgtaggcctgatttttatgaagcaccatgctaccattctaggtttcaacaaatgtctttagtaagtcatgtaatggcaacatgcttttatgcagaaagttaactgttactactaagagttttcaaatattrtaattataaaaacctaaacccattaaatcaagatacaacctatcacaaagacaaatgaaaactactaatacactgtggtaagtagaacacttctttaaggaggtgattcctgacaacagaggggctagcgtgaggcaagtgaagtacttttcttaggcatgaaatgtaagggagtgcaagaaaaactcagtaatcaagataaatgatgtctcaatatgatattttttaaccaaaattaatccacaaaaagccataatgaatcaaatatcaaatttaactaaagctaggactcaacagggc

SEQ ID NO: 103211 - DNA, 601 bp, Human
tttataatctaacccttggccaccaatatgaggaaagcaccatagtggagaggtaaatgtcagtttgaggtcaagtgatctgagtttaaattccagttctcccacttagtagctgtgaaaccttaggcagcttacttaatctttcagtgcttcagtgtctacctcgtggagtaatggtgaggattcaatgaacgaatacacataagtctcataaggacagttgctgacacacaaaaaagcactcagtggatatgagttattgttattcaagatgccaccatctacagggagcctacctcamtgcttccaaattgagaactcttgagtttatcacttatcaggctgtactgatgatccgtttgtatacctatagtacttttgtaataactgtaatttctctctaactactaaaatggtgtctaatatgtaatagttgttaaacaaaactgataacaggagagaaaccatatggcaacatcatattttagcctcaatttgttttcagtagcaataatatcaccagtaatgatgtaatacttttagaatattcagttcccacaaacacaacagcaggaactttcaaagccaaagtgaacaacag

SEQ ID NO: 103212 - DNA, 601 bp, Human
aactttgaaccaccccactgttcttccatcaggaggcccttaggagaccaacggcttggtaaacacttacaacattgtcaaaatacattagaacacgggaaaagggcaaaggagtagaaaggctggcagggctgggctcacatataattcagttcttagatttgaagcctctttagctgctcgtatgtaataaaaaactgaggagtaagtcaaggaagatcaccaggttgatatcgaaagccaaagctagttctaaaattagcatcgcattctcttaaattaaggtagtctatgctattcyaagctgcatctgctttaaaatcttttctaaaacaccacctgacagccgggcgcggtggctcacgcctgtaatcccagcactttgagaggccgaggtgggtggatcacgaggtcaggagatcgagaccatcctggctgacatggtgaaaccctgtctctactaaaaatacaaaaaattagccgggtgtggtggcgggtgcctgtagtcccagctactcgggaggctgaggcaggagaatggcgtgaactcaggaggtggagtttgcagtgagccgagatcgcgccactgcactccagcctg

SEQ ID NO: 103213 - DNA, 601 bp, Human; identical to SEQ ID NO: 103206

SEQ ID NO: 103214 - DNA, 601 bp, Human; identical to SEQ ID NO: 103207

SEQ ID NO: 103215 - DNA, 601 bp, Human; identical to SEQ ID NO: 103208

SEQ ID NO: 103216 - DNA, 601 bp, Human; identical to SEQ ID NO: 103209

SEQ ID NO: 103217 - DNA, 601 bp, Human; identical to SEQ ID NO: 103210

SEQ ID NO: 103218 - DNA, 601 bp, Human; identical to SEQ ID NO: 103211

SEQ ID NO: 103219 - DNA, 601 bp, Human; identical to SEQ ID NO: 103212

SEQ ID NO: 103220 - DNA, 601 bp, Human; identical to SEQ ID NO: 27510

SEQ ID NO: 103221 - DNA, 601 bp, Human; identical to SEQ ID NO: 38503

SEQ ID NO: 103222 - DNA, 601 bp, Human; identical to SEQ ID NO: 38504

SEQ ID NO: 103223 - DNA, 601 bp, Human; identical to SEQ ID NO: 38505

SEQ ID NO: 103224 - DNA, 601 bp, Human; identical to SEQ ID NO: 38506

SEQ ID NO: 103225 - DNA, 601 bp, Human; identical to SEQ ID NO: 38507

SEQ ID NO: 103226 - DNA, 601 bp, Human; identical to SEQ ID NO: 38508

SEQ ID NO: 103227 - DNA, 601 bp, Human; identical to SEQ ID NO: 38509

SEQ ID NO: 103228 - DNA, 601 bp, Human; identical to SEQ ID NO: 54890

SEQ ID NO: 103229 - DNA, 601 bp, Human; identical to SEQ ID NO: 54891

SEQ ID NO: 103230 - DNA, 601 bp, Human; identical to SEQ ID NO: 54892

SEQ ID NO: 103231 - DNA, 601 bp, Human; identical to SEQ ID NO: 54893

SEQ ID NO: 103232 - DNA, 601 bp, Human; identical to SEQ ID NO: 54894

SEQ ID NO: 103233 - DNA, 601 bp, Human; identical to SEQ ID NO: 54895

SEQ ID NO: 103234 - DNA, 601 bp, Human; identical to SEQ ID NO: 38503

SEQ ID NO: 103235 - DNA, 601 bp, Human; identical to SEQ ID NO: 38504

SEQ ID NO: 103236 - DNA, 601 bp, Human; identical to SEQ ID NO: 38505

SEQ ID NO: 103237 - DNA, 601 bp, Human; identical to SEQ ID NO: 38506

SEQ ID NO: 103238 - DNA, 601 bp, Human; identical to SEQ ID NO: 38507

SEQ ID NO: 103239 - DNA, 601 bp, Human; identical to SEQ ID NO: 38508

SEQ ID NO: 103240 - DNA, 601 bp, Human; identical to SEQ ID NO: 38509

SEQ ID NO: 103241 - DNA, 601 bp, Human; identical to SEQ ID NO: 54890

SEQ ID NO: 103242 - DNA, 601 bp, Human; identical to SEQ ID NO: 54891

SEQ ID NO: 103243 - DNA, 601 bp, Human; identical to SEQ ID NO: 54892

SEQ ID NO: 103244 - DNA, 601 bp, Human; identical to SEQ ID NO: 54893

SEQ ID NO: 103245 - DNA, 601 bp, Human; identical to SEQ ID NO: 54894

SEQ ID NO: 103246 - DNA, 601 bp, Human; identical to SEQ ID NO: 54895

SEQ ID NO: 103247 - DNA, 601 bp, Human; identical to SEQ ID NO: 38503

SEQ ID NO: 103248 - DNA, 601 bp, Human; identical to SEQ ID NO: 38504

SEQ ID NO: 103249 - DNA, 601 bp, Human; identical to SEQ ID NO: 38505

SEQ ID NO: 103250 - DNA, 601 bp, Human; identical to SEQ ID NO: 38506

SEQ ID NO: 103251 - DNA, 601 bp, Human; identical to SEQ ID NO: 38507

SEQ ID NO: 103252 - DNA, 601 bp, Human; identical to SEQ ID NO: 38508

SEQ ID NO: 103253 - DNA, 601 bp, Human; identical to SEQ ID NO: 38509

SEQ ID NO: 103254 - DNA, 601 bp, Human; identical to SEQ ID NO: 54890

SEQ ID NO: 103255 - DNA, 601 bp, Human; identical to SEQ ID NO: 54891

SEQ ID NO: 103256 - DNA, 601 bp, Human; identical to SEQ ID NO: 54892

SEQ ID NO: 103257 - DNA, 601 bp, Human; identical to SEQ ID NO: 54893

SEQ ID NO: 103258 - DNA, 601 bp, Human; identical to SEQ ID NO: 54894

SEQ ID NO: 103259 - DNA, 601 bp, Human; identical to SEQ ID NO: 54895

SEQ ID NO: 103260 - DNA, 601 bp, Human; identical to SEQ ID NO: 38503

SEQ ID NO: 103261 - DNA, 601 bp, Human; identical to SEQ ID NO: 38504

SEQ ID NO: 103262 - DNA, 601 bp, Human; identical to SEQ ID NO: 38505

SEQ ID NO: 103263 - DNA, 601 bp, Human; identical to SEQ ID NO: 38506

SEQ ID NO: 103264 - DNA, 601 bp, Human; identical to SEQ ID NO: 38507

SEQ ID NO: 103265 - DNA, 601 bp, Human; identical to SEQ ID NO: 38508

SEQ ID NO: 103266 - DNA, 601 bp, Human; identical to SEQ ID NO: 38509

SEQ ID NO: 103267 - DNA, 601 bp, Human; identical to SEQ ID NO: 54890

SEQ ID NO: 103268 - DNA, 601 bp, Human; identical to SEQ ID NO: 54891

SEQ ID NO: 103269 - DNA, 601 bp, Human; identical to SEQ ID NO: 54892

SEQ ID NO: 103270 - DNA, 601 bp, Human; identical to SEQ ID NO: 54893

SEQ ID NO: 103271 - DNA, 601 bp, Human; identical to SEQ ID NO: 54894

SEQ ID NO: 103272 - DNA, 601 bp, Human; identical to SEQ ID NO: 54895

SEQ ID NO: 103273 - DNA, 601 bp, Human; identical to SEQ ID NO: 38503

SEQ ID NO: 103274 - DNA, 601 bp, Human; identical to SEQ ID NO: 38504

SEQ ID NO: 103275 - DNA, 601 bp, Human; identical to SEQ ID NO: 38505

SEQ ID NO: 103276 - DNA, 601 bp, Human; identical to SEQ ID NO: 38506

SEQ ID NO: 103277 - DNA, 601 bp, Human; identical to SEQ ID NO: 38507

SEQ ID NO: 103278 - DNA, 601 bp, Human; identical to SEQ ID NO: 38508

SEQ ID NO: 103279 - DNA, 601 bp, Human; identical to SEQ ID NO: 38509

SEQ ID NO: 103280 - DNA, 601 bp, Human; identical to SEQ ID NO: 54890

SEQ ID NO: 103281 - DNA, 601 bp, Human; identical to SEQ ID NO: 54891

SEQ ID NO: 103282 - DNA, 601 bp, Human; identical to SEQ ID NO: 54892

SEQ ID NO: 103283 - DNA, 601 bp, Human; identical to SEQ ID NO: 54893

SEQ ID NO: 103284 - DNA, 601 bp, Human; identical to SEQ ID NO: 54894

SEQ ID NO: 103285 - DNA, 601 bp, Human; identical to SEQ ID NO: 54895

SEQ ID NO: 103286 - DNA, 601 bp, Human; identical to SEQ ID NO: 38503

SEQ ID NO: 103287 - DNA, 601 bp, Human; identical to SEQ ID NO: 38504

SEQ ID NO: 103288 - DNA, 601 bp, Human; identical to SEQ ID NO: 38505

SEQ ID NO: 103289 - DNA, 601 bp, Human; identical to SEQ ID NO: 38506

SEQ ID NO: 103290 - DNA, 601 bp, Human; identical to SEQ ID NO: 38507

SEQ ID NO: 103291 - DNA, 601 bp, Human; identical to SEQ ID NO: 38508

SEQ ID NO: 103292 - DNA, 601 bp, Human; identical to SEQ ID NO: 38509

SEQ ID NO: 103293 - DNA, 601 bp, Human; identical to SEQ ID NO: 54890

SEQ ID NO: 103294 - DNA, 601 bp, Human; identical to SEQ ID NO: 54891

SEQ ID NO: 103295 - DNA, 601 bp, Human; identical to SEQ ID NO: 54892

SEQ ID NO: 103296 - DNA, 601 bp, Human; identical to SEQ ID NO: 54893

SEQ ID NO: 103297 - DNA, 601 bp, Human; identical to SEQ ID NO: 54894

SEQ ID NO: 103298 - DNA, 601 bp, Human; identical to SEQ ID NO: 54895

SEQ ID NO: 103299 - DNA, 601 bp, Human; identical to SEQ ID NO: 40452

SEQ ID NO: 103300 - DNA, 601 bp, Human; identical to SEQ ID NO: 40453

SEQ ID NO: 103301 - DNA, 601 bp, Human
ggtaaagagtaacattatgtgcactcttaatggaacaagcttctagtgaaatctcttgaaacaaactgcaggaagccatgcattataattattattatgagaattttaattccaaaacctctgtgctttatattgccatagtctgtctggggctaattattcaatgacaacaatggcaacagaaaacactcttaacaggcaaggcaaattatgttttaaaattgagaaagtacgtgtaatatacaaaaagactgaattttccagcaaccctcattggaaagaatgcacaaaatgccatccrgtgaataaataggttgatttaaatttgaggagcacttaactactgaaaattgaggtgaagaagacagctaatgctcatagcaagtaaaacaacctcatgtattaaaacaaaaggtggacctttggaatatttatgataatggtaaaagtatccctttcactctagcatttaattattttattatattctcctttaagctcatttcaagttatatgttatataatttttcctctatcatctactcctcccgaagtataccttttggacccctgtaagatgacagagaaaataaaaagtatg

SEQ ID NO: 103302 - DNA, 601 bp, Human
taggaatttgaggcttcagtgagctatgatcatgccactgcactccagcctgggcagcagagtgaaaccctgtctcaaaaagagagggagaaaaaaagaaaatgtggtatatgtataccatggaatactactcagccataagagttaagtcgtcttttgcagcaaaatggatgaaacttgaggccattatctaagtgaaatgactcagaaagtcaaatgctgcatgtttttacttataactgggagctaaacagtggtacagatggacatacagggtggaataataggcattggagacttygaaaggtgggagagtaggagggggataaggattgaaaaattacctattgggtaccatgttcactattcaggtgatagatacactaaagcccagacttcaccactgtacagtatattaaatatgtattagtaagaaatctgctctggtcccccttaaatctatgagtgtacatttttttaattgccaaaatattttttttaaattagcaattgatcactgaggatctttaggttgaaggaacaggagtagaagagagaggcaaaacttcattcagaagacaaatgtgattacatgttatca

SEQ ID NO: 103303 - DNA, 601 bp, Human
atgactcagaaagtcaaatgctgcatgtttttacttataactgggagctaaacagtggtacagatggacatacagggtggaataataggcattggagactttgaaaggtgggagagtaggagggggataaggattgaaaaattacctattgggtaccatgttcactattcaggtgatagatacactaaagcccagacttcaccactgtacagtatattaaatatgtattagtaagaaatctgctctggtcccccttaaatctatgagtgtacatttttttaattgccaaaatattttttttaaattagcaattgatcactgaggatctttaggttgaaggaacaggagtagaagagagaggcaaaacttcattcagaagacaaatgtgattacatgttatcaatagattatggccatttctaatcgaatcctggtaaagcaacaaattcaggttagcatccaaacctggcacctactatgtatgtgttacagaaagactaacttgcagaactttttggatatttataaatcatatatatatatatgagattttatatataaagttcctgacacatggtaggtactcaactaaaggtaacta

SEQ ID NO: 103304 - DNA, 601 bp, Human
gccagtagcatcatctgattgtgatattgaaggtaaagatggcaaacaatatgagagtgttctaatggtcagcatcgatcaattattggtatgtgattattttgttttactcacattttcatgcattgggaaaatttgaacctttttggtatgcagttttataatcaagtattcatctttcttgacaagaaagtgaagtaactatagaataaaatttaatgagctactaactgtatatttttatagctgacataattatgtagcttaaaaataattctttcctcgactctaagattctcayaactattcatttcagtcctatttcccttttagtaaatttcttgtaagcataattcagtatcactgcctaaatttcctcacctcccatttaccatgttagtccctgtagaagcattacattaagagtgggaaaataacagagtaaatagttaagacttatggtgaatagatgtgtattttatttggctgtgtgtagatgcatagttatttatatgtgtgtattttatatctatgtgtaatcaataatttgttatgagttaaattttctatttttgatggttaaagcttttctaattaatag

SEQ ID NO: 103305 - DNA, 601 bp, Human
caatatgagagtgttctaatggtcagcatcgatcaattattggtatgtgattattttgttttactcacattttcatgcattgggaaaatttgaacctttttggtatgcagttttataatcaagtattcatctttcttgacaagaaagtgaagtaactatagaataaaatttaatgagctactaactgtatatttttatagctgacataattatgtagcttaaaaataattctttcctcgactctaagattctcacaactattcatttcagtcctatttcccttttagtaaatttcttgtamgcataattcagtatcactgcctaaatttcctcacctcccatttaccatgttagtccctgtagaagcattacattaagagtgggaaaataacagagtaaatagttaagacttatggtgaatagatgtgtattttatttggctgtgtgtagatgcatagttatttatatgtgtgtattttatatctatgtgtaatcaataatttgttatgagttaaattttctatttttgatggttaaagcttttctaattaatagattttataccttagagccaacttaggtttctagaaaattcgagcag

SEQ ID NO: 103306 - DNA, 601 bp, Human
taatactaatagttatgaagtgcttgttatgttctcagtgctttccatgtgttaactaatttaatccttacaacagcccttgagaaagacactcttactacctccgtttcacaacagaagaatctgaggcccagggttatccagtttataagtgaccgagccagaatctttgtccatgctctctaccccactctcctacctcccaaggacaatctctgtgatagtttattcaatcagcaaacatttatttagggcctgatatgtacaagttactatgaaaaacccatttgtgtaggtgatrttgggtttgggtgtggatagaatgatggaccaagtacagatcttttttcaagaagcttacattttggtgagtgttaaagattggtggtgaataatgcaagttacagttttaaaagtaggaagagtgacttcctgtttgttagatgtctgcttatcatctaacaaatagactggttgtaaaacaagctcagaaacaaaaagatgtaaatggtgttctggaagtagtaaagaagcaattttggcctgtgtagaagtttcagcaagttatccagaaggtctagctaagatgattggtaaaagt

SEQ ID NO: 103307 - DNA, 601 bp, Human
caaaaaattctttttaaattaaaatgtatacattgttattttagacataagactattgtacacataatagactacagtatagtgtaaacataacttttatatgctgggaaaccaaacaaaattgtatgactcactgtattgtgatacttgctttactgcagtggaaccaaacccacagtatctctgaggtatgcctgcaataaattatgcaatcattatcactatctaattctagaatattttcatcattgccaaaagaaatattctacccattagcagtaactctttattccccatcacyagcctctggcagccactattctgcattctgctttctgtctctaggaatttgcctattctggacatttcacatctgtcttgtatataattcatatggatgatatgcagctttttgtattgatcttgtttgccttagtataatgtttttaaaattaatccatatgataacaggagttagtatttcatttctcttcatggctcaataaaattctgttgtatggatatgccacattttgtttatccattcatcaatttctggacatttgggttttccattgtttggctatgcaagtttttatac

SEQ ID NO: 103308 - DNA, 601 bp, Human
acagaaatagttttcctataaagccacaaataagtgatacttggagaagaaagaacttgtctttcccccttgaataatcttggcatcctcatcaaacatcacttcaccagagatgtatgggtttatttctggactctccaattccattttgttcatctgtatatctgtcctgggtcagtaccaaactgtctttattactctttctttggataagtttgaaatcgggaaatatgaatcattttactttttttttttttgagattgttttggttcatgcataaactaatttgggaccatcatyttcgtaataatgtttaaaaatgcttgtggtccatgaacatgggatttttgttccatttatttgtatcttttaaattttcttttaacaatattttatagttttcagaatataggttttacccttcttttgttaaatttattcctaagtatcttatgtctctttaatgctattgcaaatggaattttttctttattttaaaattatctatgatttctaactctccactccttgtatacttacctaagtatgtgtcttatttccccgtactagtccatatgtatattaaggacagattttatg

SEQ ID NO: 103309 - DNA, 601 bp, Human
aatcattttactttttttttttttgagattgttttggttcatgcataaactaatttgggaccatcattttcgtaataatgtttaaaaatgcttgtggtccatgaacatgggatttttgttccatttatttgtatcttttaaattttcttttaacaatattttatagttttcagaatataggttttacccttcttttgttaaatttattcctaagtatcttatgtctctttaatgctattgcaaatggaattttttctttattttaaaattatctatgatttctaactctccactccttgtmtacttacctaagtatgtgtcttatttccccgtactagtccatatgtatattaaggacagattttatgtttgagtcatctttgtatctcacagactattagcccagcatcttacacgtagtagtttttcaaatgtttaattaataatttatggattgttaatcaacaccataaattaatgaaaacccagagctaattttgaataatctaggaagcctgtttttttaacatatgttctttggaaatttgttatgaattaaatatcaggtactttttgatatcaatatgaactagttttggat

SEQ ID NO: 103310 - DNA, 601 bp, Human
atgtttaattaataatttatggattgttaatcaacaccataaattaatgaaaacccagagctaattttgaataatctaggaagcctgtttttttaacatatgttctttggaaatttgttatgaattaaatatcaggtactttttgatatcaatatgaactagttttggatgttatacaatattttttatccataaaaaattattttacctaaatataactcacatggttgaactacataactcttagtcaccacagcaaaggctgtttcaaaatataaaggctgctagaaatggccaaacrctttctaggaataactcagtctaattgtaggcaaatacagggctatccctttattttaagttgtaaacttataaatctaatgactaatcggttataatatactttcacaacttccaatatctttaactgtgactctattccagaggctttcacagattcaacttctgtctttgcactgacagctctcatatagcctgaggtctacatttctcccattaactctaggaccatttaattcaaatatctagtagatatctctacccagatgtactatggcacctcatgcataatagtcaacta

SEQ ID NO: 103311 - DNA, 601 bp, Human
aagaaaatagatatttgcatgatacagtgagagcagtgcttagggtattaaatgcatagaaagaaaagaaaaagatataaaatcaatagtctaatcttccaccttaggaaaacagaaatgagaaagaaaattaaaactaaattaatcagaagaaaataaataatgaaattagagatgaaattgagaacaagaaattagtagaggaaaatcaatgaaaccaaaactggttctttgaaaagatcaataaaattaataagcctccagccaggctgaccacgaaaataagaaacaagacacaaaytactactatcagaagtgaaaagagagccatcactactgattccatggatattataaagataatgaggtaaaagtattttgatggttaattttatgcattaacttatcttggccaaggaacaccaaggattgccagcagccaccaaaatctaggagaaagtcatgaagtggtttcaccacagagcctccaaaaggaaccaaccctgccaacactttgatgtcagacttatggcttccagaactctgagagactaaatttctgttgttttaagccaccctgttcatggacatttgttataga

SEQ ID NO: 103312 - DNA, 601 bp, Human
aaggtacagatgaagagattcatgggcaagatatgggagaacaggtctggagctttcttgccttctctgggcatgccaccctccaaatacctccacatgttcagctatttgtaagctctctggagagttaggcatgactgattaaatcattggccattggtgatcaacataaccttcagcccctctcctctccccagaagctgggggatggggccgaaagtcccaaccctctatttatgccttgttatcctaggggctgggactggggctggagctgggggctgcctaggggctgccagayaccagtcatctcattagcacagaaaaagacattcctttggaggtttcaaggattttatgggttgtgtgtcaggaatctgggacaaagaccaaacatacagtcatacgacacaatgtttcagtcaatgagggactgcatataccatgatggccccataagattataatggagttgcaatattcatattgcctagtgacatcatatctgtggtaatgtcttagaatgcattactcacatgtttgtgatgatactgatgtaaacaaacccattgcactgccagtcatataaaggtatagcaca

SEQ ID NO: 103313 - DNA, 601 bp, Human
agcaatagactataccttatagcctaggtatgtaataggctataccatttaggtttgggttctatgatgtttgtgcgatgatgaaatcatctaatggcaccattacaatgacacatttctcataatatatcccctatcattaagtgacacataactgtatttcacagtatcacaatgtacatgaggaatctctataccttcttctcatttttttgtggacctaaaattgctctataaaatagtctttaataaaaagagagaaagaggacagtccctgtccaccaacaaaattgaccacagrttttcccacttctcagtgcactaccattgccacataccccttcgcatatagctgtgttcccaggctttccaagagcacacagagcagataatactgtggcttcacttagaaattcaacagagaagtgactgtgataagtgagaagaggatcatgagatatggagtcaaataaatatcagcacagagtggtccactttaaatttaagatgaaaataacatacaacgatacagaaatgccacagcaaaataaaaagactaaaagaaacctagaatataagcatccattctggaagggggcag

SEQ ID NO: 103314 - DNA, 601 bp, Human
aggtagtttcccaaaaggaagagtaaaactgaaatggcccccagcacctggagagaaaaaggagaaactgcaagttggagcaatgagatgaatgctaatgccacaacataattacaaagtccgtcctagtgaagaaggaaggcactttcagattgcccttttttataggtgcctgttgttgtcaaggcctgttctcatacctggccagacttccattaagtctgtgcattcaactttgaggacaatgatgcgtctaatactcccaggcctgaatagctattttatgaaaattactatattsgtatttttatttgttttgaacccacatctatgcctgcattagatattataaactttattatctagcttctttaccatgtgcagatagaggtgaatctcaactagacaaccgatgaagacattgtcgatcacataatgataatatttgtgcttcagttgtttttctcttaatggtgcttattatgcaggttattaattcaaagaccatcattggtattgaggaatgtgagagtaggaatgtcatttatagagatgaaaagtttctattcaccatgaagatcacagatgttttcatctgcca

SEQ ID NO: 103315 - DNA, 601 bp, Human
gaaggcactttcagattgcccttttttataggtgcctgttgttgtcaaggcctgttctcatacctggccagacttccattaagtctgtgcattcaactttgaggacaatgatgcgtctaatactcccaggcctgaatagctattttatgaaaattactatattggtatttttatttgttttgaacccacatctatgcctgcattagatattataaactttattatctagcttctttaccatgtgcagatagaggtgaatctcaactagacaaccgatgaagacattgtcgatcacataatgataatatttgtgcttcagttgtttttctcttaatggtgcttattatgcaggttattaattcaaagaccatcattggtattgaggaatgtgagagtaggaatgtcatttatagagatgaaaagtttctattcaccatgaagatcacagatgttttcatctgccagggagtaatttatactgcatctacttatgttatgacccgtgtggaccctgtgtcaatattgaatctgaatatgccacttgctagctatgtgacattggataaattacttaatccttctgtgccttagtttccttatt

SEQ ID NO: 103316 - DNA, 601 bp, Human
actttttttccttcttgttaacctagcaatgttgggcattagatgaagaagaggcaaggctacagggttagataaggatctgcagtcttagtctttgcaaatacttggtatctcttgccttctcaaaacttaggcattgaaaattattataagtaatgaaatccaaaatgttagatagggtaaacacagttgaactcacaaatatatgtttttttttcttttctctgctcttttggtagaaaatgtagaacatgattaataaggttggagttttttctttataatttttttcacagtggcrttccaaactaaagaatgcttgtttacctaatatggccaaattggagccagtaccttcattcagctagatttaccccagttgcatatttgcaatgaggcagaattcctacagacagccttccttctgatttttctgcctttgttcctcctcacactgtgtttctcccataattcacatctaccctctacctaattggcttctccagtcaaagtggataagcatctcagtcagaaatacattatgagaacttcccaaacatgtactaatcgccacaaaccaaggctcagatcatgccatatc

SEQ ID NO: 103317 - DNA, 601 bp, Human
ccaaagacgtgcccactgggtgaatgggtatgtcgacatggtcctagtctgagtgtaggtgtgtgtgaatgcaccctgtgatcgagggtgtcctatccaggactggtccgtgctttgtaatctgagctgctgagatagactccagccacctgaactagaataagcagtttggaaagtgaccctgaactagaataagcagtttggaaaatgaacaaatcaatcaatgtaaattattgtcaaataaaaatttgttaagtaaatggtcattatacaaatacacaacaataaatgatgcaagacraaggtgctcatccagctgtgagtcagccttacttgtttgtgattcttttttaactgtgtggtggaagtgctcctgacagttttagctttgcaaacacttatttcttgacttaatccaccaccactatgaccatcgacactcactgatttacaaaaacatgggtaattatcttgtttttgttaatctttcttaaatgtatgtgtagctcatatttaattcagtgtttaatattagaaatgtttggggtcttcatttagaaatttggcgatgtttttgtgatgagaaatatgccacaggatc

SEQ ID NO: 103318 - DNA, 601 bp, Human
gtgatttcatgaagttcgtcatttctatgacagcaagttgtggagaccaaggagaagaacctgaagagtttattacagaacacacattagataacattatgggaattttcagaaattacatggtgctttcagaggagtttatctccatcagataggaacttaaaggcttaaattataataatgtgtgtataaaaaaagaagagtgattttattatataatcactggatagacaaaactgtaaagatctcctataaagcaaaaggaaataatttgtgtatctgtctacatactatcttcctrcctatctcacttgtgtgcgtgtgcgtgtgtatgtgtgtgtgtgtgcgtgtctttgcatattggtctgtgtatgcatatgtatatataattaagagaagatgattgataccatagacagagcagagagctaatctataaataataagtgtttctgaagagaaaatagcccatcaaaacagaagcaaaagttcagaataaaagagagatatatttctgtattaaaatcttaaacttgttgattatgactcaagggtaagagacaaacactaggatatatcaaggtgaattttttcaaggaag

SEQ ID NO: 103319 - DNA, 601 bp, Human
tacagaattgttggtaggagcaaatatttgactattcatcaataagtattgaataatttgtggaacacacttaatgtggaatattacgcagttataaaacaattgttctagtatgtttgacctagaatgacagtcatgatataaagtgagaatgatacaaaaatcaaagtgtaatgtatacactgtgatcctattttttaacaaaatgaaaaaggaaaataccctcataaaaccctatatatgcatgtatatatgtgtattttctatgcctgcagacctaacacgcataggcataggatgmtgagctgaaagtatagaggtctcatatactccttgtgcccacagacaaatttccccactatcaacagttgctatcacagtggtacatttattatgatcaatgactctacacatcattgtcacccaaagtctatagtttagattaagattcactcttggtgttgtacatactatgggttttgtcaaatgtcttcaatccaaattatattacagaatagtttcactctcctaacaacttcactgttcattctttgtgcctctcctattcatccacttgctccctcttaaatcttgacaaacc

SEQ ID NO: 103320 - DNA, 601 bp, Human
ccattatcactgacgatgtagtggacatagcaggggaagagcacctacctgtgttggtgaggtttgttgatgaatctcataacctaagagaggaatttataggcttcctgccttatgaagctgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttyctgtgccttaaatatgtggttggcaaaatcagtacctgttatgggagtatctgttgcattaggaacaatcgaggaagtttgttcttttttccatcgatcaccacaactgcttttagaacttgacaacgtaatttctgttctttttcagaacagtaaagaaaggggtaaagaactgaaggaaatctgccattctcagtggacagggaggcatgatgcttttgaaattttagtggaactcctgcaagcacttgttttatgtttagatggtataaatagtgacacaaatattagatggaataa

SEQ ID NO: 103321 - DNA, 601 bp, Human
tgaatctcataacctaagagaggaatttataggcttcctgccttatgaagctgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctctttctgtgccttaaatatgtggttggcaaaatcagtacctgttatgggagtatctgttgcattaggaacaatygaggaagtttgttcttttttccatcgatcaccacaactgcttttagaacttgacaacgtaatttctgttctttttcagaacagtaaagaaaggggtaaagaactgaaggaaatctgccattctcagtggacagggaggcatgatgcttttgaaattttagtggaactcctgcaagcacttgttttatgtttagatggtataaatagtgacacaaatattagatggaataactgtatagctggccgagcatttgtactctgcagtgcagtaacagattttgatttcattgttactattgtt

SEQ ID NO: 103322 - DNA, 601 bp, Human
ttacattgtctctagtggattttcttccaaaatgaaagttgttgcttctagacttttagagaaatatccccaagctatctacacactctgctctttctgtgccttaaatatgtggttggcaaaatcagtacctgttatgggagtatctgttgcattaggaacaatcgaggaagtttgttcttttttccatcgatcaccacaactgcttttagaacttgacaacgtaatttctgttctttttcagaacagtaaagaaaggggtaaagaactgaaggaaatctgccattctcagtggacaggsaggcatgatgcttttgaaattttagtggaactcctgcaagcacttgttttatgtttagatggtataaatagtgacacaaatattagatggaataactgtatagctggccgagcatttgtactctgcagtgcagtaacagattttgatttcattgttactattgttgttcttaaaaatgtcctatcttttacaagagcctttgggaaaaacctccaggggcaaacctctgatgtcttctttgcagccggtagcttgactgcagtactgcattcactcaacgaagtgatggaaaatattgaa

SEQ ID NO: 103323 - DNA, 601 bp, Human
atcctctcttcctatttgaatatcctttatttctttctcttgcctgattgccctggccagaacttccaatactatgttgaataggagtggtgagagagggcatccttgttttgtaccagttttcaaaggaaatgtaaccgaacagcatggtaatggaaccaaaacaaatatatagaccaattgaacagaaccgaggcctcagaaatagcatcacacatctacagccatctttgacaaacctgacaaaaacaggaaatggggaaaggtttccctatttaataaatggcgctgggaaaactgrctagccatatgcagaaaactgaaactggaccccttccttatgccttagaacaaaaattaactcaagatggattaaagacttaaacatacgacctaaaaccataaaaaccctagaagaaaacctaggcaataccattcacgacataggcatgggaagacttcatgactaaaacaccaaaagcaatggcaacaaaggcccaaattgacaaatggtatctatttaaactaaagagcttctgcacagcaaaagaaactataatcagagtgaacaggttacctacagaatgggagaaaatgtttg

SEQ ID NO: 103324 - DNA, 601 bp, Human
acacatctacagccatctttgacaaacctgacaaaaacaggaaatggggaaaggtttccctatttaataaatggcgctgggaaaactggctagccatatgcagaaaactgaaactggaccccttccttatgccttagaacaaaaattaactcaagatggattaaagacttaaacatacgacctaaaaccataaaaaccctagaagaaaacctaggcaataccattcacgacataggcatgggaagacttcatgactaaaacaccaaaagcaatggcaacaaaggcccaaattgacaaatgrtatctatttaaactaaagagcttctgcacagcaaaagaaactataatcagagtgaacaggttacctacagaatgggagaaaatgtttgcaatttatccacctgacaaagacctaatatccagaatctacaaggaacttaaacaaatttataagaaaaaaataaacaaacccatcaaaaagtgggcaaaggatatgaacagacacttttcaaatttatgcggccaacaaacatatcaaaaaaagttcatcatcactggtcattagagaaatgcaaatcaaaaccacaaagagatatcatct

SEQ ID NO: 103325 - DNA, 601 bp, Human
gagttttaacatatgcacaaagatactccaccttacaagaggtacagcttaaattccctcctcttgagtgtggattagaattagtgactcactgcaagcaactgaataatgaggaaatggcagtgtgtgacttccatgtaataaaagacatggcttcctccttgctttctcttacattgatacttgggggaaagtcagcaactatcttggaaggatattgaagaaagcctgtggagaaactcatgtggtgagaaattgaggcattctgccaatacctgcatgaataggtcatcttgggaayagatcctctaatcctgatggagtccagatgactacagacatgaccaacatcttgactgcctcctcatgaaagatgaactagaagctcccggttaggcagcttccaaattcttgatccacagaaactgtactgaaagcatcaatttcttaccacatgtcttttggacaaactcaacattaatggacagaggagcatacttctctatagtaggctaaataatggccacccagataaaaaaattctaatctgaaaatgtataaggtaaaggaatctacagatgtgattgaattaagaatgttg

SEQ ID NO: 103326 - DNA, 601 bp, Human
ctctcatttgttgagtttagatgttaaatactggctgaacaataatctactctactttagcatcttttcaaaaataatcacaaaatttaaaaggaaaattatgcactggtactagcaaaataaatgaacaaatgaattaacacaaaataggcaaaaggaaaatgaagtatctagaccaaagtttaattatccatgaaagcaatggaaaatgtgaagtctctaagaaaccaatgtaaaaagagctaaaaacaatatagtatgaaagaaaccagaaagaaacaaatgttctttggattttggrgaaatacagagactaaaataaaaaccagaaatgaatactccattaaaacaggcatatgaaagacaggatgggtaaaaaccacacaaaacgaaattgtgtgtttgtgtatatatacgtgtgtacacacatacacgaaaagaaaaagttcaatagaaggttcattttttatgtaattagtgtttctaaagaagatacttaaaatgtaatttaaaaattcaaagatagaagaaaactatgctgaaattaaagaagatataattctacaaatgtaaagaacattatgtattttaagaacttgaa

SEQ ID NO: 103327 - DNA, 601 bp, Human
gaaaatgaagtatctagaccaaagtttaattatccatgaaagcaatggaaaatgtgaagtctctaagaaaccaatgtaaaaagagctaaaaacaatatagtatgaaagaaaccagaaagaaacaaatgttctttggattttggggaaatacagagactaaaataaaaaccagaaatgaatactccattaaaacaggcatatgaaagacaggatgggtaaaaaccacacaaaacgaaattgtgtgtttgtgtatatatacgtgtgtacacacatacacgaaaagaaaaagttcaatagaagrttcattttttatgtaattagtgtttctaaagaagatacttaaaatgtaatttaaaaattcaaagatagaagaaaactatgctgaaattaaagaagatataattctacaaatgtaaagaacattatgtattttaagaacttgaaagaaaaggagtggggaagtggccaagatggccaactagaagcagctcgtgtgagtggctctcacaaagagggacaaaagggcgagtaaatacagcaccttccactgaaacatccaagtactcgcactgggactaatcaaggaaacaacttgacccat

SEQ ID NO: 103328 - DNA, 601 bp, Human
tgtgtatatatacgtgtgtacacacatacacgaaaagaaaaagttcaatagaaggttcattttttatgtaattagtgtttctaaagaagatacttaaaatgtaatttaaaaattcaaagatagaagaaaactatgctgaaattaaagaagatataattctacaaatgtaaagaacattatgtattttaagaacttgaaagaaaaggagtggggaagtggccaagatggccaactagaagcagctcgtgtgagtggctctcacaaagagggacaaaagggcgagtaaatacagcaccttccrctgaaacatccaagtactcgcactgggactaatcaaggaaacaacttgacccatggagaacatagaaaacaaaggcaggacgacagcccacctgggcacgacacccagccaggtgaacctcccctgcccagagaatcggtgagtgaatgtgtgaccctggaaaccacactcttcccacgaatctttgcaacctcgagttgggagatcccctcttgaacccactccatcagggctttcagtctaatacacagagatacgggagtcttggcagagaagctgctcaggcacatgttggagaac

SEQ ID NO: 103329 - DNA, 601 bp, Human
aagggcgagtaaatacagcaccttccactgaaacatccaagtactcgcactgggactaatcaaggaaacaacttgacccatggagaacatagaaaacaaaggcaggacgacagcccacctgggcacgacacccagccaggtgaacctcccctgcccagagaatcggtgagtgaatgtgtgaccctggaaaccacactcttcccacgaatctttgcaacctcgagttgggagatcccctcttgaacccactccatcagggctttcagtctaatacacagagatacgggagtcttggcagagmagctgctcaggcacatgttggagaaccaggaactgtagatattccaccttcaggcttcccggcaaaagtaactgcaactccagaaaagcaggagattagatccttgtgcatacccttaggaaagaggctgaatccagtgggccaagcagcgatggtctgtaggccctacttccatggtgcctcaaaggataagacacattggcttggaattccagccagccaccagcagcagtgttgtgcctacctgggacagagttcccagggagaggggaaggccaccatcttcactgtttgggcaag

SEQ ID NO: 103330 - DNA, 601 bp, Human
aggatcaaaaaacaattaatggatactaggcttaatacctgggtgatgaaataatctatacaaaaaaaacccatgacacaagtttacctatgtaacaaacctgcacttgtacccctggacttaaaataaatgtttaaaaaatagagaaagaaaaagacactaaaaacatgaaaagatatgaaagcatataactcactgtaaagataaagcataaaattcaccataaagataaaatatagtcaaattcagagggctgtaatgaatttgtatgtaattaagtgtatactgtaattatagtttrtaagttacttttcctctactataagagttaaaagacaaaagtattaaaaaataacttcacctaaaaaaaagaacttagccaatgtcatgttttatactagaaaatactgcagttcagtcttataatcctggcttttctcttctgattttccatatttataaaatatttgaagaaatttgtttcttatgtacatcttgacatatgtgatatatgatttgtttctttttattttttatttttttctgagacagagtcttgctctgttgcccaggctggagtgcagtggcgtgatctcagctc

SEQ ID NO: 103331 - DNA, 601 bp, Human
aaaaagacactaaaaacatgaaaagatatgaaagcatataactcactgtaaagataaagcataaaattcaccataaagataaaatatagtcaaattcagagggctgtaatgaatttgtatgtaattaagtgtatactgtaattatagtttataagttacttttcctctactataagagttaaaagacaaaagtattaaaaaataacttcacctaaaaaaaagaacttagccaatgtcatgttttatactagaaaatactgcagttcagtcttataatcctggcttttctcttctgattttycatatttataaaatatttgaagaaatttgtttcttatgtacatcttgacatatgtgatatatgatttgtttctttttattttttatttttttctgagacagagtcttgctctgttgcccaggctggagtgcagtggcgtgatctcagctcactgcaagctccgcctcccaggttcaagcgattctcctgcctcagcctcccaagcagctgagattacaggcatgtgccaccacacccggctaatttttttttttttttttgtatttttagtagagatggggtttcaccatgttggccagg

SEQ ID NO: 103332 - DNA, 601 bp, Human
aagtgtgctatttcatagtcttttaaaaactcacagtagctaagttagcctcatggcatctcacaaccataaattcttttttttaaatttcttaatttaaatatctgcaaaacttatgttttaggtgactacagtcctttattttcttattatcagctattcttccatagctcaaaagatgcaagaaatactaagaaaaaaccacacatacctcttataatacattgttgcttccagaagtcttctccttcggttatcatgtttaaaattgaataatcttctaatatgttcacacataagygataagatcacataagcataatagagaaaacaaactttaaaagtcaagataattattaaaccaagttctaagaacttcatgctgtcacctaggagccaaacagttttagttctgttacttgtcaatcacatgattaactggaatagaaagctggggtggaggcggggcattacctagcaacatagctcaagctctaggctccttaagaaagcttataatttcttaatattttatttgaaccatggcccttctgactttttcctataataggaaggtatgtttttattccgtgctgctcgc

SEQ ID NO: 103333 - DNA, 601 bp, Human
taggttttatgttgcttgcacatccaattaattagttgtgactgttgaaaatactgtgttgattataagcctccactcttggttcaactgaaaagagtgtaaaacggaaaactgatatcacctcttggtctactaagaggtaaaggtcttaggtatgttatatatttgtgattctttctcttatgtattgagctttatatggatcatcatgttccaaaattaactgtagagaaagaaaatatgcaaataatttaaatctttgaaattaaattatattacattgattaacttgatacaagtmacctttttcttgaaataacaaggcaagatgttaaagcagtcagctacactgaattttcttcatgagccaggcacgctacaagctttttactattgttttatttcattttgtttctgataagtgaagcttaataaaatgtatggccaggatttaacaatttcttgttaactttatttttatattgattaaaattcaagttttatctctgctagtataccctactatgttaatttttcatacctcacagtagttaacacagtactaggcagacctacaaaattatggattctgggtattcag

SEQ ID NO: 103334 - DNA, 601 bp, Human
gttttatgttgcttgcacatccaattaattagttgtgactgttgaaaatactgtgttgattataagcctccactcttggttcaactgaaaagagtgtaaaacggaaaactgatatcacctcttggtctactaagaggtaaaggtcttaggtatgttatatatttgtgattctttctcttatgtattgagctttatatggatcatcatgttccaaaattaactgtagagaaagaaaatatgcaaataatttaaatctttgaaattaaattatattacattgattaacttgatacaagtaacytttttcttgaaataacaaggcaagatgttaaagcagtcagctacactgaattttcttcatgagccaggcacgctacaagctttttactattgttttatttcattttgtttctgataagtgaagcttaataaaatgtatggccaggatttaacaatttcttgttaactttatttttatattgattaaaattcaagttttatctctgctagtataccctactatgttaatttttcatacctcacagtagttaacacagtactaggcagacctacaaaattatggattctgggtattcagaag

SEQ ID NO: 103335 - DNA, 601 bp, Human
agaaaggttgggtgcggtggctcacgcctgtaatcccagcactttgggggtccgaggtgggcggatcacaaggtggaaagatcaagaccatcctggccaacatggtgaaaccccgtctctactaaaaatacaaaaattagctgggcgtggtgcacgcctgtagtcccagctactcaggaggctgaggcaggagaatcacttgaacccaggaggtggaggttgcagtgagccgagatcgcgccactacactctagcctgggcaacagagtgggactccgtctcaaaacaaaaaacaaaaaaacagagcaaaaaaaaaaaaacaaaaaaaaaaaaaaaagaaaagaaaagataacaactattttcccaggatgcaggggtaaaaccaagattctctgttttttactttttagtgaatgcttattctcggtgtgcaaggaaaagtatgaaattttcacatctgtatatttcaaatctgcttaggcaaatcaacttcaacttgtacttaaaaaaattgtccaggaccccctattgaaaacaatatgaaaagtttgcctttatatttccctttgagatctgttgtttaatctttgaaatgtattct

SEQ ID NO: 103336 - DNA, 601 bp, Human
tccactagtatcttcttatctgttccaggacccaatccggcataccaactgcattttgttgtctgtcacccctgtctcttcaggtctacgacagtgttttcttgactgttttttatgaccttggttgtcttaaggggtctatccaggtattctgtagaatgttccacagtttgaggttgtctgctgttttctagtgattagactgagcttctggatttttagaaagaatatcacagagtaaagtgcccttctcatcacatcacatcaaggagtgaatgaatggtttcagcgtgacatctgrtgtcatgttgatggtgacacgaatgatgttgatctttattacttggttaaggaagagtttgccaggttcttcctcagaagttactgtttttctctttccctcctctattatttgagagttagtcaccaagtctagcccaaggggttatattaatagtgatgccccatgcttttgtggtacatacttctctgtgtacaacagccaatggtgaggcaatgactatccagtgccatccccaactaccaggaatgtccccatgctctgaaagagaacagacatccttctcacttgagccaaagc

SEQ ID NO: 103337 - DNA, 601 bp, Human
agcttctggatttttagaaagaatatcacagagtaaagtgcccttctcatcacatcacatcaaggagtgaatgaatggtttcagcgtgacatctggtgtcatgttgatggtgacacgaatgatgttgatctttattacttggttaaggaagagtttgccaggttcttcctcagaagttactgtttttctctttccctcctctattatttgagagttagtcaccaagtctagcccaaggggttatattaatagtgatgccccatgcttttgtggtacatacttctctgtgtacaacagccartggtgaggcaatgactatccagtgccatccccaactaccaggaatgtccccatgctctgaaagagaacagacatccttctcacttgagccaaagcaaaacataaaccccacagtcaacacttttgaacagatgtgtatgatctcctggctttgaggcttggttttcatgatttcacaagttagatattagatcatggagtttctatcctatttgtgtagaaatttaaaaaatgttattcatggaggttagcaccactggcccgcagttaggccttgaatacatccatttgctccagcttg

SEQ ID NO: 103338 - DNA, 541 bp, Human
attaggctgggtgtggtggctcacgcctgtaatcccagcactttgggaggctgagacaggcagatcatgaggtcaggagttcgagaccaccctggccaacatggtgaaaccccatctctactaaaaacacaaaaatcagccgggcatggtgacacatgcctgtagtcccagctactcaggaggttgaggcagaagaattgcttgaacccgagaggcggaggttgcagtgagccgagattgygccactgcacttcagcctgggtgacagagcaagaccccatctcaaaaaaaagaaaaagaataaataaataaaaatacaaaaattagccggtcatggtggcaggtgcctataatcccaactactctggaggctgaggcaggagaatcacttgagctcgggaggcagaggttgcagtgagccgagatcgtgtcattgcacgatctaggtgcccagcctaggtgccagagtgagactcggtctcaaacaaaaacaaacaaacaaacaaacaaaaaaccccacaagactttaatgttgagtagg

SEQ ID NO: 103339 - DNA, 601 bp, Human
tgcttttattgtatcttaattagaagaagtagaagttactttgcatagatctacctacctttggatttgccacagtgttgtggacacatttattcattttgcatctcctgacttctatgtctcttcacatcctctttctcagcttatctcaggaaacacccatcagtgttggggaattctggggagtaaccaaagatttagaagttaaattcagcctactgagaataggagctgaggggatgaagaattgaaacttaacttttcatgatgctatggagaaatgacttcccttttgataaaycgtatgagtcaatgaccatctgttttagttgcttttggtaagggaaaaaagtgtaatggaatatttactcaagcttttatctttactggttctgcaagtgtctttggatcctgatttgtaattatttatcattactattttagttggtttcagacatttcaagagaaggctttctgcttatcctgccttataataatactttttttaaaagcaaaacaggactctcttcttccacagtagtcgtaattataggatcattgataattgtgactttatcacccctttgatctattttaatgt

SEQ ID NO: 103340 - DNA, 601 bp, Human
catatgttagttagcctgatttagccattccacggtatatacatgtttcagaacatcatgttgcacaccataaatacaaacaattttttaatttgccaattaaaataaaaaccaggtttaccctattaaggataaggggtttctgatgagtaaatgacatagaagagttaataaagatggtaaactctcgtgggtatactcgagagaggaaaggaaatggccttcgtcttcggtgtaggtagttattctttccctttcgtgtcagcataggaaggtgtgctcaacatcaatttcactcttyctgtggatagcacagttctgaactgtgctattcaagataaaacagtcttgaaatttttctgtgattttcatattcaaatggcatatttaaatagatatttaaaagactcaaaggaaaatgagtgagcaaaataataacttcaccctgtagtactctcgttatttttcagtactttcacattccacaaatattgactgtctacctaacatggggggggtttgggaattacagcagagaaagaacagagctgcctgccctcgtaaagttcacaatccaggagagaggtagacaaataaatag

SEQ ID NO: 103341 - DNA, 601 bp, Human
gtcagcataggaaggtgtgctcaacatcaatttcactcttcctgtggatagcacagttctgaactgtgctattcaagataaaacagtcttgaaatttttctgtgattttcatattcaaatggcatatttaaatagatatttaaaagactcaaaggaaaatgagtgagcaaaataataacttcaccctgtagtactctcgttatttttcagtactttcacattccacaaatattgactgtctacctaacatggggggggtttgggaattacagcagagaaagaacagagctgcctgccctcrtaaagttcacaatccaggagagaggtagacaaataaataggcagttataatacaacctgaaaagggtttgtgagcagaagtagtgggtgttagagaagtatataggtggggtatctatctccaacttgtagggccagagaaacttccaggagaaaatgacgttgaagttaaaaccaaaaaggcatagaggagctaaacaaagctgggcttatcagaacaagatactaacctggacaaatgtaaattttttgtcccatatagacgatacttttttctttagcatgatggtaaatattcctt

SEQ ID NO: 103342 - DNA, 601 bp, Human
atatattttatgaagtacttaaaaccttaaaaatcatttttctattccaaggatgaaagtgaagaagagaaaaaggaagccactgtaacttaacgtagtgactagtttgggttgctttggtagcttgttttatacaaattgctttctcaaggagaaaagaggattaaaaattaaagcatacaaggactttggagagttctagttagaatttttaagagttagttagctcctttatttttaaggaagcagtatttcagaatcctcctagatggttttcttcatcttttatcctaatgtggtrtattttcatgttgaaagattctatatttggttggccttattattcagtcttttttttttaatttttggtattctgtctgctttaggaatttgaagtgattgcccagataaagctcttacagtctgcctgcaacagctattgcatgaccccagaccaaaagttcatccagtggttccagaggcagcagctcctgacagaggaggagaggtgggatcacctgtcgttcatcggggtagaactgaagtgttggcaagaaaaatgctgcatttaatacctcgctgggtcatttattcaacaact

SEQ ID NO: 103343 - DNA, 601 bp, Human
ctgtagcctgctcgcttgttggcagattggtctgcaggccatatgtggcccactgcctgtttttacatttttaaatgattggggtgggggggaacaaaaaaagaatattttgtgacacgaaacagttatttgaaattcagatttcagtatctacataaatatggttttattgaaacacagcccgttcatttacatctcatctatggttgctttcatgctgtaaagacagagttgagtagttgcaacagagaccatatggcccacaaagcctaaaatactatgtgatcctttacagaagaarttggcccatccctaccctagcccaggggatttctttggaagtttatcataagggagagtgaaattgacagcaaaataagtatttacaaaaaaaaaaacttgaggtttagagaaatatttgaatgaattaatgacagcatttggattcaaactcaggtctgcccggctctacagcctaagctctgaagatggctgtataatgttgggcacccttccccacctactcagtaacgaaatacatctactgtctacagctacaagctttcataaaaggcacttggaatcacatataaattcctct

SEQ ID NO: 103344 - DNA, 601 bp, Human
tctgcccggctctacagcctaagctctgaagatggctgtataatgttgggcacccttccccacctactcagtaacgaaatacatctactgtctacagctacaagctttcataaaaggcacttggaatcacatataaattcctcttgtgcttgtgtcagttatatctgcctggcagatagaggtctgaatctggagcatttttaatttaggaagttttggcaattaaaaatttaaaaaagtatttgtaggccaccctggccaacatggtgaaaccccatctctactaaaataaataaatatrtatatatatatctttatcagtaatgtaattgcctatgtctgttcattgacgatcagatagattacaaaagtctcttcattttctttagataaaactaagtcatttgtgcatgtgcacaaacacacatacaaaatagtaggaaggaggtaatagagaagaaataggagggggaggtagtagaggaaggaagattcttccactggcctagcagtgggatgagaatgatcagaatggagttagtttttgatgctgccaaagtgcatatatccttgtatttgaaacacgcagaactaaatagcc

SEQ ID NO: 103345 - DNA, 601 bp, Human
gactcagcctgtgagtgtcccctgggggttctggggctccaagagggtgccatcagagtcgtgagaggagatgtattcaacaggatgaccttgagccagggtgaaagtgaagagcactccgctcatttgttaagccgtttatccttctgtcatgaactcaaagcatttgctgagtccattcttctccactcccctctctgttgtgaatcaccattctctcctgcctgaatcactccagtaacatcttcactgtcttctggctgccccttacccaaccattcattctccactaaatagctatgttgtcttttaaaatgtacaccagattatgttgcttcctgtataaaaacccctatagcttttattttaaaataaaacccaaactctgtatcctggtttactaggccttacatgacttaacctgcagacttccctctcttacaacattgccctctgttcaccagtgttgaagacgtttgcactggctgtgcctggcctgaaatgctctttcttcatgactggctccttcaaatattagcaaaaatgttatgtgccaagagagaaccctttctaatgttgctgtccacccctcattctcatt

SEQ ID NO: 103346 - DNA, 601 bp, Human
actcagcctgtgagtgtcccctgggggttctggggctccaagagggtgccatcagagtcgtgagaggagatgtattcaacaggatgaccttgagccagggtgaaagtgaagagcactccgctcatttgttaagccgtttatccttctgtcatgaactcaaagcatttgctgagtccattcttctccactcccctctctgttgtgaatcaccattctctcctgcctgaatcactccagtaacatcttcactgtcttctggctgccccttacccaaccattcattctccactaaatagctagrttgtcttttaaaatgtacaccagattatgttgcttcctgtataaaaacccctatagcttttattttaaaataaaacccaaactctgtatcctggtttactaggccttacatgacttaacctgcagacttccctctcttacaacattgccctctgttcaccagtgttgaagacgtttgcactggctgtgcctggcctgaaatgctctttcttcatgactggctccttcaaatattagcaaaaatgttatgtgccaagagagaaccctttctaatgttgctgtccacccctcattctcattc

SEQ ID NO: 103347 - DNA, 601 bp, Human
atgaccttgagccagggtgaaagtgaagagcactccgctcatttgttaagccgtttatccttctgtcatgaactcaaagcatttgctgagtccattcttctccactcccctctctgttgtgaatcaccattctctcctgcctgaatcactccagtaacatcttcactgtcttctggctgccccttacccaaccattcattctccactaaatagctaggttgtcttttaaaatgtacaccagattatgttgcttcctgtataaaaacccctatagcttttattttaaaataaaacccaaacyctgtatcctggtttactaggccttacatgacttaacctgcagacttccctctcttacaacattgccctctgttcaccagtgttgaagacgtttgcactggctgtgcctggcctgaaatgctctttcttcatgactggctccttcaaatattagcaaaaatgttatgtgccaagagagaaccctttctaatgttgctgtccacccctcattctcattcatactagctgcttcctccagtggaatgtaagcaacctgagaacaggaaccttgtctatcatgctcgcagttgtattgcctgag

SEQ ID NO: 103348 - DNA, 601 bp, Human
ccgcaagattttctttttttttaagaaaaaatctagtttactagcggtgtcaccggttgagagtttctaaccccatagaccacataaatagcaaattggagtgaggcacagacccagctcacacatgacttcataggagacatttttcttctttccatgctcaggcaagaacagtctccctgttgtcttcctatgctagtagaaagatatttttctggcctatctttttagtaagggtatagccctttgtgggccctggctgtatatagttttggttctaactcctcaccattcataaacrgaaaccctcatctttgggccctgggtgtgcattaaaacccatatcactattttgccaagattggggcctcccactcccccaccagagcagctgcagaactagctcgcgtgcttctggttttcagttcctttttcacttaaggcctgtagggatttcccttcctatcttgcaagctcaactaaaaagagtttttaatatttcttatctagctgttttatagaggaagcatttaggatactgtagttcacagattgttggaaatagaagtcttcctccttggtttcttacccaaagcagtgc

SEQ ID NO: 103349 - DNA, 601 bp, Human
ctatagtattttgaaagtcatgttttgaacaggcatcaaaagaagagttcaatttggggacatactactaatagaaacaggtgtaaaagcactaagcagtttcgtttattcatttggcctttgaaatattgttctatacccacctcttaaggcactggagttatttaggggaagtaggacttcttagaaagagcaaaaagtcagagatggagatgtgtcaggttcttggtgccatgttttgtcttagccaagcatttatcacaataatgttgcattgcatgccactccaaaagtcagtgasttaaaacaaccactatttatctctcttatgtatctgctggttggctgatctaggttgggcttgacactaggccacagatttggtccaggtctgttccacttgcctctcattattgttggagtaacgggctacccagggcatgcccttagcatgctaagacggacaagcaagagggcaagcccactcgcaagcatatgtcaagcctttacttgagtcgtatcaaccaacattctattggctaaagtaatcatgtggccacattccacataagtaaatgaagcagagaaataggctccagtt

SEQ ID NO: 103350 - DNA, 601 bp, Human
cacctcttaaggcactggagttatttaggggaagtaggacttcttagaaagagcaaaaagtcagagatggagatgtgtcaggttcttggtgccatgttttgtcttagccaagcatttatcacaataatgttgcattgcatgccactccaaaagtcagtgagttaaaacaaccactatttatctctcttatgtatctgctggttggctgatctaggttgggcttgacactaggccacagatttggtccaggtctgttccacttgcctctcattattgttggagtaacgggctacccagggcwtgcccttagcatgctaagacggacaagcaagagggcaagcccactcgcaagcatatgtcaagcctttacttgagtcgtatcaaccaacattctattggctaaagtaatcatgtggccacattccacataagtaaatgaagcagagaaataggctccagttttagtgggaggaactctgaaatcacagtgcaaagggcacagctgcaggggaagatgagggattggtaacaaggatacattctcccatgttggaaaaaaggaaactgatgagaggtgataaaagaatttccgtcgagtttc

SEQ ID NO: 103351 - DNA, 601 bp, Human
ttgggttcctgttctaggggtgctgtcaactagctgtgtggacctggagccccagttttctccctgggtctcaggttcctcagcagaacaggtatgggactagttgatgtccaaggcctttctagcactaatattcaatgcagagccgtataatctggggtacttctcttagaaacttctaaaaatacagaactttctctctcactacgaaatctgactgcagtaggactgaatcaactgcgttggcaaggctttcctccagccccgtaagcttctgacttctttgggaacccatattgcytccagtttctggtgtctgctgccacctgctggttaacttctataagaacagctaaaacctagggaaatagaactgctttgcctcacgtgcttatagagtgattaggtcacactgagtcaccgataggcatctaccactgatggggactcagagtacttacaccagggatgagacacatgtgtgctgtgggctgttgtggaggaaataactgcagtctatcagtcttgatatctacctctgctttgaaaattgcaaagctgttggccagcgttctaatctgttttcttctggggtgtgttt

SEQ ID NO: 103352 - DNA, 601 bp, Human
aatgcagagccgtataatctggggtacttctcttagaaacttctaaaaatacagaactttctctctcactacgaaatctgactgcagtaggactgaatcaactgcgttggcaaggctttcctccagccccgtaagcttctgacttctttgggaacccatattgcctccagtttctggtgtctgctgccacctgctggttaacttctataagaacagctaaaacctagggaaatagaactgctttgcctcacgtgcttatagagtgattaggtcacactgagtcaccgataggcatctaccrctgatggggactcagagtacttacaccagggatgagacacatgtgtgctgtgggctgttgtggaggaaataactgcagtctatcagtcttgatatctacctctgctttgaaaattgcaaagctgttggccagcgttctaatctgttttcttctggggtgtgtttactcttccagctctctgagtcctcctcatcctgttcttctatccattccatggacacaaattcctcagggatgtcttccttaatcaaccccctctcctcccctccgtcctgcaacaacaaccccaaaatccacaag

SEQ ID NO: 103353 - DNA, 601 bp, Human
tcggtgacgtccattacctcgactgtgctgcctcctgtttacaaccaacagaatgaagacacctgcataatccgcatcagtgtggaagacaataacggcaacatgtacaagagcatcatggtgaggagcaagccctgacccaggagcgggtttccatttagattgtgtgtctgtgtctgtcggccgctcagactaatagccctaaatatgcacactcaatattagcatatacatatatgcattcacacagaagggatgtgtgtcagttccaggtctccctgggcatagatgctgaatgatrtatgtatataaaatatatatacatatatatgcacacacatggtgtatataggatataattttcacatcttaaagaaatgctaaaacttattcgtttaggtcagtattagccatttgaaaattctcaatttgggtgacagtgtaaatgtgctccagggaggatgacacaacctcacacatttttggaagccttcctatggaattatatgtctggttttatcattgaatttccacacattcttagcagtgtactcccctgatggcagatttttgtcatttagtcatttggatcaaacctagt

SEQ ID NO: 103354 - DNA, 601 bp, Human
aatacacacagagcctctcatggcgataaccttgggtatgtgaggtctggtaggtttatcacaagaatataaactccttagtttatgggagataatcatgtattggaaatcactttatcctttgcagcaaaatcccacagctaattccacatctctcctcatctttatcactcgcctctttgaaggcacactcagtgcttacaagctcaggtctgaatatggcataagtggtatggaggctccacataaaagctttgctaaagcatttattgagtcaacaaaatatcaaacatttattgcrttctagtcattagatcaggctttggggatagggagatgagtgagacatttctgcctttgaggaacttttaattagaaagggagcccacaaagcattattcacaatgtgcaaaataatagagccaagatcaggtggtaaagggccttgtggcccacacagaggagtgtgttaatcccgcaggcaatagggtcttgttgaaggcttttaagtagtgatgggatttgctcattaagaaagtcatggcactgtgtttgctggagtgtcggggtagactggaggcggggaagcaagttaggaagc

SEQ ID NO: 103355 - DNA, 601 bp, Human
atttattgagtcaacaaaatatcaaacatttattgcgttctagtcattagatcaggctttggggatagggagatgagtgagacatttctgcctttgaggaacttttaattagaaagggagcccacaaagcattattcacaatgtgcaaaataatagagccaagatcaggtggtaaagggccttgtggcccacacagaggagtgtgttaatcccgcaggcaatagggtcttgttgaaggcttttaagtagtgatgggatttgctcattaagaaagtcatggcactgtgtttgctggagtgtmggggtagactggaggcggggaagcaagttaggaagctgctatcatgttccatgtaggagaggataagggcttgaatgacggtcatgtggctggagatggtgaggatttttgaaagcttttgatgaggtagaattgtagaatccattcatttagttaccaactttttggttactgttgtggaggactagaggctgtctgggtagttggtgggtctgtgagatatgaactaccagaggaggatattcagggacatttaaatcagaggtaccagtatgacatcagatggcattgtctgataga

SEQ ID NO: 103356 - DNA, 601 bp, Human
tatgcaaatgtcaacacaaagaaaagacaaacagcatcttagtattatcatgaaaataattttgatctcatggatcccctcacagatttcagggaccccacgggccatagattgcacactgagaactggtggcctagagaacttgctttgcaagagcaactaatgtccctggaatccaaggcccttccatagaagaagagacagcaattagcccttgtaaaattacctcctcagtgaccatggaaaaatgtcttctaccactgaacccatcactctttcgaaatgatctttctctccattrtgtcaatcacagagtcagtctcccaagatcccttacacagggaatgcagtatttctgtcacaggaaagtcaatgagggcgacaccaaagcatcgttcagtaccgcgcattcagtacagcagccactggccacgggtggcgatggagcatttgaaatgggaatactccaaattgagatgagctgagggtaaaatatataccagattttgaacacttagtacaaaaaagtaaaatactgcattaacaatttttgtattgattatatatgctgatgtaatatttggggtgttcaagttaaata

SEQ ID NO: 103357 - DNA, 601 bp, Human
tctgcctccctggttcaagcggttctcctgcctcagcctcctgagtagctgggattacaggcacccacgaccacgcctggctaacttttttgtatttttattagagacggggtttcaccatgttggccaggatggtctcaagctcctgacctcctgatccacctgcctcggcctcccaaagttggtgggattacaggcatgagccacctcacccgtcctaaaaactttttaattgtggctactagaaacttaaaatgaaatatgtggctcacattcgatacctatgagtgctaattcagtytatcagcataaggatgcacgcttgagctgtgaatactcattgtaatcataagtttgattcagcatcgctttgatggtacaaagtaataaacacgcaagggaaagcccttggtcatcttgtcttcattgggacatacctggggaagtttaaggaaaggagaatgaaggtagcctggctgtctcatatgacttacccaccttagcctgacatgcatcccctgaagggaggtcttctcctttagctttctgctactagtccagtgtgacccagctttgggagtattttcttcatactatcaaa

SEQ ID NO: 103358 - DNA, 601 bp, Human
tacaggcacccacgaccacgcctggctaacttttttgtatttttattagagacggggtttcaccatgttggccaggatggtctcaagctcctgacctcctgatccacctgcctcggcctcccaaagttggtgggattacaggcatgagccacctcacccgtcctaaaaactttttaattgtggctactagaaacttaaaatgaaatatgtggctcacattcgatacctatgagtgctaattcagtctatcagcataaggatgcacgcttgagctgtgaatactcattgtaatcataagttygattcagcatcgctttgatggtacaaagtaataaacacgcaagggaaagcccttggtcatcttgtcttcattgggacatacctggggaagtttaaggaaaggagaatgaaggtagcctggctgtctcatatgacttacccaccttagcctgacatgcatcccctgaagggaggtcttctcctttagctttctgctactagtccagtgtgacccagctttgggagtattttcttcatactatcaaaaacatattttcctcatttagaattttgtgtgcacctacttttcccttgtaaatga

SEQ ID NO: 103359 - DNA, 601 bp, Human
aagcattccacaagctaggctatgggatcagcatgtcacccagggctctattgctggtttagaggagagtggctgaaattagaatactaccttctcctagagattaaaagctacagcctctgggaaaattctttttcagtttcctcttggaagatttctcattcattcagctgagccttaggctgtggggcaacactttctcagttataaccttttgatgtaattataattataattctaagcctaaaagatggtctcaagttgtaccattttgcttacaacacagcactaaggtgaggcyggtgggtctaaaggtccaggagtctcgaggggtagccaggacccagtgttgcccaccagctgtgtggtcctaaatgcaagctgctggacccccgggccttggtccttaattagagacaataccctgctggttcctcatatatcacagggcgattctgaagataacaagaaatcgtgtacctgaacatggggagacactaagtgatatataactgtgaggactattattactgacctgtgagtatgtgggcagcagcatgggacactttgaggggattgttctccgctgagcctttgtgca

SEQ ID NO: 103360 - DNA, 601 bp, Human
attctttttcagtttcctcttggaagatttctcattcattcagctgagccttaggctgtggggcaacactttctcagttataaccttttgatgtaattataattataattctaagcctaaaagatggtctcaagttgtaccattttgcttacaacacagcactaaggtgaggctggtgggtctaaaggtccaggagtctcgaggggtagccaggacccagtgttgcccaccagctgtgtggtcctaaatgcaagctgctggacccccgggccttggtccttaattagagacaataccctgctggttcctcatatatcacagggcgattctgaagataacaagaaatcgtgtacctgaacatggggagacactaagtgatatataactgtgaggactattattactgacctgtgagtatgtgggcagcagcatgggacactttgaggggattgttctccgctgagcctttgtgcacagaatgtacaggagtcacttggaacctgctcatatcagtcttgttgttggatatcaatgtttgaagttaacttaagactcaatttgtccagttttacaaccatatgcctctctggttgcctccccg

SEQ ID NO: 103361 - DNA, 601 bp, Human
tctttttcagtttcctcttggaagatttctcattcattcagctgagccttaggctgtggggcaacactttctcagttataaccttttgatgtaattataattataattctaagcctaaaagatggtctcaagttgtaccattttgcttacaacacagcactaaggtgaggctggtgggtctaaaggtccaggagtctcgaggggtagccaggacccagtgttgcccaccagctgtgtggtcctaaatgcaagctgctggacccccgggccttggtccttaattagagacaataccctgctggttcctcatatatcacagggcgattctgaagataacaagaaatcgtgtacctgaacatggggagacactaagtgatatataactgtgaggactattattactgacctgtgagtatgtgggcagcagcatgggacactttgaggggattgttctccgctgagcctttgtgcacagaatgtacaggagtcacttggaacctgctcatatcagtcttgttgttggatatcaatgtttgaagttaacttaagactcaatttgtccagttttacaaccatatgcctctctggttgcctccccgac

SEQ ID NO: 103362 - DNA, 601 bp, Human
gggtgcagcaagccaccgtggcacatatatacctgtgtaacaaacctgcacgttctgcacatgtaccccagaccttaaagtatagtaaaaataaaataaaaattaaaaaacaaaaataaaagtgaggctgggcatggtggctcacgcctgtaatcccagcactttgagaggccgaggcaggtagatcatctgacgtcaggagttcaagaccagcctggccaacctggtgaaacccgcctctactaaaaatacaaaaaaatacaaaaaaaaaaaaaaaaattagccgggggtggtggcacaygcctgtaatcccagctacttggggggctgagacaggagaatcacttgaccctgggaggcagaggttgcagtgagctgacattgtgccactgcactgcagcctgggcaacaagagcaaaactccatctcaaaaaatataataataataaataaataacttaaataaataaaataaaactgagtcaaaataactttgctttgatgatttcatattacacttggaacaatccttgttcaaaaattacagatgtctagttgggaatcattgaaattgaaaatagtttaaatattaaaagaaggg

SEQ ID NO: 103363 - DNA, 601 bp, Human
tgtttccttctctcaacaaatacaatacccaaattcatattagcagacagatacccaggaaggggagcatcacacactggggcctgtcagggggttggggaaaaggggagggagagcattaggacaaatatctaatgcatgcaggacttaaaacctagatgacagattgataggtgcagcacatgtatacctatgtaacaaacctgaacattctgcacatgtatcccagaacttaaagtaaaatactataaaataaagatatgcacgttcagcacatgtatcccaaaacttaaagtaaaatttttttaaaaaaatatacatactttcctacatgggaaataaaatactcgtttgacgggattacttcaaaaaatatttcaatatttcaagtagaattctggagtgctgtagattttctgttttttctatgtcattggattctcttagtctttgagaaaatctgcatactggggtggaaaatggactgcaggagaaacgaaacccgagttcaaatcccagttctgctattcactagctgccatcttgggaattttctttaacttttcttggcctctgtttcctactgtactttttttctagt

SEQ ID NO: 103364 - DNA, 601 bp, Human
aacccgagttcaaatcccagttctgctattcactagctgccatcttgggaattttctttaacttttcttggcctctgtttcctactgtactttttttctagttttaacattttctattggaacatttaattcatggagcgaatttctaaaatctcatttgtactaattttttaaattgggattgagaagctggggccaatttttggggtagtgatggtgatcactgtctggttcaggtcacattccagagatgaagggccgtagtcccgttcttgtgtctgggcaaggtttacagctgccrttgtcagtactgagctgacctccacaagctgaccatcttatctttccttatctttttcagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaa

SEQ ID NO: 103365 - DNA, 601 bp, Human
ttcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcytaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagta

SEQ ID NO: 103366 - DNA, 601 bp, Human
ctaggagttttgtattttttgtattcattcccctcccccagttaacaaattctgtacaatgtatattttgccaaatccccttcttcttcttcttttttttttttttttaaaaaggccaatgggctgaaagcacagggaccctcaattttcgaacagtcccatctccccccgccccccggtaaggaataaactaccttaacgctaccaataacaaaaacacaacaaaaaacaaaaccactaaggaaagatgcaggttccccacaatcagaaatttctggagctaatgtgaccccaggaaatmagagttctaggaagaaaaactaaggcgctcggcaccagccttccccaccagccggggccgccttccccagcgccgcgagggcgcggccggcgggaccagttcccgaggcaggcaggcactcgggtgcaacctgaggaatctgggggcgtggaaggcgcgcgggggagggcaggcttccaagagtgggaccctcgcgtctcctgccgactgggtaggaaacgggggcttcccccttgccctctcagagcgggcgatcccaaagagacaggttaagccgcaggttgagagggcagctccgcg

SEQ ID NO: 103367 - DNA, 601 bp, Human
caattttaggattacaaaaatgattctgctttatacgaatgactcatcttctatcttattcattggggtttattttaaatatttccaaggattctccacacgcattccccgttgttttttctattgtccttttcttagcaggtaaaaggctccaagcttccttctaggagttttgtattttttgtattcattcccctcccccagttaacaaattctgtacaatgtatattttgccaaatccccttcttcttcttcttttttttttttttttaaaaaggccaatgggctgaaagcacagggwccctcaattttcgaacagtcccatctccccccgccccccggtaaggaataaactaccttaacgctaccaataacaaaaacacaacaaaaaacaaaaccactaaggaaagatgcaggttccccacaatcagaaatttctggagctaatgtgaccccaggaaatcagagttctaggaagaaaaactaaggcgctcggcaccagccttccccaccagccggggccgccttccccagcgccgcgagggcgcggccggcgggaccagttcccgaggcaggcaggcactcgggtgcaacctgagga

SEQ ID NO: 103368 - DNA, 601 bp, Human
ctgactgccatattttaactaaaatggaaacaattttaggattacaaaaatgattctgctttatacgaatgactcatcttctatcttattcattggggtttattttaaatatttccaaggattctccacacgcattccccgttgttttttctattgtccttttcttagcaggtaaaaggctccaagcttccttctaggagttttgtattttttgtattcattcccctcccccagttaacaaattctgtacaatgtatattttgccaaatccccttcttcttcttctttttttttttttttwaaaaaggccaatgggctgaaagcacagggaccctcaattttcgaacagtcccatctccccccgccccccggtaaggaataaactaccttaacgctaccaataacaaaaacacaacaaaaaacaaaaccactaaggaaagatgcaggttccccacaatcagaaatttctggagctaatgtgaccccaggaaatcagagttctaggaagaaaaactaaggcgctcggcaccagccttccccaccagccggggccgccttccccagcgccgcgagggcgcggccggcgggaccagttcccgag

SEQ ID NO: 103369 - DNA, 601 bp, Human
actgactgccatattttaactaaaatggaaacaattttaggattacaaaaatgattctgctttatacgaatgactcatcttctatcttattcattggggtttattttaaatatttccaaggattctccacacgcattccccgttgttttttctattgtccttttcttagcaggtaaaaggctccaagcttccttctaggagttttgtattttttgtattcattcccctcccccagttaacaaattctgtacaatgtatattttgccaaatccccttcttcttcttcttttttttttttttwtaaaaaggccaatgggctgaaagcacagggaccctcaattttcgaacagtcccatctccccccgccccccggtaaggaataaactaccttaacgctaccaataacaaaaacacaacaaaaaacaaaaccactaaggaaagatgcaggttccccacaatcagaaatttctggagctaatgtgaccccaggaaatcagagttctaggaagaaaaactaaggcgctcggcaccagccttccccaccagccggggccgccttccccagcgccgcgagggcgcggccggcgggaccagttcccga

SEQ ID NO: 103370 - DNA, 601 bp, Human
aactgactgccatattttaactaaaatggaaacaattttaggattacaaaaatgattctgctttatacgaatgactcatcttctatcttattcattggggtttattttaaatatttccaaggattctccacacgcattccccgttgttttttctattgtccttttcttagcaggtaaaaggctccaagcttccttctaggagttttgtattttttgtattcattcccctcccccagttaacaaattctgtacaatgtatattttgccaaatccccttcttcttcttctttttttttttttwttaaaaaggccaatgggctgaaagcacagggaccctcaattttcgaacagtcccatctccccccgccccccggtaaggaataaactaccttaacgctaccaataacaaaaacacaacaaaaaacaaaaccactaaggaaagatgcaggttccccacaatcagaaatttctggagctaatgtgaccccaggaaatcagagttctaggaagaaaaactaaggcgctcggcaccagccttccccaccagccggggccgccttccccagcgccgcgagggcgcggccggcgggaccagttcccg

SEQ ID NO: 103371 - DNA, 601 bp, Human
gaactgactgccatattttaactaaaatggaaacaattttaggattacaaaaatgattctgctttatacgaatgactcatcttctatcttattcattggggtttattttaaatatttccaaggattctccacacgcattccccgttgttttttctattgtccttttcttagcaggtaaaaggctccaagcttccttctaggagttttgtattttttgtattcattcccctcccccagttaacaaattctgtacaatgtatattttgccaaatccccttcttcttcttcttttttttttttwtttaaaaaggccaatgggctgaaagcacagggaccctcaattttcgaacagtcccatctccccccgccccccggtaaggaataaactaccttaacgctaccaataacaaaaacacaacaaaaaacaaaaccactaaggaaagatgcaggttccccacaatcagaaatttctggagctaatgtgaccccaggaaatcagagttctaggaagaaaaactaaggcgctcggcaccagccttccccaccagccggggccgccttccccagcgccgcgagggcgcggccggcgggaccagttccc

SEQ ID NO: 103372 - DNA, 601 bp, Human
atgcaaaaacagaaaccgggaactgactgccatattttaactaaaatggaaacaattttaggattacaaaaatgattctgctttatacgaatgactcatcttctatcttattcattggggtttattttaaatatttccaaggattctccacacgcattccccgttgttttttctattgtccttttcttagcaggtaaaaggctccaagcttccttctaggagttttgtattttttgtattcattcccctcccccagttaacaaattctgtacaatgtatattttgccaaatccccttcttcttcttcttttttttttttttttaaaaaggccaatgggctgaaagcacagggaccctcaattttcgaacagtcccatctccccccgccccccggtaaggaataaactaccttaacgctaccaataacaaaaacacaacaaaaaacaaaaccactaaggaaagatgcaggttccccacaatcagaaatttctggagctaatgtgaccccaggaaatcagagttctaggaagaaaaactaaggcgctcggcaccagccttccccaccagccggggccgccttccccagcgccgcgagggcgcg

SEQ ID NO: 103373 - DNA, 601 bp, Human
cataaaacaccatctatccatcacaaataatgtttttaggaagcatgttcaccatttattttctaaagaaaaagttcttacacaaaatctctggttgacaagctgttattttcaaggctgcagggatttctagagaagcatgcctgatgtagattagctcattttttataactccaagcacttaagtatttaaataatgcaaaagagcaacagctaattaattgtgaaagttgtggcaaagcactatctatatattgataaatgtctaatgctctatttaggtgcctttaaaaaaggatawtgttgccattaaatattttcactctcatatttccccactataacaggacattgttgagagtcttccttatgaatacacccaagaattagaaatgcatacaaattcagtgtctgagattttctaaaactacagcttcggtttttttgcaacatttacatttttctaaaaaagatgtaatgcaaatgcgaagccaaagttatgaatattcaaatatgcaaaaacagaaaccgggaactgactgccatattttaactaaaatggaaacaattttaggattacaaaaatgattctgctttatac

SEQ ID NO: 103374 - DNA, 601 bp, Human
aagcaaagactgtttcacccttggttctaactatcaagtgaacaccttgatagtctttcatttcccagtgagatacatatgcaaacattacctagagtggtgttaaagaaatcctaaaatatatatcagaattattagtcccccaaatgaaataacctattatcaaccaaaatatgtcttttcctgtgattctaattgaaaaaataaagaccaaacttttgctagaaccatattctgtattatctgaaatgctggtagaacatgctggcagattagcaatctgaatgatacacattagcartctctcaatattgatgaaaagaggcatcacagaagatgtaataattcatatgtcccttaggtggcagcttaattttttgctttagatattttctctcatatttcacaaaggttattcaaactgtgttagaccatacctattaaattcaggctctctttgaaagcactagtgagttagcaagcatgagaaacagaaggccaatcagactgtcagaatgtacaaacattcccctaaaaggaaaaccacagagttcacttgttcctccaactctagtaccccaccactagggctgtctttcct

SEQ ID NO: 103375 - DNA, 601 bp, Human
aaaacaagaacaaatagagaaacaaaagctttcctactctttcatctaggacaagaataaatacacataaagtcaatattagtgaagtaaacaagcatcttctatatccattcatagtaccttcaattgattgatttcttaacagacaatcagcaaaattatcagtttttattagagattttagtagagaccgagcttaaacaaatatattctatggtgcttaactctatagtatttaaagattcaatatttatttcctctaaaaatgagtcaagtgtctgaaaggaaaaagccacctaamtgaaacttcagtttctactatacagggtatttattataaaactgtaattacaatgcaattatattgaagtataaatgatcatcattcatttatttaagaatataatcaaaatttgcatacctggaagaaaaccatccaccctccaaaatagggatttgctaatgtaggagtagaaggcaaaagttgagggtaactcaggtaacacactcatacgtattaggatatgaacagctggtatagcaaacttgatagaaatcactgatagacaagaagacattctctgcattttaaattaaagta

SEQ ID NO: 103376 - DNA, 601 bp, Human
ttaaggttaagtgatagaggcataatcccttataggcctttgaattcttttaactttgcattctttatttcagagatttttcaggcttctccagattctacagtctaaatagtttgtaaatccacacacttctactttgccagggatttcttagtgtaaaaatatcctgaagtctcacctgccttcaatccttactgtgtccatacccaccattaccaggataatctttgtaaaaggcagaacttacctttgtccattcctcttttaaaagctcctattggtagaaaatatactgaacccrtgatttgataccaagtatgttttggctcaacttttatgaaaacaaatatttaattagaatataccaacatttatgagttttccttaaagataaattttggaggaaaaaaactccattagaccaatttaattccctgatgattatatatatattacctagtgaaatccttggcagtttttccattttaattttaattttactgaactaatgtttagcagcatcactttcatttaatttttacaataactattagattcatgaatccattttacccatgtcaagttctactgaatatagctt

SEQ ID NO: 103377 - DNA, 601 bp, Human
aaattcacataagattgtatgacttttataaaaaacaaaaagacatctttgattaatttgtcttcactatgaatactgatgtgatgtgttacaatcatcctgaaaaggaggctaacaaaggacaggactgagtctgtcttgaggtgagtgatatgatggaaagaatggattttcccccacccaactcatttttgatattacataaagtgaaaaacattaaataattcaccaaagtatctagatttttttttgtttttgaagtgcaagggaagtaacttgacctttgttaaacactttgatmatggaaaacacataaggttctcatcttattccaggaagtgtagacactagataatcttttcatagtcatccaaaaagcatattaagtgaaccaggtaaatccatcctacactttttattccagagacaagttggctaaactttgaggagactaaaacaaaacaaaaaaaaattattgtttggttcatttgataaatgtggattccaatcatataatttaggccaaatattatactttgacttcttagacttagatttccagatagtctggtttataaaataagattttaactatgcttac

SEQ ID NO: 103378 - DNA, 601 bp, Human
aactctatgtatttctactttccaatgacccatgttcttattttctgaatttacttattgatgctttaggtatgataaaggtatgtaatggctaaggaaacataaatgaagcataagacatcagttgagagttttgacggaaaggaagtggtgatatgaaggaaacagataaaccaaagaaaaaggaaaaggtcagggagctgataaaagtaacttgaagaaactttagtgcaaatgttggattcagacaatcgctacttttaaagtacttaaagaagtcagtctttgaaatcttgcccgkattccattccagtttcatcattggagacttccaatgatgaaaaattggggaagaattaccttccaaagcctcagtttcctcgtgtgtaaaatggaaataatagcaagagatattaaatgagatgattcactcatcgattcatcaattgtttatagagcccctgctaagctaaaaactgttttaagtgttgacacagtggtaaagaaagcagaaagtgtaactacttttatgaaactgacttcctagtggtgagagataacaagaaaacaaacaacaaattgagataacttcagttataga

SEQ ID NO: 103379 - DNA, 601 bp, Human
taagttcttaagtacagaataacctaatcttctttctgtgttgaagagatcactttgactgttatgaagagaatagattggaagtaaggcaaagcctggaagcagttatgaggagactgaatgggaggatggagaaaggggatggtgatctggaccaagtgttggcagtgcaggtggaaagaaaggaaagactgacatagaattaagagaagtggctgcatggaaaagacaaagacattttagagaatgactttttttccccatgagcactgggatgggaaagagccaaattagggggtcrgaaatccagagttatgtttgggctgttattgatgtctgattttcattaggtggtagagaggtcaagaaatccgttggagataagaggctgaggcccattcagtaggtctcaactggagacataaacataggagtcattgcattcagatggagcttaaagctaagggactgcatgtgacagtgtaaataaacatgtagagagtagcagatgactggtttctgagccttgggaaacttcatatttggaagagacacaaggaggagctaggaaaagatagtgagaagaggtagccagtgaaaa

SEQ ID NO: 103380 - DNA, 601 bp, Human
tagattggaagtaaggcaaagcctggaagcagttatgaggagactgaatgggaggatggagaaaggggatggtgatctggaccaagtgttggcagtgcaggtggaaagaaaggaaagactgacatagaattaagagaagtggctgcatggaaaagacaaagacattttagagaatgactttttttccccatgagcactgggatgggaaagagccaaattagggggtcagaaatccagagttatgtttgggctgttattgatgtctgattttcattaggtggtagagaggtcaagaaatccrttggagataagaggctgaggcccattcagtaggtctcaactggagacataaacataggagtcattgcattcagatggagcttaaagctaagggactgcatgtgacagtgtaaataaacatgtagagagtagcagatgactggtttctgagccttgggaaacttcatatttggaagagacacaaggaggagctaggaaaagatagtgagaagaggtagccagtgaaaaaaagtagaactatactttgctttgaatgttgaaaagggttggcattatagtgagaattcagtaaattccacat

SEQ ID NO: 103381 - DNA, 601 bp, Human
ttaagagaagtggctgcatggaaaagacaaagacattttagagaatgactttttttccccatgagcactgggatgggaaagagccaaattagggggtcagaaatccagagttatgtttgggctgttattgatgtctgattttcattaggtggtagagaggtcaagaaatccgttggagataagaggctgaggcccattcagtaggtctcaactggagacataaacataggagtcattgcattcagatggagcttaaagctaagggactgcatgtgacagtgtaaataaacatgtagagagkagcagatgactggtttctgagccttgggaaacttcatatttggaagagacacaaggaggagctaggaaaagatagtgagaagaggtagccagtgaaaaaaagtagaactatactttgctttgaatgttgaaaagggttggcattatagtgagaattcagtaaattccacataaaaatctgaatttatgtctcccctagaaaggttggttgtgaacatgcaattggtaaatatctctattaactttaatattgttacaaaagtaatattaaggaatttataatatttggaagaattagatg

SEQ ID NO: 103382 - DNA, 601 bp, Human
ataaaaactacagaatatattgagagactaaagaattagaaatttaactgaaaatttcatgcaaaggtaatgctctgttgaaccattttgtagcttatgttttgttttgatacatattttaaaatattgtttaagacaatacttgaacagattgggattgtgtgtgtgtgtgtgtgtgtgtgtgtgtgtattggttaaataactggtttatttttaaactgaaattaaaccttccatttctttgagaaatttaaaaagtagttgttatcaatgtggcagatattaggtagaatctaatatygtgaaaattaaactgcacataaatagatataaatccttttgtcagtgtgtgtatatctctgtgtgtaattttgatctcaggcttggcaggtttccttaaaacttttttttagagctacttaattttgtacttactggtggttagctaataagaaaaagctaataaaaaatagtgcttactctgtgccaggcacttctgttaacattttataaatgttatctcatttaacaagctcatgtcattgtatagtctagcttatacttgtctttaacataagcaaatttgttaatttgtgtttcc

SEQ ID NO: 103383 - DNA, 601 bp, Human
gaaatagcattccatctaggtaaaagaggaatcagcatcattgaaatgtgaatagctgtgattcctccttgctgaatggtaactttagaagagagggaacccaggagtccatccagaggctcaaggaataagaggttctcacccataggaagatgaaaaatactttcagggtgacccatgagggaaaatcaccaaagcctttgaaataaaagattttcccttttctaagaataaaagatggtgttatgtcaagggcggctcgatggtgtggatgaaagaactattgggaatggctactgaragatcaaaggcaagtggaacctcaaaattctggaagtagaacgagtcagatacaatataagaagtacttcaaaggcaagaaaataagaataataaaaatacctttagttgtcaaatgtaaaatttgtgccagttttgtcacattccatttttcaggaacactgtaaaggtattttctattaatatcaatttaactgtacatatcttcccatctatcttaattagtcacttttcaagaacaaatgtgttatgctcaaagcatccaaaggacttttttgttagccttaataaaatgctttct

SEQ ID NO: 103384 - DNA, 601 bp, Human
cattgaaatgtgaatagctgtgattcctccttgctgaatggtaactttagaagagagggaacccaggagtccatccagaggctcaaggaataagaggttctcacccataggaagatgaaaaatactttcagggtgacccatgagggaaaatcaccaaagcctttgaaataaaagattttcccttttctaagaataaaagatggtgttatgtcaagggcggctcgatggtgtggatgaaagaactattgggaatggctactgaaagatcaaaggcaagtggaacctcaaaattctggaagtrgaacgagtcagatacaatataagaagtacttcaaaggcaagaaaataagaataataaaaatacctttagttgtcaaatgtaaaatttgtgccagttttgtcacattccatttttcaggaacactgtaaaggtattttctattaatatcaatttaactgtacatatcttcccatctatcttaattagtcacttttcaagaacaaatgtgttatgctcaaagcatccaaaggacttttttgttagccttaataaaatgctttctcttaaactaaattttaatttagtttacatgtctacgta

SEQ ID NO: 103385 - DNA, 601 bp, Human
attgaaatgtgaatagctgtgattcctccttgctgaatggtaactttagaagagagggaacccaggagtccatccagaggctcaaggaataagaggttctcacccataggaagatgaaaaatactttcagggtgacccatgagggaaaatcaccaaagcctttgaaataaaagattttcccttttctaagaataaaagatggtgttatgtcaagggcggctcgatggtgtggatgaaagaactattgggaatggctactgaaagatcaaaggcaagtggaacctcaaaattctggaagtakaacgagtcagatacaatataagaagtacttcaaaggcaagaaaataagaataataaaaatacctttagttgtcaaatgtaaaatttgtgccagttttgtcacattccatttttcaggaacactgtaaaggtattttctattaatatcaatttaactgtacatatcttcccatctatcttaattagtcacttttcaagaacaaatgtgttatgctcaaagcatccaaaggacttttttgttagccttaataaaatgctttctcttaaactaaattttaatttagtttacatgtctacgtat

SEQ ID NO: 103386 - DNA, 601 bp, Human
aaatgtgaatagctgtgattcctccttgctgaatggtaactttagaagagagggaacccaggagtccatccagaggctcaaggaataagaggttctcacccataggaagatgaaaaatactttcagggtgacccatgagggaaaatcaccaaagcctttgaaataaaagattttcccttttctaagaataaaagatggtgttatgtcaagggcggctcgatggtgtggatgaaagaactattgggaatggctactgaaagatcaaaggcaagtggaacctcaaaattctggaagtagaacragtcagatacaatataagaagtacttcaaaggcaagaaaataagaataataaaaatacctttagttgtcaaatgtaaaatttgtgccagttttgtcacattccatttttcaggaacactgtaaaggtattttctattaatatcaatttaactgtacatatcttcccatctatcttaattagtcacttttcaagaacaaatgtgttatgctcaaagcatccaaaggacttttttgttagccttaataaaatgctttctcttaaactaaattttaatttagtttacatgtctacgtataagg

SEQ ID NO: 103387 - DNA, 601 bp, Human
gtcacattccatttttcaggaacactgtaaaggtattttctattaatatcaatttaactgtacatatcttcccatctatcttaattagtcacttttcaagaacaaatgtgttatgctcaaagcatccaaaggacttttttgttagccttaataaaatgctttctcttaaactaaattttaatttagtttacatgtctacgtataaggtggttatagaaaatgaatgtaaaatcacttcattaagtgtaacaaaacaaaataatatgaggaattgttatactgtttaagcatttgaaaaackataaaggagtatagaaattttgttaccactactatgattagtttctcatttggtttttcactttaagaattggaataaaagttgaaatcttgattaaaaaaacaagaaatgattcacaaattattttacaaattgaaatactgaaatacagaatgttcaaccactgtcaacatgaactcctattctgtaattaatctattctataaacatctgtatttgctaaagagcaacagatcaaggaaaagaaaaaataatccttgccatccatagagccatgatttttgtggaatcttcgctcca

SEQ ID NO: 103388 - DNA, 601 bp, Human
aatttagtttacatgtctacgtataaggtggttatagaaaatgaatgtaaaatcacttcattaagtgtaacaaaacaaaataatatgaggaattgttatactgtttaagcatttgaaaaacgataaaggagtatagaaattttgttaccactactatgattagtttctcatttggtttttcactttaagaattggaataaaagttgaaatcttgattaaaaaaacaagaaatgattcacaaattattttacaaattgaaatactgaaatacagaatgttcaaccactgtcaacatgaactyctattctgtaattaatctattctataaacatctgtatttgctaaagagcaacagatcaaggaaaagaaaaaataatccttgccatccatagagccatgatttttgtggaatcttcgctccagtttaagttttgtcagtgtctggaagaaaatacttcccatggatcatctttttgctaaagagtattctttacattttaaaacatatgaatatttacataaaggtgtttgtggaaaaggaaattatgtgccttttattttaattcacccattattctattccacatgtaaagtagaaaat

SEQ ID NO: 103389 - DNA, 601 bp, Human
ttcctttatagtgttaattgatttaaggtccatcaaaatgctgttaaaatgtctagaggttaacaataacagtggcacatgggtcagattaaaattctttttgagtaaaataaataaataaatgacagcttattttcttctgatttaaaaaaattagctagtggattgaaacaacaatgtgatagctaagatttcattctctcactttataatgaaaggagatttaaaattagggattatatggtacacgaaaaatttatatacacagattacaagtactagtttttttagtgaagaaaakacaactatatattttctctttttatctgttgtcctattttacaattgtagcaattaatctgccaaactctttaatcaataaaatatggtatttaacaaccaaatttggcccctccctccccttaaatatatttccaatgctccttgctccattttaaacctgctgtcctttataagagaataatatattttgtaatttgagaaaatcatgcaaaggaaagtttctcaaaattcacattaatatgtaataatagtaataaatatgtataaccataatatcttagaattttacaatatttta

SEQ ID NO: 103390 - DNA, 601 bp, Human
tgaactacagattcatgaatactaagggcaacttttatctcaggaaatatatcagtggactgaaaatgtcaaatcaattcaattaaatcagtaataacactttgctgtttatgtggctgttttttcttctatttttattgtcttagattgcatggatacaatcaaaataagttaatttgtatacaggatataaatggaccagagaatgtgtcttctattaaataataacaaataagaataccttttattttgtgatggtctttactatttactgagagacaagtattgttcaagttgccgkttttttttaattagctgacatatttcctgcttttatttgagttagaattcctgtaccaaacattttaaaaagagaaaaaaaattaaagaaagagaaaaggaatttggaaactactataatgtaaagtagcattatttatacaacaattaattttagagaagcaagagaccttagaaataatctatttcaacgcatctattttacaaaaaagaaaattgaaactcatagatatttagtgacttgtcctttgttacaccaaaaatgagggaacttggtctagaattcctccagcatattatg

SEQ ID NO: 103391 - DNA, 601 bp, Human
caaacattaagcatttcacagtgaaaagggtcataggtatattttcatcctttgcatatagaagaaatagcaatctattattctcagtttttgacttaaaaggtattgttgcttccctttctttccctcccctactcaagtttttgcccatggatccagatacctacaagggcctaatacagggaaagtgcactgtgtatgagctatgaaggcacaatggaagcttgcctggcaatcagtgccagaacagacagctagtctgatgaattctgctacacatcacagggctactagttttttkttttttgttttttttttttttgtcatacattactgcaagttccctgaggaagtttactgatctgtagttttacgagaaatgcacgtcatggaggtggcgtgggggagcgggtgaacaaggaaactttagttgctataaaacaggagctgagagctcaagcaggttggttatgttctgccagatggagataaaactgtggcagccacatcctgtgactagaaattgtttaagtaggcagacctgttggaggactaaagaacattaggcaaggagattaaattagtgtaggaaaaaaaatca

SEQ ID NO: 103392 - DNA, 601 bp, Human
taagcatttcacagtgaaaagggtcataggtatattttcatcctttgcatatagaagaaatagcaatctattattctcagtttttgacttaaaaggtattgttgcttccctttctttccctcccctactcaagtttttgcccatggatccagatacctacaagggcctaatacagggaaagtgcactgtgtatgagctatgaaggcacaatggaagcttgcctggcaatcagtgccagaacagacagctagtctgatgaattctgctacacatcacagggctactagttttttgttttttkttttttttttttttgtcatacattactgcaagttccctgaggaagtttactgatctgtagttttacgagaaatgcacgtcatggaggtggcgtgggggagcgggtgaacaaggaaactttagttgctataaaacaggagctgagagctcaagcaggttggttatgttctgccagatggagataaaactgtggcagccacatcctgtgactagaaattgtttaagtaggcagacctgttggaggactaaagaacattaggcaaggagattaaattagtgtaggaaaaaaaatcagttttgt

SEQ ID NO: 103393 - DNA, 601 bp, Human
tgaatttgaagttgagaaccaacttatttcaagtaaaattaaaattttgagagataagagaatatactttttttaaggttagaactcagaggccattatgacaattaatgggctagtggagacacctggtctctaagaaggagacaccagcttcttcatgttttgatttctgccttgttctcttgtctgtcaccactagacacatactattttatagtaattacttgcatattttgtagaaaaggcagctgtgttttctacaaatatttcacaaatgttagtattgctctatgccaaggarcagaagacaaatttgtggaaaagatacatgtggcccctccccaggtgggatttcttgtgtaggccccatgcagtggagggacagagggggccagtgctcattttgaggacacgatagttcggactgtctgaggaaatcgacagtgtgtgtttaatgaccaaaccaacatggctttgaagaatacatatatatttttttttttgctttttttttttcattgcccaggctggagttcaatggcatgatctcagctcactgcaacctacgcttcccaggttcaaggaattctcctgcctcgga

SEQ ID NO: 103394 - DNA, 601 bp, Human
ggagacaccagcttcttcatgttttgatttctgccttgttctcttgtctgtcaccactagacacatactattttatagtaattacttgcatattttgtagaaaaggcagctgtgttttctacaaatatttcacaaatgttagtattgctctatgccaaggaacagaagacaaatttgtggaaaagatacatgtggcccctccccaggtgggatttcttgtgtaggccccatgcagtggagggacagagggggccagtgctcattttgaggacacgatagttcggactgtctgaggaaatcsacagtgtgtgtttaatgaccaaaccaacatggctttgaagaatacatatatatttttttttttgctttttttttttcattgcccaggctggagttcaatggcatgatctcagctcactgcaacctacgcttcccaggttcaaggaattctcctgcctcggacttccgagtagctgggattacaggcatgcaccaccatgccttgctaattttgtatttttagtagagacagggattttctatgttgttcaggctggtctcgagctcccaacctcaggacctcaggtgatctgcccgcctt

SEQ ID NO: 103395 - DNA, 601 bp, Human
gtctgtcaccactagacacatactattttatagtaattacttgcatattttgtagaaaaggcagctgtgttttctacaaatatttcacaaatgttagtattgctctatgccaaggaacagaagacaaatttgtggaaaagatacatgtggcccctccccaggtgggatttcttgtgtaggccccatgcagtggagggacagagggggccagtgctcattttgaggacacgatagttcggactgtctgaggaaatcgacagtgtgtgtttaatgaccaaaccaacatggctttgaagaatayatatatatttttttttttgctttttttttttcattgcccaggctggagttcaatggcatgatctcagctcactgcaacctacgcttcccaggttcaaggaattctcctgcctcggacttccgagtagctgggattacaggcatgcaccaccatgccttgctaattttgtatttttagtagagacagggattttctatgttgttcaggctggtctcgagctcccaacctcaggacctcaggtgatctgcccgccttggcctcccaaagtattgggattacaggcgtgagccactgtgcctg

SEQ ID NO: 103396 - DNA, 601 bp, Human
taattacttgcatattttgtagaaaaggcagctgtgttttctacaaatatttcacaaatgttagtattgctctatgccaaggaacagaagacaaatttgtggaaaagatacatgtggcccctccccaggtgggatttcttgtgtaggccccatgcagtggagggacagagggggccagtgctcattttgaggacacgatagttcggactgtctgaggaaatcgacagtgtgtgtttaatgaccaaaccaacatggctttgaagaatacatatatatttttttttttgctttttttttttcrttgcccaggctggagttcaatggcatgatctcagctcactgcaacctacgcttcccaggttcaaggaattctcctgcctcggacttccgagtagctgggattacaggcatgcaccaccatgccttgctaattttgtatttttagtagagacagggattttctatgttgttcaggctggtctcgagctcccaacctcaggacctcaggtgatctgcccgccttggcctcccaaagtattgggattacaggcgtgagccactgtgcctgaccaagaatatttttcttaatttttctgtaaaa

SEQ ID NO: 103397 - DNA, 601 bp, Human
tcttaacactgttaattgaaaccaatgtttctcatgccttttagtctctggactcctttttaaacattcttaaacataaacctaatttttagcataattgtggaatataaagaggttttgtctatgtgggttatatatatttattgtaaaataaactagatagaatttaaaaatatttaattatttattaaataataataaatcaatatattaatataaatagcacatattgtatgaaaaacaaccagatattataaaacaaagatttaataggaatagtgtcacttttttgcatttttasaaatcttttaaatgtctgtctgaataatagatagctggattctcatatatgctttaatattctctatctgttgtaatattatataccatatagtttctggaaacattaattttctactaatgagagaatgagagagaagaagaaaaataacttcttagtactgttaggtaaataataatactcataacacttaattaatattattttgaccttgaagaatctttaaaaggttcttggggactatcttgagtctccagaaaacactgagaaccactgatacgccaacaagataaaattctt

SEQ ID NO: 103398 - DNA, 601 bp, Human
tgatgtaactgtgccatgtgaccattgtacacatgtgggagggaggagctgaattacgcctgacccctggccagagcaagagctactggccaaaggggagattgagcatctgtgttgtacttcccacgtctcttcacctaggaagtgcaatagatttctgacgagtctatgattacccactgatgaataaagacaatctccctgcacaattgcactgcaggcaagactgaacttatgaccaccacttctgtgtaattttgaatttcttagacctgaaccctgctgagtacacctgcttccytctattccttgctgaagttcattcttttcagtgcgttaatggagccaaaccaagctggtggtggtaacaatttgaataataatagtctttaactttttatcttttgaaaaatagaattctcaggagcacttttagctataagattccttcatccaattaaataagctttaagcttcatgaaaagtgtaaaagggcacaggtgcatttgtggaaatagaaggaagcaatcttgagcctgaatacattgaggtactggcaagcttctggaagtagttgaagaagacttcagttagaagcttg

SEQ ID NO: 103399 - DNA, 601 bp, Human
atttgaaatcaaggatttattctccccctgccctgagcctctcccttatgtccacataggctctagcattggaagaaatattttaagatctctttctttttgactttgtgatactcccatattaaaaatggcttatgacaggaaaaggacaaatatgctatattttttcccttaaggctaatgttctcgggactaccatgaaaaatccaggtatcctaatctggagggttaccctttggatctgaatgggattggagtcagtacaaggggtggggagtgtttttagaacatcccggcagcmtttttttttttttttttttttttttgagacggagtctcgctctgtcgcccaggctggagtgcagtggtgcaatcgcggctcactgcaagctccgcctcccgggttcacgccattctcctgcctcagcctcccgagtaggggggactacaggcgcccgccgccacgcctggctaatttttctttttttttttttgtattcttagtagagacggggtttcaccgccctgctgccttttaaagcaatttaatacatgagttaaatatcatattttaaaaatagattttattttttattataat

SEQ ID NO: 103400 - DNA, 601 bp, Human
tctcctgcctcagcctcccgagtaggggggactacaggcgcccgccgccacgcctggctaatttttctttttttttttttgtattcttagtagagacggggtttcaccgccctgctgccttttaaagcaatttaatacatgagttaaatatcatattttaaaaatagattttattttttattataattttgatgaatgcatttttgtcaaagttgtcaaagtcaagaagtcattattgagaccctgagggtaaggcaggagccaagtgagaacaagcagatgtcaaagatggtgaaaaacyagaacagccaggtcccccaggcatatacagagaagttttgcaatggcaggtccccgtggttgtctgacccagacttccaccttgaggtaactggggtaactataacgatattttcatcctgatctcttcatgcagttatatgtttccaagaacagataaactgtgaacttaatacaagtgtctcctttccttggattctcaccatctgggtggtaaacatgacagaaacattcaagtatgttcaatgtagtacatggtaacaaatgctttagcacagactagggagcatgtctggcaaca

SEQ ID NO: 103401 - DNA, 601 bp, Human
tgatgaatgcatttttgtcaaagttgtcaaagtcaagaagtcattattgagaccctgagggtaaggcaggagccaagtgagaacaagcagatgtcaaagatggtgaaaaaccagaacagccaggtcccccaggcatatacagagaagttttgcaatggcaggtccccgtggttgtctgacccagacttccaccttgaggtaactggggtaactataacgatattttcatcctgatctcttcatgcagttatatgtttccaagaacagataaactgtgaacttaatacaagtgtctcctttmcttggattctcaccatctgggtggtaaacatgacagaaacattcaagtatgttcaatgtagtacatggtaacaaatgctttagcacagactagggagcatgtctggcaacatgttggcaaataattaaattggcacattcaggataaaatgagaacatggaaaaacagaatatgattctcttcccagccctggaaagacatcccaagtgtacgtattgtttatattatgttattagtatatctttaccagcaaagggcaggtcatcatcattcaatatgctcaaatactcacatttaaag

SEQ ID NO: 103402 - DNA, 601 bp, Human
ggataaaatgagaacatggaaaaacagaatatgattctcttcccagccctggaaagacatcccaagtgtacgtattgtttatattatgttattagtatatctttaccagcaaagggcaggtcatcatcattcaatatgctcaaatactcacatttaaagacataggcactttgagaggccaaggggggagaatcacttgagcctaagagttcaagaccggcctgggcaacatggcaaatcccatctctacaaaaaatacaaaaattagctgggtatagtgcctgtggtcccagctacttgrgaggctgaggtgaaaagattgtttgagtcgaggaaatggacgctgcagtgagccatggtcacaccactgcactccagcattctagcctgggcaacagagcaagaccctgtctcaaaaaaaaaaaaaaaaaaaagagagatgtagggagcattgtggacatctattcatggagggttaaacaatagaattagacaaccatgtgtatgtgtggaatcatgtgttttttccacacatgtaggaaggagaaggtaggaacaatgaaaagattcttttagtgatcatagtggctccaaaacagat

SEQ ID NO: 103403 - DNA, 601 bp, Human
gatagataaagaagagagggaagggcataacacaaaggaacaggaagtattaaaatgtgcgtgttatggacttgcatacaaattgagtgctttaattttgccaagcatctttcataacactataaggaattaacagtatgagatagcataagtaagggggcctgagaacttacataaacacccttggtacatggaaagtaaatataaaatggtgctgataattctaattacatagtttatagaaaagatacatgaccaagcttgaagcaagaatgattgataaggaattaggtaggttctktataaggaaaggtgatttcagatcccaaaagggcatggctgaatgtttagcctttcagagttggggaatccatttcttcctgtggaaggattagtctttaggtgaatagatatgtatcgaagggaaattaagagagcataagaaaaccccactttacctgccatctatccatggaagcagcaataagaccacctgagagctatggtacaattaaattgaagatatttgaacacataaagtaggtgtaatgtaacatataggctcaaacatttgaaagtgatgatatttggtcattgctgg

SEQ ID NO: 103404 - DNA, 601 bp, Human
ttttcagagttcaaaccgtggtagatttgagagtatgtttggaaatgactaatgcttagtgttgtttaccctgtcaccacattcctgcataaggctctttatctctgactggtcatgctcacatctgttttctgccagccttttctggtgcccgcaggcacccacctgcacccaatgtcctccttttatgctttctggcctcctttcatgtactgtgtggtccaccatactacctaatctgctatatactcacaaaactatttacttcttttgaaaaaaatgtattattagatttaaatawatgtatttatatttcccttcactttttaaagttttcactttatttttatactatgttttaagcttccctaatatcccactgctgaatcccaccgacatggaatccacggcatggtgaatccctgacttacccattcctactagaagtagagccagaatctaatccagacctcctgccagccactcccagaccccttctttcccccaaagaaaatgaagaacatattttttgtgcaaagagatacaatcaggaaatttttttaaaatcagcttttattttaactgaatagcttacttagtc

SEQ ID NO: 103405 - DNA, 601 bp, Human
ctggggcctactttacagatttgtccttaagtactgaatataaatgtttctgcttcttattttccttagcatttttaaagaaagtcctggaagccaaaaatctccatgatgaaatatttataattattaatcactgttatatgaccttattatgtatgaaaactatattcaacatcctaaatatgaaatgtgattagttctgattttaaagatttgtgataaaacaagacaccattgatgaaatacatagaaaaaggaagacaaaatagcttgggacacattaataacttacacaaaaaawtttaaaaattaaatcttctaatagatttgatatataatataccccagaaatatttacattatattttcaaagtctagagcatttcttccatagactccaaaactatttgtatatattatcatcgaaacacaattttgagagaagttggaatggcagtgcagttagcagataaaaaaaatacccacttttctttacaagtctctatctaattcatactccctattgctctttcctgcttcacaaacttcttaaaagattttttcatgtggtgtgaatatttaaaatctgtcttagcaattt

SEQ ID NO: 103406 - DNA, 601 bp, Human
taaaaataatttaaattttttgaaatgtaaaaaaaaaaaatttttctagcctcccagtctacactctcacttttcactaacccatttactgctttcttgcttgttctcccagcacaccacaaaaacaacttccatgcatacaccagtatcacccccctcacccccctgtttccaataaattaaacccaatggaccaagctaaagcatttattatacttcacctctcagaggcatttaacgctattgacaacttccttcttttcaaaaccctgtcctcccctaattttcatgaaacatgaarctaccttctagttctcttatttatctcagccatctggctcctctttctctattcccttgttacctattggtgttggtatgtattccattctagaactttgtctcctctactgtgatgctatcatttagggtgaaatcaactactcccattgcttaatttgtcttttataaatttgtgacttctacatctatagctccagttctgctgtcttttttgtattaaagaccaatttctccaactatgcactagacacttccaactagtatcccactggtatctcaaattcaacattattgaact

SEQ ID NO: 103407 - DNA, 601 bp, Human
ctttttttcccccccagttttttcttctttaaactctggattgctattttcatattaatttgatgaccccatcacagtaccagaatattcctgaaaatagagttccaatttgatcaaaacataaaccagagtgagtgagtgagtgactagaattataaaggccaggcagcaggaaaagttaccctaaaccatctgactgctcaggtcttgcatgtgcaaaggggagccggaagaggagaaatctattatacatgcaacactgaactggagaacacggcttggggcctctgggacagttcargtccctgagctgccccctacttcccagacagctgctcctgcagtttgggcacatagtcgtcccactcagcctggtaacgctttctggccactggggccacgagcacgagctcgtacttttttttttttttttttgagacggagtctcgccttgtcgccaggctggagtgcagtggcctgatctcgcctcactgcaacctctgcctcccgggttcaagcaattctcctgcttcagcctcccgagtagctgggactaaagccgtgccaccacgcccagctattttttttttttttttttttg

SEQ ID NO: 103408 - DNA, 601 bp, Human
aaaaggataaataatgctaactcattggcttactgggatgcttaaaagaaaaaaaatacatatatattatataaagaggtgtgcatagtgtctgctacataacatttcagtaaactgttgccatcattattatatttactgataagctaatggagggtagaaaagactgtttcctgtggttctctgaaatcataatacctggcttgtcgctgcccagagtgcttactccataaatacttaataatttaatatgatttgttagatttattgtctgtggaccatatagcagatttctagcataaaaaaagtgcaattctcttatttttattgtgcactttattattatcatgcattgctaagaaaggaaagccatacatatctgttttagctgacccttattttttgtcttgatttgcttttttccacttttgtacaggctttatgtttatggaggtcaagtatgcattctcaaccttcaaaacatgctatcattcattttagggcagatgctgagaataagtatttatttaatctattctattttacccttctgcccttgtacttttcccagatttgcagaactagacaggtttaaattccc

SEQ ID NO: 103409 - DNA, 601 bp, Human
tatttgtatatatgcatgcatatatgtgtatgtatatttatgaatacatatacacaccatatacatacacttatgtatggtgtgtgcatatgtatgtgtagatatatgtacatacacactatagtggactggggagttagtatactgggaggagcatacatttagggtatgattcacatatttattttgtccttctcccattttccattaattaacaggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggttggcacacaaaagttgttaacttaaatatcagggaatgtcatttagaaaattctacagttatcagtacaacttgtctttaaattatttgcacagtttctaagtatgtgattttattcaagtgcagaaattgcaggaaattagtatctgtgaaatatagatcgactgaagtaattaatgcatgt

SEQ ID NO: 103410 - DNA, 601 bp, Human
gtatgattcacatatttattttgtccttctcccattttccattaattaacaggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggttggcacacaaaagttgttaacttaaatatcagggaatgtcatttagaarattctacagttatcagtacaacttgtctttaaattatttgcacagtttctaagtatgtgattttattcaagtgcagaaattgcaggaaattagtatctgtgaaatatagatcgactgaagtaattaatgcatgttgttagggagtggagagagaaaagaagggaagcaagatctccaaggacaatcaggaggggaaatttgttctagtatcctctgatctatacacactcgccatgattctcccgcttggcttcccgccacctggacagatgagaatttccctagttcagagattatcag

SEQ ID NO: 103411 - DNA, 601 bp, Human
gaggggcactatgctccttagaatactgatatatgtatatgctcatttaatgtttagcaataggtctgccagtgtattcagactcagatttaccatcagtagagtgttcatgcttttctgaaataatgtgttatgttgacttttttgtgggcaaacaggtttatagacatactctgataaaagatactaagctatttgaactgtttaacaatgccatttatcttcgtttgaaaaacaagcatatataataccatcacagaaattttgtttagggtacatcaaagtattttgagtaccttamtgatgaagtttattggatatagtaagcagttaaataaatggtcagtgccttcctacagcaagtacaagactgtgtatttaatcttccatttgtttccctgtcaccatagcagagtagtaactaggacctgtctaaacactgtaaaaatttgaacacattgcccaaaatttttacaaaaggaatgcaaggatgaaggtgctgatgactaggtggaacatctcatgctattttattattttgtttattgcctgagtagtgtcacattgagttttccttttgaaggttctgtatttcacgtca

SEQ ID NO: 103412 - DNA, 601 bp, Human
tctgaatgagttttttaaaggatgaataaatgagctttcctcactcttctacatattctgctggagccctcctctggggatccagagtggaaaacctcatgtttatgttgtttattctattctatggtttagttaaatttcgtggtttagtggcttttgaagactgagctgagaacccatgctcaattatttggaagatgcattttcaattctaatggaatgtatgtgtgaaattatagactgtactgcatttgtaattggtagacacctgcaagctcaaatcaaagccatgttcagaacrtgcatgcatgtatcactgcagaaatacagactctgcctgcaaatgtgagactaatctcacatcattgaactgatgaccccagggatcttgacagaaaataacccaacaagctcttgaatagagggcagctcatatttcttttgctttttccatggcaactagcatagtgctagtcatctagtaggaaccaaatgaatatacattgattgcctgtgctgtaattctggatgtgatgttgggcaaaggtgtaaaatacattaggtaatttgaagcctgaaaatggaaagttctaacctagta

SEQ ID NO: 103413 - DNA, 601 bp, Human
attacagctactactccatctaagccaacatgtggtaagtttatttacttagaatcagcatacctcactttggaatagcactttaattacatctttctttattccaagctttcaggacccactagtaagctaaactcactggctctaatttctcaccgatgactagtctcaaattagtaaaaaattactagctacacatggacatagagttgggaatgatagacactgggaaatacaagagcgatgatggagggaggaagacaagggttgggaaactacctatattgggaactgtgcctayttgctgggcgtcgaattcaattttactgcaaacctcagcatcctgcaatatacctttgtaacaaacttgcacatataaccctggaatccaaaataaaagttgaaaactaagttttccagttagacaactttggtaaagccacttaatttaatttaggtatttgaaaaaaaaatggaataacagcaagtttgttggtgagggggagggggacaaggattcagtgtgatgataaatataaaatgtggataataccttcaaagcttatcaagaagaaaaatctctctttttctctctctttct

SEQ ID NO: 103414 - DNA, 601 bp, Human
tagtgccacattatttcctgcataatcttattttagaggtttgtatgtctcctgcaattcatgcttgtgtctgcctccacactggattatacatttctaaaagctgattatatctaacttgcctttgaattcctagtattggtgaccatgtcttacatatgacaagggcttaataatttttgttgaataaaaacaaatgaataaatttatatttgttgtaaagatatttttatcagtcagcagaaattgttgacactaaacaaaggtgctttggaggtatattatcaatcataattttacscaagttaaggaaagaatgagggcttctgatccctgagtaattaatgccccacatatatcaagaaacaggtggttaataactacgttttagaaaacaagaaaattataaagcaagaataaatttctcaaatgcatcatttatttgtgcatcaagtcaacaagtaactagtgagttcccattaatgatacatattatgcatactcctgaatttacagtgataataaaaatagcctagactttgctctcatggaagttccaagtccagctaggaagacagacacttatctggtaatcatccaa

SEQ ID NO: 103415 - DNA, 601 bp, Human
ttcgaaatatttctttatttcaggtaatatgatatttgataataaagaaattaaattagaaaaccttgaacccgaacatgagtataagtgtgactcagaaatactctataataaccacaagtttactaacgcaagtaaaattattaaaacagattttgggagtgagtatgttacttgcatttatatgtaaaattgcttctctcttcatgttcttataattatttgagaatcataggaaatgaattgtctttttgctgtttttgatactttttaagcatatgctttttatttcaatgaagcrcaatttatctatttttacttcttttgcttatgtttttggtgtcgtatatgaaagtccattgccaagtcatgcagatttatccatatgttttgttctaaaaattttatagcattggctcttaaatttagctctgttacccactttgagttaatatttgtatatggtgtgaggtaacagtctaatttcattttgttgcatatggccatctaatttttccagcgccatttgctgaaaatactatttattcccccactgaatagtcttgccattcttatcaaaaattagttgaccataatgatg

SEQ ID NO: 103416 - DNA, 601 bp, Human
aggtaatatgatatttgataataaagaaattaaattagaaaaccttgaacccgaacatgagtataagtgtgactcagaaatactctataataaccacaagtttactaacgcaagtaaaattattaaaacagattttgggagtgagtatgttacttgcatttatatgtaaaattgcttctctcttcatgttcttataattatttgagaatcataggaaatgaattgtctttttgctgtttttgatactttttaagcatatgctttttatttcaatgaagcgcaatttatctatttttacttmttttgcttatgtttttggtgtcgtatatgaaagtccattgccaagtcatgcagatttatccatatgttttgttctaaaaattttatagcattggctcttaaatttagctctgttacccactttgagttaatatttgtatatggtgtgaggtaacagtctaatttcattttgttgcatatggccatctaatttttccagcgccatttgctgaaaatactatttattcccccactgaatagtcttgccattcttatcaaaaattagttgaccataatgatgggtttatttctgaactttcag

SEQ ID NO: 103417 - DNA, 601 bp, Human
ttatgtcttctttaatttattttcaaaatgttttgtagttttcagtgcattagtgttataattcttctgttaaatttatttctagtttaagtttattcctggttataatgctgttgttttcttaatcacattttcaggtttgttactaatgtacaaaagtacaattgatttttctgtattgatcttgcagtctgtcacattactgaatttgtttattaatgataatattgagaaatttttgacaaaacttataaatgtaattctaaattttgttttgttttgattttgagacggagtctcrctctgttgcccaggctggagtgcagtggcgtgatctcggctcactgcaacctctgactcctgggttcaagcaattctcctgcctcggcctcccaagtagctgggactacaggtgcgtgccaccacgccctgctaattttctgtatttttagtagagatcaatctcctgacctcatgatccgcccaccttggcctcccaaagtgctggaattacaggcatgagccaccatgcccggcccgtgattctaagttttatgtaaaaaggatagttgaaggctaaagaggctgcctaaatccttgt

SEQ ID NO: 103418 - DNA, 601 bp, Human
taatttcatcagaaaagagaaatcaagaatttgaaagtactagaaatttttattgagccagtgagtcacaaagctctctgcttagagactgcataggcatagtatactccctgatcttagaattgcttccactcattcaaagctttccagccccagaaatgactaaaatccagaacattctaaatatttgcttgtccttcttggtcttagtttaaatctttgtgctccaaagcctagagacagaaaacctctggatgacaacactcatttctgtcttgcaagtattatgtaagtgatttgactcactttgaactcatcattcagcctcctaaacaaaccaacaaacaagcaaaccccttgtaaaacttgtttcagctaataatacagacaaaatgttgggtgaataaaaatgaacatgggcccatgtagccgctggggccagtttggtgtaatcttgggagcatagttctaagtttagaattagacttctgcagaagtaatgcaattaaaaaaaaaaagaagaagaaagaaatgtgctatgactagttcactcatgaaatgttcaaatgagatgctatttaagagaacaaatatcttctgg

SEQ ID NO: 103419 - DNA, 601 bp, Human
cagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcgtaagttatatgttttaatgcttctttccataaatggtaaaaagcaaggtatgaactttttagcctacaatatttctatctttattctagcaagcacatttacctggcacatttgttaacatctagggcttataaacaygtaaaatctaaaagtttaaaaaccgttatcctggattctctctcttcttcagatatagtcatagaattttaaggacaaagcataaaagcatcttaattggcatcagtttgtgcaatttcatgcagttaagtacttaaccaacttagattaaaacattcactgtttgctgttgtctttactatctggaaatattaattgtaatcagaaacctaacaatgtctcataaagcattagcctactaacctctgttcatctgataaaacatttcataaaatgtaatattttattagcattttcttc

SEQ ID NO: 103420 - DNA, 601 bp, Human
aggtgagactagatgaaaagggctcttcagcagctgacttcacagcaactaatttctgacaggtcagagttggcattgctcaaatctgggcttcatttccaagaagtttcacaagtctgccaggggaagtccctggacttcttgcttctttcgtgtaggacaggctgtcgaaacctcagtggataaaagacctagagaatgtgtatcccagaagaagctggccaaggatatgggagcaaccaccatggaccagaagtctctctgggcaggtgagcatggggttgataattcagcaggaaakttggtgaggaaggaagaggtaacaggtctgtagaagaagtaatcttcctcctttcctgggacttcagtctttccgttgaccttagtgtcaaaaaatttcaagccaatgcaactgttgtaggggaaccacctgatctttcctgaatggacaaaaatgcagcagtagccagaaccctttgcactggcaggatgttctcagtttgtgcagaggtccttcttgtccacattagaactggagctaagacaggaaagaggccaagctttcttagtctcttggtgtatgagcgttgtattgcgagtc

SEQ ID NO: 103421 - DNA, 601 bp, Human
cgaaacctcagtggataaaagacctagagaatgtgtatcccagaagaagctggccaaggatatgggagcaaccaccatggaccagaagtctctctgggcaggtgagcatggggttgataattcagcaggaaagttggtgaggaaggaagaggtaacaggtctgtagaagaagtaatcttcctcctttcctgggacttcagtctttccgttgaccttagtgtcaaaaaatttcaagccaatgcaactgttgtaggggaaccacctgatctttcctgaatggacaaaaatgcagcagtagccrgaaccctttgcactggcaggatgttctcagtttgtgcagaggtccttcttgtccacattagaactggagctaagacaggaaagaggccaagctttcttagtctcttggtgtatgagcgttgtattgcgagtcacatctttcttgggctctgctgtggttatattttacaacttttggagagccccacatttctcatctgcagaatggtttattgaatttaatgttttttaaactctccctttcaactctaaagttctgatccaaaactctggcttttgtggtggctgggaattgggatga

SEQ ID NO: 103422 - DNA, 601 bp, Human
taggaatgtagagacacaaggcaccccagggctggggacctcaaggtcctataaagaaaccacaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcrcgccactgcactccagcctgggagacagagcgagactccgtctcaaaaaaaaaaaaaaaaaaaaaaaaaaaaaaagaaaccacagcagctgtggctggggagcccagatgaagtgtggctctatcttgtatgtgagcacacccacattttcactgccattatctgggacagcagaaccaggtttggctcaacagatttctctttccacccatctattgcaggtgtagtggtcttgctgcttctccagggaggtaagtagtcaataagtcactaccgcctggatctcctggcttgggtgct

SEQ ID NO: 103423 - DNA, 601 bp, Human
ggaatgtagagacacaaggcaccccagggctggggacctcaaggtcctataaagaaaccacaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcrccactgcactccagcctgggagacagagcgagactccgtctcaaaaaaaaaaaaaaaaaaaaaaaaaaaaaaagaaaccacagcagctgtggctggggagcccagatgaagtgtggctctatcttgtatgtgagcacacccacattttcactgccattatctgggacagcagaaccaggtttggctcaacagatttctctttccacccatctattgcaggtgtagtggtcttgctgcttctccagggaggtaagtagtcaataagtcactaccgcctggatctcctggcttgggtgcttt

SEQ ID NO: 103424 - DNA, 601 bp, Human
ccccagggctggggacctcaaggtcctataaagaaaccacaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccactgcactccagcctgggmgacagagcgagactccgtctcaaaaaaaaaaaaaaaaaaaaaaaaaaaaaaagaaaccacagcagctgtggctggggagcccagatgaagtgtggctctatcttgtatgtgagcacacccacattttcactgccattatctgggacagcagaaccaggtttggctcaacagatttctctttccacccatctattgcaggtgtagtggtcttgctgcttctccagggaggtaagtagtcaataagtcactaccgcctggatctcctggcttgggtgctttcatttttgatgtacagtttct

SEQ ID NO: 103425 - DNA, 601 bp, Human
ctacatgctttttctcttgattactctctccggttctgccactgacatatttatgacactgagtttttattctatctttttgtgtatcccttgttctagttctttttgagccactctctctctcacccctcccccatagctggcctcaatatgtgtgtgtgaatacaaacatacacaatgtttgtattatctgtttctctactgatctgtgtcatccatccatacatacatactgaatcttagtgctccatgggtgtttcatatgttggtggtatctctgtctctcaatgtatttttttttaaatttttttgagacagggtctcactgtaaggtccaggctgtagtgcagtggtgtgaccatggctcactgcagccttgacctcccaggctcaaacaatcctccaacttcagcctccttagtagctgagactacaggcatgaaccactacacctggctaatttttaaattttttgtagagatggggttttgctatgttgccagagctggtcttgaactcctgggctcaagaagtcctcctgcctcagcctcccaaagtgctgggataacaggtgtgagccactgtgcccagtctcagcgta

SEQ ID NO: 103426 - DNA, 601 bp, Human
tcaaacaatcctccaacttcagcctccttagtagctgagactacaggcatgaaccactacacctggctaatttttaaattttttgtagagatggggttttgctatgttgccagagctggtcttgaactcctgggctcaagaagtcctcctgcctcagcctcccaaagtgctgggataacaggtgtgagccactgtgcccagtctcagcgtatttcttaactggggtctgggtactcaagagccagcactaaaggcccaggctgaatgaccctcagaggctctggcagaatgagcaaatgaygcaatggctgtcttggggagaaaattgtgactttctggactctaaggcaacagccctagagtctcactggctctcttcactctactccaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagtcagtaa

SEQ ID NO: 103427 - DNA, 601 bp, Human
aatgatgcaatggctgtcttggggagaaaattgtgactttctggactctaaggcaacagccctagagtctcactggctctcttcactctactccaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagtsagtaagatgggggtggaagcatcctgcatggattttagaggagggaagctggtcttaagctgacactaagacatactatctcattcattcattcattcctatatatttctctgggtgtatttctgatcctaactgttctcaccagtgcttcatcccttcactgaacttcactttagttcaaacagccaggccctaattgtccattttctctacacttaagaactctgttctttagacaaaggcttccctggcagccagaaattaaataatcatcttattcttctacttcaggaatcccaa

SEQ ID NO: 103428 - DNA, 601 bp, Human
gatgctctaccagaccatcaacagtctcaaaaccaagtcagtaagatgggggtggaagcatcctgcatggattttagaggagggaagctggtcttaagctgacactaagacatactatctcattcattcattcattcctatatatttctctgggtgtatttctgatcctaactgttctcaccagtgcttcatcccttcactgaacttcactttagttcaaacagccaggccctaattgtccattttctctacacttaagaactctgttctttagacaaaggcttccctggcagccagaaawtaaataatcatcttattcttctacttcaggaatcccaaactgaaaattctcttgtccattggagggtacctgtttggttccaaagggtaagactacatctttattttttgttcatttccccatgtaatttttgatcatcatcatttttcctccttctaagaagagatattaaactaggctttaagaggttttcccttggccaggtggcaaaactgatctgagatttgtcataagcagaggaacagcattaggtttcctggggtctttgaaggaattcttctggagcttaatacaagccca

SEQ ID NO: 103429 - DNA, 601 bp, Human
gaacaaattagtaaatttctattgaatgggcagctctcctaaaattggaggcatctgcccagaggctcaggtgcaatggctttctaatcattgtaagcactttcaaatgcaagagaaaagctagaaaactatttccaccgtagttttctgatatcaggccagtttcttgctatctcttcaacttcaaagatgagatacatgcaggaatcaaaatctcaatttaatattgagtaaaacaaaattaattcaaggctctaagaaagcctgggtgtgggaggtattgtaagaggtgaaaagtgayacaacttaaaggttatgtcctcaggaaaataccagtatctcatctacagctttgggtttaaaatgctattggtgcccttggtgtgggcatctgagaatcaacttcatggcttcagaattctagttcagatgaagcccttgaggagctgctgatttcaagtcctgttttcatcagaaatcccgggggtggggagatctgcgttgcctatttgtggccgggatgcttgtttggggaccatgaagtcactggagtccagttctttttcctggaacttccctaaatgttatccccttgaggcac

SEQ ID NO: 103430 - DNA, 601 bp, Human
aagctagaaaactatttccaccgtagttttctgatatcaggccagtttcttgctatctcttcaacttcaaagatgagatacatgcaggaatcaaaatctcaatttaatattgagtaaaacaaaattaattcaaggctctaagaaagcctgggtgtgggaggtattgtaagaggtgaaaagtgacacaacttaaaggttatgtcctcaggaaaataccagtatctcatctacagctttgggtttaaaatgctattggtgcccttggtgtgggcatctgagaatcaacttcatggcttcagarttctagttcagatgaagcccttgaggagctgctgatttcaagtcctgttttcatcagaaatcccgggggtggggagatctgcgttgcctatttgtggccgggatgcttgtttggggaccatgaagtcactggagtccagttctttttcctggaacttccctaaatgttatccccttgaggcacatgaagcaggattagtaccctcagtcccaatttagaggtggccagactggaacccagagagcaggttaatgacaaagtggccatcaatcagaaaggactctaaccttggacttgaat

SEQ ID NO: 103431 - DNA, 601 bp, Human
gtggttctagaaacctcatagattccaggcaagaagcttagcactgtactctgggaaggggaatattgcaccttgtttctttgtttttcctaggagttagcagaagcctttcagaaggacttcacaaaatccaccaaggaaaggcttctcttgactgcgggcgtatctgcagggaggcaaatgattgataacagctatcaagttgagaaactggcaaagtgagtacatcagagcaactttccatccctctgcttccaatttggtccatgcaaatgatgcatcagcatgtttgacggatgargggaggaggaagagagggaaggtcattgtcctaaccctgcatcattcagccaggaacaacttctttacagagactttcaatccttctagcagcatcattcaaagccaaaacaattacttacaattgtttctaccactgctcgtcacaaaatctctcccattgcttttggcactttagagatctggatttcatcaacctcctgtcctttgacttccatgggtcttgggaaaagccccttatcactggccacaacagccctctgagcaaggggtggcaggacagagggccaagctcctacta

SEQ ID NO: 103432 - DNA, 601 bp, Human
acaacttctttacagagactttcaatccttctagcagcatcattcaaagccaaaacaattacttacaattgtttctaccactgctcgtcacaaaatctctcccattgcttttggcactttagagatctggatttcatcaacctcctgtcctttgacttccatgggtcttgggaaaagccccttatcactggccacaacagccctctgagcaaggggtggcaggacagagggccaagctcctactacaatgtggtgagtaggccaggggaaccgcaggggtactggctgtgggggtggggcyggggagagtccagcatgtctagagttacttctgtcttgaactgaggaagagctatgagcccaagagggaattgggtagccccaggagcaagtgagtgcaggagaagtgctttgaccaggcaccaacaaaatgtcacctagaaaatatcagaagtgctgatagctgaagtgccctaagctctgtctctggctcagagtgtcccccatcccagtcttctctggattctccatctttcatacatttcttggcatctacacaggagaacagaacttggaccttcctgtgtccatctatattccc

SEQ ID NO: 103433 - DNA, 601 bp, Human
actttagagatctggatttcatcaacctcctgtcctttgacttccatgggtcttgggaaaagccccttatcactggccacaacagccctctgagcaaggggtggcaggacagagggccaagctcctactacaatgtggtgagtaggccaggggaaccgcaggggtactggctgtgggggtggggccggggagagtccagcatgtctagagttacttctgtcttgaactgaggaagagctatgagcccaagagggaattgggtagccccaggagcaagtgagtgcaggagaagtgctttgaycaggcaccaacaaaatgtcacctagaaaatatcagaagtgctgatagctgaagtgccctaagctctgtctctggctcagagtgtcccccatcccagtcttctctggattctccatctttcatacatttcttggcatctacacaggagaacagaacttggaccttcctgtgtccatctatattccctatttaattctatctttaaaacaaccccatgaggtcagctgggtaggaaatgttactcccacttcacagatgatgaaacagaagcttggcagattccattgactcttcaaggtcg

SEQ ID NO: 103434 - DNA, 601 bp, Human
aggggtactggctgtgggggtggggccggggagagtccagcatgtctagagttacttctgtcttgaactgaggaagagctatgagcccaagagggaattgggtagccccaggagcaagtgagtgcaggagaagtgctttgaccaggcaccaacaaaatgtcacctagaaaatatcagaagtgctgatagctgaagtgccctaagctctgtctctggctcagagtgtcccccatcccagtcttctctggattctccatctttcatacatttcttggcatctacacaggagaacagaacttgkaccttcctgtgtccatctatattccctatttaattctatctttaaaacaaccccatgaggtcagctgggtaggaaatgttactcccacttcacagatgatgaaacagaagcttggcagattccattgactcttcaaggtcgtgtgttgtgaacttcctggtgatgggaaatgaaaagtaaaaaaaaaaaataatgttgttgatgttgttctggaacataacttatccacccaatgggttctccttgcccattgatttatcaagataggagaattgcaatagagaaagagttaaagtcatg

SEQ ID NO: 103435 - DNA, 601 bp, Human
gggatcagggtttttaaggataattttgtggatgggggacagaaagtggcgagtgctgattggtcaggttgaagatgaaatcataagggttcaaagtgggtttttctcgctgtcttttgctcttgtttgggatcacagaactggttgagccagattcctgggtctgggtagtgtcagctggtgcatcagaatgcaagatctgcaaaatatctcaagcactgatcttaggttttgcaacagtgatgctattcccagctgcaatttggggaggcttagaatcttgcagcctttggccgcatgwctcctaaaccataacttctaatctcatggctaatttgttagttctacaaaagcagactggtctctaggcaagaagagagtttgtttctaaaaagggctgttaatcatctttgtttcaaagctaacctagagactaaattcctcccaaattgagttggcttacacccaggaatgaacaaggacagcttggaggttagaagcaagatggagtcagttaggtcagatctctttcactgtcataattttctcagttacaatctttgcaaaggctgtttcatatatatggatgtatattcctaaa

SEQ ID NO: 103436 - DNA, 601 bp, Human
agattcctgggtctgggtagtgtcagctggtgcatcagaatgcaagatctgcaaaatatctcaagcactgatcttaggttttgcaacagtgatgctattcccagctgcaatttggggaggcttagaatcttgcagcctttggccgcatgactcctaaaccataacttctaatctcatggctaatttgttagttctacaaaagcagactggtctctaggcaagaagagagtttgtttctaaaaagggctgttaatcatctttgtttcaaagctaacctagagactaaattcctcccaaattsagttggcttacacccaggaatgaacaaggacagcttggaggttagaagcaagatggagtcagttaggtcagatctctttcactgtcataattttctcagttacaatctttgcaaaggctgtttcatatatatggatgtatattcctaaaattttgggagaaaaaatatctgtgttgcatgtttccaggccttcatattcaaagtcacaaaatggatcggtccagagctagatatgatttctggttggggttttctaggccttcatgtggctaagtcacatcagcctccttcactccttcc

SEQ ID NO: 103437 - DNA, 601 bp, Human
agcctcttacctcccaatctgtctataaaccaaaaataaaattctaagccccccaaacatctgaacaaatccttcctcttggccaagggcattcaaagttaatctgaaaagttaattcaggtcatgatgggaagttgggtgtcagacatgcctcacagctgaccagcattaacatcaatacagagaccttaagactgatagaagagaatttctaagtctgatgagaaacatttacaatctagtctttctgaagcctgctacctggaggctttatctgcatgataaaaccttggtctctacrccacttatcataacccagacattcctttctattgactccaggcctttacataataactctttcaaccaattgccaatcaaaatatctttgaattcacttatgacctggaagctgcagcttctagttgtcctgcgtttctggagtgaaccaatgtacatcttacatgtactgactgatgtcttatgtttccctgaaatgtatgaaatcaagctgtaacctgaccaccttgggcacatgtcctcaggatctcctgagagctgtgtcatgggccattcgtcactcatatttggctcagaataa

SEQ ID NO: 103438 - DNA, 601 bp, Human
tctgatgagaaacatttacaatctagtctttctgaagcctgctacctggaggctttatctgcatgataaaaccttggtctctacaccacttatcataacccagacattcctttctattgactccaggcctttacataataactctttcaaccaattgccaatcaaaatatctttgaattcacttatgacctggaagctgcagcttctagttgtcctgcgtttctggagtgaaccaatgtacatcttacatgtactgactgatgtcttatgtttccctgaaatgtatgaaatcaagctgtarcctgaccaccttgggcacatgtcctcaggatctcctgagagctgtgtcatgggccattcgtcactcatatttggctcagaataaatctcttcaaatattttacagagtttgactctttacgttgacatgtcccattgggtgcaaggtcattgtgaggcctcatggactaggaatctgacagccacctttgtcagtattcacaaagagccattgtgtagacaagttccacagggattttgagttgactcaaaaggggaaggaagatggtgacaaccttgatttcatgttttctaggttcct

SEQ ID NO: 103439 - DNA, 601 bp, Human
acttatcataacccagacattcctttctattgactccaggcctttacataataactctttcaaccaattgccaatcaaaatatctttgaattcacttatgacctggaagctgcagcttctagttgtcctgcgtttctggagtgaaccaatgtacatcttacatgtactgactgatgtcttatgtttccctgaaatgtatgaaatcaagctgtaacctgaccaccttgggcacatgtcctcaggatctcctgagagctgtgtcatgggccattcgtcactcatatttggctcagaataaatytcttcaaatattttacagagtttgactctttacgttgacatgtcccattgggtgcaaggtcattgtgaggcctcatggactaggaatctgacagccacctttgtcagtattcacaaagagccattgtgtagacaagttccacagggattttgagttgactcaaaaggggaaggaagatggtgacaaccttgatttcatgttttctaggttccttgactgatttcttttgtgatccactgtctagttcctttcagaaattagaaaaagttgcataagcctcttgctgctaaagagcatatg

SEQ ID NO: 103440 - DNA, 601 bp, Human
ctgccatgtctgggtagatgttccatcttcaatttgacagcagagtaaagcatcctgagtgttgcgaaggggaaagggcagagtactactgaacatgtgaggggatctcctaactctgggttgggagagggtcagggaatgcttcctggaggaagtgaaataagctggactctgaagaggagatggagctagccaggaatggggataggcagaggagagtgcgagaaattgaaaaaggaagactaccccaagttcttgatttgagcagctaagtggatggcaatgccatttacagagatarggaagactggagggagaacagagtggacattggtcctgctcatgagatcagttttggacgttctgagtgtgaggagcccgtgggacatacagataacaggtgagtcattgaatatatgggtttggatcacagcaggccagtctgcactagagaggtagattcaaaactatcagcataaagctggtacctgaagccaaaccatacagtgagaagtgaatgaggccccagacacacccaaaaacctcctacacctgagggacatgcagaggaaggggaacatattaaggtaactgacaagga

SEQ ID NO: 103441 - DNA, 601 bp, Human
aagtaggtgtttcaaaaaggagggagtggtcaaatgtgtcaaattctgtgcagttgtcagatagatcatagggataacaaaattgttctgctaattataccatcattcctctctgccctccaatctgggaaaatttatttaaaaagcataggggaagatataaatctaacaataggtcaaccaacagaaactctttggacactcccatatcccaaacactgggtactgtgaaagctagaaataagtaattatccatccttgtctctaaaggggttattgtcaaggtggaaagaatgtgaartacagacatagctagttaaacaagagttcaaaaacaagataactataacatttaataaaatcagagaggtattgtaaaacaatatgggattcaatgaccaatgaatggtgtagagtgacatgagatcagagatgggtgactggggaaggctccatggaagaggagaagtttatgctgggccttgaaggattagtagaaatttgatcaggtagagaaaaaaaaaatatcattctatatcctggtctatctttggagtcccagcctgacctctcattgtgagtgtgaacatgccatcggccc

SEQ ID NO: 103442 - DNA, 601 bp, Human
actgtgaaagctagaaataagtaattatccatccttgtctctaaaggggttattgtcaaggtggaaagaatgtgaaatacagacatagctagttaaacaagagttcaaaaacaagataactataacatttaataaaatcagagaggtattgtaaaacaatatgggattcaatgaccaatgaatggtgtagagtgacatgagatcagagatgggtgactggggaaggctccatggaagaggagaagtttatgctgggccttgaaggattagtagaaatttgatcaggtagagaaaaaaaaaatatcattctatatcctggtctatctttggagtcccagcctgacctctcattgtgagtgtgaacatgccatcggcccatgctgaatgacttggcacccaccaaggtacccattcagtgtaatgctcaatttttcccttcatcttacacataggaatgattggcacatcatcaattcaattggcaacaagaatgggacatgggtcattgtgagagtcctcattgaatctcagggtgcctgatacataggaagtgggagagaggctgacccatccttgggtagttctaggttgatagcaataa

SEQ ID NO: 103443 - DNA, 601 bp, Human
ggcacatcatcaattcaattggcaacaagaatgggacatgggtcattgtgagagtcctcattgaatctcagggtgcctgatacataggaagtgggagagaggctgacccatccttgggtagttctaggttgatagcaataacactcttaatataagggagaagagaggtcattgctcagaatctcctggtagggttataatatcaaccactagatatgcacttcccatctcatggaaagtttgatttgattgttcagttcataatgactctaggtcattataactttgacaggttgatatktgcttaaatattcaactttcattttctgccctcattgtagtaagcacaaatgtagttcatccaaaaagagtaatcctaaatggattttctatgtgatgttgaaatgcattgtttaattgaagatttatcttttttagagctcttccttatgctaacagaaagaatatagctaatgatagaaggggagccccaggacagggcatattggatatgggacgggacagaggaggagtaataagatttaagtggagatgctacaagatgaggaatagtggtgatggtcatgataatacttcactt

SEQ ID NO: 103444 - DNA, 601 bp, Human
tgagagtcctcattgaatctcagggtgcctgatacataggaagtgggagagaggctgacccatccttgggtagttctaggttgatagcaataacactcttaatataagggagaagagaggtcattgctcagaatctcctggtagggttataatatcaaccactagatatgcacttcccatctcatggaaagtttgatttgattgttcagttcataatgactctaggtcattataactttgacaggttgatatttgcttaaatattcaactttcattttctgccctcattgtagtaagcacraatgtagttcatccaaaaagagtaatcctaaatggattttctatgtgatgttgaaatgcattgtttaattgaagatttatcttttttagagctcttccttatgctaacagaaagaatatagctaatgatagaaggggagccccaggacagggcatattggatatgggacgggacagaggaggagtaataagatttaagtggagatgctacaagatgaggaatagtggtgatggtcatgataatacttcactttagaagtagagcactttactgttttcaaaaaaattttttaatgtgtat

SEQ ID NO: 103445 - DNA, 601 bp, Human
cacttcccatctcatggaaagtttgatttgattgttcagttcataatgactctaggtcattataactttgacaggttgatatttgcttaaatattcaactttcattttctgccctcattgtagtaagcacaaatgtagttcatccaaaaagagtaatcctaaatggattttctatgtgatgttgaaatgcattgtttaattgaagatttatcttttttagagctcttccttatgctaacagaaagaatatagctaatgatagaaggggagccccaggacagggcatattggatatgggacrggacagaggaggagtaataagatttaagtggagatgctacaagatgaggaatagtggtgatggtcatgataatacttcactttagaagtagagcactttactgttttcaaaaaaattttttaatgtgtattagttcatttgatcctaacaacaacactgtaaggtagatatgttgaaagcattattataattatttccattttgcaaatgaagaaattggaagatttattggtcggtgctggggtctgatctggaactcaagtattttctgatttctagctgctgtgtctcctcctgatg

SEQ ID NO: 103446 - DNA, 379 bp, Human
tcctttggctcttctgccatgttttcttagcaattaggctggttctgcccttttcataggcttcccatagacttttaaagtaataataataatattgataaattttggctaccatttattgagcatagtatgagctaaagactttcattacatatatatattagggataaatattgacaccaccacaattcttggttacaaaatcatcagcctgtcttaattttctaaatcacaataaatctgactctatgtcctcaattcactggactgatgataatttccatctcactcattacctgakgctcttttcccccacccacagttgatcttacttagtctagacatttgggagctcccatggtcattattgctacgcctt

SEQ ID NO: 103447 - DNA, 601 bp, Human
atttgaaaactcctgattagataattgggtagcagccttccaactctgagcatccattgtttagtaacttgacttaggcctcagtttactgagttgggctttgaaatatttttccttttgtttccaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggttttgttttcctgcagctgwtgacttgttgccctgaagtacaataaaaaaaattcattttgctccagtaagtatggcctcatttattcagtccttgaccctgtgatatcaggttgttctgtccctgctatttgtgggatccagagctagggtgaaaacgaagttttgcatatcatgtttaaatattaaaaacagctaacatgctgttaaaatatgacttatgctccaacattaacacatacaactttgcaaccacctagaaggtcagaacctgaaaatttaaaattctcagactccttagaataccacaccagaattccc

SEQ ID NO: 103448 - DNA, 601 bp, Human
ctcaatactcagaacttaccatatttgttactttccttcccttagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccaggtaaaattctttctttgtatgtaatcgttctttcctcattgttccttttaaattccattccttttttagtactagagcccaaagcaatagaatatgcaaaaaaaaaaaaaaaattaaaagtagcttatcaaatctgtcatccctctgtgtctttgcttggagctaaataatttcaatgtaattataaataaactgtgcttgttcaaatgtacgtagaatgtgtttatgtgtcttgagtcataataacatacatactcagttcccagtcctctctgtgcctgtggatcaacaaaatcagatgctgccaatacctgacagagacaataaatgcccagtaccccaaagcaaaagagcccatgtggtgaacaaagcatctaagtgtttttgcattgatttcc

SEQ ID NO: 103449 - DNA, 601 bp, Human
ttgggtcaagttttctttttctttgttggatggatgactagatatgtggctagtggatttcataattaccgttctgtgaagtttcagaatagctaaattcattggtcttttacaactttgagcttcaaatatgaattagcagtcacattccaattctgaaatttaggtatctgtatttcagaaagtgccatgtggactgaaaaggcaaacataggttcaagtcaagccactgatttcttatgcctaagaaataaaaatgaagtgtgagtctgactatcttttgaaagaagccaggaaaccracacagaaaaagtatttcgttctccatgtatcttagattttaaattttgaggagcagaatcccatataattagcctaatttgatggggtgagaatatatttttagctgtaccataaatagatctgcccaaattcctacttccctataacattggctgtgcattttctcaagcaattatggcttttgccttaactaatttgatcattcacaacttaattcttgcacaaatgtttctccttttaaaaatattatcctgtcccttttccactctgcttttctcatctgaaattttccctctga

SEQ ID NO: 103450 - DNA, 601 bp, Human
agaatatatttttagctgtaccataaatagatctgcccaaattcctacttccctataacattggctgtgcattttctcaagcaattatggcttttgccttaactaatttgatcattcacaacttaattcttgcacaaatgtttctccttttaaaaatattatcctgtcccttttccactctgcttttctcatctgaaattttccctctgaaccacaaaacagagatgatttcagtcaccattttcttgattcttccaagaatagcacatagcaagtgagagaaattattgtattacatgargatgtcttgggacagtggttctcaaagtgtggttcccagatcagcagcttcagtgcttcctaaaaacttgttagaaatgcaaatttcctgcccccaatctaccgaattaacagtctggtggtgagggtgttcagcagtctgtaatctgtgtactaacaagcactttagatgactctaaaagcactctaaagctttgccttaggtcattagtacttgttcttaggaccacctgaatgatctgttaaaactctgattgctgggcccactcttaaagtttctgatccagttggcttggggtga

SEQ ID NO: 103451 - DNA, 601 bp, Human
tttgatgataatgataaaccaattgtgagatagagtactggaatattagaaaaatctgtggtagcaccaacccaactggtattagctcacaaattgtttcttcctctaggagtttacagttccacaggcattattaaaagaatatgccggctgggcgcggtggctcacacctgtaatcccagcactttgggaggccaaggcaggcagatcatgaggtcaggagttcgaggccagcctggccaacatagcgaaacctcatcgctactaaaaatacaaaaaaattagccaggcgtggtggcaygtgcctgtaatccgagctactcgggaggctgaggcatgagaatcgcttgaacctgggaggtagaggttgcagtgagctgagatcacaccattgcactccagcccgcacgatagtgtaagactccgtctcggaaaaaaaaaaaaaaaagtgcttatttaattgggagaatacctagccaataattgtgtctagtaaattgttgtacatatctcttgaatgtatgactgtttcaattcagaaaacctgaataattttttcagtggacttcattttgaatgttactattggtgacttctaacc

SEQ ID NO: 103452 - DNA, 601 bp, Human
taaaccaattgtgagatagagtactggaatattagaaaaatctgtggtagcaccaacccaactggtattagctcacaaattgtttcttcctctaggagtttacagttccacaggcattattaaaagaatatgccggctgggcgcggtggctcacacctgtaatcccagcactttgggaggccaaggcaggcagatcatgaggtcaggagttcgaggccagcctggccaacatagcgaaacctcatcgctactaaaaatacaaaaaaattagccaggcgtggtggcacgtgcctgtaatccsagctactcgggaggctgaggcatgagaatcgcttgaacctgggaggtagaggttgcagtgagctgagatcacaccattgcactccagcccgcacgatagtgtaagactccgtctcggaaaaaaaaaaaaaaaagtgcttatttaattgggagaatacctagccaataattgtgtctagtaaattgttgtacatatctcttgaatgtatgactgtttcaattcagaaaacctgaataattttttcagtggacttcattttgaatgttactattggtgacttctaaccatcatatgtggtcc

SEQ ID NO: 103453 - DNA, 601 bp, Human
attaaaagaatatgccggctgggcgcggtggctcacacctgtaatcccagcactttgggaggccaaggcaggcagatcatgaggtcaggagttcgaggccagcctggccaacatagcgaaacctcatcgctactaaaaatacaaaaaaattagccaggcgtggtggcacgtgcctgtaatccgagctactcgggaggctgaggcatgagaatcgcttgaacctgggaggtagaggttgcagtgagctgagatcacaccattgcactccagcccgcacgatagtgtaagactccgtctcggaaaaaaaaaaaaaaaagtgcttatttaattgggagaatacctagccaataattgtgtctagtaaattgttgtacatatctcttgaatgtatgactgtttcaattcagaaaacctgaataattttttcagtggacttcattttgaatgttactattggtgacttctaaccatcatatgtggtccttaattcatgtacaagggattccaaaattcctttgactggaaagaacccccccgcctcaattattattttacttgcgactatacattaatcttctttgataaccatctcttcaaagta

SEQ ID NO: 103454 - DNA, 601 bp, Human
ctaaccatcatatgtggtccttaattcatgtacaagggattccaaaattcctttgactggaaagaacccccccgcctcaattattattttacttgcgactatacattaatcttctttgataaccatctcttcaaagtaaaaggagtatcttcattttatatttaaaacgctgaatttcaaagcattgatttgaatgccagtggggcgcacagacagcaaaattacaggcttttcaaagttccagaagcacaagatagtgtctgaaattacagacattttattttattttgtgtgtgtgtgtttttttttactctcttgtaacttaaaacaattttgtaagatccacccccctccaggcagcattttatagccaatttataaacctctaaaaaccgaagtttatggtgggaatgctgacagtcagccccactactgcagagctagtgaatgccaacagagtaccttgcctgcgagggtaaggatcagagcgtaaatcatccagagtctggagggccatgactgtgtgttcatgttatccatttcccatttccagaaacatgagactgattgtccagcaaaaatcacattgagagggtgttat

SEQ ID NO: 103455 - DNA, 601 bp, Human
ttactctcttgtaacttaaaacaattttgtaagatccacccccctccaggcagcattttatagccaatttataaacctctaaaaaccgaagtttatggtgggaatgctgacagtcagccccactactgcagagctagtgaatgccaacagagtaccttgcctgcgagggtaaggatcagagcgtaaatcatccagagtctggagggccatgactgtgtgttcatgttatccatttcccatttccagaaacatgagactgattgtccagcaaaaatcacattgagagggtgttatgagaggycagtaaagaatgacccaaagtggggaagtgatgggtgggggacagggggagcagggggagcattcacaattaatccagcttcaacatctgggaacatagaacctctttaagcaatgcatttactatcccctggtgagctaaagagcgtgagagaccactgaacagagagacctttgtgttttgtagtattttttgcccttcctcaatactcttaatctgattctcatggagctttgtttgaatgacttctaacatatgggcagccctgtgttctacctctccctactgaatgtgcaagtt

SEQ ID NO: 103456 - DNA, 601 bp, Human
tttcccatttccagaaacatgagactgattgtccagcaaaaatcacattgagagggtgttatgagaggccagtaaagaatgacccaaagtggggaagtgatgggtgggggacagggggagcagggggagcattcacaattaatccagcttcaacatctgggaacatagaacctctttaagcaatgcatttactatcccctggtgagctaaagagcgtgagagaccactgaacagagagacctttgtgttttgtagtattttttgcccttcctcaatactcttaatctgattctcatggagstttgtttgaatgacttctaacatatgggcagccctgtgttctacctctccctactgaatgtgcaagttttctaaataaataatttaagtttttctttcttttcattaagtaaaaaaaaaaagatgggtataggcatacaaatactagcctgcttactaaatatcaatcagtataaatagcaggtcttttttgtgttttctactaataactttgaatattattaaaatgttatttatttaccttctactgcctgatacttcttgttctcttcttccatctgctgaaatataatgagaccac

SEQ ID NO: 103457 - DNA, 601 bp, Human
cagggggagcagggggagcattcacaattaatccagcttcaacatctgggaacatagaacctctttaagcaatgcatttactatcccctggtgagctaaagagcgtgagagaccactgaacagagagacctttgtgttttgtagtattttttgcccttcctcaatactcttaatctgattctcatggagctttgtttgaatgacttctaacatatgggcagccctgtgttctacctctccctactgaatgtgcaagttttctaaataaataatttaagtttttctttcttttcattaagtaaaaaaaaaaagatgggtataggcatacaaatactagcctgcttactaaatatcaatcagtataaatagcaggtcttttttgtgttttctactaataactttgaatattattaaaatgttatttatttaccttctactgcctgatacttcttgttctcttcttccatctgctgaaatataatgagaccacagaaacagaataatcatatgaaaatacaggaattttaaaaaatatgttaaataacaatactttatttgaaggcaaatatatgactctttaaaatgcccatcaagtctatca

SEQ ID NO: 103458 - DNA, 601 bp, Human
caacattctactggattggggatgatgcaggatttttgctccttagttcaactaaatctgggttcttttctcatgaccaggaaaaattaggcatgtggatacactgaagtgtgaaaagggcagaatttattaagtgaaaggaaaactctcagcaaagaaaggggtagtatagccctaggtagtattggaaaaggcaacattcgtttggttaaaaggcattattcagaaagaatcaatcaggaaagagcgggcaaacaggggcagaagttgtccctctgggtcacaggtttcagttggaacmagcagtcatgtctttcagccttcaggctgttttaggcttgaaggtgatgtttcaccagggacccttccctatctgcctaggtaatttgtctgcctgctgcctctatcagggagatgacaataagtatgtaataaacaaataatcaaacatcagataatgaaaatattacaaaaacaccccaaacataggggtgtaatagagagtatggggcaataggaagcaagaggtaagagaatgatgttctgtcttcagagggaacattgaaactaaaatacaaatcagaaagaaccagccaagaaa

SEQ ID NO: 103459 - DNA, 601 bp, Human
tgtcagccttaaataatgagattcagaaaatatgattaagtacagagtttatttgagctcagagcttgaagatggccactcaggagtgtagattcaagttgccctggatatacagtccaattagcagtagttacaagtgggtcttgaaaggaaaaaagaagcagtttttaagtttttgctaagaatatacattaaagtaatgtattgattggctattcatggttctttgtatcacagattccaagaacatgaagataatggtagaggcagctaattaggaacaaaaatgcctttaaaaaaytaccctgggcatggatgctgtgaggaggggcatgatcaaaagtctccaactcatggctctctgggttggataaattttgcatacctcacatagctcagcctgatctgagttttctcatttccctccatttcatcaagatgttttgaagaaagcatagtagatgaactaaaagcattttgactccttagtcctatatcataaggaaggttcattcccaaatggttctgtcccacccaggtgggcgtgtggggaaggggcaggggagagaatacatctcagtaagaaattttaagtgtgcct

SEQ ID NO: 103460 - DNA, 601 bp, Human
aaaagaagcagtttttaagtttttgctaagaatatacattaaagtaatgtattgattggctattcatggttctttgtatcacagattccaagaacatgaagataatggtagaggcagctaattaggaacaaaaatgcctttaaaaaactaccctgggcatggatgctgtgaggaggggcatgatcaaaagtctccaactcatggctctctgggttggataaattttgcatacctcacatagctcagcctgatctgagttttctcatttccctccatttcatcaagatgttttgaagaaagyatagtagatgaactaaaagcattttgactccttagtcctatatcataaggaaggttcattcccaaatggttctgtcccacccaggtgggcgtgtggggaaggggcaggggagagaatacatctcagtaagaaattttaagtgtgcctaaagctgaattggaatggtatcacagggtggcaaaaatgagacttcagccaaatctcagtcaacttatttatatagttgctgtcacttattgaatcatcctggtctttagaatattatgactttaattttctcagaagcagtaaaacagtgag

SEQ ID NO: 103461 - DNA, 601 bp, Human
agaacatgaagataatggtagaggcagctaattaggaacaaaaatgcctttaaaaaactaccctgggcatggatgctgtgaggaggggcatgatcaaaagtctccaactcatggctctctgggttggataaattttgcatacctcacatagctcagcctgatctgagttttctcatttccctccatttcatcaagatgttttgaagaaagcatagtagatgaactaaaagcattttgactccttagtcctatatcataaggaaggttcattcccaaatggttctgtcccacccaggtgggmgtgtggggaaggggcaggggagagaatacatctcagtaagaaattttaagtgtgcctaaagctgaattggaatggtatcacagggtggcaaaaatgagacttcagccaaatctcagtcaacttatttatatagttgctgtcacttattgaatcatcctggtctttagaatattatgactttaattttctcagaagcagtaaaacagtgagagatacatattgcaagtaaggattaccattacaaaaagagaacatgtattccaaaatgaaaaaggaaacctgttccactggtgagtacac

SEQ ID NO: 103462 - DNA, 601 bp, Human
taatggtagaggcagctaattaggaacaaaaatgcctttaaaaaactaccctgggcatggatgctgtgaggaggggcatgatcaaaagtctccaactcatggctctctgggttggataaattttgcatacctcacatagctcagcctgatctgagttttctcatttccctccatttcatcaagatgttttgaagaaagcatagtagatgaactaaaagcattttgactccttagtcctatatcataaggaaggttcattcccaaatggttctgtcccacccaggtgggcgtgtggggaagsggcaggggagagaatacatctcagtaagaaattttaagtgtgcctaaagctgaattggaatggtatcacagggtggcaaaaatgagacttcagccaaatctcagtcaacttatttatatagttgctgtcacttattgaatcatcctggtctttagaatattatgactttaattttctcagaagcagtaaaacagtgagagatacatattgcaagtaaggattaccattacaaaaagagaacatgtattccaaaatgaaaaaggaaacctgttccactggtgagtacactgaaaacatcct

SEQ ID NO: 103463 - DNA, 601 bp, Human
aatggtagaggcagctaattaggaacaaaaatgcctttaaaaaactaccctgggcatggatgctgtgaggaggggcatgatcaaaagtctccaactcatggctctctgggttggataaattttgcatacctcacatagctcagcctgatctgagttttctcatttccctccatttcatcaagatgttttgaagaaagcatagtagatgaactaaaagcattttgactccttagtcctatatcataaggaaggttcattcccaaatggttctgtcccacccaggtgggcgtgtggggaaggrgcaggggagagaatacatctcagtaagaaattttaagtgtgcctaaagctgaattggaatggtatcacagggtggcaaaaatgagacttcagccaaatctcagtcaacttatttatatagttgctgtcacttattgaatcatcctggtctttagaatattatgactttaattttctcagaagcagtaaaacagtgagagatacatattgcaagtaaggattaccattacaaaaagagaacatgtattccaaaatgaaaaaggaaacctgttccactggtgagtacactgaaaacatcctg

SEQ ID NO: 103464 - DNA, 601 bp, Human
atggtagaggcagctaattaggaacaaaaatgcctttaaaaaactaccctgggcatggatgctgtgaggaggggcatgatcaaaagtctccaactcatggctctctgggttggataaattttgcatacctcacatagctcagcctgatctgagttttctcatttccctccatttcatcaagatgttttgaagaaagcatagtagatgaactaaaagcattttgactccttagtcctatatcataaggaaggttcattcccaaatggttctgtcccacccaggtgggcgtgtggggaagggscaggggagagaatacatctcagtaagaaattttaagtgtgcctaaagctgaattggaatggtatcacagggtggcaaaaatgagacttcagccaaatctcagtcaacttatttatatagttgctgtcacttattgaatcatcctggtctttagaatattatgactttaattttctcagaagcagtaaaacagtgagagatacatattgcaagtaaggattaccattacaaaaagagaacatgtattccaaaatgaaaaaggaaacctgttccactggtgagtacactgaaaacatcctga

SEQ ID NO: 103465 - DNA, 601 bp, Human
aaagcatagtagatgaactaaaagcattttgactccttagtcctatatcataaggaaggttcattcccaaatggttctgtcccacccaggtgggcgtgtggggaaggggcaggggagagaatacatctcagtaagaaattttaagtgtgcctaaagctgaattggaatggtatcacagggtggcaaaaatgagacttcagccaaatctcagtcaacttatttatatagttgctgtcacttattgaatcatcctggtctttagaatattatgactttaattttctcagaagcagtaaaacartgagagatacatattgcaagtaaggattaccattacaaaaagagaacatgtattccaaaatgaaaaaggaaacctgttccactggtgagtacactgaaaacatcctgaagaaaattaaacccttgtcctttagagactcatagataggaaataattctggatttagtctaaaatataggaaaatcataaaaactcaaaaacagtagtcagtgctggaatctaatagcaggtgtgctatagttttcttctgaaacattatttttctctctccagttccccatgtaaaccaaggataattct

SEQ ID NO: 103466 - DNA, 601 bp, Human
gggcgtgtggggaaggggcaggggagagaatacatctcagtaagaaattttaagtgtgcctaaagctgaattggaatggtatcacagggtggcaaaaatgagacttcagccaaatctcagtcaacttatttatatagttgctgtcacttattgaatcatcctggtctttagaatattatgactttaattttctcagaagcagtaaaacagtgagagatacatattgcaagtaaggattaccattacaaaaagagaacatgtattccaaaatgaaaaaggaaacctgttccactggtgagtmcactgaaaacatcctgaagaaaattaaacccttgtcctttagagactcatagataggaaataattctggatttagtctaaaatataggaaaatcataaaaactcaaaaacagtagtcagtgctggaatctaatagcaggtgtgctatagttttcttctgaaacattatttttctctctccagttccccatgtaaaccaaggataattcttagtctgatcaatttatttgcaaaataagttttagtagtgctcttggcctgattatttgtataaagtgtaacaagaataatgaatggccat

SEQ ID NO: 103467 - DNA, 601 bp, Human
aatctcagtcaacttatttatatagttgctgtcacttattgaatcatcctggtctttagaatattatgactttaattttctcagaagcagtaaaacagtgagagatacatattgcaagtaaggattaccattacaaaaagagaacatgtattccaaaatgaaaaaggaaacctgttccactggtgagtacactgaaaacatcctgaagaaaattaaacccttgtcctttagagactcatagataggaaataattctggatttagtctaaaatataggaaaatcataaaaactcaaaaacartagtcagtgctggaatctaatagcaggtgtgctatagttttcttctgaaacattatttttctctctccagttccccatgtaaaccaaggataattcttagtctgatcaatttatttgcaaaataagttttagtagtgctcttggcctgattatttgtataaagtgtaacaagaataatgaatggccatataggctcctttaagttggctttgctagaactttttcataaggaatctcaaattagatttttaaaagcctcttgaggctaggaaaacaagccaaggatttgctgtcaggttg

SEQ ID NO: 103468 - DNA, 601 bp, Human
tgtgcctgtaatacctatatgaattgggtaaagtcctctcttcttgaggtcccaaaatatcttgaggttcctggacctgtcagaaagtgatattctttacttatcataaggtcaggaaccttgtaagagaaccatgtaaaaatgtatcatgccagtcttttccagaggccttttattgggtttctaaagtcaacttcaattcctcaaagcaatctggtcatatctaaaaatatgccattccaataaaagctttggaaaaattaccagtgttcaatgtgtcctgataccaaaaaacaaacayattcttattgaacttatgcaaataactatattgccataaaacaagaatactcattattagtttccatattttgaagaaatcagctaaagagaaaagtgaacatttcaattttgcttgcaaatgtatactttaccccgttgctataagctatgaatagctgaaaagaaaataagacaaaatataaaagagtcagtaatgttgcaaacaaaaaagtcataaaaatcatttcagtcctctatcagttcagtaaattgaaataacttttgattgacgttgacttagcaatcttcattaatgtat

SEQ ID NO: 103469 - DNA, 601 bp, Human
gtcaacttcaattcctcaaagcaatctggtcatatctaaaaatatgccattccaataaaagctttggaaaaattaccagtgttcaatgtgtcctgataccaaaaaacaaacacattcttattgaacttatgcaaataactatattgccataaaacaagaatactcattattagtttccatattttgaagaaatcagctaaagagaaaagtgaacatttcaattttgcttgcaaatgtatactttaccccgttgctataagctatgaatagctgaaaagaaaataagacaaaatataaaagrgtcagtaatgttgcaaacaaaaaagtcataaaaatcatttcagtcctctatcagttcagtaaattgaaataacttttgattgacgttgacttagcaatcttcattaatgtatcagctttttaattagagttctggcagattttacttcgtccaaaagtaagatctctaaatttatcagaaatctttattcaagaattcttgttgggattcttttccacgaattttttgaagaatggactatagctgattataaataacgttttgagaagacttaaagtaaaacgataattgtctgtggat

SEQ ID NO: 103470 - DNA, 601 bp, Human
tcctgataccaaaaaacaaacacattcttattgaacttatgcaaataactatattgccataaaacaagaatactcattattagtttccatattttgaagaaatcagctaaagagaaaagtgaacatttcaattttgcttgcaaatgtatactttaccccgttgctataagctatgaatagctgaaaagaaaataagacaaaatataaaagagtcagtaatgttgcaaacaaaaaagtcataaaaatcatttcagtcctctatcagttcagtaaattgaaataacttttgattgacgttgasttagcaatcttcattaatgtatcagctttttaattagagttctggcagattttacttcgtccaaaagtaagatctctaaatttatcagaaatctttattcaagaattcttgttgggattcttttccacgaattttttgaagaatggactatagctgattataaataacgttttgagaagacttaaagtaaaacgataattgtctgtggatgacaaaaagagtagccatggtcaaagatacaattgacaagaaatttaattatttttatggcataaaacaatgtaatataataatcataat

SEQ ID NO: 103471 - DNA, 601 bp, Human
tgattgacgttgacttagcaatcttcattaatgtatcagctttttaattagagttctggcagattttacttcgtccaaaagtaagatctctaaatttatcagaaatctttattcaagaattcttgttgggattcttttccacgaattttttgaagaatggactatagctgattataaataacgttttgagaagacttaaagtaaaacgataattgtctgtggatgacaaaaagagtagccatggtcaaagatacaattgacaagaaatttaattatttttatggcataaaacaatgtaatrtaataatcataattatgtctgatagcatatatcaagacatatctgaatttaagaatctcatataattttggaatacatgttaatacatgtatactaatataactcaaacctatttttctaacttttattttaaattcaggggcacatgtgcaggttcgttatataggtaaacttgtgtcatgggggtttgttgtacagattacttcatcacccatatattaagcctagtacccattagttatttttctgatcctctccttcctcccaccttccaccttctgaagggccccagtgtgtgtt

SEQ ID NO: 103472 - DNA, 601 bp, Human
acatataaataatttctaattttagacaacttgaacacacacaaaatttctttcccaagattaatcttccacaaaccctctacaacttgcttaaaatgttttgccactacctaagcaaaaattctatggataaatacataggtattttcctgatcagaagacagctattttcactaaaccaacaatattaaactagtcttaaagatttactcaaatcatgtgaactaaaaggcacttgagctggttttgagacaggatagttcccttggtacctttgtgggactcacaaaggggcggctcrgttaggcagcccgcagcactcaaaccccttgtgggagggttagcacgcaggtgagctggtgcaggagccggggcaagtgcctttgggtgcctgcaggaacaaacactgtacaggcccatggcagcgcctaggggttgcctacgacccctggagccccagaggatgtgtgttatggtgtggtcctttagctttgtcatccatggatggcttaagtgtttaacagctcaatggggagttagtgtgacagcctcttccccctcacctcagttcttgtctggcatccaggaggagtgaggtcac

SEQ ID NO: 103473 - DNA, 601 bp, Human
tatggtgtggtcctttagctttgtcatccatggatggcttaagtgtttaacagctcaatggggagttagtgtgacagcctcttccccctcacctcagttcttgtctggcatccaggaggagtgaggtcacacgaacaatttggagggtggtgaatgcagaggattttatcgtgtggtggaagtagttctcagcaggaaggggagctggaagggcaatatagtgggaagataatcttcccctggagttgggccatctgtggcagaactcttctatgaaattctgctgtcaagccatccctckgaagtcaagctgcttctttctaatatccagctggttcctcttttctccttccctgccagtggagcttggagtttttatgggtacagggtggagggtggggccggccagggtagttttggaaaaggcaacatttgggtgggaaaacagggatgtgaagttttcatttagggcattggttttgggcttgagggtggagccctcgccggggaaccaccatcttctacccagtatttccctgcctcctgtctgtatgtagtttctatttttctgataaaatatttgatttaaccacttacattt

SEQ ID NO: 103474 - DNA, 601 bp, Human
gtcatccatggatggcttaagtgtttaacagctcaatggggagttagtgtgacagcctcttccccctcacctcagttcttgtctggcatccaggaggagtgaggtcacacgaacaatttggagggtggtgaatgcagaggattttatcgtgtggtggaagtagttctcagcaggaaggggagctggaagggcaatatagtgggaagataatcttcccctggagttgggccatctgtggcagaactcttctatgaaattctgctgtcaagccatccctctgaagtcaagctgcttctttctratatccagctggttcctcttttctccttccctgccagtggagcttggagtttttatgggtacagggtggagggtggggccggccagggtagttttggaaaaggcaacatttgggtgggaaaacagggatgtgaagttttcatttagggcattggttttgggcttgagggtggagccctcgccggggaaccaccatcttctacccagtatttccctgcctcctgtctgtatgtagtttctatttttctgataaaatatttgatttaaccacttacattttctttaagacaattaattggag

SEQ ID NO: 103475 - DNA, 601 bp, Human
ttgaatcccgggtcccccagaaaagagaaatgccacaagaccggggtatgcaatgtttccacaatgcacctcactgcatacattccctcaagactggtaggtgagcaatgcccatcagcccactctgtgatcagaccaccctcccacaggaggagttttatgccttgaggggaagtgtttcctccaccttcaagtgttcaaacctgtctttctatctaaacaccggaaaaaatgagtagccccgtacatttataatcattcactgtaactgatttcagctgcttcagaaaccacagttttygccagtgacttgtcagccattgcacacacaaaattcaagttgtatctcatagtacagagtaatccctggtaccctaaaagctaaagaggtcagttactacttctaacagctcttgcaaatctttattattagactcagttatggaagtacgattgcccataatcatatttcctttttgaatgataaaaaagacccagtgagaggaattttggtcacccaagaagaatgtttagatttgtcaattgaactgagctgtgaaatctgaccaattttaaagattacaaatttttcacttaagct

SEQ ID NO: 103476 - DNA, 601 bp, Human
gcaagggagatcactgaaagtctgtttcaggtcccacctgagtcaccaaaatgtcaaccttaaataacataagtacagagattatatgagctcaaagcttgaagatggccacccaggagcctagattcatgttgccctgaatatacagtccaattagcaatagttacaagtgggtctttaaaggaaaaaagaagagaagttgtttatcaagacttttcgttaagataacataagctattaattggttattcattgctctttgtgtcacaaatgctaggaatatgaagataatgagtgagaragctggtcaggaacaaaaatgccttaaacaattgcccccagtcatggctactcaggggagagacagccatgactgaagccctgtacttatgtctctctgggcctgataaatgttgcatatctcacatagttgacctgctctgagctatttttcttttctcaataatatctaggaatgaaatatggctgtagctaggagattgattaaaagtggtaatgtattccagagtcattaatggtatgacttttctacacctatgcttaattttcactttatctcagattatttatttaagtttaa

SEQ ID NO: 103477 - DNA, 601 bp, Human
tttctagatggagtataaggcaaactttatctcttacatgcttcttgaaacacacagtctttgggataatttttttactcctctgctgttgatagctttatggtgtaggcatcaagatgctggctggaagcagagtttcactccagatgattctactgaagaaaattaaggagtatttaccaaatatttacagaagcagtgttaagggaactgaggtaaaggcaaagagatgttgatgttcccagagaggagcaacagagggaaacgtttaccaccctgagagctcaaggagcaaccacargggtgtttccagagttcattgagagccagagcctcagaggagggcctgcttggaaggactgtagacagggagagatgcaacccctgctagacagaagtgccaaagcaaggagacaaagagggaaaaccactcagatttctctctactcttgccttttgaagttctttctttcaagcttccataggcagaacccaatggaaaaccagtaaacaaaagaactaagattacacagtcgatagaagggtcacttccttggggcatagagcaggacagagaggacatttaggaaaggatgagcag

SEQ ID NO: 103478 - DNA, 601 bp, Human
tctttgggataatttttttactcctctgctgttgatagctttatggtgtaggcatcaagatgctggctggaagcagagtttcactccagatgattctactgaagaaaattaaggagtatttaccaaatatttacagaagcagtgttaagggaactgaggtaaaggcaaagagatgttgatgttcccagagaggagcaacagagggaaacgtttaccaccctgagagctcaaggagcaaccacaggggtgtttccagagttcattgagagccagagcctcagaggagggcctgcttggaagkactgtagacagggagagatgcaacccctgctagacagaagtgccaaagcaaggagacaaagagggaaaaccactcagatttctctctactcttgccttttgaagttctttctttcaagcttccataggcagaacccaatggaaaaccagtaaacaaaagaactaagattacacagtcgatagaagggtcacttccttggggcatagagcaggacagagaggacatttaggaaaggatgagcagaaatacaccactctccctgtataaattaagttaaataatttttcttttctcctaact

SEQ ID NO: 103479 - DNA, 601 bp, Human
gcatcaagatgctggctggaagcagagtttcactccagatgattctactgaagaaaattaaggagtatttaccaaatatttacagaagcagtgttaagggaactgaggtaaaggcaaagagatgttgatgttcccagagaggagcaacagagggaaacgtttaccaccctgagagctcaaggagcaaccacaggggtgtttccagagttcattgagagccagagcctcagaggagggcctgcttggaaggactgtagacagggagagatgcaacccctgctagacagaagtgccaaagcarggagacaaagagggaaaaccactcagatttctctctactcttgccttttgaagttctttctttcaagcttccataggcagaacccaatggaaaaccagtaaacaaaagaactaagattacacagtcgatagaagggtcacttccttggggcatagagcaggacagagaggacatttaggaaaggatgagcagaaatacaccactctccctgtataaattaagttaaataatttttcttttctcctaactattaaaaataaagaatgcaagttcagtgataaacagcacctactattttgc

SEQ ID NO: 103480 - DNA, 601 bp, Human
tgtttagctgtcctgtctcatcagcctgctctgatctgcgataatttcttagactttgtttgttggagtagtactggccaggtattctgaatgtctctagatctgagtttgtcagctgtttttctcatgataagacccctagttttcatgggttttgggagagaataccacagaggtgaaacacccttgacatctcatatcaggttatattccatttttgaaaacaacttcttgaagtaatagtggctgggtagagtggagctagcaggacccatcctactcttgaacagattgaagtacrtcagtcagtagagaaaatcaggagggatgacatgaggccagcaatggagctgcatctcttgcaaataaatagtctcaattcaaagtcatgagacaacagttctattccaggctcatccactaactagtttttagggaagccaatcacagtcttctagtgttactttcttcatctgtacaatatagaagttgatatctgagtcttgaaattatgtgactctcaaactctggaatgtgttttcattagtcaaatattgtcatccacagtttcatttcctaagaggaatgtgttgtaatgctg

SEQ ID NO: 103481 - DNA, 601 bp, Human
tcatccacagtttcatttcctaagaggaatgtgttgtaatgctgagcaagataccctcaaaatttctggtttctacaaaagggcatgtaagggaggcctctctgcttcactgtttggtacttaagacacttgtatcctaagaatgtcaggtgcctggcaggaagaaaacaaattgcaaaaactgagaagaaaattcatcgcattcattcatctttgtttctggaactcactattttattccttccgttacaatggattaagaaggaaatgacataatttgtttttgaaatgtcagaagcartgcagagtttagtactttaaaaaatagtttaatgttgaccctgtgcatacgtaaatcttaccagaaatgaggatgactggcttacaacgttagatactctaagttgccaataatttgtacagagcctgtgattgcaaaaccacaaacatttcacaatactggaaacctctaattaaccataataaatgacaggatgggtttgttttaaatacatggttaataatgcttactgctttaagaccataaactgtgtgattctctatggaggtgacagaggtaggctgcaaatggttttgcaaa

SEQ ID NO: 103482 - DNA, 601 bp, Human
ctactaatattggatcagcctctcatctgacgtaatttgcctgtgggaattgtatcggctgttaaactagctcctcttagtagctgtttgaaaaaaaaaaggaagaagaagcacaattctgtggtgtgtttcaaataactgaagccagtgtcctaggtactgagacaagaaagaatgtcaaacaggacctttaatgtgtatttatatttaaacatcagacctaacagaaaaccctgaagctttatacaatgattagagccttgtaagatcctaattaatgtattgtcaggtgaatggttgkcctggcactcaagctgttctgagggacgcaaggggtttcaggtaccgcctaggaagaatagatgcagttgtagtgattcagtggcccatctgaaagggacatataaaggcagctgtgtctggtgtgctgtcttttcagactcacttgataatgctagtgtcagtttcaactgaagcgtgtgccagattccagacagcttgagctggcatttcagagaggttaattgtgaaacttgagaagaaaatgggcacattcttcctaagatggctattcaaatatagtctctttcctcccccccca

SEQ ID NO: 103483 - DNA, 601 bp, Human
aatggttggcctggcactcaagctgttctgagggacgcaaggggtttcaggtaccgcctaggaagaatagatgcagttgtagtgattcagtggcccatctgaaagggacatataaaggcagctgtgtctggtgtgctgtcttttcagactcacttgataatgctagtgtcagtttcaactgaagcgtgtgccagattccagacagcttgagctggcatttcagagaggttaattgtgaaacttgagaagaaaatgggcacattcttcctaagatggctattcaaatatagtctctttcctccccccccagagctttctgggtctcagtctcacttttgttctgcttccacgtaaaatgcatgaggaacactgagccttttccccttggcagctcctatattgccatctttgctgggactgctttgccttgttaaaatgtgccccgtgtattaaaatggaattgtcactgctgggtggtgcagcgtaacatggtttgacactaagcgccggcagctacagaaaacagacttttattgcatttattctttcagagacgggagtctctaaaggctcacagcagacattcacttagttaaatctg

SEQ ID NO: 103484 - DNA, 601 bp, Human
ggagtctctaaaggctcacagcagacattcacttagttaaatctgaatgaacccaaagtgaacaatctactctgctgtctttgtgttcatagaaacagcccccatccagcttgatatggctgtaaaacagtgttaagaaaagatgatcacacttagaatgcagaagggaggacttgaggctttcaaacagaacaaaaatattttaagtgggtggagtgggttagccacttgattttcttttttagcttcctctctattccctaaaatgtattatgtagaataaacacacacacacacacayacacacacacacccctacacacacacacacacccctagtattagtcttcatttataattccatgccattttaagacaaaggatttgatttgtaggactcttgcaagcaagctttagattcttaactgccttttatccagatgagtacccagagagagattgaacagggagggggctctgaggcataaactttgcattttgtagctctcctggaataaaaattccataaagtaacatctgtagtaattaagggcttacatttcctctcccattcatgtctctgctaggagagaaggttatt

SEQ ID NO: 103485 - DNA, 601 bp, Human
tgtaggactcttgcaagcaagctttagattcttaactgccttttatccagatgagtacccagagagagattgaacagggagggggctctgaggcataaactttgcattttgtagctctcctggaataaaaattccataaagtaacatctgtagtaattaagggcttacatttcctctcccattcatgtctctgctaggagagaaggttattttcccaaagagacaatagtggatcctgtgggaagagagaaagaacagagttagaattcttttcttcctggaaatggaaattttctacttaaaaaaaaaaaaagataaaaaaattgaaagacttacagtaaaaggttccactggaaaggaaacttgaaagagttaggaaaattgtacttagctgttcctaaatatttagaatgaggaaagattccgcttgcctttcttatccaaacatcttctgatataggggaacttgtgagtgagtagtaaacaaaatgctgtttttgtttttatttttatctattaaaattgcataaagagttttctttttatttggacatcaaattgattcattctgaagactttttttttcaaaataatacttatg

SEQ ID NO: 103486 - DNA, 601 bp, Human
aaaattccataaagtaacatctgtagtaattaagggcttacatttcctctcccattcatgtctctgctaggagagaaggttattttcccaaagagacaatagtggatcctgtgggaagagagaaagaacagagttagaattcttttcttcctggaaatggaaattttctacttaaaaaaaaaaaaagataaaaaaattgaaagacttacagtaaaaggttccactggaaaggaaacttgaaagagttaggaaaattgtacttagctgttcctaaatatttagaatgaggaaagattccgcytgcctttcttatccaaacatcttctgatataggggaacttgtgagtgagtagtaaacaaaatgctgtttttgtttttatttttatctattaaaattgcataaagagttttctttttatttggacatcaaattgattcattctgaagactttttttttcaaaataatacttatgtggatccattgggtcacctgatgatatacatactgagcgttaatgttaagttagtttcctacactctcttgtcatagcaggatcagctacttaaattagggtgaaatatgacaatgtagatcccttt

SEQ ID NO: 103487 - DNA, 601 bp, Human
tcctggaaatggaaattttctacttaaaaaaaaaaaaagataaaaaaattgaaagacttacagtaaaaggttccactggaaaggaaacttgaaagagttaggaaaattgtacttagctgttcctaaatatttagaatgaggaaagattccgcttgcctttcttatccaaacatcttctgatataggggaacttgtgagtgagtagtaaacaaaatgctgtttttgtttttatttttatctattaaaattgcataaagagttttctttttatttggacatcaaattgattcattctgaagaytttttttttcaaaataatacttatgtggatccattgggtcacctgatgatatacatactgagcgttaatgttaagttagtttcctacactctcttgtcatagcaggatcagctacttaaattagggtgaaatatgacaatgtagatccctttgttaaaacactgttaagaagttcaaggtggcaacagcagaactttaaaccaagtgcagggttgttctaagtgtggggctgtgtgtgaagacataggcctcattcctgtaaatttagccctgcttggcggtagagatttgtcatatcca

SEQ ID NO: 103488 - DNA, 601 bp, Human
ggaaatggaaattttctacttaaaaaaaaaaaaagataaaaaaattgaaagacttacagtaaaaggttccactggaaaggaaacttgaaagagttaggaaaattgtacttagctgttcctaaatatttagaatgaggaaagattccgcttgcctttcttatccaaacatcttctgatataggggaacttgtgagtgagtagtaaacaaaatgctgtttttgtttttatttttatctattaaaattgcataaagagttttctttttatttggacatcaaattgattcattctgaagactttktttttcaaaataatacttatgtggatccattgggtcacctgatgatatacatactgagcgttaatgttaagttagtttcctacactctcttgtcatagcaggatcagctacttaaattagggtgaaatatgacaatgtagatccctttgttaaaacactgttaagaagttcaaggtggcaacagcagaactttaaaccaagtgcagggttgttctaagtgtggggctgtgtgtgaagacataggcctcattcctgtaaatttagccctgcttggcggtagagatttgtcatatccatcga

SEQ ID NO: 103489 - DNA, 601 bp, Human
tttttttcaaaataatacttatgtggatccattgggtcacctgatgatatacatactgagcgttaatgttaagttagtttcctacactctcttgtcatagcaggatcagctacttaaattagggtgaaatatgacaatgtagatccctttgttaaaacactgttaagaagttcaaggtggcaacagcagaactttaaaccaagtgcagggttgttctaagtgtggggctgtgtgtgaagacataggcctcattcctgtaaatttagccctgcttggcggtagagatttgtcatatccatcratacagaaagatgcactctcatcacatgcttcataagaatgtacatctgaaaacaaaactttgtcagagaataattatagctcaaaactggaactcgttcctgatattatcttcaaacttgttaaacaagtgatacagatgccctgacttcctctctcagttaatttttaagaatttcccgggcaaaccttccactgagccacatgcttgctctctctaccacattgtaataaggacgcacgccctccaagctgcccagctcagccccctgccctaattacttcgccaaaagcctctcct

SEQ ID NO: 103490 - DNA, 601 bp, Human
tcacctgatgatatacatactgagcgttaatgttaagttagtttcctacactctcttgtcatagcaggatcagctacttaaattagggtgaaatatgacaatgtagatccctttgttaaaacactgttaagaagttcaaggtggcaacagcagaactttaaaccaagtgcagggttgttctaagtgtggggctgtgtgtgaagacataggcctcattcctgtaaatttagccctgcttggcggtagagatttgtcatatccatcgatacagaaagatgcactctcatcacatgcttcatargaatgtacatctgaaaacaaaactttgtcagagaataattatagctcaaaactggaactcgttcctgatattatcttcaaacttgttaaacaagtgatacagatgccctgacttcctctctcagttaatttttaagaatttcccgggcaaaccttccactgagccacatgcttgctctctctaccacattgtaataaggacgcacgccctccaagctgcccagctcagccccctgccctaattacttcgccaaaagcctctcctagattccgtgcctcttctcagcatttctctcacttc

SEQ ID NO: 103491 - DNA, 601 bp, Human
ctgatgatatacatactgagcgttaatgttaagttagtttcctacactctcttgtcatagcaggatcagctacttaaattagggtgaaatatgacaatgtagatccctttgttaaaacactgttaagaagttcaaggtggcaacagcagaactttaaaccaagtgcagggttgttctaagtgtggggctgtgtgtgaagacataggcctcattcctgtaaatttagccctgcttggcggtagagatttgtcatatccatcgatacagaaagatgcactctcatcacatgcttcataagaaygtacatctgaaaacaaaactttgtcagagaataattatagctcaaaactggaactcgttcctgatattatcttcaaacttgttaaacaagtgatacagatgccctgacttcctctctcagttaatttttaagaatttcccgggcaaaccttccactgagccacatgcttgctctctctaccacattgtaataaggacgcacgccctccaagctgcccagctcagccccctgccctaattacttcgccaaaagcctctcctagattccgtgcctcttctcagcatttctctcacttctggg

SEQ ID NO: 103492 - DNA, 601 bp, Human
ctcttgtcatagcaggatcagctacttaaattagggtgaaatatgacaatgtagatccctttgttaaaacactgttaagaagttcaaggtggcaacagcagaactttaaaccaagtgcagggttgttctaagtgtggggctgtgtgtgaagacataggcctcattcctgtaaatttagccctgcttggcggtagagatttgtcatatccatcgatacagaaagatgcactctcatcacatgcttcataagaatgtacatctgaaaacaaaactttgtcagagaataattatagctcaaaamtggaactcgttcctgatattatcttcaaacttgttaaacaagtgatacagatgccctgacttcctctctcagttaatttttaagaatttcccgggcaaaccttccactgagccacatgcttgctctctctaccacattgtaataaggacgcacgccctccaagctgcccagctcagccccctgccctaattacttcgccaaaagcctctcctagattccgtgcctcttctcagcatttctctcacttctgggattcctctcacatttgaattcttatagctgtaataaatatgtataact

SEQ ID NO: 103493 - DNA, 601 bp, Human
gagccacatgcttgctctctctaccacattgtaataaggacgcacgccctccaagctgcccagctcagccccctgccctaattacttcgccaaaagcctctcctagattccgtgcctcttctcagcatttctctcacttctgggattcctctcacatttgaattcttatagctgtaataaatatgtataacttacttgacatttgttagcatattttttttgtatcttgtttcctttgccatgtaatatggtcctataatatggccatgtaatatggtcctgaaatggacataaaatttaratgtaggaaagttttacaacttgagttgatgggcaccattccaagaaagctcatattaataacagcagaaaatccaaaattaaactttgccttttgaacacattttacacatttcacacatttcatacacattctttcatgtgtgtgtatgctgtttcttaaatgtatttttgcctctagtatactctttggaagacttaattttcttttatcagaattaatccttaattattatcctccccatccaattttataaaataaaaaaggccagatattatccattatttggaaactgctaca

SEQ ID NO: 103494 - DNA, 601 bp, Human
ctgaaatggacataaaatttagatgtaggaaagttttacaacttgagttgatgggcaccattccaagaaagctcatattaataacagcagaaaatccaaaattaaactttgccttttgaacacattttacacatttcacacatttcatacacattctttcatgtgtgtgtatgctgtttcttaaatgtatttttgcctctagtatactctttggaagacttaattttcttttatcagaattaatccttaattattatcctccccatccaattttataaaataaaaaaggccagatattatycattatttggaaactgctacaaatattactgtacttaagatatggtaacattgccaaaatttaaattatgttggtatggctcaaaatgttcatgctttaggttgtatgtgagatgccaaaatttggcacaagaataccagtttaggaatattgataagatagtatgaaaaaataggatattgtccaaaattcaatattgagaaagcatagaacctaaggtttgtgtatctataccttccttcaacatgtaggaccccacctaactctttggatgtcttacataaagtggattttcaataa

SEQ ID NO: 103495 - DNA, 601 bp, Human
ctctttggaagacttaattttcttttatcagaattaatccttaattattatcctccccatccaattttataaaataaaaaaggccagatattatccattatttggaaactgctacaaatattactgtacttaagatatggtaacattgccaaaatttaaattatgttggtatggctcaaaatgttcatgctttaggttgtatgtgagatgccaaaatttggcacaagaataccagtttaggaatattgataagatagtatgaaaaaataggatattgtccaaaattcaatattgagaaagyatagaacctaaggtttgtgtatctataccttccttcaacatgtaggaccccacctaactctttggatgtcttacataaagtggattttcaataaaaatgtcataatgctgacgactacattactataccaatcagtcctttaggctgcaagccatgcaaataaaacacatcttgtcaacctcttttgtgaaatccatcagcagtatagcttagtagctatagcacaggctttactgttgcacagatgtcagttcaaatactgacttttcctcttattggaaaggtagtttatctgtttaa

SEQ ID NO: 103496 - DNA, 601 bp, Human
aactgctacaaatattactgtacttaagatatggtaacattgccaaaatttaaattatgttggtatggctcaaaatgttcatgctttaggttgtatgtgagatgccaaaatttggcacaagaataccagtttaggaatattgataagatagtatgaaaaaataggatattgtccaaaattcaatattgagaaagcatagaacctaaggtttgtgtatctataccttccttcaacatgtaggaccccacctaactctttggatgtcttacataaagtggattttcaataaaaatgtcataatgctgacgactacattactataccaatcagtcctttaggctgcaagccatgcaaataaaacacatcttgtcaacctcttttgtgaaatccatcagcagtatagcttagtagctatagcacaggctttactgttgcacagatgtcagttcaaatactgacttttcctcttattggaaaggtagtttatctgtttaagcctcagtgaccttattgatatgaatgacaataaaaagacttacccatcaggtttgctaattcatcattcaacagacatttgttgaacactttcaattgccaaata

SEQ ID NO: 103497 - DNA, 601 bp, Human
actgctacaaatattactgtacttaagatatggtaacattgccaaaatttaaattatgttggtatggctcaaaatgttcatgctttaggttgtatgtgagatgccaaaatttggcacaagaataccagtttaggaatattgataagatagtatgaaaaaataggatattgtccaaaattcaatattgagaaagcatagaacctaaggtttgtgtatctataccttccttcaacatgtaggaccccacctaactctttggatgtcttacataaagtggattttcaataaaaatgtcataatrctgacgactacattactataccaatcagtcctttaggctgcaagccatgcaaataaaacacatcttgtcaacctcttttgtgaaatccatcagcagtatagcttagtagctatagcacaggctttactgttgcacagatgtcagttcaaatactgacttttcctcttattggaaaggtagtttatctgtttaagcctcagtgaccttattgatatgaatgacaataaaaagacttacccatcaggtttgctaattcatcattcaacagacatttgttgaacactttcaattgccaaatat

SEQ ID NO: 103498 - DNA, 601 bp, Human
ctgctacaaatattactgtacttaagatatggtaacattgccaaaatttaaattatgttggtatggctcaaaatgttcatgctttaggttgtatgtgagatgccaaaatttggcacaagaataccagtttaggaatattgataagatagtatgaaaaaataggatattgtccaaaattcaatattgagaaagcatagaacctaaggtttgtgtatctataccttccttcaacatgtaggaccccacctaactctttggatgtcttacataaagtggattttcaataaaaatgtcataatgytgacgactacattactataccaatcagtcctttaggctgcaagccatgcaaataaaacacatcttgtcaacctcttttgtgaaatccatcagcagtatagcttagtagctatagcacaggctttactgttgcacagatgtcagttcaaatactgacttttcctcttattggaaaggtagtttatctgtttaagcctcagtgaccttattgatatgaatgacaataaaaagacttacccatcaggtttgctaattcatcattcaacagacatttgttgaacactttcaattgccaaatatt

SEQ ID NO: 103499 - DNA, 601 bp, Human
ttatctgtttaagcctcagtgaccttattgatatgaatgacaataaaaagacttacccatcaggtttgctaattcatcattcaacagacatttgttgaacactttcaattgccaaatattgctgggtgaattaagataatgccgcagggttacctctgaacgagtgctcagaatagagccctccacatagacacctttcaaagagtgaataatactttctaagcattaatgagtttgtgatgttctcttatcaatctggtcatcatgttcatgaaaaaagttggcaattagggtacaattmtcaaatcaagtatttctatggctttcttgttttcctttacttcttaagtttctttttcttgacaaccatatatgacctctggtttacctttttttcccagaatggagtctactgaaaaatgtgaagtggtaattcaacattttaatggaaaatatctgaaaacaccaccaggcatcccaggtaagaaattcactaataagtgactgaatgatgccgaggcttaaattgctcttattagaataagtacattgtaaagcccttgttgatcactgcagagttggggggtttgcttttcttaat

SEQ ID NO: 103500 - DNA, 601 bp, Human
tagtgtatgtggaaggttttaatattaactaagtaaagttttaaatataattccaatataaaaaattaacaatggaatgaagtattaaactaagaaaaattacgtaaagattcatctgaataaggcagtttggtttatttgttggtcttttatatacagttattctcagaggagactaaggcgacttcttccatcttacaatatgtgactttaatctttttaagcttgatttcaataccgtttgctgtataatgcatctactatttaaaacccatcagagagttcagaggttgagcatttyagttccttaaaatatattgagtttatagataagaggaagcatatacaaaaagagaaatatttttgtggagggttttgtaatgacttgctttttttaaggggggatgtcaagaatgcagaaagacccttcagacagacacttgcataatctgaaaacctaaagtagctgattgctggctaatcagtgagtcaacatacagtgaagactgtgccttgatttggttagcttccatgtgtaacgttcccttgggaactgactgcattatgatccaattggagacatatggtgttgttaagaaaa

SEQ ID NO: 103501 - DNA, 601 bp, Human
aaaaaattaacaatggaatgaagtattaaactaagaaaaattacgtaaagattcatctgaataaggcagtttggtttatttgttggtcttttatatacagttattctcagaggagactaaggcgacttcttccatcttacaatatgtgactttaatctttttaagcttgatttcaataccgtttgctgtataatgcatctactatttaaaacccatcagagagttcagaggttgagcattttagttccttaaaatatattgagtttatagataagaggaagcatatacaaaaagagaaatwtttttgtggagggttttgtaatgacttgctttttttaaggggggatgtcaagaatgcagaaagacccttcagacagacacttgcataatctgaaaacctaaagtagctgattgctggctaatcagtgagtcaacatacagtgaagactgtgccttgatttggttagcttccatgtgtaacgttcccttgggaactgactgcattatgatccaattggagacatatggtgttgttaagaaaagagttagcagttttcatctcagcatgttagctgcccttgcattttagcagaaatacttt

SEQ ID NO: 103502 - DNA, 601 bp, Human
attacgtaaagattcatctgaataaggcagtttggtttatttgttggtcttttatatacagttattctcagaggagactaaggcgacttcttccatcttacaatatgtgactttaatctttttaagcttgatttcaataccgtttgctgtataatgcatctactatttaaaacccatcagagagttcagaggttgagcattttagttccttaaaatatattgagtttatagataagaggaagcatatacaaaaagagaaatatttttgtggagggttttgtaatgacttgctttttttaaggggggatgtcaagaatgcagaaagacccttcagacagacacttgcataatctgaaaacctaaagtagctgattgctggctaatcagtgagtcaacatacagtgaagactgtgccttgatttggttagcttccatgtgtaacgttcccttgggaactgactgcattatgatccaattggagacatatggtgttgttaagaaaagagttagcagttttcatctcagcatgttagctgcccttgcattttagcagaaatactttttttttttttgtataaacagacattttaagacactttac

SEQ ID NO: 103503 - DNA, 601 bp, Human
gaaagtattttatttggttttccccaatgaacatattgctgactaatacaatttaatgctgaagacaaagaaagtcactacaaatccccaaatgtctgggcatccttccagaatatgcaggctatgatattaacctatctaatatcatagctacacccaatggaaacattgtgaatagcaggaacttggttatgagttttctcactcatttttatctcccgggaacaagaaagacaaaataattatgttcagttataaaactcttaggagagacaactgtatgcttctgagatttccactyatcataatagaactaaatacagaatattgatcatcatcagtgcttgaatctgcttatttataaattactttgaaagttagagttgaataaaggcttcaaatgctaagtaaagacatttaatctttgatacttaaattaggtgtggaagaaaagaggatataatacaagatatgggtattttgcaaggtaaagtagtaatttgcccttgttgagtataattactaagtcataacaggtataattacaatttgggtatatgctgtctgcctttattggtcctcattacttattacctggaaa

SEQ ID NO: 103504 - DNA, 601 bp, Human
cttaaattaggtgtggaagaaaagaggatataatacaagatatgggtattttgcaaggtaaagtagtaatttgcccttgttgagtataattactaagtcataacaggtataattacaatttgggtatatgctgtctgcctttattggtcctcattacttattacctggaaatagctgaaatcttactttcagaaatgtatgtcttaaccaatatttgattccatatttaagacagggagtaggatatcactatgagctatggcatcagatatttatactttttttaagtggccaatttcckaatctttttcattactttagagagtgtgtctttgcttgtgaatatgctcaactataattggtgtgacccactgaaaactaaaatacaatttttaaaatttgaaaaatctcagtgttctgccttatcaagatttgacatatttgaattcagaagtttgtggttttatagaactgcacattgattgtttaaatacattgctttaaggtcatgtagatgagggactcacagggatccaataatgatgacctgagatcctcgggtcttaagaaagctgtggaaagattgaatatgatgtcaatc

SEQ ID NO: 103505 - DNA, 601 bp, Human
agaaagctgtggaaagattgaatatgatgtcaatcatcttcttctcatactagggccctattgtattagtttgttttcatgctgctgataaagacacatccaagactgggcaatttacgaaagaaagagatttattggacttacagttccacgtggctgaggaggcctcacaatcatggtggaaggtgaaaggcatgtctcatatgacggcagacaagagaagagagcttgtgcaggcaaacttcccattttaaaatgatcagatctcatgagacttattcacaatcacaagaacagcacsggaaagacctgcacccatgattcaattatctcccactgggtccctcccacaacacatgggaattcaagatgagatttgggtggggacacagccaaactatgttgcctacatttaatataactctaagcaagtactgagcaattggtgccatattcatacggtctacgtctctgtttaggcacagtgtggggaaaatgtgcctgtgttattgggcaaatataatggcatttggtttctgtcactgttgacaatgacaattattcttaaaggagatgcaaagctaattattttcctgagatg

SEQ ID NO: 103506 - DNA, 601 bp, Human
agattgaatatgatgtcaatcatcttcttctcatactagggccctattgtattagtttgttttcatgctgctgataaagacacatccaagactgggcaatttacgaaagaaagagatttattggacttacagttccacgtggctgaggaggcctcacaatcatggtggaaggtgaaaggcatgtctcatatgacggcagacaagagaagagagcttgtgcaggcaaacttcccattttaaaatgatcagatctcatgagacttattcacaatcacaagaacagcaccggaaagacctgcayccatgattcaattatctcccactgggtccctcccacaacacatgggaattcaagatgagatttgggtggggacacagccaaactatgttgcctacatttaatataactctaagcaagtactgagcaattggtgccatattcatacggtctacgtctctgtttaggcacagtgtggggaaaatgtgcctgtgttattgggcaaatataatggcatttggtttctgtcactgttgacaatgacaattattcttaaaggagatgcaaagctaattattttcctgagatgatcatctagtttcc

SEQ ID NO: 103507 - DNA, 601 bp, Human
aggaaaaaatctatttcaacctaaaatgttgacattgctctgaatttcaaattctaaaaatttcatagttaaggaaatttgcaaggacatgtaacactgaccacatttatgttgctgccccatttcgatttgagccattgttggaataatttgctaattaaatatgattcatgttggtattgggttctaattcctgacagataagtgagttggaagagaactttacagatatctttttggaacacgctttatttctctgggctcctcctatttattcataaaagatctttttttaaatgartacatcatggatgattgatgtcttttagcatatcccagaactacctctgttcattttagattataatgttatccccagattttggttccctggatcaatgaagctaaatatacatgccaaaaatcaaattattgagtactagtatacaggaagttaacaaagatcagtcacatgtattgctgctagcagatgagaaggagagaccaaaagcatgtgttaaatagtgtcaatcgtttgagtgttgtagccatcagcagaaagagatcattcagcgttttctcccttacctagagggaaaag

SEQ ID NO: 103508 - DNA, 601 bp, Human
cgatttgagccattgttggaataatttgctaattaaatatgattcatgttggtattgggttctaattcctgacagataagtgagttggaagagaactttacagatatctttttggaacacgctttatttctctgggctcctcctatttattcataaaagatctttttttaaatgaatacatcatggatgattgatgtcttttagcatatcccagaactacctctgttcattttagattataatgttatccccagattttggttccctggatcaatgaagctaaatatacatgccaaaaatsaaattattgagtactagtatacaggaagttaacaaagatcagtcacatgtattgctgctagcagatgagaaggagagaccaaaagcatgtgttaaatagtgtcaatcgtttgagtgttgtagccatcagcagaaagagatcattcagcgttttctcccttacctagagggaaaagaaaatacagcattccataaatgttgcatgtcctacatatcgatcttgatgtttttctggacaaaatgaaggatcattagttgcttgcctgcctaaccccagacatttctttgtcccgtaatgaat

SEQ ID NO: 103509 - DNA, 601 bp, Human
ctttttttaaatgaatacatcatggatgattgatgtcttttagcatatcccagaactacctctgttcattttagattataatgttatccccagattttggttccctggatcaatgaagctaaatatacatgccaaaaatcaaattattgagtactagtatacaggaagttaacaaagatcagtcacatgtattgctgctagcagatgagaaggagagaccaaaagcatgtgttaaatagtgtcaatcgtttgagtgttgtagccatcagcagaaagagatcattcagcgttttctcccttmcctagagggaaaagaaaatacagcattccataaatgttgcatgtcctacatatcgatcttgatgtttttctggacaaaatgaaggatcattagttgcttgcctgcctaaccccagacatttctttgtcccgtaatgaattacacagcaatgttgtatagccccaaagtgttccattttcaaatctctggcaaaagcaaagggttagttcccagacacttcagggatctgtggggcatggacttgaaaggctcactttcaaagagcccccagagcagaatgatacaccatgcggaaaaggt

SEQ ID NO: 103510 - DNA, 601 bp, Human
catcaaacatactttgttgcttcatgatgaagaaaacacctttaaaatattattagtgaacttcacagagcagctggacaacatcatggtcaatggagtctgagaatctatgtgagtcctatggaatttgatatggtcaatcagttttcaacctttctatggagccacatctgacattgtgaaggtaaaaaagctgtgtgctggtaactgattagatatataagacagagagaagaggtgattaaatttctaaatctttgtatgagaagctaaatagagaaggaaaaagtttcatcttcaraagaatagaaataattgaaatgagttttttgacagggctacatctactctacccacctgtgatttcggctgcatatgagatgcaacctagaagcatcttaccttatgtatccacctagtttcttcacttttccacctcaggacaaaatttataaaagcttgctcaatgagacagacaaacgtcttctacaaactttgggggagttatcaccccctgggatagcctccaatcaacagggtataggagccagaagataacattgggtctctcatcctttggaaggataattctgagtcacat

SEQ ID NO: 103511 - DNA, 601 bp, Human
acttgccttgattgcctcttgaagttctaatcttggtaggagcaggttaagtgaatagtgacaaagagggttgttttttttctttatttatctgattttgaattttccaaaccagagtatttttcattttttgtagctcaagggctgtatgcttagctctgtacattctcactaaatactctttggagttgtatagtttcatgaattaaatgacaatcatacatatatttgcttttaatgaactttctgaaggtatggggaggatgcacagctctgggtaaacaagcatgcaaccaatttkggggaaaacattgaggaaaatcttaaaatatttttaaatgttttaattaaaaatatttccatatctaaatagagaaagaaagcaagagtgagagagagaaaaatgtttgtaagaataagaaacttatttgagaaaaatttcagttacattttggaaagcctaatttttctaagactgcttttcaaggtgtatactgaagacctaattgtagtttctttaaagaactcattcttgaacagtgcaatgatgaattctgttttctggcatggcaaatggtcttgcctaattatactggaataa

SEQ ID NO: 103512 - DNA, 601 bp, Human
aagagtgagagagagaaaaatgtttgtaagaataagaaacttatttgagaaaaatttcagttacattttggaaagcctaatttttctaagactgcttttcaaggtgtatactgaagacctaattgtagtttctttaaagaactcattcttgaacagtgcaatgatgaattctgttttctggcatggcaaatggtcttgcctaattatactggaataatgtctctaaactttttgccactggagctagttaagcacaatgattatgcagcacttttgctccccctgccacgtcttcacataraaagataaatgtcttgagaaaaaacaaaaaagagaatttccagtctctattatatcccttttggcataatattgttgctcatttctgcctagagaaagtaccacattaacatattatttctcttataatattatataacatactctgtaatttttaatcaataagatatggttaatgctttcttgaccatattttttctatagttacatatgaagcaccaataagtagcagcataatgtgtctggagtttccatttggttccagaatttgattgattaaagtagttgtaatttcatggga

SEQ ID NO: 103513 - DNA, 601 bp, Human
gtctggagtttccatttggttccagaatttgattgattaaagtagttgtaatttcatgggatagagaaaagggatgaggaggttttctatacatctccaaaatcatgaaccaccttcataacttatttctaaaatactgactccattcaggtctgcacgaatttctggactgaaaatttcacataaaaacttacaaaataaataataaaacactaattttgcttctaagaccatgttgggctttgccttctgtcagcatcactaatgagtagctaaaccatttagtgtctgtccggatgagtcctattaggaagctgagggttgagtggcttaagaccaattaacacacaagccagggaaaccaaattgaataattaagttcttagtgcatttcagaatctagaatctcatttaataggattgatttaagaacacattctaaccaatttttgtatgaatggatagtattctgaattaaatacttgcaactctctccttgtaaccattaaaaagcctgctatacatacacctcatcatttatgatctaatttttagaatgatctaatttttagaatgaaaagtctgcaaaacataagaaaat

SEQ ID NO: 103514 - DNA, 601 bp, Human
aaaacactaattttgcttctaagaccatgttgggctttgccttctgtcagcatcactaatgagtagctaaaccatttagtgtctgtccggatgagtcctattaggaagctgagggttgagtggcttaagaccaattaacacacaagccagggaaaccaaattgaataattaagttcttagtgcatttcagaatctagaatctcatttaataggattgatttaagaacacattctaaccaatttttgtatgaatggatagtattctgaattaaatacttgcaactctctccttgtaaccatyaaaaagcctgctatacatacacctcatcatttatgatctaatttttagaatgatctaatttttagaatgaaaagtctgcaaaacataagaaaatattttaagagaaatgtgaatgaaaacagtaggcaagctctgaactagccattatgtgtttatcttactagctgcttcctcttatttcttacgtctttcagccctgaatgatgaatcaattatttgagtaatattttagttatttttcagtacaaaaaataaatctttcataggaaattggcatgcttatgaaggttcatttgtccc

SEQ ID NO: 103515 - DNA, 601 bp, Human
aataatggtcctctaaagatctgtaaatcctaatccccagaacctgtaaatatgttaggttacatgaaaaagagtaattaaggttacagcaaaaattaaggttgcagctggaattaaggttgctaataaactgaccttaaaataggaaaattattgtgttagtttgttctcgcattgatataaagaactacctgaggctgggtaatttataaaaaagagaagtttagttggctcctggttccacagggtgtataggaagtgtggctggagaagactcaggaaacttacatcagggcggaaygtaaaggggaagcaggcatgacctacatggctggtgcaggaggaagagagtgaaggaggaggtgctacacactttttgacaaccagatcttgtgagaactcattatcacgagaatagcagggaggaaatctgcccccatgatccagtcacctcccactaggcccctcctccaacactgaggattacaatttgacatgagatttgggtggagacacaaatccaatccattcccattaccatggtttatctgggtgggcccagtgtaattagaagcatcctcaaaagtggaggagaacggta

SEQ ID NO: 103516 - DNA, 601 bp, Human
atgcagcatagacaagtggaaatttacagccgaggagcagcataggaggtcggtggttggaaaattaccaagaggaagcatcaggggtaggattctttctgaagacaggccagggtaatcagacgtcacctagaagaaagttcagtaagctgactaaagtaaggccaaataaagaatcatctcagaatcattagagttgcttgtgtgttaaatagaaaaaaaaatcttgttagttattttaacttcacagtttctttataactgctcataagcacatattactatagaagactgttcagcrtctgaaacaagaagctttgggaagtccttatatcttagagcacattgttttttatttaaagaaataaaatatgaacttaaactatctgacaccataagtatgccaggaaaataatcctaattgctaatctaaattcatgtaaatgtgtatctcttgggtctcaaccttaatacttgctttcaataattcctattcttgaaaagttattagggcctagaaaaacagaatggagctcctcgaggttataatcaactttaagttttagatgattatatctcaagcatagaccatgctcacacc

SEQ ID NO: 103517 - DNA, 601 bp, Human
tggaaaattaccaagaggaagcatcaggggtaggattctttctgaagacaggccagggtaatcagacgtcacctagaagaaagttcagtaagctgactaaagtaaggccaaataaagaatcatctcagaatcattagagttgcttgtgtgttaaatagaaaaaaaaatcttgttagttattttaacttcacagtttctttataactgctcataagcacatattactatagaagactgttcagcgtctgaaacaagaagctttgggaagtccttatatcttagagcacattgttttttattyaaagaaataaaatatgaacttaaactatctgacaccataagtatgccaggaaaataatcctaattgctaatctaaattcatgtaaatgtgtatctcttgggtctcaaccttaatacttgctttcaataattcctattcttgaaaagttattagggcctagaaaaacagaatggagctcctcgaggttataatcaactttaagttttagatgattatatctcaagcatagaccatgctcacacccctactcattgtcccatgaaacggggagtgtcctaaagctctaaatgccctaaatct

SEQ ID NO: 103518 - DNA, 601 bp, Human
ttatatcttagagcacattgttttttatttaaagaaataaaatatgaacttaaactatctgacaccataagtatgccaggaaaataatcctaattgctaatctaaattcatgtaaatgtgtatctcttgggtctcaaccttaatacttgctttcaataattcctattcttgaaaagttattagggcctagaaaaacagaatggagctcctcgaggttataatcaactttaagttttagatgattatatctcaagcatagaccatgctcacacccctactcattgtcccatgaaacggggaktgtcctaaagctctaaatgccctaaatctttcatctgaaagcttagttttgagacacacattaaaaatttagaggtggtgaatatgcatacttattatatatttagaaagatagataatgcttatgataaaataattttaaaaattaagtgcattttcaaaaatgtgtttcttagccaaagttattatacattccatattattcctatagcaagattgggaggctgtacatatgaaaacataaccattttctattgaactgagtgtgagacacattttggaccagaggtttatatcaaac

SEQ ID NO: 103519 - DNA, 601 bp, Human
cttaataaaggtccattcaaaagaatgaaaattgtatccatatataagacaaaggggttttaaaataaaaaaatcttagcaaagtgtacaaaagcactgaagaaaaatattgaaactaatatgtttttacacataatcattttaagatggtatagtgagcttgatacaaagggtgttacagagaccgctggaggttcctaagatcctttctggtggtctacaaggtcaaaaatatttttatcataatacgaattcattatttgcctttttcactctgattctctcatgaatgtaaagtggwgttttccaggggctacatgatttgagatgtggcaaaagctggaatatggaagcaaatgttagaatccagctgtcttttattaagccagaaattacaaagccactcttctcttttttattctgtttttgaaaatagtgtttttaaataaaagtgtatgatttatgtcaatatgtaacaggactattattattttaaaataaacatctaaatttttttattttatgttttaatggtgtcaataaatataacgtgtctaaacaagttttgggggatcttcaataatttttcagagtgtaaaga

SEQ ID NO: 103520 - DNA, 601 bp, Human
ttcaggcgcctaatctatagtgagtgttttgttttatttttttaaatgcagaggcaatggttagtcttctgaacatttgcattctcattttcattagcaaatagcatattgtttgacagaatatgtgaatgttgtattaagacaatgtatttaagcagcgtgtgtggcatgctgcaattgtgggaatggaattatgtgaatttgtgagtagcatgcgaatgagtctgcccacaatttagggagagtttaagactaatatctaagagccagaaagctaaccacagatgccacatgggagctrtgttatcatcataagaactattctgtgttgcttcttttagtcgctgctaatttcagataatgttcatcttacatctggacttcaccagtgtgagtgctattcaccatgtgggacatatcttaagtacgtacgaccttccaggtttgctagttgtagtacatgataataataaaaatgataataatatatttaaacactagcatgcaactaattgaacactgtatattattagtgttcacataaaatcttaaaaaaatttcagaaatagtaaagtctcctattgtagagtcacataatcat

SEQ ID NO: 103521 - DNA, 601 bp, Human
aagtacgtacgaccttccaggtttgctagttgtagtacatgataataataaaaatgataataatatatttaaacactagcatgcaactaattgaacactgtatattattagtgttcacataaaatcttaaaaaaatttcagaaatagtaaagtctcctattgtagagtcacataatcatgatttcattaagcttattgcatctttacctaatttgaatgatctctaaggaaagtaattctctagtcatcttttgtaactagttgtaattttatctgaatgaatccatgtaatagataaaakaatttaagataaaattctcatataatttatttttaaaggacgcaactcaatatttgcttacatcatttaacagccccttcatttcttgcatcccaaagacaagcattttacatctttgctacacctatatgatgttaaagaaaagagcgccatttgtccagcttatgatatgctttctatgagatcctcacggccaggatcccctttgccctttatgaatttaatttctggaagaacatatgctacagagaataccacctttgcctttggaatcagatggactttggtttgacttatgct

SEQ ID NO: 103522 - DNA, 601 bp, Human
cctattgtagagtcacataatcatgatttcattaagcttattgcatctttacctaatttgaatgatctctaaggaaagtaattctctagtcatcttttgtaactagttgtaattttatctgaatgaatccatgtaatagataaaagaatttaagataaaattctcatataatttatttttaaaggacgcaactcaatatttgcttacatcatttaacagccccttcatttcttgcatcccaaagacaagcattttacatctttgctacacctatatgatgttaaagaaaagagcgccattygtccagcttatgatatgctttctatgagatcctcacggccaggatcccctttgccctttatgaatttaatttctggaagaacatatgctacagagaataccacctttgcctttggaatcagatggactttggtttgacttatgctgctgtctcttttttacgttttaacttgaacaagttatttagcatcttgccaggttcctcatagaacctaattgttccgcacccattaactcgtcatttaacattaggtatatctcctaatgctatccctccaacatggtacatgtatacatatgt

SEQ ID NO: 103523 - DNA, 601 bp, Human
aacttccctttccttaactctcactgtacggcattaaatgcttttctcctatactgggtgtctatttgtgacatgtagcctcatttaacaactgttgtatgcttatcttatcccactggatggcagaattatgcctttgttattcttttatctcctccaatacctaccatttgaacatacgatgtttgatatagacacactaaattgaatttaaaatagtcgagcatattattctagtgtgatttcctaatattgccttaattctctcttaatgcgttttattagtaaatgcttataaagtgaatgcagaaaccatcaactatgatgattccacatagaaatatatgacataatactttttttggtacattttaaaacacttaaacctcaaaaaccttctttcaaatggaagacaatgtttaaaagcacaagaacccttttcatttttataaagattaaattatctttccattctgcttcctgctttctattgctactttctccagattaatttttttaaagagtattgacctatggacattaaacacaaaaggaatataaaataaatgcgttggaataccaaacatcctgttggttgtta

SEQ ID NO: 103524 - DNA, 601 bp, Human
tattattctagtgtgatttcctaatattgccttaattctctcttaatgcgttttattagtaaatgcttataaagtgaatgcagaaaccatcaactatgatgattccacatagaaatatatgacataatactttttttggtacattttaaaacacttaaacctcaaaaaccttctttcaaatggaagacaatgtttaaaagcacaagaacccttttcatttttataaagattaaattatctttccattctgcttcctgctttctattgctactttctccagattaatttttttaaagagtawtgacctatggacattaaacacaaaaggaatataaaataaatgcgttggaataccaaacatcctgttggttgttacaattctacaacaacaattagatttttttttctaattaaaatcatttgaaatcacagtttttgtcttctcagaggtttctcttttcccaaagtttccttcaggtcctgtccttgtagtacattggggttgtagtggcctgtgccaccaggagaatggattcattaacctttacattgatttgaagtgtcgttcaaataaatacttatactctttttctctgatggc

SEQ ID NO: 103525 - DNA, 601 bp, Human
aagtttggcacagaaatgtattagtcctggatccaacagaattattttacactctatattcttttggcttctgcagagaagaaaatttctttctttgaatttcattttttaatttcagggtttaaacatttcctgctttctgcatatgtgtctttttgtattttgtctgcctgtttctcttgttctcttgtgactctctgtatatgattatttcaatttcacttcttcacaccaatatctactaaaagatatagttagagccaggaaatgtttctgatcccctgttcccaatcttatcaayaaacttttttttttttttgtgcaaggggattggggaattactatgtgccaaatgttgtatttagtattttacagatttttaaatttatttctcaaacacccttagggaaaaagaaactgttccatcttgcagatgaggaggctgcattttatattatgtgtataaattgctttgatgcatacatactagtaatgacagtagtaaatgggctgattgaccccaggatttaattctgtcaccttattagatatgtgaccatgagcagttacttaacccctttgttcctcaatttcccctttg

SEQ ID NO: 103526 - DNA, 601 bp, Human
tggcacagaaatgtattagtcctggatccaacagaattattttacactctatattcttttggcttctgcagagaagaaaatttctttctttgaatttcattttttaatttcagggtttaaacatttcctgctttctgcatatgtgtctttttgtattttgtctgcctgtttctcttgttctcttgtgactctctgtatatgattatttcaatttcacttcttcacaccaatatctactaaaagatatagttagagccaggaaatgtttctgatcccctgttcccaatcttatcaataaacttttttttttttttgtgcaaggggattggggaattactatgtgccaaatgttgtatttagtattttacagatttttaaatttatttctcaaacacccttagggaaaaagaaactgttccatcttgcagatgaggaggctgcattttatattatgtgtataaattgctttgatgcatacatactagtaatgacagtagtaaatgggctgattgaccccaggatttaattctgtcaccttattagatatgtgaccatgagcagttacttaacccctttgttcctcaatttcccctttggtaaa

SEQ ID NO: 103527 - DNA, 601 bp, Human
attagtcctggatccaacagaattattttacactctatattcttttggcttctgcagagaagaaaatttctttctttgaatttcattttttaatttcagggtttaaacatttcctgctttctgcatatgtgtctttttgtattttgtctgcctgtttctcttgttctcttgtgactctctgtatatgattatttcaatttcacttcttcacaccaatatctactaaaagatatagttagagccaggaaatgtttctgatcccctgttcccaatcttatcaataaacttttttttttttttstgcaaggggattggggaattactatgtgccaaatgttgtatttagtattttacagatttttaaatttatttctcaaacacccttagggaaaaagaaactgttccatcttgcagatgaggaggctgcattttatattatgtgtataaattgctttgatgcatacatactagtaatgacagtagtaaatgggctgattgaccccaggatttaattctgtcaccttattagatatgtgaccatgagcagttacttaacccctttgttcctcaatttcccctttggtaaaatgggaataactat

SEQ ID NO: 103528 - DNA, 601 bp, Human
tgtgtctttttgtattttgtctgcctgtttctcttgttctcttgtgactctctgtatatgattatttcaatttcacttcttcacaccaatatctactaaaagatatagttagagccaggaaatgtttctgatcccctgttcccaatcttatcaataaacttttttttttttttgtgcaaggggattggggaattactatgtgccaaatgttgtatttagtattttacagatttttaaatttatttctcaaacacccttagggaaaaagaaactgttccatcttgcagatgaggaggctgcrttttatattatgtgtataaattgctttgatgcatacatactagtaatgacagtagtaaatgggctgattgaccccaggatttaattctgtcaccttattagatatgtgaccatgagcagttacttaacccctttgttcctcaatttcccctttggtaaaatgggaataactatagtctcttctgtactagtgttgcaagattggctatggattaaatacattaaactacatagagcaattggaatgtttctggtaaatactaagtgttacttaggtgttaacattgtactgctatgtcat

SEQ ID NO: 103529 - DNA, 601 bp, Human
tttttgtattttgtctgcctgtttctcttgttctcttgtgactctctgtatatgattatttcaatttcacttcttcacaccaatatctactaaaagatatagttagagccaggaaatgtttctgatcccctgttcccaatcttatcaataaacttttttttttttttgtgcaaggggattggggaattactatgtgccaaatgttgtatttagtattttacagatttttaaatttatttctcaaacacccttagggaaaaagaaactgttccatcttgcagatgaggaggctgcattttayattatgtgtataaattgctttgatgcatacatactagtaatgacagtagtaaatgggctgattgaccccaggatttaattctgtcaccttattagatatgtgaccatgagcagttacttaacccctttgttcctcaatttcccctttggtaaaatgggaataactatagtctcttctgtactagtgttgcaagattggctatggattaaatacattaaactacatagagcaattggaatgtttctggtaaatactaagtgttacttaggtgttaacattgtactgctatgtcataggtct

SEQ ID NO: 103530 - DNA, 601 bp, Human
aggaatcaaggaatattctggagaagcatccatttttactgaaattcaaagataaagatgaaaggtatttccaagcagaaataggttgatgctttttgaaacatattgatatagttcaagtttaatcctatatgcttgactttaaattgatgagaactagtttttgctgaaaataaacaggatgagggaaccagatatgcccctgagcgctttgaattgattataactagatggagctggtttggtctagttaggtttgatttgaaactgcttgagttaagttttattcagtcagataacaaaaaaaaaaaatttgagtgaatcttatggtttgactacatgctttctatattgagaatattaaacatttgtccattgcatttgtcattcatgctttcccttgattgctctttaacttttacttctatttcttaaaaataatagtttactttttatgtgaaataaacttctccaatgtgtcttttaaaaaaatcaccttaaatgtaagagatttcattaatattcatttctgtatcttttgctttttctctaaatttaactctttagtatatttggtatcaaataactatctaaattgaat

SEQ ID NO: 103531 - DNA, 601 bp, Human
aaatcaatgttttataaaaattttggtattattaatcagggttagctcctgaatattatgaaatacctgagaaactcattgtctaatccttgattgcttgctaatgctacctcttatataactaaattttaaaagttgaaattggatcactgctgcaggctccctgagacaccaaaaaaccgtgagtctgcttgctttctcagtggggaggctagtggtctagggcaagttatcagccctggtcactggctgcctggaaatagactcagtgctgttgtgggggcacagtgggagtgagacyggcctttagtaccgtgggctgtgtgggagagggttgaggcctgtgactaccggctttcccccacttccctggtgacctgtatggctcagcataggcagccacaatccccccgggaatataactccataagattgggagccatatcctcatcccccacagcagctgcagctagtctcacccaaggaaagactgaactcagacatgcttatccctgccccccacctggtggtctttctctacccaccctcggagtcgaagacaaaggtcataatctcttgggatctctatggccctgcacac

SEQ ID NO: 103532 - DNA, 601 bp, Human
aaattggatcactgctgcaggctccctgagacaccaaaaaaccgtgagtctgcttgctttctcagtggggaggctagtggtctagggcaagttatcagccctggtcactggctgcctggaaatagactcagtgctgttgtgggggcacagtgggagtgagactggcctttagtaccgtgggctgtgtgggagagggttgaggcctgtgactaccggctttcccccacttccctggtgacctgtatggctcagcataggcagccacaatccccccgggaatataactccataagattgggarccatatcctcatcccccacagcagctgcagctagtctcacccaaggaaagactgaactcagacatgcttatccctgccccccacctggtggtctttctctacccaccctcggagtcgaagacaaaggtcataatctcttgggatctctatggccctgcacactgcctgagaagcctgaatacttaaccaggtgtccctagggcaagtttgtatccttataggaccatagctgacgcgctcttgaaagctccacctcctacctggaggccaaccaacacaaaaccagtgcactaaacaaaa

SEQ ID NO: 103533 - DNA, 601 bp, Human
tgggctttcgaattaacccaatccatcaaagacaaagaaaaaagaatttaaaaaaaagaacaaagcctttcagaagtttgggactatgttaaatgagaatatgttaaatgtccaaacctaagaataattggcgttcctgaggaagaagagaaacctaaaagttttgaaaacacatttgagggaataatccaggaaaactttctggacttgctagagatctagaccccccaaatgcaagaaactcaaagaacacctggaaaattaatcacaaaaagatcatcacctaggcacattgtcatcrggttatctaaagtcaagacaaaggaaagaatcttaagagctgagaggcaaaaacatcaggtaacctataaaggaaaacctatcagattaacagcagatttctcagcagaaatcctacccgctagaagggattggggtcctatttttagcatccttaaacaaaacaattatcagccaagaattttgtatccagcaaaattaagctttgtaaatgaaagatacagtcttttccagacaaacaaatgctgagagaatttgctactaccaagccagcactacaataactgttaaagggagctct

SEQ ID NO: 103534 - DNA, 601 bp, Human
cagaaatcctacccgctagaagggattggggtcctatttttagcatccttaaacaaaacaattatcagccaagaattttgtatccagcaaaattaagctttgtaaatgaaagatacagtcttttccagacaaacaaatgctgagagaatttgctactaccaagccagcactacaataactgttaaagggagctctaaatcttgaaataaacccctcaaaaatacaccaaaatagaacctccataaagcataaacctcacaggacctatataacaataacacaattaaaaaaaagtatttaktcaacaaatagtaagatgaataggatagtacctcacatcccaatactaacattgaatgtaagtggcctaaatggtccacttaaaagatacagaatggcagaatggataaagattcaccagccaagtttctactgtcttcaggagactcatctaacatataaggcctcacataaacttaaggtaaagggatggaaaattatgttccatgcaaatggacaccaaaagtgagcaggagtagctatgcttacatcagatgaaacaaactttaaagcagcagcagttaaaaaagacaaagaagga

SEQ ID NO: 103535 - DNA, 601 bp, Human
aaaagtggtgctaagaggaaagttcatagcattaaatgcctacatcaaaaagtctgaaggagcacaaatagacaatctaaggtcacaccttacagaactggagaaacaataacgattcaaacccacgcccaacagaagaaaatacgtaacaaagatcagagcagaactaaatgaatttgaaacaaaaaatataaaaagataaataaaacaaaaagctcattttttgaaacgataaataaaattgatagaccgttagcaaaattaaccaagaaaagaagagagcaaatccaaataacctcawtaagaaacaaaatgggagatattacaactgataccaaagaaatacaaaagattattcaaggctacaggaacacctttacatgcataaactggaaaacctagaggagatggatacatttctgaaaatatacaaccctcctagattaaaccaggaagatatagaatctctgaacaagcagtgagattgaaatggtaattttaaaattgccaccaaaaaaagaccaggaccacatggattcacagctgaattttatcagacattcaaggaagaattggtgccagtcctattgacactattcca

SEQ ID NO: 103536 - DNA, 601 bp, Human
gaccgttagcaaaattaaccaagaaaagaagagagcaaatccaaataacctcattaagaaacaaaatgggagatattacaactgataccaaagaaatacaaaagattattcaaggctacaggaacacctttacatgcataaactggaaaacctagaggagatggatacatttctgaaaatatacaaccctcctagattaaaccaggaagatatagaatctctgaacaagcagtgagattgaaatggtaattttaaaattgccaccaaaaaaagaccaggaccacatggattcacagctgarttttatcagacattcaaggaagaattggtgccagtcctattgacactattccaaaagataaagaggggatcttccctaaatcaatctataaagccagtatcaccctaataccaaaaccagggaagaacatagcaaaaaaagaaaactacagaccagtattcttgatgaacataaatgcaaaaatcctcaacaaaatactagtgaactgaatccaacagcttatcaaaaagataatccaccattatcaagtgggtttcataccagggatgtaaggatggtttaacgtatgcaatctaaaaa

SEQ ID NO: 103537 - DNA, 601 bp, Human
attattcaaggctacaggaacacctttacatgcataaactggaaaacctagaggagatggatacatttctgaaaatatacaaccctcctagattaaaccaggaagatatagaatctctgaacaagcagtgagattgaaatggtaattttaaaattgccaccaaaaaaagaccaggaccacatggattcacagctgaattttatcagacattcaaggaagaattggtgccagtcctattgacactattccaaaagataaagaggggatcttccctaaatcaatctataaagccagtatcacyctaataccaaaaccagggaagaacatagcaaaaaaagaaaactacagaccagtattcttgatgaacataaatgcaaaaatcctcaacaaaatactagtgaactgaatccaacagcttatcaaaaagataatccaccattatcaagtgggtttcataccagggatgtaaggatggtttaacgtatgcaatctaaaaattcaatgcaattcttatcttaataccatattattctttacagaactagaaaaaacaatcctaaaattcatatggaacaaaacaagagcccactagccaaagcaa

SEQ ID NO: 103538 - DNA, 601 bp, Human
taaactggaaaacctagaggagatggatacatttctgaaaatatacaaccctcctagattaaaccaggaagatatagaatctctgaacaagcagtgagattgaaatggtaattttaaaattgccaccaaaaaaagaccaggaccacatggattcacagctgaattttatcagacattcaaggaagaattggtgccagtcctattgacactattccaaaagataaagaggggatcttccctaaatcaatctataaagccagtatcaccctaataccaaaaccagggaagaacatagcaaaamaagaaaactacagaccagtattcttgatgaacataaatgcaaaaatcctcaacaaaatactagtgaactgaatccaacagcttatcaaaaagataatccaccattatcaagtgggtttcataccagggatgtaaggatggtttaacgtatgcaatctaaaaattcaatgcaattcttatcttaataccatattattctttacagaactagaaaaaacaatcctaaaattcatatggaacaaaacaagagcccactagccaaagcaagactaagcaaaaagaacaaatctggaggcatcac

SEQ ID NO: 103539 - DNA, 601 bp, Human
atatacgctgtggactacaactcagccataaaaaggaatgaaataatggcatttgcagcaatgccattgcaattgcaggatggaattggagactattattctaagtaactcaggaatggaaaaccaaacattgtatattctcatatgtgggagctaagctatgaggatgcaaaggcataagaattatacattggactttggggactcagggaaaaagggttggtggtggcaagaaataaaaggccacacactgagtacagcatatgctgctagggtcatgggtgcaccaaaatctcagaartcatcattaaagaacttattcatgtaaccaaacaccatctgttaccccaaaacctactgaaattaaaaaaaattaaaaattaaagtaaaataaaatatttagccatttatttttcctgggaaattttaaacttcattatgatggattcttctaatgtacatttgatttattttatattttgagttggtaatatgtgcagttatttaaaaattcaagaacttcacagtgaaaaatactttctctttctttcctgtgacacagtcacccaagtttctccctagaaaagctattgtcaacatt

SEQ ID NO: 103540 - DNA, 601 bp, Human
caaaagagaaacataatgaatggtgatagacgtatttatcctttttaaaaatctgaatatctcatatatatataatgcccatactgagaatattaaaatgtaactgattttttctctagtaatttttattaaaaaatattaattttttgaagccatctagaatttattttagcattagttgtaagatggagaaaccaactttaatttaaatttttaaaatttcctgatggttaattagtcagttgttctactattgaataatacattctttgcatagaatccaaatgttacattttcttcyattaaatcaccatgtatattttttattttcctgaaatttcaattgtcttaattgacttactagtcaaatcatgtgttattaatgtacatctttgataattagtattttacataatgtttgactatttgagggagtcattcccaccaccacccatcattcctcttcttttaaataatatttctggcttttttgcttatctattttacaataactttaaaatttatattttacctgccccctgcatatatgggcattttatgatttgtgcatccttaattcgaagtgagaggaacatatgat

SEQ ID NO: 103541 - DNA, 601 bp, Human
ctagtaatttttattaaaaaatattaattttttgaagccatctagaatttattttagcattagttgtaagatggagaaaccaactttaatttaaatttttaaaatttcctgatggttaattagtcagttgttctactattgaataatacattctttgcatagaatccaaatgttacattttcttccattaaatcaccatgtatattttttattttcctgaaatttcaattgtcttaattgacttactagtcaaatcatgtgttattaatgtacatctttgataattagtattttacataaygtttgactatttgagggagtcattcccaccaccacccatcattcctcttcttttaaataatatttctggcttttttgcttatctattttacaataactttaaaatttatattttacctgccccctgcatatatgggcattttatgatttgtgcatccttaattcgaagtgagaggaacatatgattttctggaggaaactttcaactttgaatgcttgtgaccaaaggaaaactatgacatcatctggcagccatttcaaattatagccagatgttctaaaatggtttcttactacccca

SEQ ID NO: 103542 - DNA, 601 bp, Human
tttttattaaaaaatattaattttttgaagccatctagaatttattttagcattagttgtaagatggagaaaccaactttaatttaaatttttaaaatttcctgatggttaattagtcagttgttctactattgaataatacattctttgcatagaatccaaatgttacattttcttccattaaatcaccatgtatattttttattttcctgaaatttcaattgtcttaattgacttactagtcaaatcatgtgttattaatgtacatctttgataattagtattttacataatgtttgamtatttgagggagtcattcccaccaccacccatcattcctcttcttttaaataatatttctggcttttttgcttatctattttacaataactttaaaatttatattttacctgccccctgcatatatgggcattttatgatttgtgcatccttaattcgaagtgagaggaacatatgattttctggaggaaactttcaactttgaatgcttgtgaccaaaggaaaactatgacatcatctggcagccatttcaaattatagccagatgttctaaaatggtttcttactaccccagaagtgt

SEQ ID NO: 103543 - DNA, 601 bp, Human
atcatctggcagccatttcaaattatagccagatgttctaaaatggtttcttactaccccagaagtgtggctttaagtcacttccacttcacaggcattgctatcaattttctatctctcacaactcaaaatcttaaagacaaaaggtgttatatcatcttataactttctgaatttttacaggtgattttagctaagacaatccaaacatctggagatccctctccatttttctttgatgttaaacacatttttacagaagtaaatacagctctcttctgcactgacatagagaaaataytttttgctcaatatttcaaggacgactttaaaaatctattctaaaatataggtaaaaaagtagcatatgaaatttaaaacattatattaaaacaagatataattgcactataaaggttaaatctcatatttagcgctcacatgatatcactcaattttgtgaggcgtcttttgtaaagtatagtaggccattatgagtatttggttacataattcattttcacttaatgtagatagtattaatatattttgtgtggttcggttctatgaattttcaaagagcatgattcattcatgggta

SEQ ID NO: 103544 - DNA, 601 bp, Human
gaaattaaacattcaggaaagtgtgttaattttcaaaaagactccttttttgtgtctgccctcattttcttgctttttgagtcagttatcgggattttgaagtttaaaatgctgagatttttaaagtttcaatcgaaaagtattcatactttgacattgaataaaatttcccagttagcatgatctttaaaatacaaatttgatttacatttacatttcaaagcttttaattctttttggtgaatgtcccctgatactgcactctgcagacccattctatttgtttagctttggcttctcycctgccttgagtgttaaatttggtgggagatgggcaaggaaatcagagtgaaccctcacatctcagctctgatagaaggtgcacctattcctctataccagtatgtttaagaagtcttgtaacacatcttgcttttagaaatccatttatttttgtttttgtttttgttttttaaagaggttctcatacataagtggggtgaacaggtgaataacattgatttctttagaagacaggtattatgtaaatactgccttgtagaaatgcatttccatttcctgcattgatctcatcttaaag

SEQ ID NO: 103545 - DNA, 601 bp, Human
tatgatcttgacctttaaatcatttattaaaataaaaacataggtgcctgggaccagaattcatttttataaaatcacaactgttcactatataacactatgatttctttttgtgtttctgatattttcctatctaaaagtgacatagggttaaaaaggagagaaagtggatgtagaacaatatccaaacattggttccctgcttcagtccataattgtcattcattttttattgcctcaattccagttatcaaaaggtaggtactaatccaaactgcatttcacctcctagcaaaggagwtaaaatatgtcttattgttctccatgttctgtatgaagttcttactttgaaatgcagggcccttcattctttggcttaatcctctgaaactcactgaattttctagccttgtcatctaccaaaatgtgcacatattgttgtaccttgggctgtcttaaaaaaagacatcatgaactctggagccagactatctagatcagaatcccacctgtaccacttactagctgtatgacctggggcaagtgacttaacctctctttgactcagcattctcatctatataataagaacaattaaagt

SEQ ID NO: 103546 - DNA, 601 bp, Human
aagacctgaaatgaactataattgaaattccttgaaggaaaagctggccaggtgtggtggctctcacctttaatcccagcgctttgggaggccaagggggtggatcacttgaggtcaggagttcaagagcagtctggccaatgtggtgaaaccctgtctctactaaaaatacaaaaaattagctgggtgtgcacctataatcccagttacttgggaggctgaggcaggagaattgcttgaacccgggaggtggaggttgcagtgagcccagattgcaccactgcacttcagtctgggcaayggagtgagactccatctcaaaaaaaaaaagaaaaaggaaaagaaaaagaaaagcagaaagagaaacctagtaagttacataattcagcctaaaagttagaatgttagcttctggggaagttaagaccgtcataatttttttttccacttctgtatactaagaacctgaatgattcttagataacaatttggatttatttaatatttattaagtgaattatgaaatcagtgaataataaaaaagcatgtcacattttctattgctaaaaaagtaattttatataacatccatttctccaaa

SEQ ID NO: 103547 - DNA, 601 bp, Human
agttcaagagcagtctggccaatgtggtgaaaccctgtctctactaaaaatacaaaaaattagctgggtgtgcacctataatcccagttacttgggaggctgaggcaggagaattgcttgaacccgggaggtggaggttgcagtgagcccagattgcaccactgcacttcagtctgggcaatggagtgagactccatctcaaaaaaaaaaagaaaaaggaaaagaaaaagaaaagcagaaagagaaacctagtaagttacataattcagcctaaaagttagaatgttagcttctggggaasttaagaccgtcataatttttttttccacttctgtatactaagaacctgaatgattcttagataacaatttggatttatttaatatttattaagtgaattatgaaatcagtgaataataaaaaagcatgtcacattttctattgctaaaaaagtaattttatataacatccatttctccaaataatatcctctctaatttaagatggataatgatgcctgatcttatttaagaaatgtattctattttgaagagcttaataaaaataattttgactcattataaacatggccaactccaac

SEQ ID NO: 103548 - DNA, 601 bp, Human
ggtgaaaccctgtctctactaaaaatacaaaaaattagctgggtgtgcacctataatcccagttacttgggaggctgaggcaggagaattgcttgaacccgggaggtggaggttgcagtgagcccagattgcaccactgcacttcagtctgggcaatggagtgagactccatctcaaaaaaaaaaagaaaaaggaaaagaaaaagaaaagcagaaagagaaacctagtaagttacataattcagcctaaaagttagaatgttagcttctggggaagttaagaccgtcataatttttttttycacttctgtatactaagaacctgaatgattcttagataacaatttggatttatttaatatttattaagtgaattatgaaatcagtgaataataaaaaagcatgtcacattttctattgctaaaaaagtaattttatataacatccatttctccaaataatatcctctctaatttaagatggataatgatgcctgatcttatttaagaaatgtattctattttgaagagcttaataaaaataattttgactcattataaacatggccaactccaactctcttttagccagttgtatcttta

SEQ ID NO: 103549 - DNA, 601 bp, Human
ggcatctgcctcctcactctcttgctcctattcttgccatgtgacgtgcctgcttccccttcgtcttctgccatgattgtaagtttcctgaggccctcaccagaagcagttgctagaactaggctggtgcagcctggaggaccttgagccaattaaacctcttttcttataaattgcccagcctcaggtatttctttacagtaatgcataaacaacctactacaccattggaccctgagattttgctgatggactgttcctactgaggcaattcctctcaattgttccttagctctctccmcagggaagcatcttaaaaccacatgatggcggggcacggtggctcacgcctgtaatcccagcactttgggaggctgaggcaggtggatcatgaggtcaggagatcgagaccatcctggctaacatggtgaaaccccgtctctactaaaaatacaaaaaattagccaggcatggtggcgggcgcctgtagtcccagctactcgggaggctgaggcaggagaatggcgtgaacccgggaggctgagcttacagtgagctgagattgcgccactgcactccagcatgggcgacagagcaagac

SEQ ID NO: 103550 - DNA, 601 bp, Human
ttcttgccatgtgacgtgcctgcttccccttcgtcttctgccatgattgtaagtttcctgaggccctcaccagaagcagttgctagaactaggctggtgcagcctggaggaccttgagccaattaaacctcttttcttataaattgcccagcctcaggtatttctttacagtaatgcataaacaacctactacaccattggaccctgagattttgctgatggactgttcctactgaggcaattcctctcaattgttccttagctctctccccagggaagcatcttaaaaccacatgatggyggggcacggtggctcacgcctgtaatcccagcactttgggaggctgaggcaggtggatcatgaggtcaggagatcgagaccatcctggctaacatggtgaaaccccgtctctactaaaaatacaaaaaattagccaggcatggtggcgggcgcctgtagtcccagctactcgggaggctgaggcaggagaatggcgtgaacccgggaggctgagcttacagtgagctgagattgcgccactgcactccagcatgggcgacagagcaagactccatctcaaaaaataaacaaacaacaaca

SEQ ID NO: 103551 - DNA, 601 bp, Human
agatgaggtttcaccatgttgaccaggatggtctcgatctcctgacctcatgatctgcccgcctcagtcacccgaagtgctgggattacaggcgtgagccaccgagcccggccacaatggcttttacttagtcaccattccattagcccctaatgagacagtcagcctgtcctttgaagttttgaggccaggcattgtcttctcctctgtctgggaaagtcctagatggcatcttcttccaatataaggatacttcatctatattgaaaatctattgtttagtgtagccaccttcataaaytatcttagctagatcttccagataacttgctgcagcttctgcatcagcacttgtttcttcactttgcagttttatgttatggaaacagcttctttccttaaacctcatgaaccagactctgctagcttccaactttttttctgcagctttctctcacctctcgtagccttcatagagttgaagagagttaagatcttgctctggactaagctttggcattaagaaatgtagctagtttgatcttctatccagaccactaaaactttctccagatcagcaataaggtggttttgctttctt

SEQ ID NO: 103552 - DNA, 601 bp, Human
ggaagggaagggaagggaagggaagggaagagaagggaagggaggggaagggaggggaagggaaggaggggaaggggaggggaggggaggagaggggaggggagggaatggagaggaaggaggggaagaaaggaaagaaaaggagaaaaagagaaagggagaaagaaagagaaggagaaaggggtgacaaagtggcagggagaaaggaaggaaagaagaggcagaaggctgtgtcaaaattgtcctgaaatcagttttgtctcttcttttaatttattggcaaacaaaccaacacagcaamtaactctatagcatatacagaatggaataggaggtgtttcctagaattggaaatgtgctaacactgttgttgttggcatgttatgcttttcaccaaagaatttagcaaaaattttaagaaggttaagttttatagaaccctcaccttagcctatttgaaactaagctgaccagatgacatagtgatgcaatttggtgtctatatccataataaccacatctgtcaaatgtgtattgtccgatattgttgcaacagtagaatttttgatgactctctggatttaattcatgcatcatttgg

SEQ ID NO: 103553 - DNA, 601 bp, Human
ttgttggcatgttatgcttttcaccaaagaatttagcaaaaattttaagaaggttaagttttatagaaccctcaccttagcctatttgaaactaagctgaccagatgacatagtgatgcaatttggtgtctatatccataataaccacatctgtcaaatgtgtattgtccgatattgttgcaacagtagaatttttgatgactctctggatttaattcatgcatcatttggatcttcgagatcattttatacacccaagttctttttgcaacatcaattgtaatgatttgtaccctctggtttttttttttttttttttgtaatcacaagggattgtacaatgtaatcttaatgttgaggatatgaagttattttttcttcaacctctttaaatattagcaactatttcacagatggtcttttcttaagcgatgtcattgatttaccagtgagagcagccaaatctcacttgggaaataatggtcaatgcctctcagtcatccataaatggagttgacctaatgctaaactaagctacaaggtaagagggccattgaagaaatttctaacacagatggtcaaatcaattcaaatattacac

SEQ ID NO: 103554 - DNA, 601 bp, Human
aggatatgcttgagatttcccacatttcaaaacttgtctttaaatgcaatttcttcatgcatgatgaataatcaaatatttacacctaataaacattccctacaacttttttttagcacaacaaaatacactatggtaatactattctccttaatgccaatggcacaacaacaaaaacgaaatcctggaaggaaagacttttactccaagtcaatttaaaacttccttattcattttaaatatttcattgcattaatttttcaaagcaacaaaacaaatattcatcaagtgaaactaagcrtgacccccctcagataggtacatctgttgctttcctgctgtatccctgaataattcattttaatacatttaaagtatacacttcattaaaacaagctacagtcatttacatataaaatgtacattgatgaaaacaaaaatgaaagctgttagaaagctgatcctaaaattttgttactccttgtgatttatatctagctgtctctgtctatttcctcctacaatgatggtataaaggcatctccacatcctctggcccattgggagctttagttatatcagcaaataggtgggaaaagtt

SEQ ID NO: 103555 - DNA, 601 bp, Human
aaatatttcattgcattaatttttcaaagcaacaaaacaaatattcatcaagtgaaactaagcatgacccccctcagataggtacatctgttgctttcctgctgtatccctgaataattcattttaatacatttaaagtatacacttcattaaaacaagctacagtcatttacatataaaatgtacattgatgaaaacaaaaatgaaagctgttagaaagctgatcctaaaattttgttactccttgtgatttatatctagctgtctctgtctatttcctcctacaatgatggtataaagrcatctccacatcctctggcccattgggagctttagttatatcagcaaataggtgggaaaagttagctggtatattttgatactcttttcccacagcctttgttcatcatggacaacttcatcaagatttatcgtcactgtttgtccattttagctccctctgctcacatcacataatagatgtaccatgtatactgaatggcatttaggaatcaaagccaacacagagaatactaatcagttttaacttcttgaaaattaatcaatttgtgctggtctgatacagtgcagggaaaaatat

SEQ ID NO: 103556 - DNA, 601 bp, Human
atccctgaataattcattttaatacatttaaagtatacacttcattaaaacaagctacagtcatttacatataaaatgtacattgatgaaaacaaaaatgaaagctgttagaaagctgatcctaaaattttgttactccttgtgatttatatctagctgtctctgtctatttcctcctacaatgatggtataaaggcatctccacatcctctggcccattgggagctttagttatatcagcaaataggtgggaaaagttagctggtatattttgatactcttttcccacagcctttgttcmtcatggacaacttcatcaagatttatcgtcactgtttgtccattttagctccctctgctcacatcacataatagatgtaccatgtatactgaatggcatttaggaatcaaagccaacacagagaatactaatcagttttaacttcttgaaaattaatcaatttgtgctggtctgatacagtgcagggaaaaatattcagttttattcactccctgcccttttgaactctgttaactgattatctaaatggttttcagaaaggccttaattttttttttttaccattatagcatttccccc

SEQ ID NO: 103557 - DNA, 601 bp, Human
ttatttaaagccatatcagaagccaaaactgtaatgtttcttatgttgacacagcaatgggggtcagttccaggttactaggagactccattgtggtttaactatgttactagtaccaaacttgaagaatcattgctttttttctttttttttttttgagacaaagtcttgctctgttgcccaggctggaatgcagtggtgtgatctctgctcactgcaacctctgcctcctgggctcaagcgattctcctgcctcagcctcctgagtagctagggttacaggcacccaccaccacacctractaatttttgtatttttagtagagatggcatttcaccatattggccaggctggtctcgaactcctgccctcaaatgatctgcccgcctcggcctcccaaagtgctgggattacaggcatgagcacctgaccagaatcattcctcttaatcttagcttcctggcttgagaaggaaaatccaaatatttcatttattttttcttcctcatttatgagctaagtttttctctgccataaaaggaaaaacattctaaggcaaattccttctcactgtattttttttatgacacacagtaaaat

SEQ ID NO: 103558 - DNA, 601 bp, Human
cagttccaggttactaggagactccattgtggtttaactatgttactagtaccaaacttgaagaatcattgctttttttctttttttttttttgagacaaagtcttgctctgttgcccaggctggaatgcagtggtgtgatctctgctcactgcaacctctgcctcctgggctcaagcgattctcctgcctcagcctcctgagtagctagggttacaggcacccaccaccacacctaactaatttttgtatttttagtagagatggcatttcaccatattggccaggctggtctcgaactmctgccctcaaatgatctgcccgcctcggcctcccaaagtgctgggattacaggcatgagcacctgaccagaatcattcctcttaatcttagcttcctggcttgagaaggaaaatccaaatatttcatttattttttcttcctcatttatgagctaagtttttctctgccataaaaggaaaaacattctaaggcaaattccttctcactgtattttttttatgacacacagtaaaatatggtcgccttctagaaatttctgctctttttctcatgtcttacaaagcataagtgggaagatt

SEQ ID NO: 103559 - DNA, 601 bp, Human
ttgctctgttgcccaggctggaatgcagtggtgtgatctctgctcactgcaacctctgcctcctgggctcaagcgattctcctgcctcagcctcctgagtagctagggttacaggcacccaccaccacacctaactaatttttgtatttttagtagagatggcatttcaccatattggccaggctggtctcgaactcctgccctcaaatgatctgcccgcctcggcctcccaaagtgctgggattacaggcatgagcacctgaccagaatcattcctcttaatcttagcttcctggcttgwgaaggaaaatccaaatatttcatttattttttcttcctcatttatgagctaagtttttctctgccataaaaggaaaaacattctaaggcaaattccttctcactgtattttttttatgacacacagtaaaatatggtcgccttctagaaatttctgctctttttctcatgtcttacaaagcataagtgggaagattctaggccttaaagactggcctgggttcaaattataccacttctctttaccagctctttcatcttaatttcctcatccataaaatcaggccattcatacctatat

SEQ ID NO: 103560 - DNA, 601 bp, Human
tttttgtatttttagtagagatggcatttcaccatattggccaggctggtctcgaactcctgccctcaaatgatctgcccgcctcggcctcccaaagtgctgggattacaggcatgagcacctgaccagaatcattcctcttaatcttagcttcctggcttgagaaggaaaatccaaatatttcatttattttttcttcctcatttatgagctaagtttttctctgccataaaaggaaaaacattctaaggcaaattccttctcactgtattttttttatgacacacagtaaaatatggtsgccttctagaaatttctgctctttttctcatgtcttacaaagcataagtgggaagattctaggccttaaagactggcctgggttcaaattataccacttctctttaccagctctttcatcttaatttcctcatccataaaatcaggccattcatacctatattttggggttgttgtgagaattacagcatatttgtatattcaataaatgggagctgctatcatatttattgacttttaggattaaattgtccacagcttccaacatctctttttcttcctttgaaactcccaaactatc

SEQ ID NO: 103561 - DNA, 601 bp, Human
ttcttcctcatttatgagctaagtttttctctgccataaaaggaaaaacattctaaggcaaattccttctcactgtattttttttatgacacacagtaaaatatggtcgccttctagaaatttctgctctttttctcatgtcttacaaagcataagtgggaagattctaggccttaaagactggcctgggttcaaattataccacttctctttaccagctctttcatcttaatttcctcatccataaaatcaggccattcatacctatattttggggttgttgtgagaattacagcatatwtgtatattcaataaatgggagctgctatcatatttattgacttttaggattaaattgtccacagcttccaacatctctttttcttcctttgaaactcccaaactatcatttgagagaccatatgtattttggatatttcacatcatgaatgtttagtcctggaaagtttgcttattttctctggtgtttttgtacctgtaacactcttgctctactgttaaaacctgacagcaagcctgagtataaaccaggagcccttaggaatatcagattaaggatcagcccaggaatctactttat

SEQ ID NO: 103562 - DNA, 601 bp, Human
ctatttataacatgctacttattttacttttagtctaaagccttgcatgtcaatatctagttagaagtaagtttggctgcgggtaaaattctgacagagaagagggacaggtgattggtggcctagtagagttagggcagtctgatataaatgaaaaaattaactagcatccggtgtagttgtaacatttataaaatgggagtgtgtatattcatacattttatccttattataagaccctttctgcccttaagatgcagcactctgaatggtgaatactaaaaacacagactcttgatckaggtgagggagttggaagaggcaggacaagaaaggacgttgactttctgaaaatgggacgaacggctttatctgaaagccctagtactatagctctctgatgggatcctatttgatactcacagcccgttaaggcaaaagagtaatgtccttcttgggcaaatgaagaagctgaggctcagggagaataaatgacatagccaagatcttggcaaatccctttcccttttcactagttatatggaatcagaaaacttaagttttagttttattctgccactttcttagggacttcaaatca

SEQ ID NO: 103563 - DNA, 601 bp, Human
aggacaagaaaggacgttgactttctgaaaatgggacgaacggctttatctgaaagccctagtactatagctctctgatgggatcctatttgatactcacagcccgttaaggcaaaagagtaatgtccttcttgggcaaatgaagaagctgaggctcagggagaataaatgacatagccaagatcttggcaaatccctttcccttttcactagttatatggaatcagaaaacttaagttttagttttattctgccactttcttagggacttcaaatcagtattttcacctgcataatgtaygataataacccgcggctatgcttatatttcctgggttattttttagattgaaattaagtggtgactctgaagatgcttcatgaaaatttcaaagtactgaataaatataaaacattatctaaatggcaaaatagaatacccagcttctgcccatccccatcacagcataatataaatagtttctattaagaggagatgtgtggacaaaggggtgttaaagacaaaagctaaaattcattggaatatctatcacctaccttaatatagtcacagtttgcaaactggttgtctttagtgttt

SEQ ID NO: 103564 - DNA, 601 bp, Human
tcccttttcactagttatatggaatcagaaaacttaagttttagttttattctgccactttcttagggacttcaaatcagtattttcacctgcataatgtatgataataacccgcggctatgcttatatttcctgggttattttttagattgaaattaagtggtgactctgaagatgcttcatgaaaatttcaaagtactgaataaatataaaacattatctaaatggcaaaatagaatacccagcttctgcccatccccatcacagcataatataaatagtttctattaagaggagatgwgtggacaaaggggtgttaaagacaaaagctaaaattcattggaatatctatcacctaccttaatatagtcacagtttgcaaactggttgtctttagtgtttaatagaatagagccaaaagatatattttatcaacacacattttatatatgtgtaatataacactatatattatatgtatactgttatatgtaatataacattagatatgtaaaatgtatgcatataatgtgtgatgaaatatatagacacacatacacacacacatttgaacactctcaagctacagaaaaattgaaag

SEQ ID NO: 103565 - DNA, 601 bp, Human
taaaacattatctaaatggcaaaatagaatacccagcttctgcccatccccatcacagcataatataaatagtttctattaagaggagatgtgtggacaaaggggtgttaaagacaaaagctaaaattcattggaatatctatcacctaccttaatatagtcacagtttgcaaactggttgtctttagtgtttaatagaatagagccaaaagatatattttatcaacacacattttatatatgtgtaatataacactatatattatatgtatactgttatatgtaatataacattagatawgtaaaatgtatgcatataatgtgtgatgaaatatatagacacacatacacacacacatttgaacactctcaagctacagaaaaattgaaagtgaagaataagaaacatatttttaaatcacctgagagcaagttactggtatggtatattctcaagaaactgcaattattgtaattattgtcaaatgagtaattataaagaatttaatcacatttaatttggcaatattttatgcatccagagtgcaaagtaggctatttcattcttctatctgtatttttttctaaactgcttctgata

SEQ ID NO: 103566 - DNA, 601 bp, Human
aatttataccaagttaagtcattttccctggactaccaggtttcatgtaaatcactttatacaagcagatttgacaaaacttggtattttaactgctgctctcaaaaaaatgtaagactgaaattatttgtgttctttttcttcaaagtggtctaggcatattcatgtttgctataaaactaaaagaaaaaaatgctgacaaatgaaatatatacataaatgtcagtgtagaagccattggtttagaagatcatttttaattgattagggaaattaacagaggaaaacagaatcacaaaayaggcccaaataatttataattagctctataatatatagacttatattctatttgctttaatgttttttgaatacatgccaagtaactcagaggtaccttgagcttggcaaatggcaaaaaagaaccctttatgtattttaagatggataacagaggctaaaaattatatacactatgtgccaatcattgagattcaactctacttttttaatactcttaagaaatgataaaatctgattttatgacacaaagcctatacttctaacactctgagctctgtatgtttttaaaaaatgctgc

SEQ ID NO: 103567 - DNA, 601 bp, Human
ggaaaacagaatcacaaaataggcccaaataatttataattagctctataatatatagacttatattctatttgctttaatgttttttgaatacatgccaagtaactcagaggtaccttgagcttggcaaatggcaaaaaagaaccctttatgtattttaagatggataacagaggctaaaaattatatacactatgtgccaatcattgagattcaactctacttttttaatactcttaagaaatgataaaatctgattttatgacacaaagcctatacttctaacactctgagctctgtrtgtttttaaaaaatgctgccatatcttactatttatttctggaaaccagaaataggctagtcgttcttggaaatttcactctatttctaatttcttccttgtcaaaaagtcagtttgttcacattcagagcataaatgaaacctcaatttgcataatgccttaaataaatgtcaaaatgaatctgtgattttttctgatgtataaataaagatactagttgctttaaacggtttaatcaataacacagcttaccacagtttaccatgctttctgggcaaagaatctgcgtgtacgtgtgt

SEQ ID NO: 103568 - DNA, 601 bp, Human
tttatgtattttaagatggataacagaggctaaaaattatatacactatgtgccaatcattgagattcaactctacttttttaatactcttaagaaatgataaaatctgattttatgacacaaagcctatacttctaacactctgagctctgtatgtttttaaaaaatgctgccatatcttactatttatttctggaaaccagaaataggctagtcgttcttggaaatttcactctatttctaatttcttccttgtcaaaaagtcagtttgttcacattcagagcataaatgaaacctcartttgcataatgccttaaataaatgtcaaaatgaatctgtgattttttctgatgtataaataaagatactagttgctttaaacggtttaatcaataacacagcttaccacagtttaccatgctttctgggcaaagaatctgcgtgtacgtgtgtgtgtgtgtgtgtgtgtgtgtgtgtgtgtgtggcaaaattctgttgaaattcccagtgatatgtactgaatgagtttaattccctattctgaaactactactactagtattttttaaattatctgttctgtgtttgaataaggttaga

SEQ ID NO: 103569 - DNA, 601 bp, Human
tctgtatgtttttaaaaaatgctgccatatcttactatttatttctggaaaccagaaataggctagtcgttcttggaaatttcactctatttctaatttcttccttgtcaaaaagtcagtttgttcacattcagagcataaatgaaacctcaatttgcataatgccttaaataaatgtcaaaatgaatctgtgattttttctgatgtataaataaagatactagttgctttaaacggtttaatcaataacacagcttaccacagtttaccatgctttctgggcaaagaatctgcgtgtacttgtgtgtgtgtgtgtgtgtgtgtgtgtgtgtgtgtggcaaaattctgttgaaattcccagtgatatgtactgaatgagtttaattccctattctgaaactactactactagtattttttaaattatctgttctgtgtttgaataaggttagatttctaagtttaatcatgcattgcataacaacctcttggttaatgatggactgtgtatatgatggcggtctcatcgtattataatggagctgaaacatttctattgtctactaacactgaagtcatcctaatgtcctagcacaatgct

SEQ ID NO: 103570 - DNA, 601 bp, Human
gtcttagtttttaacagaaaagtttaaacagtataaatactaattttaaaaatagaaaaccaccttatggaataaggatattaagaaaatttttttgtacagctgtacaatgtgtttgtgttttaagctaaatgtgattactaaagagtcaaaatttaaaaagattaagtttataaactaaaaaagttacagtgagctaagtttattgttaaagagagaaaaatatgttttataaattaaatgcagcctaagtatacagtagtatacagtaatgttctaagccttcacattcactcaccaygcactcactgactaacctggaacaactttcagttttgcaagctgcattcctggtaagtaccctatacaggggtgccatttttaatactttgtaacatatttttgctgtactgttttgtgttttccacactaatttttgttcaaaatatttgagaagaatgaaaagtagcttgttctttttcattccagagcataattgatttttaaaaacctatttgatgcatgaaccatatttcccttctcagagaactcgaaacctacaggtaaaacaagaacctcagaaaaagaacccagacaaaaa

SEQ ID NO: 103571 - DNA, 601 bp, Human
atgttttcattgacagcactatgatcagtggaaaaaaaaaaaaaagatcctgttaaaatacctaagtcttacttttgtttctttaatcatgggcaccctttatgtgtgtgcatgttaaaccagattagcatttgcgcatgcacatgtatgtatatctttttattttaggtgagacaataaatcactgatatattagtaacggggccttcaactatgtcaatacttctgccaatgccaattttcattactaatattaaattttatcatatatttgattgataaatgtttgttttttgtttgycttaatagaaggcaaacagtttatttcagagcttacatcttttgctcttgcaaggctgtcactatcttctcacagatttttttttaggaattaggagaaagtacctgtttctgagcaatcctctcaaaagtctgatgactatgatgattaacagtacagactgatatttcctgtgaaggcagcagtttaggccgaaatgctttctaatgtatgaagaaaataactttcagtttaggaattttagaggaaggaaaaaaatcacttaagcagcatctgtttcaagtaaaaattctgttgcta

SEQ ID NO: 103572 - DNA, 601 bp, Human
cttgcaaggctgtcactatcttctcacagatttttttttaggaattaggagaaagtacctgtttctgagcaatcctctcaaaagtctgatgactatgatgattaacagtacagactgatatttcctgtgaaggcagcagtttaggccgaaatgctttctaatgtatgaagaaaataactttcagtttaggaattttagaggaaggaaaaaaatcacttaagcagcatctgtttcaagtaaaaattctgttgctaccaccccaccatcatggtccttaaattttcttttcattgattagatrttttcaaattttgttttacttcattttactattatattgatccggtgttttaaggaatttgcttgcattcttatcaaggaagcatcgttttcaatttaaataggtcattatggttagaaatctaaagaaatagcatagttcattatagtatacgctttgttaatagaagtaattattttcatccttattataatttgacacaatgtttcctttaaaaaacagtgatcttagaaaatactttaggtggataagaacaagagacatgatgagtaatatctaattagaggtaggtgacctttt

SEQ ID NO: 103573 - DNA, 601 bp, Human
ttaggaattttagaggaaggaaaaaaatcacttaagcagcatctgtttcaagtaaaaattctgttgctaccaccccaccatcatggtccttaaattttcttttcattgattagatattttcaaattttgttttacttcattttactattatattgatccggtgttttaaggaatttgcttgcattcttatcaaggaagcatcgttttcaatttaaataggtcattatggttagaaatctaaagaaatagcatagttcattatagtatacgctttgttaatagaagtaattattttcatccwtattataatttgacacaatgtttcctttaaaaaacagtgatcttagaaaatactttaggtggataagaacaagagacatgatgagtaatatctaattagaggtaggtgaccttttaagctctaacaacattctctacatctccagttataaatttttatttctaacttaagaaattaaactaattatgtattatggagggaatattagatccttatatgtcagtgcagcttatttctaattaatggatggttgaaatcttcaaactaccttggacctatttggcatttgaggaatctcct

SEQ ID NO: 103574 - DNA, 601 bp, Human
agcatcgttttcaatttaaataggtcattatggttagaaatctaaagaaatagcatagttcattatagtatacgctttgttaatagaagtaattattttcatccttattataatttgacacaatgtttcctttaaaaaacagtgatcttagaaaatactttaggtggataagaacaagagacatgatgagtaatatctaattagaggtaggtgaccttttaagctctaacaacattctctacatctccagttataaatttttatttctaacttaagaaattaaactaattatgtattatgsagggaatattagatccttatatgtcagtgcagcttatttctaattaatggatggttgaaatcttcaaactaccttggacctatttggcatttgaggaatctcctttcagatgacatttcaaatgcacatataaacacacgtacacatatgcatatgtgtgcatagaattgatattgtgaaccacacaatggaatgtgctgtaggaaatctctcaccttctaaagccaagtgacaaatgaaaaggaaaatgccaaaggattttgcaatttgaaacagagtgctaaaataaggatgcattga

SEQ ID NO: 103575 - DNA, 601 bp, Human
aatgtgctgtaggaaatctctcaccttctaaagccaagtgacaaatgaaaaggaaaatgccaaaggattttgcaatttgaaacagagtgctaaaataaggatgcattgatgaggttatggtgtaacacattcatggtgtaacacatgtatacatatatgtgtatgtgtgtttccatacatttttattctaagacaaataccatagtaataattaaagtaattatatttctcttaacactcttgaaagcttttttccaagtaacaggttcatgatatactgagctattttttgttacatttygtttttacaacatactaatattgatttatttgttagacaccaatagaaaacgcaccaaagtaataacaaagtctctcctagtagagaagcctattacttacttttgatgtatgtatattttcccaaactcatttctttggtaatgaacattgtctccataaaattgcattatcgaatagtttgtggaggactactgttgtggcatctgatcccagcataattctttctctcttttaagtctaaatttaagtctaaatcctgtggtactggtgttggggtaaaaaagaaggaagaaaggaa

SEQ ID NO: 103576 - DNA, 601 bp, Human
acagagtgctaaaataaggatgcattgatgaggttatggtgtaacacattcatggtgtaacacatgtatacatatatgtgtatgtgtgtttccatacatttttattctaagacaaataccatagtaataattaaagtaattatatttctcttaacactcttgaaagcttttttccaagtaacaggttcatgatatactgagctattttttgttacattttgtttttacaacatactaatattgatttatttgttagacaccaatagaaaacgcaccaaagtaataacaaagtctctcctartagagaagcctattacttacttttgatgtatgtatattttcccaaactcatttctttggtaatgaacattgtctccataaaattgcattatcgaatagtttgtggaggactactgttgtggcatctgatcccagcataattctttctctcttttaagtctaaatttaagtctaaatcctgtggtactggtgttggggtaaaaaagaaggaagaaaggaaaatattttcagtccctgggaacatgagggcatttttttctctctcaggtggtgtaatcttcaggtaatcgctgaagactgg

SEQ ID NO: 103577 - DNA, 601 bp, Human
atttatttgttagacaccaatagaaaacgcaccaaagtaataacaaagtctctcctagtagagaagcctattacttacttttgatgtatgtatattttcccaaactcatttctttggtaatgaacattgtctccataaaattgcattatcgaatagtttgtggaggactactgttgtggcatctgatcccagcataattctttctctcttttaagtctaaatttaagtctaaatcctgtggtactggtgttggggtaaaaaagaaggaagaaaggaaaatattttcagtccctgggaacakgagggcatttttttctctctcaggtggtgtaatcttcaggtaatcgctgaagactggggctctccttggggctctctagtgtggtcttttggagctgctccacttcacagttccatgacctgcaagagtcatctccagatccacctgtactggctcagctaccatcctggggcacgcctggaagcccacacggcctctggcagctgtccaataagcagccttcttaactgctgtacagcaggacagtctagactggctctcttctgtgatgctcactacatttattctacaaatattttg

SEQ ID NO: 103578 - DNA, 601 bp, Human
taagtctaaatttaagtctaaatcctgtggtactggtgttggggtaaaaaagaaggaagaaaggaaaatattttcagtccctgggaacatgagggcatttttttctctctcaggtggtgtaatcttcaggtaatcgctgaagactggggctctccttggggctctctagtgtggtcttttggagctgctccacttcacagttccatgacctgcaagagtcatctccagatccacctgtactggctcagctaccatcctggggcacgcctggaagcccacacggcctctggcagctgtccartaagcagccttcttaactgctgtacagcaggacagtctagactggctctcttctgtgatgctcactacatttattctacaaatattttgaacaccttctataagctgggttctattctaggttcttgagattcattagtgcaaagccacaaaaaacccttgctctcatggagtctacattctaaggtctcataggaaacacatgtaactttaccatgctgaagagaaggcatgaggctgcttcaaaacttgttccctctcccccattattccctccagtttttttctctcctgctaaatt

SEQ ID NO: 103579 - DNA, 601 bp, Human
tctaggttcttgagattcattagtgcaaagccacaaaaaacccttgctctcatggagtctacattctaaggtctcataggaaacacatgtaactttaccatgctgaagagaaggcatgaggctgcttcaaaacttgttccctctcccccattattccctccagtttttttctctcctgctaaattatacattgctcagataatcaaatgcccacactaagcagatgtccaactagtgattcagatctctgtgtctgcttctcaaaggtacccctaaatcttttgtccattaggataaagaygagtgacctcaaaaatgttctttttttctcacttccccagacttcctgcattgatttggagttaggttgaggagctaaccatggttgctggtgattgctgagggtatgctctgccgtttcttaggaagttgtggaagatattggtctttttgtgaatatgtatgacactattcatttcctccccagatttgggctctacatgtcaatccctgtggaattgaaaaagtcatgatactttgttgtaagtccatatattatgatagaaatagacataagatgttaaagtgggacttcttaaag

SEQ ID NO: 103580 - DNA, 601 bp, Human
tgttccctctcccccattattccctccagtttttttctctcctgctaaattatacattgctcagataatcaaatgcccacactaagcagatgtccaactagtgattcagatctctgtgtctgcttctcaaaggtacccctaaatcttttgtccattaggataaagatgagtgacctcaaaaatgttctttttttctcacttccccagacttcctgcattgatttggagttaggttgaggagctaaccatggttgctggtgattgctgagggtatgctctgccgtttcttaggaagttgtgraagatattggtctttttgtgaatatgtatgacactattcatttcctccccagatttgggctctacatgtcaatccctgtggaattgaaaaagtcatgatactttgttgtaagtccatatattatgatagaaatagacataagatgttaaagtgggacttcttaaagtggggtttcaagttccactgagatattgacaggacagttaggatccaaagtgagtgtgagtcagatgtcctcccctccctaacatgtggaattacagtgaaaattgttccaagaatgtgataaaatttttggat

SEQ ID NO: 103581 - DNA, 601 bp, Human
gttcaatgagatggtagaacatataaataaattgcattgtcattatactttgcttattgatttttcagcttactaatcatatgtgcatctgtgtatgcatatcacagatgtacaacgcacacacatatgcatatataaaatattatatattatatattgctgtagtacctgttattttcatccagtagtgtatcatgaacttctttacataaatatatgcattttaatgtttcatttgtcatgatatttaactaatacccttttattagacataaatgatgtttccggttttctatattawgaataaggctgtgagaaacatacctgtggctacaccttttcataggcccttaactaattgcttaggataaatttcttaaggccattctttttttcaatattttatgggtcatcatacatgcctaagtcataatgtggtaaatattttacaaccaatcctggaacattttattcatataaaaatagcatttccataagattcttggcaaaatagctccaaaaaggcatgagttaggatgttttactaagaaagtactgatgcctgataaaactatgatgtgctgtacagagcttcaaaatt

SEQ ID NO: 103582 - DNA, 601 bp, Human
aatatatgcattttaatgtttcatttgtcatgatatttaactaatacccttttattagacataaatgatgtttccggttttctatattaagaataaggctgtgagaaacatacctgtggctacaccttttcataggcccttaactaattgcttaggataaatttcttaaggccattctttttttcaatattttatgggtcatcatacatgcctaagtcataatgtggtaaatattttacaaccaatcctggaacattttattcatataaaaatagcatttccataagattcttggcaaaayagctccaaaaaggcatgagttaggatgttttactaagaaagtactgatgcctgataaaactatgatgtgctgtacagagcttcaaaattggtatctcttttggcttaggattgacttggcgatgcgggctcttttttggttccatatgaactttaaagtagttttttccaattctgtgaagaaagtcattggtagcttgatggggatggcattgcatctgtaaattaccttgggcagtatggccattttcacgatattgattcttcctacccatgagcatggaatgttcttccatttgtt

SEQ ID NO: 103583 - DNA, 601 bp, Human
gtcataatgtggtaaatattttacaaccaatcctggaacattttattcatataaaaatagcatttccataagattcttggcaaaatagctccaaaaaggcatgagttaggatgttttactaagaaagtactgatgcctgataaaactatgatgtgctgtacagagcttcaaaattggtatctcttttggcttaggattgacttggcgatgcgggctcttttttggttccatatgaactttaaagtagttttttccaattctgtgaagaaagtcattggtagcttgatggggatggcattgmatctgtaaattaccttgggcagtatggccattttcacgatattgattcttcctacccatgagcatggaatgttcttccatttgtttctatcctcttttttttcgttgagccgtggtttgtagttctccttgaagaggtccttcacatcccttataagttggattcctaggtattttactctctttgaagcaattgtgaatgggagttcactcatgatttggctctctgtttgtctgttgttggtgtataagaatgcttgtgatttttgtacattgattttgtatcctgagactttgctga

SEQ ID NO: 103584 - DNA, 601 bp, Human
agttaggatgttttactaagaaagtactgatgcctgataaaactatgatgtgctgtacagagcttcaaaattggtatctcttttggcttaggattgacttggcgatgcgggctcttttttggttccatatgaactttaaagtagttttttccaattctgtgaagaaagtcattggtagcttgatggggatggcattgcatctgtaaattaccttgggcagtatggccattttcacgatattgattcttcctacccatgagcatggaatgttcttccatttgtttctatcctcttttttttsgttgagccgtggtttgtagttctccttgaagaggtccttcacatcccttataagttggattcctaggtattttactctctttgaagcaattgtgaatgggagttcactcatgatttggctctctgtttgtctgttgttggtgtataagaatgcttgtgatttttgtacattgattttgtatcctgagactttgctgaatttgcttatccgcttaaggagattttgggctgagacaatggggttttctagatatacaatcatgtcgtctgcaaacagggacaatttgacttcctcttttcc

SEQ ID NO: 103585 - DNA, 601 bp, Human
ctcataaaatgagttagggaggattccctctttttctattgattgaaatagtttcagaaggaatggtaccagttcctccttgtacctctggtagaattcggctgtgaatccatctggtcctggactctttttggttggtaagctactgattattgccacaatttcagctcctgttattggtctattcagagattcaacttcttcctggtttagtcttgggagagtgtatgtgttgaggaatttatccacgtgcacattgtgcacatgtaccctaaaacttaaagtataataataataaatktaaaaaaaattggtatctcattttccatcttttatggaccactttctagggaacagtaagagcctggaaaataactaatgctaatttaggaagacagatatttaacacatggccctctcatctgctcttccttgccatatataaagttacagaatgagtgtttccttgaaaaatctaagaggatgcatctcttggaggaactgatgtttggaaaaagacatcctgaggaggaggggaacaacaccactgtaatgacaaagaagtctatccaggcacaattgattgaacattagcttacct

SEQ ID NO: 103586 - DNA, 601 bp, Human
ttattgccacaatttcagctcctgttattggtctattcagagattcaacttcttcctggtttagtcttgggagagtgtatgtgttgaggaatttatccacgtgcacattgtgcacatgtaccctaaaacttaaagtataataataataaatttaaaaaaaattggtatctcattttccatcttttatggaccactttctagggaacagtaagagcctggaaaataactaatgctaatttaggaagacagatatttaacacatggccctctcatctgctcttccttgccatatataaagttwcagaatgagtgtttccttgaaaaatctaagaggatgcatctcttggaggaactgatgtttggaaaaagacatcctgaggaggaggggaacaacaccactgtaatgacaaagaagtctatccaggcacaattgattgaacattagcttaccttcattttctttctccctaacacactctgaagggacctggtgtctcatcttcaactgcagcacaagataagagcacatttagttgccactttactttagatgcaggaaccagcattgaccctggtcatttaagatcattcctacatttct

SEQ ID NO: 103587 - DNA, 601 bp, Human
ttagatgcaggaaccagcattgaccctggtcatttaagatcattcctacatttctaggtttcttatctgcactcgagcttccatgcacacccaaaaccttagatatcacccatgtcaaataccctgcagcaattattatttatagtcacctcttttagaacttcgaagacttaaaaccatagttatatctcattttattttctcttagctttcacatttcaccctaggaaacaatatactataatgtttaagagtatgggctctggagtaacatctggttagaagttgaaggcaatccctytatacctcagtttgttcttttttataatagggttaaaattaaaattaggaacagggggttgtcaacaagtgggtaaagaaaatgtggtatatatacaccatggaataatactcagtcataaaaaggaatgaaataatgtcttttgcagcaactcgaatgcagctggaggcgattattctaagtgaagtaactcaggaatggaaaaccaaatatcctttgttctcacttataagtgggagctaagctatgaggatgcaaaggcataaaaatgatataatggacttcgaggactcaaggagg

SEQ ID NO: 103588 - DNA, 601 bp, Human
taaaaaggaatgaaataatgtcttttgcagcaactcgaatgcagctggaggcgattattctaagtgaagtaactcaggaatggaaaaccaaatatcctttgttctcacttataagtgggagctaagctatgaggatgcaaaggcataaaaatgatataatggacttcgaggactcaaggagggagaagggtgggagggggtaagggataaaagactacacattgggtatagtgtacactgcttgggtgatgggtgcaccaaaatctcagaaatcaccactgaagaacttatccatgtaacsgaaaagcacctgtactccaaaaactattgaaataaaaataaaaaggaaaaaaaaaagaagagagggttatgagtattgaattgagtagtatattagctgttactgtagcaattattggctacttgccatatctcagtaaacattaatttttagtaatttcatagtccagtttggtggatgtatagggagtatggattctaattcacacctacatgctgaaattcagacctttctgacatatggtttgacctctttaagggcctctcagtcttttactggaccctcttctttccagttaac

SEQ ID NO: 103589 - DNA, 601 bp, Human
cagcaactcgaatgcagctggaggcgattattctaagtgaagtaactcaggaatggaaaaccaaatatcctttgttctcacttataagtgggagctaagctatgaggatgcaaaggcataaaaatgatataatggacttcgaggactcaaggagggagaagggtgggagggggtaagggataaaagactacacattgggtatagtgtacactgcttgggtgatgggtgcaccaaaatctcagaaatcaccactgaagaacttatccatgtaaccgaaaagcacctgtactccaaaaactaytgaaataaaaataaaaaggaaaaaaaaaagaagagagggttatgagtattgaattgagtagtatattagctgttactgtagcaattattggctacttgccatatctcagtaaacattaatttttagtaatttcatagtccagtttggtggatgtatagggagtatggattctaattcacacctacatgctgaaattcagacctttctgacatatggtttgacctctttaagggcctctcagtcttttactggaccctcttctttccagttaacagacaaaggaagagacaaaacacagaa

SEQ ID NO: 103590 - DNA, 601 bp, Human
ccatatctcagtaaacattaatttttagtaatttcatagtccagtttggtggatgtatagggagtatggattctaattcacacctacatgctgaaattcagacctttctgacatatggtttgacctctttaagggcctctcagtcttttactggaccctcttctttccagttaacagacaaaggaagagacaaaacacagaagactgcccgattagcaaagccaaaaagtcatgtgcatccccctgtgcgcgcacacacagacacacacagacacacacacacacacacacacacacacayatttcactggacagacctccatcatatgacccactcccctacatgcaggtgagctgggaaatgtaatctggttgtatgcccaagagaaacacaacacagatgttggtgaacatttcagcaagcctctgctgttattatcatttggatataaaaccaactttttttttgttaattggcacaacctctaagcattcttcctttgattgttatttgctctgttgaagttcaatgcagccaagcccagaaatcaaaggttcttctggtgcttagaaaccctttaatataaatatattattatcg

SEQ ID NO: 103591 - DNA, 601 bp, Human
catatctcagtaaacattaatttttagtaatttcatagtccagtttggtggatgtatagggagtatggattctaattcacacctacatgctgaaattcagacctttctgacatatggtttgacctctttaagggcctctcagtcttttactggaccctcttctttccagttaacagacaaaggaagagacaaaacacagaagactgcccgattagcaaagccaaaaagtcatgtgcatccccctgtgcgcgcacacacagacacacacagacacacacacacacacacacacacacacacatttcactggacagacctccatcatatgacccactcccctacatgcaggtgagctgggaaatgtaatctggttgtatgcccaagagaaacacaacacagatgttggtgaacatttcagcaagcctctgctgttattatcatttggatataaaaccaactttttttttgttaattggcacaacctctaagcattcttcctttgattgttatttgctctgttgaagttcaatgcagccaagcccagaaatcaaaggttcttctggtgcttagaaaccctttaatataaatatattattatcga

SEQ ID NO: 103592 - DNA, 601 bp, Human
acagacaaaggaagagacaaaacacagaagactgcccgattagcaaagccaaaaagtcatgtgcatccccctgtgcgcgcacacacagacacacacagacacacacacacacacacacacacacacacatttcactggacagacctccatcatatgacccactcccctacatgcaggtgagctgggaaatgtaatctggttgtatgcccaagagaaacacaacacagatgttggtgaacatttcagcaagcctctgctgttattatcatttggatataaaaccaactttttttttgttaaytggcacaacctctaagcattcttcctttgattgttatttgctctgttgaagttcaatgcagccaagcccagaaatcaaaggttcttctggtgcttagaaaccctttaatataaatatattattatcgaggcttataatgtgaagttctttacatttttgcataaaaagtgacccatagaaaatagtcattttcaaacacagaaaacttttgtgagtcaaaacagttggcacagagtacttaagacatgcttgatcccaactggcacctaagtagataaaaacaaataggttgggtgtggt

SEQ ID NO: 103593 - DNA, 601 bp, Human
acacacagacacacacagacacacacacacacacacacacacacacacatttcactggacagacctccatcatatgacccactcccctacatgcaggtgagctgggaaatgtaatctggttgtatgcccaagagaaacacaacacagatgttggtgaacatttcagcaagcctctgctgttattatcatttggatataaaaccaactttttttttgttaattggcacaacctctaagcattcttcctttgattgttatttgctctgttgaagttcaatgcagccaagcccagaaatcaaasgttcttctggtgcttagaaaccctttaatataaatatattattatcgaggcttataatgtgaagttctttacatttttgcataaaaagtgacccatagaaaatagtcattttcaaacacagaaaacttttgtgagtcaaaacagttggcacagagtacttaagacatgcttgatcccaactggcacctaagtagataaaaacaaataggttgggtgtggtggctcacgactgtaattccagcactttgggagacccaggagggtggatcacgaggtcaggagttcgagaccagcctggcc

SEQ ID NO: 103594 - DNA, 601 bp, Human
gctatactctatgttaggtcagatgtttttataacaaattgtccttaacactatgttcaatgtttcagcaatcttctaatttagatttacatatacaaagatatataaatgaatataggtataatgagaaagatatataattaaccagtgttacattcgacattgtgttgtctaaatgacacatgagaagcttatttaatattcaaattctatatttttcactgaaaatcttaacttcaatcaataactagtaaatgacctaagaagttgtgtaacttttctcttctactgacagtatacmgcattgttttttctcctttcatttagttactattttaaaatttttcttctttaataagtaaaatacaattctattttttttcaaaactgtgagacgatgtttttttacattttttgtccatgtgtgtattttttctattagttctcaataatttatataatttttttagttgtcgtttgatattgcttgaccccactgagagaatttctcaataattcaggcttgatacattgttatcaacaatgtctttataaaatgttttattgttgattatgataatctttaaacacaaatgttgtg

SEQ ID NO: 103595 - DNA, 601 bp, Human
ggatagtgttcattttattcaaacttagctatttataaactcagaatacaagtatccccttttgccctaagatattttctgtcactaattaggttttgctttgcaagattatatcattcaaagtccttttcctgttactcaggtaaactgtcattggatagacagttcaaagtgttactttgtaaactaattaatgcacgtggtgctacaaaattccaagaatacaagaaagtccacaataaaaagtaattctccctgggcatggtagcaggtgcctaaaacccagctactccagagaccrgagactgaggtggtgggaggattgcttgagcccagaagattgcgaccaacctgggcaacaaagcaagatcccgtctcaataaacaaaccaaccttgctccagtttccctcctgggaagcaaccattgttatcagattcttcaaccctctactagagatactgattgcctagaatggtcctgttttatgactggaatacactggcttcctatagaagtgcaaatgtgaatccaagttcatatatccccttgctgtttttctgcccaaatggaattcattatccaaacagccaagtatacat

SEQ ID NO: 103596 - DNA, 601 bp, Human
caaggtaatggtattaagatgcagtgcctttggaaggtgaattggacatgagggtggagcatgcatgaatgggattaatgtccttatgaaagagttctgagggagcttatttgcctttcccccatgtgatgaccctgtgagatggtgccatctgtgagaaagtgggcctcatcagacactgaatctgctactgcctccatcttggacttcctagcctcaataaccacaataaataaatttctgttgtttataagccacccagcttattgttatagcagccaaaatggactaagacaatagycttcacaaaagagtcacatcttttaaaaaatacaaatcagatcacaactcctttgtgtaaatctgttctcaacttcccattgtttttcctataaaatccagatcctaatcaaggtgagttatgttcaccaattttttctttattataaccacttcacagcaattgcagcattagaaattttatctctgatggaagttaatatcaacacatctactgatggtgagggttatatgtgtacaaacttggaaattagtttccagttgtaaacctatataacaaattccaatgaaatctagctca

SEQ ID NO: 103597 - DNA, 601 bp, Human
tattctaagattaggcactaatgttaactaattattaatgatattaataatcaaatctatttcaaggaattctgagaataaataagaaagtgtttagaaagcactacgtcttctacatgtagtaaacatccagtgtttctttttatgttattttgcattttcttattcttatacttgtcatgataataaatgattcctttgaaagcttttgaaagataaatgctctttttccattttggtatgagtcgatagggtcattaagtctccaagtggcttgtcagtgttatatactgatggcatrtatatcaatgattagatggctatgaaaatgaattttagttttagttattactatagatattttaatttgcattaataacattacttaaaatgctgcttgcaacttatgcctttataagctgtgagtctcctatagcaattgttcactataaaatctcatgcttcctcccatgcagactttacacactgtattttttatcagaaatatccttttttatgtatttctacaagatgaaattcagtatatccttcagtgccacattaattatgcctcttccatgaagacttctcttcttatcgc

SEQ ID NO: 103598 - DNA, 601 bp, Human
aactaattattaatgatattaataatcaaatctatttcaaggaattctgagaataaataagaaagtgtttagaaagcactacgtcttctacatgtagtaaacatccagtgtttctttttatgttattttgcattttcttattcttatacttgtcatgataataaatgattcctttgaaagcttttgaaagataaatgctctttttccattttggtatgagtcgatagggtcattaagtctccaagtggcttgtcagtgttatatactgatggcatgtatatcaatgattagatggctatgraaatgaattttagttttagttattactatagatattttaatttgcattaataacattacttaaaatgctgcttgcaacttatgcctttataagctgtgagtctcctatagcaattgttcactataaaatctcatgcttcctcccatgcagactttacacactgtattttttatcagaaatatccttttttatgtatttctacaagatgaaattcagtatatccttcagtgccacattaattatgcctcttccatgaagacttctcttcttatcgccatctattaggatctctccctaatt

SEQ ID NO: 103599 - DNA, 601 bp, Human
tctttttatgttattttgcattttcttattcttatacttgtcatgataataaatgattcctttgaaagcttttgaaagataaatgctctttttccattttggtatgagtcgatagggtcattaagtctccaagtggcttgtcagtgttatatactgatggcatgtatatcaatgattagatggctatgaaaatgaattttagttttagttattactatagatattttaatttgcattaataacattacttaaaatgctgcttgcaacttatgcctttataagctgtgagtctcctatagcmattgttcactataaaatctcatgcttcctcccatgcagactttacacactgtattttttatcagaaatatccttttttatgtatttctacaagatgaaattcagtatatccttcagtgccacattaattatgcctcttccatgaagacttctcttcttatcgccatctattaggatctctccctaatttaacgtataactcttgtgttatttttaccttttgactgtatattctggttagctactgtattagtcttctattggtgtaacaaactaccacaaactgggtggcttaaaacaa

SEQ ID NO: 103600 - DNA, 601 bp, Human
ggcatgtatatcaatgattagatggctatgaaaatgaattttagttttagttattactatagatattttaatttgcattaataacattacttaaaatgctgcttgcaacttatgcctttataagctgtgagtctcctatagcaattgttcactataaaatctcatgcttcctcccatgcagactttacacactgtattttttatcagaaatatccttttttatgtatttctacaagatgaaattcagtatatccttcagtgccacattaattatgcctcttccatgaagacttctcttctyatcgccatctattaggatctctccctaatttaacgtataactcttgtgttatttttaccttttgactgtatattctggttagctactgtattagtcttctattggtgtaacaaactaccacaaactgggtggcttaaaacaacataatcttaatatctgacaattccttaggttaaaagcctgaaatggctctcacagggctgtcaccagggctgcattcttttctggatgctccaggagataatctaattacttaactttttcagtttcttgaaatcacctacatttcttagatcatag

SEQ ID NO: 103601 - DNA, 601 bp, Human
gaatggaggaacagcatagcacagaactgttcagctaccaacctaaatctattagccgtgctgtcctggaaatcacttttcagccacacaaaatttcactggccctatatcccaaggagccctgagttgccactataccgtagactcctctctccgtctggtggctctttccttccccttttttagatatataccttcaacttgaacctttttgttagtattatattattctttattttgttttaacataaaggggccactggacaatatttgttcagatcacttatgtgtactgctcagytgatatgcacatttactcttctgaaactgtttagcattaagtaacttagaacataaaaaacaatgcaacaagcatattatcttctattttttcccaaatcctttgtgatgtaagaggacagaacacatatatacatatcttttctacaaatggattatcaacattgttctcaacattacctagttccttaaataagaaatatatattttaaaatttgtatggcattcaaagagttacaattatgaatttcacatttctctagatgggtattaaacaatctttggcagatcacagactaag

SEQ ID NO: 103602 - DNA, 601 bp, Human
ccatcaagaggagaatgcctctgctaagaggaattatctatttacactgcattgcagtcccatttctcatgcatagatctgtagcatatttggctaaaacttgcagaattattatgtcgcttcctgtccctctatccctactcactactttgttcaagggaattaataaaaaaaaaaattgccttattttggagctgtttgcgaaagtcttgttatttcagttaaagagaacactattttgttagcaagccattctgtttctttgggctacatttctatatacttatcagctaattatatmgtgcagatatttttagtgggaggtagtcttttttttttgtccacttgtgacttctgccttgagacatttttgataaaattgtgctggggtcaagttgaaaaggaatgttttcctacattaaaaattttaattttaaagcaatttgactaaacatatcggtgatcataaaaataaagtcaaggtttaattcaaaacagaacattttagtttgtgtatagaaaaactttattttggagcagatatcaaggagacaaccaacagaataccgtcttcaactcttcgtttgttcacaaataaact

SEQ ID NO: 103603 - DNA, 601 bp, Human
atgtcgcttcctgtccctctatccctactcactactttgttcaagggaattaataaaaaaaaaaattgccttattttggagctgtttgcgaaagtcttgttatttcagttaaagagaacactattttgttagcaagccattctgtttctttgggctacatttctatatacttatcagctaattatatagtgcagatatttttagtgggaggtagtcttttttttttgtccacttgtgacttctgccttgagacatttttgataaaattgtgctggggtcaagttgaaaaggaatgttttcytacattaaaaattttaattttaaagcaatttgactaaacatatcggtgatcataaaaataaagtcaaggtttaattcaaaacagaacattttagtttgtgtatagaaaaactttattttggagcagatatcaaggagacaaccaacagaataccgtcttcaactcttcgtttgttcacaaataaactcaatagattaaaacttatggtagtgaagttgcagggcaggctgttaccagcacggtaaaacaaaagaaagaaatctcaaaatacgtgcccttttgattgtggttatgcataaa

SEQ ID NO: 103604 - DNA, 601 bp, Human
atttcagttaaagagaacactattttgttagcaagccattctgtttctttgggctacatttctatatacttatcagctaattatatagtgcagatatttttagtgggaggtagtcttttttttttgtccacttgtgacttctgccttgagacatttttgataaaattgtgctggggtcaagttgaaaaggaatgttttcctacattaaaaattttaattttaaagcaatttgactaaacatatcggtgatcataaaaataaagtcaaggtttaattcaaaacagaacattttagtttgtgyatagaaaaactttattttggagcagatatcaaggagacaaccaacagaataccgtcttcaactcttcgtttgttcacaaataaactcaatagattaaaacttatggtagtgaagttgcagggcaggctgttaccagcacggtaaaacaaaagaaagaaatctcaaaatacgtgcccttttgattgtggttatgcataaagctttgacagagtaaaatacatagaatgggtgtgtatgtaatatagagatacaggcctggaaagctgcctagagactttccgttgatgataattttagtac

SEQ ID NO: 103605 - DNA, 601 bp, Human
ggtcaagttgaaaaggaatgttttcctacattaaaaattttaattttaaagcaatttgactaaacatatcggtgatcataaaaataaagtcaaggtttaattcaaaacagaacattttagtttgtgtatagaaaaactttattttggagcagatatcaaggagacaaccaacagaataccgtcttcaactcttcgtttgttcacaaataaactcaatagattaaaacttatggtagtgaagttgcagggcaggctgttaccagcacggtaaaacaaaagaaagaaatctcaaaatacgtgyccttttgattgtggttatgcataaagctttgacagagtaaaatacatagaatgggtgtgtatgtaatatagagatacaggcctggaaagctgcctagagactttccgttgatgataattttagtacttaactaaaaaccatggttttttgactctttcatttttatttctgtaaatttaacttctactcagacagtagaagttttattctcttttattttattctggtgaatgcatcaaatacaaaagcaagttgtttagctcacaaattgcaattcagatcctttgccccttgtgcatt

SEQ ID NO: 103606 - DNA, 601 bp, Human
ctagttcttcagggatctgagaaataaatatcatatttaaaataacagatcttctttgagaacttttgactgcctgaaactttactcagggtggattttaaacaactttcatatacataggaatgaaagtatggctactatatgctttttactttaactcttattacaggttgaatagtgccaaagatgaatgagtatatttgtttgctcataatatgccaatcgaattctccttttgaggactgagtagaagttaagagtgtgagttacagccctgcttttctttttaaagttaccttgrtcattgtcccacatggtggggcccatttacctctcagtgttcttggctacaaaataaaaatgaaggaaaaaataatgtgtgaagcatttttgagctctaaaaattctgaatttatgtctcaaaaataatactaaatgacccataattcaagataaatgtacacagtaagaatttttaatataaggaaatgtaaaacccaagaaaaggagaataaaataattatatgaaaactcaaccatatagttactgtaattaattattataaatcactcgatacttgctgacatggaagttaaaaca

SEQ ID NO: 103607 - DNA, 601 bp, Human
ctttactcagggtggattttaaacaactttcatatacataggaatgaaagtatggctactatatgctttttactttaactcttattacaggttgaatagtgccaaagatgaatgagtatatttgtttgctcataatatgccaatcgaattctccttttgaggactgagtagaagttaagagtgtgagttacagccctgcttttctttttaaagttaccttggtcattgtcccacatggtggggcccatttacctctcagtgttcttggctacaaaataaaaatgaaggaaaaaataatgtktgaagcatttttgagctctaaaaattctgaatttatgtctcaaaaataatactaaatgacccataattcaagataaatgtacacagtaagaatttttaatataaggaaatgtaaaacccaagaaaaggagaataaaataattatatgaaaactcaaccatatagttactgtaattaattattataaatcactcgatacttgctgacatggaagttaaaacaaatatttcaaaattcatcaaatacttttaccaaagaaaagcagaaatgtttggcaaatctgttataggagttttcttca

SEQ ID NO: 103608 - DNA, 601 bp, Human
tatagttactgtaattaattattataaatcactcgatacttgctgacatggaagttaaaacaaatatttcaaaattcatcaaatacttttaccaaagaaaagcagaaatgtttggcaaatctgttataggagttttcttcataattttatgtaaggacctggtttaccaaaagctgttagattgatttttcctcttgtttttctaagattttaagttctataggatttgttaatagtgttaacacattttttattcaccctcaatttctgagggtagacatttaccttaaataaaaaaaawtaacatgggagaattgatataataagatacagtttttatataagataaaggttatctcaaatcagctttggtgtgtgatcatcataagcttagtagggcttaaatgacttgttccattgtagtactgtcctcttttcctttatttctctctacactattcctttgtgttttaaaaaattattgaacctgctgtaaaatagaaatagtaacaaaatatacatcacaagatgtttgtaaagatttaatgagataatgcacataatgtatttaatacttttactagacaaatgttcttaaaaa

SEQ ID NO: 103609 - DNA, 601 bp, Human
tcgatacttgctgacatggaagttaaaacaaatatttcaaaattcatcaaatacttttaccaaagaaaagcagaaatgtttggcaaatctgttataggagttttcttcataattttatgtaaggacctggtttaccaaaagctgttagattgatttttcctcttgtttttctaagattttaagttctataggatttgttaatagtgttaacacattttttattcaccctcaatttctgagggtagacatttaccttaaataaaaaaaaataacatgggagaattgatataataagatacartttttatataagataaaggttatctcaaatcagctttggtgtgtgatcatcataagcttagtagggcttaaatgacttgttccattgtagtactgtcctcttttcctttatttctctctacactattcctttgtgttttaaaaaattattgaacctgctgtaaaatagaaatagtaacaaaatatacatcacaagatgtttgtaaagatttaatgagataatgcacataatgtatttaatacttttactagacaaatgttcttaaaaatgcaatcagtacatttatactgaaagaaagac

SEQ ID NO: 103610 - DNA, 601 bp, Human
aataattagagcaagatgctggaacagaaacatactaccataatatcccacaaaagcactgattttgataagtaccaatggatgagagtacctttgtgggagcctgggcatctagcagaaaagtcccagtacactgttggagcaaaaggtatccaaggatagacgtattgaagggaataagaacggtttcactttacccatgtcacccctttaccgggcatagctcagtgacaagagaggctccctcagcctgcaatttttcccatacgtaaaaacaagcaagtagttagtaagtgtccarttcccctagctgtatgggatgctgcccaagacatccacttctttctaaccccacccaggatactgaggtaattagcatgactgagtggttggaagaagctgggaacaggaaacggaggctatagaccctactaaccactctacagactccctgaggaagtccacccatgaactacttaggaggccttgcctgtggatcctcctcaactagctcatgggcaccacaagtgtgccatgcacctcaagccccctccaagccagctcccttaatataccactatggacagcaagagcaagtgtc

SEQ ID NO: 103611 - DNA, 601 bp, Human
ggagcctgggcatctagcagaaaagtcccagtacactgttggagcaaaaggtatccaaggatagacgtattgaagggaataagaacggtttcactttacccatgtcacccctttaccgggcatagctcagtgacaagagaggctccctcagcctgcaatttttcccatacgtaaaaacaagcaagtagttagtaagtgtccaattcccctagctgtatgggatgctgcccaagacatccacttctttctaaccccacccaggatactgaggtaattagcatgactgagtggttggaagaarctgggaacaggaaacggaggctatagaccctactaaccactctacagactccctgaggaagtccacccatgaactacttaggaggccttgcctgtggatcctcctcaactagctcatgggcaccacaagtgtgccatgcacctcaagccccctccaagccagctcccttaatataccactatggacagcaagagcaagtgtctcactcagacaccaagcatgactctgcaagattgagagaaggcatatgaacttgagcatttctgggcacggccacagagaacacaaatgggaggttct

SEQ ID NO: 103612 - DNA, 601 bp, Human
aaaccaacagaaattctggagctgaagaatgcatgaataaaatgaaaattgcaatagagtgtcatcagctgccttcatcaaacagaaatgatctgtgaacttgaagatatatcatttgaaaatattccatcagagataaaaaagaaaaaaacagtgaaaacaaatgaacaaaacctacaacatttatggaacaatatcaagaaagcaaacggtcactgtatgggagctccagaagaagagacagaaaaggaacagaattcttatttaaagaaataatggctgaaatatttccaaatctggmgagagatgtgaacatccaggtatatgaagatcaaaagcctccaaacggacttccccaaagaagactcactacgacacattaaaatcaaattgtcaaaaatcaaagacaaagagaattttgaaagcgccaagaaaaaaaacatgcttatcacatataagagaacctgcattagactatcagacaagaaataggtttttgtcagcaaaaaccttgcaggccagcacagggtagaatgatgtagtcaaagtgctggaaaaaaattacaaaacaaaaatagattacctggcaaagctgtccttc

SEQ ID NO: 103613 - DNA, 601 bp, Human
tgtgaacatccaggtatatgaagatcaaaagcctccaaacggacttccccaaagaagactcactacgacacattaaaatcaaattgtcaaaaatcaaagacaaagagaattttgaaagcgccaagaaaaaaaacatgcttatcacatataagagaacctgcattagactatcagacaagaaataggtttttgtcagcaaaaaccttgcaggccagcacagggtagaatgatgtagtcaaagtgctggaaaaaaattacaaaacaaaaatagattacctggcaaagctgtccttcagaaatsgagagataaagactttcccagacaagaataaataaataaataaaagttgaggaagttcaccaccattatacttgccttacaagaaatggtaaagggagttctgcaagctgaaagcatgttaattagtaacatgaaaacaaacaaaagtataaaactcaccagtaaaagtaaatatataagcaaattcataatactctaatattgtaatggtagtgtgttaattacttatgactctagtataaaggttaaagaacaaaagtatttaaaataactatagctataataacctgttaatagatg

SEQ ID NO: 103614 - DNA, 601 bp, Human
acctgcattagactatcagacaagaaataggtttttgtcagcaaaaaccttgcaggccagcacagggtagaatgatgtagtcaaagtgctggaaaaaaattacaaaacaaaaatagattacctggcaaagctgtccttcagaaatcgagagataaagactttcccagacaagaataaataaataaataaaagttgaggaagttcaccaccattatacttgccttacaagaaatggtaaagggagttctgcaagctgaaagcatgttaattagtaacatgaaaacaaacaaaagtataaaastcaccagtaaaagtaaatatataagcaaattcataatactctaatattgtaatggtagtgtgttaattacttatgactctagtataaaggttaaagaacaaaagtatttaaaataactatagctataataacctgttaatagatgaacaatataaaatgatgtaagtcgtaacaataaaaacttaaaatggggtgggcagcagtgtaaaatttgtgtatgcaattgtaacaataaaaacttagaattgggtgggcagcagtgtaaaatttgtgtgtgcgattaaagtaatacacgtaaaa

SEQ ID NO: 103615 - DNA, 601 bp, Human
gaaataggtttttgtcagcaaaaaccttgcaggccagcacagggtagaatgatgtagtcaaagtgctggaaaaaaattacaaaacaaaaatagattacctggcaaagctgtccttcagaaatcgagagataaagactttcccagacaagaataaataaataaataaaagttgaggaagttcaccaccattatacttgccttacaagaaatggtaaagggagttctgcaagctgaaagcatgttaattagtaacatgaaaacaaacaaaagtataaaactcaccagtaaaagtaaatatatragcaaattcataatactctaatattgtaatggtagtgtgttaattacttatgactctagtataaaggttaaagaacaaaagtatttaaaataactatagctataataacctgttaatagatgaacaatataaaatgatgtaagtcgtaacaataaaaacttaaaatggggtgggcagcagtgtaaaatttgtgtatgcaattgtaacaataaaaacttagaattgggtgggcagcagtgtaaaatttgtgtgtgcgattaaagtaatacacgtaaaatagattgttataactaaaggatg

SEQ ID NO: 103616 - DNA, 601 bp, Human
ctctcaataacgaatagatcgtccagacggaaatcaataagaaaacattggactttaactacattttagaacaaatgaacctagcagacatacaaaagactccatccaaaagcaactgaatgcatattcttctcaagcatacacaaagcattctcctgaatagatcatatgttaatccacaaaacaattgttaagttttaaaagattgtaatcatattaagcatatttctgacccacagtagtataaaactagagatcaataacaggaagtatactggaaaatttacaaatatgtgaaaaytaaacaacacatttctgaaaaaccaatgggtcaaaaaaattaaaagataattaaaaaaatattgagccaaaagaaaatggaaacacaacatacaaaaacacatgggatgcagcaaaatcatttctaagggaaaagtttagagtgataaattcctatgtgaaaaacaaagagacatctcaaataaacaacctaactttacatttcaatgaactagaaacataacaaactaagcccaaatttagcaaaaggaaggagataataaagatcaaggaagaaataaaatttgagaagaggaaacca

SEQ ID NO: 103617 - DNA, 601 bp, Human
taactacattttagaacaaatgaacctagcagacatacaaaagactccatccaaaagcaactgaatgcatattcttctcaagcatacacaaagcattctcctgaatagatcatatgttaatccacaaaacaattgttaagttttaaaagattgtaatcatattaagcatatttctgacccacagtagtataaaactagagatcaataacaggaagtatactggaaaatttacaaatatgtgaaaattaaacaacacatttctgaaaaaccaatgggtcaaaaaaattaaaagataattaamaaaatattgagccaaaagaaaatggaaacacaacatacaaaaacacatgggatgcagcaaaatcatttctaagggaaaagtttagagtgataaattcctatgtgaaaaacaaagagacatctcaaataaacaacctaactttacatttcaatgaactagaaacataacaaactaagcccaaatttagcaaaaggaaggagataataaagatcaaggaagaaataaaatttgagaagaggaaaccaatagaaaagatccacaaaactaagaattacttttttttaaaaaaaggtaaacaaa

SEQ ID NO: 103618 - DNA, 601 bp, Human
tgcattccacatgtttccttatgatgtgtgaaaggtgtcgaattgtcattttctaagcttatgttacagagtaggtttttggtagctgtaagtctaattattccttctgaatatttaaatactgaaataggccacttaaaaaaaaataagactggggaggtgtggtgggtcatgcctgtaatcccactactttgggaggccaaaatgggaggatcactgggaggactgttgaacctgagttcacaaccagcctgggcaacatagtgagacctcatctctacaaaaaaaaaaaaaaaaaaaagccagctgtgatggtgtgcacctgaaatcccacctactgaggaggccagggtgggagaattacttgagcttgagaggtggaggctgcagtgagacatgagtgtgccattgtactctagcctgggtgatagagtgagaccctgtccaaaaataaataaaataaataaataaaaccaatactttctactacaaatatattcattattcattcataacgctttgattatgatgagaacacttgtcttaagtgacaatatgttcttcaatgttatgttaatttcggcccacctgaataggatat

SEQ ID NO: 103619 - DNA, 601 bp, Human
acctgttgacactctgtatattaaccaaattagccctcgatttgttgtgtgcctcacaaatttttttcttaatcagtacatttaatattttcagtagaccattctcaatataatgacttggaatgttagtaatgtacacatttcatagactatgcctcttttctacgttttttattatttcaggaatagtaaaattagaggaattgaataaacaaaactattttaaaacttgtcaattaagtttgttcagaatacgatttgtttcccagtattaactctggacatccagatatagacaggytataagcttctgattacatgaccagtgtagctagtttagattcaccttcacagagtatgtctaccatgtactgcaccttatttgatataatttaatagctcaataggtattagctgaatgaatgaataacaataattagtagtgacattaattaaacactccttttctccacctctgtttactggaaataatgcttttagatatagagatcttttgagactattctgtggtttcaaaaagctcatcaggaaatgatgttttctataattggagtaatctatcaaaatagatgaattctaa

SEQ ID NO: 103620 - DNA, 601 bp, Human
ttagatatagagatcttttgagactattctgtggtttcaaaaagctcatcaggaaatgatgttttctataattggagtaatctatcaaaatagatgaattctaaaattataataattcctgaaattgtcctgaggcaaaatttgttctactttcataagtgtttccattttcttgttaggaagaagagacacaatctgaaaaccaagtctaattttcccataggtgtaaaagagaagaccttagtaattacttgtctttttcatccagccacttagtgtcttttcttatttttgctaatgmctgcaaaaaatgaagatctccacaaggagaaaatgttctccccttagaatggctgttcttagacttgagttacacttttaccatcatctaatttttgcaatattttacatctttgcccagtaaaatgaggttcctaagttaaaagatttttgagcatattattttgaagttgctgttttcagtgcaccattcacattattgtcattattaattgcattctgggaccaaatctattttgaaaaatgtttttcttgcatcttggataaactgaataagcaaagaaagctactcctgaaactt

SEQ ID NO: 103621 - DNA, 601 bp, Human
caccatctatagaaattgcagcctctgaggacatgatagcaggagatcagagatgaaaggagaacaccagccttcaaggcttagctcagaagtaacacttgtcacatttggtagtttataggccatggaggctcatgtttataaggaaagactgggaacatggatattggtaagcacagtccttcctacaacatctaaaatgcttagcaagatgcctggctcataaaatacctcagtaaatgttgtctttttcaccatcgctattattattttagagggagtgcaagttggtagttaagartctgccactaactccatgactttaggcaaacttttaaaactttctgaatctccattgtaaaaataggtctcccctcataagactgttatagtgaccaaatgaaataaagtgctgccatttagtaagccctctaaaaatatggtagtttcattgctatcatgcatttatattcattttatctatcaattggttaaacccaattaaatgcctacatatgtgtgtttttattataacagtgttgagatttcctcatttttattaatatgtataaactaataaaacattgattttcctatttgt

SEQ ID NO: 103622 - DNA, 601 bp, Human
ggagaacaccagccttcaaggcttagctcagaagtaacacttgtcacatttggtagtttataggccatggaggctcatgtttataaggaaagactgggaacatggatattggtaagcacagtccttcctacaacatctaaaatgcttagcaagatgcctggctcataaaatacctcagtaaatgttgtctttttcaccatcgctattattattttagagggagtgcaagttggtagttaagagtctgccactaactccatgactttaggcaaacttttaaaactttctgaatctccattgyaaaaataggtctcccctcataagactgttatagtgaccaaatgaaataaagtgctgccatttagtaagccctctaaaaatatggtagtttcattgctatcatgcatttatattcattttatctatcaattggttaaacccaattaaatgcctacatatgtgtgtttttattataacagtgttgagatttcctcatttttattaatatgtataaactaataaaacattgattttcctatttgtgacaaatatattacaattattaatcattcatttgataggtatttattaggtgtctact

SEQ ID NO: 103623 - DNA, 601 bp, Human
agtaacacttgtcacatttggtagtttataggccatggaggctcatgtttataaggaaagactgggaacatggatattggtaagcacagtccttcctacaacatctaaaatgcttagcaagatgcctggctcataaaatacctcagtaaatgttgtctttttcaccatcgctattattattttagagggagtgcaagttggtagttaagagtctgccactaactccatgactttaggcaaacttttaaaactttctgaatctccattgtaaaaataggtctcccctcataagactgttatagtgaccaaatgaaataaagtgctgccatttagtaagccctctaaaaatatggtagtttcattgctatcatgcatttatattcattttatctatcaattggttaaacccaattaaatgcctacatatgtgtgtttttattataacagtgttgagatttcctcatttttattaatatgtataaactaataaaacattgattttcctatttgtgacaaatatattacaattattaatcattcatttgataggtatttattaggtgtctactgttttctagaggtaacagataaacaatggaca

SEQ ID NO: 103624 - DNA, 601 bp, Human
ggaagatacattttacttcagagtcaaaaacaaaacaaaaaaatttcattgacaattcatccaacgcccaaatgaattgattagccaagaacaaagaggaatttttactaataataggtttgtatagcttccttgttttaaaaagaactatgttgtgggtttttttcttcccctaatgaaataaaatattagagtgaaatttttaattagttaagtagtttgttgcattctaccacatccatgaccatctgatatagtacccaggaagaagtcaaagatgcaaggcgccatatcgcatgayacacgataacaaggtaatgaagagtaaatacatttgtcatttcagggaagttatttacatgacacagccttgggaaagcctgcttgggagacataaatgaatgaagctttttagattgatgaattaagtgtgccttttttgttttcaataatgtccaataaaatagtttatattgagcaagaggtcttcttttctgatctaagacataatgttgtacaagaggtacattgtgtggatacttaatatgatgcacatttgtttacatataacttctgcaaggagatattaactcccaagttc

SEQ ID NO: 103625 - DNA, 601 bp, Human
agcccttgcctttggcagctaaaggcctgttattatgggcaaagattaaaattaccctaggccaagatctataattttctatattaagtcttgagtcagtgccacaatgcaagtaaagtgaagtatcaataactcatttaaaattatttttctcatgaagcaggcagactagtcattctgttaaatccagtaaagggcataagggataaatctgggccactccaattttgtgttttatttttttttttttattttttatttttttgagacggagtctccctctgtcgcccaggctggagtscagtggcgcgatctcggctcactgcaggctccgccttccgggttcacgccattctcctgcctcagcctcccaagtagctgggactacaggcgctcgccgtcacgcccggctaattttcttgtgtttttagtagagacggggtgtcaccgtgttaaccaggatagtctccatctcctgacctcgtgatccgcccgcctcggccttccaaagtgctgggattacaggcgtcaattttgtgttttaaatgaaacactgtgaacctatacaaggggatgtggtctttcccctttgtattttgtg

SEQ ID NO: 103626 - DNA, 601 bp, Human
ccttgcctttggcagctaaaggcctgttattatgggcaaagattaaaattaccctaggccaagatctataattttctatattaagtcttgagtcagtgccacaatgcaagtaaagtgaagtatcaataactcatttaaaattatttttctcatgaagcaggcagactagtcattctgttaaatccagtaaagggcataagggataaatctgggccactccaattttgtgttttatttttttttttttattttttatttttttgagacggagtctccctctgtcgcccaggctggagtgcaktggcgcgatctcggctcactgcaggctccgccttccgggttcacgccattctcctgcctcagcctcccaagtagctgggactacaggcgctcgccgtcacgcccggctaattttcttgtgtttttagtagagacggggtgtcaccgtgttaaccaggatagtctccatctcctgacctcgtgatccgcccgcctcggccttccaaagtgctgggattacaggcgtcaattttgtgttttaaatgaaacactgtgaacctatacaaggggatgtggtctttcccctttgtattttgtgtag

SEQ ID NO: 103627 - DNA, 601 bp, Human
ggacatttaaagagagagggtagcagtgctcacagaagttcttcccttcaaaggcagcctatgtgaggtttcacacagcagtcagccagcgcacctggacagtcaggcatagatgcatttacaggatctttctccaatctgccataagtcatttttcttcctatgcctgtgctgtatgaactatgccatttagcggccacgtgctcccttactcctttataattcacatttagcgtcaatccagaggtctctattttgtcttttctttcacttgaagcttatgtatatagttatgatatgytttacattttgtccagggataactatagtttctagggcaactataaaacttggggaatccaacaaaaaagtccagggggttaaacaataatctaagccttttatttgtaaatctttgcatatctgtgaattgctttaaaatgcttcagccaaaaagggcagggatgctgaatcagacaatatggacaaaccatgaatgcctatggaaactacatggtgagaatatggagattcattatactattccctctgcatctgtgtgtttgaaaatttccatatagagaaattatttttaaaaaat

SEQ ID NO: 103628 - DNA, 601 bp, Human
ttgctcaatttcacattgtgaatgctagaatttgctccttgaagtgcaattggaatcattttctagatcttttgtaaaatcacaaaggatatttttgtgtttattaatatctttgcagccccttagagaccttgacatttttttctttaatactactaaaataatatcagatatacactcaggtctattccatttttgaatattgtctttcacacatacttatgcacatacaaatacaccactcctccccctccaccaaaggaatgtgtgtgtgtgtgtgtgtgtgtgtgtgtgtgtgtgtatttcacatataaaagcaggccaatgttgagcgtagtggctcccacctgtaatcccaggactttaggaggcccaggcgggtggatcataaggtcaggagttcaagaccagcctggccaaaatggtgaaaccccatctctactaaaaatataaaaattaaccgggcacagtggcaggtgcctttaatcccagctgcttgagaggctaaggcaggagaattgcttgaacttgggaggcggaggttgcagtgagccgagatcacaccactgcactccagcctgggtgacagagtgagactctg

SEQ ID NO: 103629 - DNA, 601 bp, Human
tgtgtgtgtgtgtgtgtgtgtatttcacatataaaagcaggccaatgttgagcgtagtggctcccacctgtaatcccaggactttaggaggcccaggcgggtggatcataaggtcaggagttcaagaccagcctggccaaaatggtgaaaccccatctctactaaaaatataaaaattaaccgggcacagtggcaggtgcctttaatcccagctgcttgagaggctaaggcaggagaattgcttgaacttgggaggcggaggttgcagtgagccgagatcacaccactgcactccagcctsggtgacagagtgagactctgtctcaacttaaaaaagaaaaaaaaaaaaaaagcaggccaactaaaggtttgtttttgtcaactgtagtatttgggttaatcaggtaatgctgcacattctctttcaaatttagatttttatatggtaacttgtttgatatagttatcaaacaaatggggaaggtccaataatgttaaaagaacaaaatcaacaaacatcagtgaagaacttgatttgcagaaatattttaacagcaagaagcattctacagttcatttccattttgatggccattttaat

SEQ ID NO: 103630 - DNA, 601 bp, Human
gatacgaggtaggcagacgtgaagatttgcaaagaactgggacagactggcaaccttcccttttggaaggcttctagcaagagattagactggatcttagaggacaaagcatgggggtacaaagacaagtttctgtggagactgagaagtaatcctggggaggaggggatacgcagaaaaagtgaaaaacacagagagaaaagagcttattaatgggaacttcttgctgttctgttagtttctttaagctcctagggtagactgaataactttttaatgcttcttaattgtttctctttayacttgacttcttgatgagacaggaccatgaaggaggccatctttattgaggttacataaccttcaatatattcaatctacttcattaatattcactgaagttacaagaaagaatgcccacaaaagaatctctttattttcctactgtcatcccttcttccactgagactctgatattttttgaaattacatgtttttttagttttttgggctcctttgagtataattgaaggaaatttctatcctgttctccattttcgctaggaaattgggagctacatgtgtaaggataatgtttatt

SEQ ID NO: 103631 - DNA, 601 bp, Human
ttagactggatcttagaggacaaagcatgggggtacaaagacaagtttctgtggagactgagaagtaatcctggggaggaggggatacgcagaaaaagtgaaaaacacagagagaaaagagcttattaatgggaacttcttgctgttctgttagtttctttaagctcctagggtagactgaataactttttaatgcttcttaattgtttctctttacacttgacttcttgatgagacaggaccatgaaggaggccatctttattgaggttacataaccttcaatatattcaatctacttcrttaatattcactgaagttacaagaaagaatgcccacaaaagaatctctttattttcctactgtcatcccttcttccactgagactctgatattttttgaaattacatgtttttttagttttttgggctcctttgagtataattgaaggaaatttctatcctgttctccattttcgctaggaaattgggagctacatgtgtaaggataatgtttattgattcttagaatgaaggatcttagattatctctcctccaacatcctcttttaaatatgaaaacatgtagggatttgctatcttt

SEQ ID NO: 103632 - DNA, 601 bp, Human
tttgggctcctttgagtataattgaaggaaatttctatcctgttctccattttcgctaggaaattgggagctacatgtgtaaggataatgtttattgattcttagaatgaaggatcttagattatctctcctccaacatcctcttttaaatatgaaaacatgtagggatttgctatctttacaaacaaataaaacccagatctttaggtttggtaatggaagtacctctgtttgattaggaacagctagaccttgaattctgattctcatcccttgagttgcacctttctcctcaggcatyctgctagcctttagaggtcgctgtcactctagcaggaaagggatcgagaaaggatccctactagttcactggtctcctctcccatcaccctccccctttttcattcattgccatttttccaaagagctgagtacacactaacctcaagacattttgtacttctaaccttttgcctacaacacttttcttcctcatatttccaaagattgctccctcctttcttttagaacttcactgagatctttccagattactgcatctattacttcctcttctgtcagtctctgctccttacattac

SEQ ID NO: 103633 - DNA, 601 bp, Human
tacattaccttatctttttttagcacttcacaattgaagttttatttatatgtttacttgtcttttggccgtcccttttactaaagtataatttccatgacagcaacattccttagtctagttatatgggatttagaataatgcctggaacatagtaagtgctcaatagttgtgaatgaatgaatgttcttctgttactgttgagcacaggctgcaatcactgaagattctggtaaataaggaggtggggatcgtttgatccaggaaacagtatggaatgaactatggaatatcaagaccygggattatatactggttctgacacttattagctgggtatacttaatttacttaaactctctcatctttaggactttttccatctcaaaaggggtttcaactcaaaaacaggtagtttggtggaataaaagtgaacacattaaagcatctaccacaatatcaaacatgaaggaagcttcatttaaaaattgataactatgcaatttgccttttaaaagttaatctgcttcttagaatttataattcatatcagatcttaaattgcaatttactttctatttttatatataccaagcagggc

SEQ ID NO: 103634 - DNA, 601 bp, Human
ctgacacttattagctgggtatacttaatttacttaaactctctcatctttaggactttttccatctcaaaaggggtttcaactcaaaaacaggtagtttggtggaataaaagtgaacacattaaagcatctaccacaatatcaaacatgaaggaagcttcatttaaaaattgataactatgcaatttgccttttaaaagttaatctgcttcttagaatttataattcatatcagatcttaaattgcaatttactttctatttttatatataccaagcagggccacattctggtaaatctsttctaatattttgaaaaaggcaggggattctccctcctgaccacataaagccagtttccttagaattaaattttcctgtgaggaacagaactagaaaaaactattttaagatgcatgtgtaactaaaaaagaacacgaatagccaagacaatcctaagcaaaaagaacaaagtggaggaatcatactacctgacttcaaactatactacatagctacagtaaccaaaacagcatggtactggtacaaaaacagacacataggccaatgggacagaacagagtccagaaataaggccacac

SEQ ID NO: 103635 - DNA, 601 bp, Human
taaaacaaccccattaacaagtgggcaaaggacatgaatagatccttttcaaaagaagacatacatctagccaattcaaacatatgaaaaaaagctcatcatcactgatctttagagaaatgcaaattaaaaccacaatgagatattatctcacaccagtcagaatggccattactaaaaagtcaaaatacagcagatgctggcaaggtggcagagaaaagggaacacataaactgttggtaggagtgtaagttagttcaactattgtggaaaacagtgtggcaattcttcaaagacctaygaatagaaataccattcaacccagcaatcccattcctaggtatatacccaaaggagtataaattgttctattataaagaagcatgaatttgtatgttcattgcagcactattcaaaatagcaaagtcatggaatcaacctaaatgcccatcaatgacagattagataacaaaaatgtggtacagatacatcatggaatactatgcagccataaacaagaaaagatcatgtccttttcaggaacatggatggagctggaggttattatccttagaaaagtaatgcaggaacagaaaatcaa

SEQ ID NO: 103636 - DNA, 601 bp, Human
attactaaaaagtcaaaatacagcagatgctggcaaggtggcagagaaaagggaacacataaactgttggtaggagtgtaagttagttcaactattgtggaaaacagtgtggcaattcttcaaagacctacgaatagaaataccattcaacccagcaatcccattcctaggtatatacccaaaggagtataaattgttctattataaagaagcatgaatttgtatgttcattgcagcactattcaaaatagcaaagtcatggaatcaacctaaatgcccatcaatgacagattagataacraaaatgtggtacagatacatcatggaatactatgcagccataaacaagaaaagatcatgtccttttcaggaacatggatggagctggaggttattatccttagaaaagtaatgcaggaacagaaaatcaaataccacatgttctcacttataagtgggggctaaatgataagaacacatggacacatagagaggaacaacacactgtggcctctcagagagtggagggtgggaggagggagaggattaggaaaaataactaatggctactaggcttaatacctggatgatgaaataatct

SEQ ID NO: 103637 - DNA, 601 bp, Human
agtttacctatgtaacaaagctgcacatgtacccctgaccttaaaataaaaattaaatttaaaaaacttaaaattggtaactatgtaattttcctttaacaagttcatctgctttttagaaattaaaattcatattgtatcttaagctacaatttactttctttttttttttttttttttttgcagttgcaagatttaatagagtgaaaacagagctcccatacaaagggagaggacccaaagtgggtagccgttgccagctggaatgactgggtttatatcctgatcattgtccctcccyctgtgctctcaggcgacagatgattggctacttctttacttcctgtttttccctaattagcattttaatgagctctctttactacctgattggtcgggtgtaagctaagttacaagccccgtgtttagaggtggatgtggtcaccttcccagccaggcttagggattcttagtcagcctaggaaatccagctagtcctgtctctcatcacctgggagctttggctctttgggtggttctaaacagcatcaaggttgagaccaaggttatctttggggtctccaccccctgaaacctgccc

SEQ ID NO: 103638 - DNA, 601 bp, Human
ttaaaataaaaattaaatttaaaaaacttaaaattggtaactatgtaattttcctttaacaagttcatctgctttttagaaattaaaattcatattgtatcttaagctacaatttactttctttttttttttttttttttttgcagttgcaagatttaatagagtgaaaacagagctcccatacaaagggagaggacccaaagtgggtagccgttgccagctggaatgactgggtttatatcctgatcattgtccctccccctgtgctctcaggcgacagatgattggctacttctttacytcctgtttttccctaattagcattttaatgagctctctttactacctgattggtcgggtgtaagctaagttacaagccccgtgtttagaggtggatgtggtcaccttcccagccaggcttagggattcttagtcagcctaggaaatccagctagtcctgtctctcatcacctgggagctttggctctttgggtggttctaaacagcatcaaggttgagaccaaggttatctttggggtctccaccccctgaaacctgcccctacttgctagttcctgccagggagacctgggtgatcagc

SEQ ID NO: 103639 - DNA, 601 bp, Human
tactttctttttttttttttttttttttgcagttgcaagatttaatagagtgaaaacagagctcccatacaaagggagaggacccaaagtgggtagccgttgccagctggaatgactgggtttatatcctgatcattgtccctccccctgtgctctcaggcgacagatgattggctacttctttacttcctgtttttccctaattagcattttaatgagctctctttactacctgattggtcgggtgtaagctaagttacaagccccgtgtttagaggtggatgtggtcaccttcccagcyaggcttagggattcttagtcagcctaggaaatccagctagtcctgtctctcatcacctgggagctttggctctttgggtggttctaaacagcatcaaggttgagaccaaggttatctttggggtctccaccccctgaaacctgcccctacttgctagttcctgccagggagacctgggtgatcagcttccctcaaagcccagggcagaagcattctggtagccccaggtgcctagagacaggcagaagggagacacttatgagtcactcctccacttcttccagagaccatactgttttg

SEQ ID NO: 103640 - DNA, 601 bp, Human
tctttcttgttattacttttttttctttttcaagtaggttggctaattatatttacttgtggaaatgtggggactctatgctttttttgttaaaaaaaaaaaaaaaaaggttgtgcccctgctctccaactacatttcattatagaagtaatattaagaagttattttgtctgtctacatttatttaataatttgatcacaggatattgacatgtgtattaccctcagccactctgcaggaccagtgaggtagacactaggcaatggtgaatagggcccagctcctgacctcaatcagacragatcgggcgcgttcagggtggtatggctgtagacatcctgacctcaatcaaatcaaattctcatagtagtggagaggaacatgggaatgcattatggaaagttaatgacatttagctcatcccctattgatgaacatctataaattatgatacatcataattatgccacaatactaagcagcatttcatttatgtgtgctaatatggaaaattcttcatatataattaaggtaaacaaacaaaaccaacatactaagcaaaactaccatctttgaaattaagaaaaagaactaaataaa

SEQ ID NO: 103641 - DNA, 601 bp, Human
cgggcgcgttcagggtggtatggctgtagacatcctgacctcaatcaaatcaaattctcatagtagtggagaggaacatgggaatgcattatggaaagttaatgacatttagctcatcccctattgatgaacatctataaattatgatacatcataattatgccacaatactaagcagcatttcatttatgtgtgctaatatggaaaattcttcatatataattaaggtaaacaaacaaaaccaacatactaagcaaaactaccatctttgaaattaagaaaaagaactaaataaacaaaytggtagatgtatatagttatgcatttttgaaagaaatcataaaaagtggtggatttaaaagaggtatttttatttttaacctttctatagtttgaatttactaattttttacatgtcctttttccattttttaattcatttttaatatcaaaggggtatctgcactgtaagattatagtgatatttttcttccttgtacctctttctaataaaaaatttcatcttatatgtagtacatagtaatctataaatataaaatacagtatgcaaagagctgtctcagaggaaagtgcaatactc

SEQ ID NO: 103642 - DNA, 601 bp, Human
aaaaccaacatactaagcaaaactaccatctttgaaattaagaaaaagaactaaataaacaaattggtagatgtatatagttatgcatttttgaaagaaatcataaaaagtggtggatttaaaagaggtatttttatttttaacctttctatagtttgaatttactaattttttacatgtcctttttccattttttaattcatttttaatatcaaaggggtatctgcactgtaagattatagtgatatttttcttccttgtacctctttctaataaaaaatttcatcttatatgtagtacrtagtaatctataaatataaaatacagtatgcaaagagctgtctcagaggaaagtgcaatactctggagccaaggaggagggaggaatgaggcaggatcagaaacagttcatcctggtcaataaataagattcttctaatttcaaaggtgcttcatcttagtaactttttccttggtgctttgccttttagccacacaagtttcgctagtctgttgctacatcaaccaactgatatttcttggaagtgctggtactttccaatttcttggtgtcaaaacattgccttcattcagcaccaat

SEQ ID NO: 103643 - DNA, 601 bp, Human
aaatcctataagccatctgatcattatatcagtttatgcattgtatgttgcatgtttaatacaaagtttggaagactagaaatactccactaagcaagcaaacagtaattactcctttataattactgtgcaactttattgccatgtgttgttataattatattttaaatactccccatttgcatcatagaccataatgtcttctagcacattaaagtctgtggcttataatggcatcccacttccacaaagacctcttcttcatttagtctctattttaactactgttaaaagagactamatgaaagtaattggcaccataatcctacagtaaggaaattgtaagcaatatactatttctgtgctactgaagtctctaattattcagagtatttcatgtttaacatttaatatgcattcctctttcagttatggagccagtcataaccaaaacagttcttctcaaatcttaacatacacagaaatcacctggggatctggttaaaatatagattttgatatagttggtctggaaacgggcccaagagtctacatttctaacaagctcccaggtgatgagtccagtgctgctgggttcatt

SEQ ID NO: 103644 - DNA, 601 bp, Human
cccaggaagctggcacccttaacaattaagtgcccccaaagtatgtgttaaagcctatggaaatatgagcctatagaaactacctaaagagaagtcatactctagactattagaaccagggactatcctataaaccttataagaaccattgttaggggaccataaacaaccctgcttcaaagagtagaaatatgtttcataaaagccattacccaaagacgtataaaaggtaaaacttaaataaaaatagattaccatttacaacttggaaaagaaacccagaattttctgtagccactgktcaatgtgttcttacagccgtaaggcagaataaaaatctggaaattatcagagaaggttttaagaacaaaataagcaagttggtctctttttaaatataaatctgacattaacagaagccttatgatattaagggaaaactggtatgggaactaaggaagggagtgaaaacatgctcctcacctatgaattagacatccaagaggacaatcaagttcgatctcatgccatattgggtcactgatggcccatcatgcatggactgtaggactcacaaataaatctggacacaaaagttctt

SEQ ID NO: 103645 - DNA, 601 bp, Human
ggcagaataaaaatctggaaattatcagagaaggttttaagaacaaaataagcaagttggtctctttttaaatataaatctgacattaacagaagccttatgatattaagggaaaactggtatgggaactaaggaagggagtgaaaacatgctcctcacctatgaattagacatccaagaggacaatcaagttcgatctcatgccatattgggtcactgatggcccatcatgcatggactgtaggactcacaaataaatctggacacaaaagttcttatgtatgggccaattctgcttatwtggacacagtgcaaacaggtacgacaagatattttcttcctcaaggatgatacctagcagataaagactgatttctaattcagtattgttacaactgcaggtgtgtgacccgtagcgagccactaaaccattctgaatctcacttccttcactggtaaaatagggaaaaatattagttgcctcatagagttgtagtaaagattaaatgaatgatctatgtaaaatggaagtgcttgataaactttagtctattattaacaccaaatactaaaaaaaaaaaaaaaaaaaaaaattcctctt

SEQ ID NO: 103646 - DNA, 601 bp, Human
aatctggaaattatcagagaaggttttaagaacaaaataagcaagttggtctctttttaaatataaatctgacattaacagaagccttatgatattaagggaaaactggtatgggaactaaggaagggagtgaaaacatgctcctcacctatgaattagacatccaagaggacaatcaagttcgatctcatgccatattgggtcactgatggcccatcatgcatggactgtaggactcacaaataaatctggacacaaaagttcttatgtatgggccaattctgcttatatggacacagtrcaaacaggtacgacaagatattttcttcctcaaggatgatacctagcagataaagactgatttctaattcagtattgttacaactgcaggtgtgtgacccgtagcgagccactaaaccattctgaatctcacttccttcactggtaaaatagggaaaaatattagttgcctcatagagttgtagtaaagattaaatgaatgatctatgtaaaatggaagtgcttgataaactttagtctattattaacaccaaatactaaaaaaaaaaaaaaaaaaaaaaattcctcttcttggataaca

SEQ ID NO: 103647 - DNA, 601 bp, Human
tcccccttagagccaaatgattttcaaatatttatttttaggtacctgtttgattgtactctttttccactgttgattttggaaacaattttgaaattctcattaattccttaaaaatgtttaactttacccagataagtaaatgcaaggaatctagctggggtgggaatgggggagaatgggtgttggggaagttgtcagttatctattaagacaataatgccacatatcaattgtaacatcttagtggcatgaaacaataaagatttctttagcttacacattggtgtggtgggctcaktttatatcacctaggcttatatatttttttctgttgtgaactgcaagttaactctgtaccactaccgatcttggatgtgcgggttcacatgtctgggtggtggctggcattggatgatctagtatggccttggctggaatgttagcatgttaaggatgacgtacctttattcgcatctcatcctccagcaggctaacctgggcatgttcacatatccatgcagaggagcaaaagaagcaactctcaatacttaaacccatttcaagctcctggtcatgtctcatttgctaacatcccatt

SEQ ID NO: 103648 - DNA, 601 bp, Human
aaatgattttcaaatatttatttttaggtacctgtttgattgtactctttttccactgttgattttggaaacaattttgaaattctcattaattccttaaaaatgtttaactttacccagataagtaaatgcaaggaatctagctggggtgggaatgggggagaatgggtgttggggaagttgtcagttatctattaagacaataatgccacatatcaattgtaacatcttagtggcatgaaacaataaagatttctttagcttacacattggtgtggtgggctcagtttatatcacctasgcttatatatttttttctgttgtgaactgcaagttaactctgtaccactaccgatcttggatgtgcgggttcacatgtctgggtggtggctggcattggatgatctagtatggccttggctggaatgttagcatgttaaggatgacgtacctttattcgcatctcatcctccagcaggctaacctgggcatgttcacatatccatgcagaggagcaaaagaagcaactctcaatacttaaacccatttcaagctcctggtcatgtctcatttgctaacatcccattggccaaagcaatca

SEQ ID NO: 103649 - DNA, 601 bp, Human
tgttacttcaaaagatactcattacaaagcactactgtgactcacataatcacttagtttttaagggggagttgttaatgtagaattggtttcttatcttcccagcccccagtgagcctttgctgtgcaaattcgctgatggaggacaaaagaagcgacagaatcaaagcaaatatacccagaatgggaggccttggcccagggaaggagaggtgagtcctgactgataacatttgctctgaaatttggcagtagatatccctcagaaggtggcaaggcagacgtatggtgccatgatgarattgggtcccatggaacacccaatgtcttcaaaggggcaaatgagcagacccatgttaatgtgttctagatgaaattattgaggagtagaggatttcaaatttaacctcagttctgcactacagcaagtcttctgtctttaaccaaactcaaacctgaaaggaactcactgaaatacttatctacaaagaattgatttctatttgtgtaatagctataaaatgagggtataattacttaacaaaatattttcagtgaaatcaatagggaaagttgaatgtttgtgttttgaaacaggcag

SEQ ID NO: 103650 - DNA, 601 bp, Human
ttacttcaaaagatactcattacaaagcactactgtgactcacataatcacttagtttttaagggggagttgttaatgtagaattggtttcttatcttcccagcccccagtgagcctttgctgtgcaaattcgctgatggaggacaaaagaagcgacagaatcaaagcaaatatacccagaatgggaggccttggcccagggaaggagaggtgagtcctgactgataacatttgctctgaaatttggcagtagatatccctcagaaggtggcaaggcagacgtatggtgccatgatgaaaytgggtcccatggaacacccaatgtcttcaaaggggcaaatgagcagacccatgttaatgtgttctagatgaaattattgaggagtagaggatttcaaatttaacctcagttctgcactacagcaagtcttctgtctttaaccaaactcaaacctgaaaggaactcactgaaatacttatctacaaagaattgatttctatttgtgtaatagctataaaatgagggtataattacttaacaaaatattttcagtgaaatcaatagggaaagttgaatgtttgtgttttgaaacaggcagac

SEQ ID NO: 103651 - DNA, 601 bp, Human
taatattctcaactttagaaaggcagtgggtattacgttctaaaaaggaggtggagggggtgatccatgtgtttttagcatggagtccagtgcatcagcagataaccctattggcctcagaagacaactgatgcctgatagcactcattatcacatgtcccctaccaaacacccattatctaaaaagactcatttgacattttaaaatttggttggataaaatgcctgctgattagagatatctttgggtcacagactatcatcacaaagccccaagactcaattagcaacttggcattaatgacagaagattcagtttctgtctccttaaggaactataatattaccttcatacaatagatggcaattgcagcaagacacttcctctcactgtacatttcttgaaaatggaatcaataaagacaaaatgtagagagttacagctgccacctggctactgtatatagaatctaagactttgcttcaaagcatgaaaaatgctatatgtactatgatgtggaagcactgtggagttgagtttaggacccagagcaccttataatttaaacgtaggttttaaaggtatattcctaatctttgt

SEQ ID NO: 103652 - DNA, 601 bp, Human
ttaaaaattattacttacaacaaaataaataataacagaaattaactcatcatgtgctaataaaaacagtatattttattaaaatatattttttaaaacaaaggcaattttttgagaaaagtggtggacttttctatttttacaaatcgctttaatgtctggctcagtaaaaaatggccagatttgtgcatgtacttcagcattctctctttttctatactctgtcttgctttaaacatgtagagaaaaatctaccttcatctagataagtcatttaaaaagggagaaccctatagatctyctaatacgatcttaggaattcttggtcttcaggccacactttgagaaccactgtcctaaagaagctgaagccaagggcaaggctgatgttcacttccatatactagaaggaccatgcaacttgttggtatattaaaatatatcttatcatttggtaaatagacactgcccctaggccatcagtgcaactccacttccccttcctccccggtgcctcctccaggagcatcatgatccagcaagaatggggtactggctggcacagcaggatttttatacatgatgtaagggaggggtccag

SEQ ID NO: 103653 - DNA, 601 bp, Human
ctttagttgaatctgctcttaatggtgcatccagctcattaaacatttgaccagtcaccagtcagcatacttataaatatgaaaacttgacaatgcagtctgggaacacaacatttctattagctttgaaggcatatggggtgcaattgaattttataatactgaagagtggaaacttgacatttcagagacatagaattaaaccactggagataaaaataaggagaaactgaagcacaattcctagaaaatagtatatctaaagaattatttggaaaacctggtaataccgtctaggctyagaatatcttagatcattttccaaggtaagggcatcatctacatagtttatcactattttctttgtttataccacagtgcttggcaattcgttgtccaaatttttatgtttaagatgaccttgaaaaaaattaagatatgtctaccaacactgccaggttctgcaaatagtctttttaaccttaaactgaaggagattatttacatatgtgatcttgaaaagagtttttggccattatgatgcatgttagcacttgcaagttggttttcgtaattagcacaccagatatggttgtattta

SEQ ID NO: 103654 - DNA, 601 bp, Human
aacctgaaagaatatgggtcaattagccaaattcctggaactctcctctatctagctgcccaggctcatcttagtagcaatctcaaagttgtatatttttcatcctacttaaccatgttatggtggggtttaacagtataggtactacatcattgactataagacaccattgattaaagatgaaatattactttaaacaccactaataaaagaaaaggaacttgacatactataaaatgctatcaattatcatttaaatcccaatttcacagatattaaaatgtgaaaaaaaaaacctgcrtcttggaatctatgaaattcagccatttaaattgagataaaaacagatgaacctacataaaatatggtaacactgttttgtcttttttatggtatcaattaaggattaatttaactttggttttaatgacaaactcagattaaaacttttttttccaagattttgagatctttagatagctatattatattatacttttcttctgcttctcgtttagcctagcattttctgtgccatagtctttctcaggcttccagtcttagttctgatggcatctttctatcttgtccttctttattg

SEQ ID NO: 103655 - DNA, 601 bp, Human
aaaaaaaaaaataattcaggccatcatcattttggctttgttacagtcaatgattctctgctcctcaactaagaccaagcattgcagtctaggtaatctttctgaagtagcaatgcctggttcctaatgtgtactctttaagcagtatttccacaattattacctcttgatataatgtaatcatttacagttaagaatatcaaataactatctcctaagtcaactgatttgtctcaatgaatttattaaaaataaagatgcatttgttaataataaaaatcccctaattattccaatatamcattgaaaatcttttcttctaaaatatttagctcctatagtaaaaatcctgtctggaagatctaaagtgtcctattttggctgaaatactaaattaaaacttaactgttgttgaaaaatgacaaaaataccccactttattttaaataaactatgaatgtctctattacacaaacaatggaaacctgaaaaatggaaaatatttctgaatctaataactcctttttgaaaataagtgacaattaaacatcacttttctacatacatggtgtgacattttcattttgttccaaggtatttt

SEQ ID NO: 103656 - DNA, 601 bp, Human
gttccaaatgcatatgacctgacactatctcttgttgtctcctcttgccaaaggtactcagaggcaggactgtccctaggcaaaatcgtgaagtaggtgaatcttgtattcattcccgacccttttgcaatgaaaatctcaccttagattctctccacctccctctcccaaggtacctactctagttactcattcctctggatttaccctctgttttccagggagctcatgctaactcctgttccccaatcactctttaagtatataatgtccccgctctgaaatactcagtagctcccccaagaggagctgggcaatcaagatcctccatccttaccttttgagtcttatttcccactctcccctttacatgttctactgaaaacagctcactcacctttccatttttatttacacacctttttccatagtactcctttttgcctgagctggccttgacctctcatctccatctgtggaaattctcctcatctttcagggctctgctcagctgtacttccctacatgccttatctgatcacccccagcctctctcatctgcaccccatccataccactcatatggcacttaacacatatt

SEQ ID NO: 103657 - DNA, 601 bp, Human
acagtcatttcaattctgtttgcaaactccgtttcaatttatgtatgctccctttataccaattccattcacatgtgactctacacttttgttcctcataccaatcttcataataatttaaaatttagtatttatggaaatactgcatgcaatctaagcttgaaagcagcaggctatactgtacatcaggccctctgttagaagattgagaattttcatgtcaattataagctaaatttgaggatttcaatgagcccaacaagaaaaccatcctcaaccacaatggaaaaataaaaaaacycaaacaggcaaggtattttgttttctttaaaatgtctatggtttcttatcctttacaaaactcttcatagctcatccactttttttctaactttttattttgaagaatttatagactcacaggaagttacaaaataaatgtacagtgatgtcctgtttaccttttactaagtttctcccaattgttatattttaagtaattatagtacactatcaaagccaggacattgatgttgatctaattcagttttaaattcgaaaaaagaaaaaaaaatctaccctaaagataacttacttgaac

SEQ ID NO: 103658 - DNA, 601 bp, Human
tatttcctgtcactgtcttttattttggaattctccaaggctttcagttgtctgtctttcagtctcattataaaagcctcattgaagatcaacatagagggtagaatgaattaaacttcattttctattttgtcagttgcctctaaagaaaatctgtgggatattgaaagtatttaaataattacctcttattcttatattattcattcaggcagtcatatagtcagtcattcaacaaacatccagtaagtatcccaggcacaatgctatgttctatagatttaaaaaaacaatgtatgayatgagaccctttccttcaagaggctcacaatctactcgtccatgaaaaagtaaacattaatggtagactagggtaggagtatagtcctttgtccttgggttgattaaaatttccctctagaagtgaaaattaaggatatcttttcatatatccaataggcatttacttatttccaacaaaattctataaactgggtgtgtagaaagaagtaaagatatggagaagaaagtcctctagaattatattacgtagttggagataaataattaactcacaaaggaaaaaataaggcattatata

SEQ ID NO: 103659 - DNA, 601 bp, Human
ttgtgcaaagtactttgtaatttagtggcacatggtttcaaatgaatacatgtgattacaattataaatttatattggaaatttatacaaaggaaaatagaaacaatagttcaaaaaatacctgtatgtccagtaattggattcaataaatattcatattttataatattttacatgcatgcatatgtatgcacatgtgtgtaatatatacatatgtatctacctatctagagtatgtattatgtatgtatatacatatctacctgtctatagtatttatctatgtatctacttgtgaaargtaccttgttgcccaaggctctatgccaaggattggggatgcagcagtgacccagacataacttgtttttgcatttatgaaacttacattgttaaggatagaaataaaataaaaattagcttttatatataattatgtagtcaattattaaaattgtgtttagcatttttaattaaaaagatagtttttgctggaccatatcaaagtaaaatttaaacatcataatatttctaacttcttacatcttcgaaaataaagacattagtcacatgataaaaatgtcatcacaaaaaataaaat

SEQ ID NO: 103660 - DNA, 601 bp, Human
ggagaaagtggactgctatgaatggaagtggaatttgtagagattaacaagccaacaagttttactggggtgaaagtttcttgtgaaggaattttataagtttaaaaagtttttttgttgtcagatttggaagttcaagtatttggtttttacttcataagcctggggagtaattattatttttttttttagcaacagagtggtgtaatataaataatgaagactatattggagcaggaaaatcctcttagtaggaagcatcattaagaggatattaaaatagtacagttatagaagtgtragagtttgttctggagtggccaatgtatgaatggaagaaagaaaccaaaaggagagacaacctgaagaaacttttcaatcatgcattaagcaagtggccatcaaagaatcctacattcagggttctccatcaagggctggggacatactggtgaataagacacacccagtctttactcatctacatagtagcaaaggaaatcaacattaaaagtattttattacttatataccataagcacccattggtgaactgcagggtgttatgaattgtctagtcttgcttgagtggttaaaactt

SEQ ID NO: 103661 - DNA, 601 bp, Human
aattttcaaggcagtgaggacagcctagaacacagtgagcatttctctttttttctcaaaatctccacctcatatttcaggttaccactcctggaccctattggagttgctgcaggtacatccgttaaccttaaatcacctgaaatatgaaatgtctttatttataccttatattaacaatataacattgtatcctttaaactatttgaacagttgcaaaaatggttcaccctctgccactacccacttagacatttacaacaatgaatattttcctcaagaaacacattttagttaagawgctaaagatatccaaatcaagagattttatatactattatattatctcatattatattatctaatctcatatctctaatatcatgtaataaataattttagtccattgaaattgggcatattatctttcctcactttattttcttgtcttgctgctaatggtagcaccagtccctctcttcagtacttcctgtgcaccaaataatcctacccacttttactaatcttactctggtcttttctcactttctttcttctctctagttgctctcgtctacctctcttgctttctggaaagtaa

SEQ ID NO: 103662 - DNA, 601 bp, Human
ctcaaaatctccacctcatatttcaggttaccactcctggaccctattggagttgctgcaggtacatccgttaaccttaaatcacctgaaatatgaaatgtctttatttataccttatattaacaatataacattgtatcctttaaactatttgaacagttgcaaaaatggttcaccctctgccactacccacttagacatttacaacaatgaatattttcctcaagaaacacattttagttaagaagctaaagatatccaaatcaagagattttatatactattatattatctcatattrtattatctaatctcatatctctaatatcatgtaataaataattttagtccattgaaattgggcatattatctttcctcactttattttcttgtcttgctgctaatggtagcaccagtccctctcttcagtacttcctgtgcaccaaataatcctacccacttttactaatcttactctggtcttttctcactttctttcttctctctagttgctctcgtctacctctcttgctttctggaaagtaagactcccaagtctatacttcaagtgtgtaactagcttcagagatcaatgacctg

SEQ ID NO: 103663 - DNA, 601 bp, Human
ggagatagaaattttacattcagaaattaaagaaataggaggattatagctaattgatcttatttatttgatacttctttatagaaattatgtttaaactgttttgcttatctttggtttcattacctttatatggtaacattcccagtagtaggacaccagtagaacaaccatttctatgcatgtgagatgtcacacaaatatatactgtttcttgagttaacattgggacatgccttttagaggtgtggaagctgatttaaacaacttactcaacataccaaggagcctaacataagtktccataataaagtatattattcctcattcgcattgctctatgcaatttagccgtcaaatataactcagagataagtaacctaacagaaagataaatattactgtagagaagagcctggtcccattttacatagaacacagggtatccaaagatgtagttgcagcttactccaatccagttattattgttcaacgttgcttaatgctgattcacttgaggtcaataagcttaacaatttttttcaactttctatctatagtacagtctaaaattagaaaaaagaaaatgctcacgtcatat

SEQ ID NO: 103664 - DNA, 601 bp, Human
ttgatcttatttatttgatacttctttatagaaattatgtttaaactgttttgcttatctttggtttcattacctttatatggtaacattcccagtagtaggacaccagtagaacaaccatttctatgcatgtgagatgtcacacaaatatatactgtttcttgagttaacattgggacatgccttttagaggtgtggaagctgatttaaacaacttactcaacataccaaggagcctaacataagtgtccataataaagtatattattcctcattcgcattgctctatgcaatttagccrtcaaatataactcagagataagtaacctaacagaaagataaatattactgtagagaagagcctggtcccattttacatagaacacagggtatccaaagatgtagttgcagcttactccaatccagttattattgttcaacgttgcttaatgctgattcacttgaggtcaataagcttaacaatttttttcaactttctatctatagtacagtctaaaattagaaaaaagaaaatgctcacgtcatattaggaacaatggacatatatacaattgtaataggagatagaatacaaaactat

SEQ ID NO: 103665 - DNA, 601 bp, Human
aacaacttactcaacataccaaggagcctaacataagtgtccataataaagtatattattcctcattcgcattgctctatgcaatttagccgtcaaatataactcagagataagtaacctaacagaaagataaatattactgtagagaagagcctggtcccattttacatagaacacagggtatccaaagatgtagttgcagcttactccaatccagttattattgttcaacgttgcttaatgctgattcacttgaggtcaataagcttaacaatttttttcaactttctatctatagtayagtctaaaattagaaaaaagaaaatgctcacgtcatattaggaacaatggacatatatacaattgtaataggagatagaatacaaaactattgcgattaaaccacaaagtactataagatatatgtatatattaacttttatatgtataaaatgtttctgaaggagtacacaagaaagcatgatggtgattctctgggaagggccaacacagtagtgggaaatagggtgagacggaaacttatctttcaccgtttacgtttttatttatttttttttcaaaaagaaaaataaagcaaatt

SEQ ID NO: 103666 - DNA, 601 bp, Human
taacagaaagataaatattactgtagagaagagcctggtcccattttacatagaacacagggtatccaaagatgtagttgcagcttactccaatccagttattattgttcaacgttgcttaatgctgattcacttgaggtcaataagcttaacaatttttttcaactttctatctatagtacagtctaaaattagaaaaaagaaaatgctcacgtcatattaggaacaatggacatatatacaattgtaataggagatagaatacaaaactattgcgattaaaccacaaagtactataagwtatatgtatatattaacttttatatgtataaaatgtttctgaaggagtacacaagaaagcatgatggtgattctctgggaagggccaacacagtagtgggaaatagggtgagacggaaacttatctttcaccgtttacgtttttatttatttttttttcaaaaagaaaaataaagcaaattatttccataggaccgtggaggagaggcagttgtgttctgatgaggaattgggaaggcttcttgctagtgcagtgacatgagcttttcctcttggagaggtgccacatcctagctaaatg

SEQ ID NO: 103667 - DNA, 601 bp, Human
tttatttttttttcaaaaagaaaaataaagcaaattatttccataggaccgtggaggagaggcagttgtgttctgatgaggaattgggaaggcttcttgctagtgcagtgacatgagcttttcctcttggagaggtgccacatcctagctaaatgacatattttgtgatcctatggaatcctgtaacagtaaactaagccatagggcttttttagtatcttaagcaagtatgtgtctgagttgtagctagtaggttaaattgtgtaaagagttaaacggtctgtatctcataaccttcacrttaatacagaaacatgacactgaaataaaggcccccgaagttagcttgattgttagctaaggaagaacaaacagttcataactacaccatggtgaatctgtgctgtttgcatttaggcagtagaaaatgtcagttctgtcatctgcctgaatctatccaagttatcacttaaaaattagatcaatatcacttttctctaggactctgaagggtagagagaagaagcatctgtgtcacaacagaaaagtaaaaatcgtagtactttttactgtaggctaacttacaagaataaaaatgtcc

SEQ ID NO: 103668 - DNA, 601 bp, Human
gttaaacggtctgtatctcataaccttcacattaatacagaaacatgacactgaaataaaggcccccgaagttagcttgattgttagctaaggaagaacaaacagttcataactacaccatggtgaatctgtgctgtttgcatttaggcagtagaaaatgtcagttctgtcatctgcctgaatctatccaagttatcacttaaaaattagatcaatatcacttttctctaggactctgaagggtagagagaagaagcatctgtgtcacaacagaaaagtaaaaatcgtagtactttttacygtaggctaacttacaagaataaaaatgtccattctcttagagctatgtggtaaaactctaatttgtttttactattgccctattgctcttttagcaatccaatatgaaattccatccctttgaaagatgagcaggggaggtgggaaatattccctcccatattcaaaatctcatctttcctgtgcccttttcattgggagttgctgtataaaagcctcttggattgtttttatttgaataaaatatattcttgggggagacgtgaaaaagaatgttttctatagcattggtttgctggct

SEQ ID NO: 103669 - DNA, 601 bp, Human
tcatctgcctgaatctatccaagttatcacttaaaaattagatcaatatcacttttctctaggactctgaagggtagagagaagaagcatctgtgtcacaacagaaaagtaaaaatcgtagtactttttactgtaggctaacttacaagaataaaaatgtccattctcttagagctatgtggtaaaactctaatttgtttttactattgccctattgctcttttagcaatccaatatgaaattccatccctttgaaagatgagcaggggaggtgggaaatattccctcccatattcaaaakctcatctttcctgtgcccttttcattgggagttgctgtataaaagcctcttggattgtttttatttgaataaaatatattcttgggggagacgtgaaaaagaatgttttctatagcattggtttgctggctgctttatgtgggcatttggtattaagcaatatggaaaccttatcttattacactaggaaaggaatctaatgtgaaggatacgttggtattacaataaaaatgaccaataccttattaatcttgtactattgttttaccctgaggatagtatttatggttccagccctaa

SEQ ID NO: 103670 - DNA, 601 bp, Human
tgaaacacaagccagtgctgtttatttcaatatgtaaataggatttgctttttgtacagtaaaaaaaattaaaccctggggttattgatatattaatgttatttttattgtcagtgaaataagattttaccatattactactgaccgccaaatcccctgaagatgacttttctgcaggcaaaataatgtcctattagtgacctagatttgcattttctggatttctggaggacggttgcctttaatgccaaagaaccaagtgattctttgcatttcttgaaaatactaagtgtttcaaagkctagcttagacttccgtggatcacacttagttaacgtctcttagccactttgcatttaatattttgttcatgtgaaagaaaccccagaagtaactagctcatgtgcttcagcaaggtgtctcaatcttcatgctactaccgttcaggactcgataatgtttgtataggagctgttctatgcattgtagcatgtttagcagcatcccaggcctttatccactagatgccggtagctcccccctctcctccagttgcgataacaaaaaatgtctccagacattgccaaatgtctgctggaga

SEQ ID NO: 103671 - DNA, 601 bp, Human
ggacggttgcctttaatgccaaagaaccaagtgattctttgcatttcttgaaaatactaagtgtttcaaaggctagcttagacttccgtggatcacacttagttaacgtctcttagccactttgcatttaatattttgttcatgtgaaagaaaccccagaagtaactagctcatgtgcttcagcaaggtgtctcaatcttcatgctactaccgttcaggactcgataatgtttgtataggagctgttctatgcattgtagcatgtttagcagcatcccaggcctttatccactagatgccrgtagctcccccctctcctccagttgcgataacaaaaaatgtctccagacattgccaaatgtctgctggagagcaaaatcacctgtggcttagaaccactgggttcagtgtaaaagaggcacttggtatatacataatgctgtgaatcttggtgaagaagtaaacttttttaacaggaaaataacttgttaagcaactcattcccattttctgtaacaacatttgcaaggcataatgcataatgcatatattaccaaatacaaaaaacataaattcatatgtttagaattaccttattttg

SEQ ID NO: 103672 - DNA, 601 bp, Human
ccacagcagaactttgtaccatattttgcaaatccctttatttactattatttacacaccttgagggctttctgagttcatctagtctatgttctataaatcataccactatgcaacaaatccaggctacacttttctgtccaagtcataaggtaaaattcagtttgtgctgccaaagcaatacatagcatagcaaagactgagccaacggaggaaaaggaaagaagtcctgccaagttctcaaaaggagactttctggaaggaaacaaccaccttctaaaaaatgtgttcatccgtaaarcactaatactaacttagtcctcatactgagttttaacaccatctctttgtggccaaaaggagtgcacatctggcaaaatctgaatattttaccagatgtcaaactatgtaagattcttcagtacttccagatctattaggggcagggaagatggttgtatgggactttatttcagctgtcactcaggacttttacaaagcttttcacacacctccttttccaccccagtacagcttcagcctcgtgttcgcatgtattatttctgtgtgtgtattattagtgtgtgtgtacatgtgtgtg

SEQ ID NO: 103673 - DNA, 601 bp, Human
aaagatcttattacagttagtaagtttatagtgtcatagataatttaaatattatctcagttgactttaaattttaattgtatatttgtcatgcagatttttggtatttatgtattcaaatgtatcagtctttcttttagaacaagggtcagcaaactttttccgtaaaaagccaaacagtaaatattttctgttttgtgagctatatggtctgtgtcacacctactcaattctatggtttattgtgaaagcatccatagacaatacataatgaatgggtgtgccttgagttccaataaawctatatttacagaaataggtatggccacatttgactcacagcctatattttgacaaccccagctttagagcatctgtattccatgcaaaataccttaatcactatagatttaaaatgccatatgttttcttactatgcttatagtaaattttgtttaaaaatgttgttacctttgaagtttattttatagcatgagatgagattaagattcaaaatttcatttttttgattttttttcccccaaacatggaaccaattgccataacaaattttaccaaagaaaccctctatatttcgtcc

SEQ ID NO: 103674 - DNA, 601 bp, Human
aatttaggtgtagatgttgaacttaatcaaagtttttttgaaactattgatattattttccttttgccaattttattgtattaatatatttgtaattaattgtatcataatttttaatattttcctaaggtagaatcattctgccatcaactccatttggttatgatatatccctgttaaaaatatacttccggattatacttgtgaatagtttattatcttggcatcagtttttattaataaaattagtaagctatttttgtcaggtttgaatattcaattaacaaaggctttataaaggtaatttggaataattcctttttctctaattgcagaaacaattttaaatagcattaaaaaaatctctttttggagattataaaatcttcatacccaagactatcttagttttggggaagagatgcatttattttaccaaatccagtttaaaaaataatctattactccagtcagacatgttctcaggaggctaaaactttataatctatttaagaatttgttaaggttggcccggtgtggtgactcaagcctgtaaccccagcacttggagaggccaaggcaggcagattgcttgaactcg

SEQ ID NO: 103675 - DNA, 601 bp, Human
agtttcttttttctatgtgatgaaattactttgggaggccttttccattgatgccatcttagactaggacattttaaaaatttattctttgggaataattttcagagataatttattaatcatacaagtaaaacaagttcatcaggttatattcacatgatagaaaaatggagaaacacatacataatagctagatagatagatagatagataaatagatgatagaatgggtggatagatgatgaatgaatggatggagggaaggatggatgcagggatgcggatggatgaatggatggaggggtggtcagacagacagaatataggtaatagatatcctgggacatgacactagttcttctttcccaactacagtataattttattatttgagagtttattccatatagttcgcaatatttctcccgttctattttgttctaaataaatatttgataataagttacactttatagactatttctgcattggcaaatattaagacacaagcttccaggtgccgttagacaaggatactgacaaaggtttctgagaaaattaaagacgtgcatcttctctgaaatcaaacccaacttattag

SEQ ID NO: 103676 - DNA, 601 bp, Human
tatatctgtctcattgttaagtcattgtgaatgcagggatttataaaccctacactattatcactggagggttcccactgcttttagaatagagtgttcctaaaaaaaaaaaatccatttcttttactttattgacaagaatagattatttcaggctttgctggataatcccatctttggcctttggggctttaaaccgtgtttttctctaacgttctggttgatgctggtaatgagaaccagttttactgatcatagaagtatgagctcagagtgactcactaattccaatgtgtttccmatggccaacttgaaaaagctacatagggggatgtgagagctaaattactgaagaccatcatgttttcctgtggggtttttccatgccctgaatatgttatacatgctttttgttggtgttttcttctctgttctatttgacattttaaagagcagaagtttaaagtaagtttcttaagaatccgtaacagtatgcccgtatctccagacaaatgtttacaaattggattgtggctcaaagatttaactttccttcatgtctttttctaaatacaaagttcaaaccgaaattgtcaagagt

SEQ ID NO: 103677 - DNA, 601 bp, Human
ttcctaaaaaaaaaaaatccatttcttttactttattgacaagaatagattatttcaggctttgctggataatcccatctttggcctttggggctttaaaccgtgtttttctctaacgttctggttgatgctggtaatgagaaccagttttactgatcatagaagtatgagctcagagtgactcactaattccaatgtgtttccaatggccaacttgaaaaagctacatagggggatgtgagagctaaattactgaagaccatcatgttttcctgtggggtttttccatgccctgaatatrttatacatgctttttgttggtgttttcttctctgttctatttgacattttaaagagcagaagtttaaagtaagtttcttaagaatccgtaacagtatgcccgtatctccagacaaatgtttacaaattggattgtggctcaaagatttaactttccttcatgtctttttctaaatacaaagttcaaaccgaaattgtcaagagtgaggattcattgacagacaatcagcaggaggtccttttagtggaatattacctgtgatacaaaaggattaaacatttcaaatataaacctttaatc

SEQ ID NO: 103678 - DNA, 601 bp, Human
aaatgtttacaaattggattgtggctcaaagatttaactttccttcatgtctttttctaaatacaaagttcaaaccgaaattgtcaagagtgaggattcattgacagacaatcagcaggaggtccttttagtggaatattacctgtgatacaaaaggattaaacatttcaaatataaacctttaatctgtgctatctaattactgacatctgaaccagtatcaaggaatttgtcactttttcacttttgtaattctaacaaagaaaagaagcaagaaacgtaattctgcatctggaaaaaacttctaatgcaaaagcatgtagctttagtcttttctcttgagatggactaggatatgttccctgtatttctgatttgtaaagattcagcaaggcagctctgttactgcaatcacccttgcttatgaagttatgtagacagtcccatgtaaatcagaatggtccaaccatttgatcctgtccatttctattacacatggtcaggcatatgatgagaaatgttctggctaacacaatttcatcttataactgtcctagaaaatgaaataaattgttacagcattggtttcctagcagagcca

SEQ ID NO: 103679 - DNA, 601 bp, Human
tctgcatctggaaaaaacttctaatgcaaaagcatgtagctttagtcttttctcttgagatggactaggatatgttccctgtatttctgatttgtaaagattcagcaaggcagctctgttactgcaatcacccttgcttatgaagttatgtagacagtcccatgtaaatcagaatggtccaaccatttgatcctgtccatttctattacacatggtcaggcatatgatgagaaatgttctggctaacacaatttcatcttataactgtcctagaaaatgaaataaattgttacagcattgrtttcctagcagagccaaaattatgcaaggaggaaagcccttctacttttcctcatatccctgtactctctctgataaatctttctctctttccccctctccatttacttttggtgctatacagattcaatttattagacaattactaaattacctcatattattgcttaaagtgtatcttctcttctttaatttgttaagtttaataatctccagtgaatatccattaaagagcatatgctttttcccccattttgaattgttaaaagtcattagaactaggattttgagccaatctgaa

SEQ ID NO: 103680 - DNA, 601 bp, Human
tttttgtttctaaaaatatatcctaatatcagggtattattctaccacagagaattcacattgattgtctatccatttaaaacaatatagttatagtcttttcacagtatttcaaagacttggataagctggcggtgtaaacatttcctcgtgggaactttataaaatgaaaagaaaataaatgattgatgcatactcaaactaattgaagtggtactgagtcaaccagatgttttcacctgaatcatgcccacagatgctattgcttcattatcccttaatctagggattacctccattrgctaactcgatgacatgtgagggtttcaaataagattgcctctcccttgtaacatacatcataaagagagcttgtttagagacagcctacctccgccctgaacatgttttcaaggaagtgatcagggctgtttgtttttcttgctgttggatgtggtcttcagtgaagtcacaggaatggaatgagagtggccacagttgacaatggagctatttccacagctggctgcaaagagtgggcagtccatcacagataaactagcacatggggatagatgatataaaacatctgtcacaatag

SEQ ID NO: 103681 - DNA, 601 bp, Human
tctcatctggacagttttaaatatattaattgaaatcttgaaggcctcagaatgtaacttgtttggatgctaatatataagttttaaccttagaatatgtctgttacaccaggacatattttatctcagcattagaccacagaacatgtcatcaatagggtatatactgagtttgaagcatgttagcaataataatactaatagaaagtgtgctttaaaaggagtaaattagttctttaatagggtcgtgacttcacacctgtatccttagatctagttaagtttccagccctaaccaggsaaattcctaaaaatatcttaaaggagaaaaatattctctgagggaccacaaaataaagtgctttttgcagcaaattgcaggacaaggaatagctactttcttagtaatagccaaaaattgaggtgccttgtgacatatttaggcaacttgcactataaacaatggccataagtaagataacaggcagctatttctcttgatcgcccctgtggtttgagcaatgattttccaggcccatttgccaataggatcttacaagaccttgaaaaggatttgcaagcaggtctttcagtctatttg

SEQ ID NO: 103682 - DNA, 601 bp, Human
tatattaattgaaatcttgaaggcctcagaatgtaacttgtttggatgctaatatataagttttaaccttagaatatgtctgttacaccaggacatattttatctcagcattagaccacagaacatgtcatcaatagggtatatactgagtttgaagcatgttagcaataataatactaatagaaagtgtgctttaaaaggagtaaattagttctttaatagggtcgtgacttcacacctgtatccttagatctagttaagtttccagccctaaccaggcaaattcctaaaaatatcttamaggagaaaaatattctctgagggaccacaaaataaagtgctttttgcagcaaattgcaggacaaggaatagctactttcttagtaatagccaaaaattgaggtgccttgtgacatatttaggcaacttgcactataaacaatggccataagtaagataacaggcagctatttctcttgatcgcccctgtggtttgagcaatgattttccaggcccatttgccaataggatcttacaagaccttgaaaaggatttgcaagcaggtctttcagtctatttgtcagtaaggagaagtttttaa

SEQ ID NO: 103683 - DNA, 601 bp, Human
gataacaggcagctatttctcttgatcgcccctgtggtttgagcaatgattttccaggcccatttgccaataggatcttacaagaccttgaaaaggatttgcaagcaggtctttcagtctatttgtcagtaaggagaagtttttaatgagaagttttatgacagctcacagtcctgagtcctagttaaacccagataaacattttaccagacaaaagatgaggtccataaatattcagacgtcttctgggaaccctgtttgccttatcatttggaagaaggctggcctgagtactgcatcygatgtgtgcttgaaacttctgtaagttgaaaatgtgtttggaggtatacaaagtgattgctgtacaaatgaataaagcatttcttatcacatgacaaggtttgacaagaatctcaggcagatatatggctactaaaacagttcatggcatagcaaagtcctaatttaaaaaaccttaacctacatttgtggcagtacacattggctgtaatatgtacagaacatcttgcagcatttaactgagcataaataattcttccatagaatggaaatcatgtcgtgaactccaatgttaaacttc

SEQ ID NO: 103684 - DNA, 601 bp, Human
tgcaagcaggtctttcagtctatttgtcagtaaggagaagtttttaatgagaagttttatgacagctcacagtcctgagtcctagttaaacccagataaacattttaccagacaaaagatgaggtccataaatattcagacgtcttctgggaaccctgtttgccttatcatttggaagaaggctggcctgagtactgcatccgatgtgtgcttgaaacttctgtaagttgaaaatgtgtttggaggtatacaaagtgattgctgtacaaatgaataaagcatttcttatcacatgacaagrtttgacaagaatctcaggcagatatatggctactaaaacagttcatggcatagcaaagtcctaatttaaaaaaccttaacctacatttgtggcagtacacattggctgtaatatgtacagaacatcttgcagcatttaactgagcataaataattcttccatagaatggaaatcatgtcgtgaactccaatgttaaacttccttgggtggggtgtggctctcagaagccctgggattttcatactaaataatgagaaggtcaagctggcagtggtcagactgagatactgtcaaagaaaa

SEQ ID NO: 103685 - DNA, 601 bp, Human
tcagtaaggagaagtttttaatgagaagttttatgacagctcacagtcctgagtcctagttaaacccagataaacattttaccagacaaaagatgaggtccataaatattcagacgtcttctgggaaccctgtttgccttatcatttggaagaaggctggcctgagtactgcatccgatgtgtgcttgaaacttctgtaagttgaaaatgtgtttggaggtatacaaagtgattgctgtacaaatgaataaagcatttcttatcacatgacaaggtttgacaagaatctcaggcagatatrtggctactaaaacagttcatggcatagcaaagtcctaatttaaaaaaccttaacctacatttgtggcagtacacattggctgtaatatgtacagaacatcttgcagcatttaactgagcataaataattcttccatagaatggaaatcatgtcgtgaactccaatgttaaacttccttgggtggggtgtggctctcagaagccctgggattttcatactaaataatgagaaggtcaagctggcagtggtcagactgagatactgtcaaagaaaagcagaggaagtgtatgaatggatctt

SEQ ID NO: 103686 - DNA, 601 bp, Human
ctactaaaacagttcatggcatagcaaagtcctaatttaaaaaaccttaacctacatttgtggcagtacacattggctgtaatatgtacagaacatcttgcagcatttaactgagcataaataattcttccatagaatggaaatcatgtcgtgaactccaatgttaaacttccttgggtggggtgtggctctcagaagccctgggattttcatactaaataatgagaaggtcaagctggcagtggtcagactgagatactgtcaaagaaaagcagaggaagtgtatgaatggatcttttaygtccatctttttggccagagaatgcttctggtatttccattgaatcttcttgtccagtttgagcaaggagctgctgttattgtttcacataccattaaagtcatcagagacctgctggtgagcaagtgccattcactcactcagtccattagcaccactaactaagcatctgttttatgacagacactgtgctgggctcagaaccattaaaaaagaaatatataaggtattgctaatgataccagtgaacttaggattcagggaagaaataaagtttgatcatgatcaaagtgtgtgcaa

SEQ ID NO: 103687 - DNA, 601 bp, Human
gattgtttctaagaattagagacatttcttactccttttgtttcttctccccacaaaagcctttcttaaaccctgaaccctcataaaacaaaacaaaacaaaacaaaacaaaacagttgacatcaacaaatgaaagaaattagacatccctacatatactacaagacaaggaatgttgcatgctaatactgcagaacactgcatttggacagctattcctcaagctaccttcatgccatttatattatgagatctctgttgctattaggtatttgttctaggaatattaaaaactggcaamaatcagacatgaataaaagaataatgaaatagtgacttaaaaccacctttttaaaattcatatatagttttgtgtgaataactataggcaatcgtataatacaaatcacagacattttgacttgaggcatttagataagacagcagaaaaaaagggatgctgtttttttaattttcacttatccaaataattttatttttgtttttccatttctatgagttcaaatgcaaggctactaagattccaaatatgaaggattcccaatgtgttataatagaagccaaactgatcaaattgaag

SEQ ID NO: 103688 - DNA, 601 bp, Human
acatttcttccattcccttaagattaaaaaatttgtattcttaataatttgtaggattgttttcactgaatgtttttattgaatgcaaacaagactctagattcttacatatccttccccaagaatccttattttattttttatttatgtgcaataactgatctgcttagaaagaactgttcatttatgtgcagtaactggtctccttacattattttccactctgtgcctagtgttgctatttacaattccaattaatgataaatcccttcttacttttccctttgattgtcaggtttcyggtttatacacagaagcaacactcactctatgacatctgtaatcaaatgagtccccaaatactgctttcaatgaaaagattctgaaagagaccagacaattcttccaaaattaattccaagtgcaggcattcgatccttctcatcatgcatgaattttgattgttctgtcacatgctcacctacctcatctgcatattgcctttaaaaaaaacacacccctggggaatgagacaacctccagggtattgagaagaaagtatccttaccaaacgcagtttggtttttatctctgatttaca

SEQ ID NO: 103689 - DNA, 601 bp, Human
aaaaaaaacacacccctggggaatgagacaacctccagggtattgagaagaaagtatccttaccaaacgcagtttggtttttatctctgatttacatgaatgatcctttttgtggctagagcaagctgtttagaattgaggggtttctgggattgtgacagtttagctgcatgttggaatgtctaagggcaaatattctaaaaagataacctgtcttgagttcaagaagagaatcgaagtcttgcagctgctaagcattagaatgttgtcaaagtgccactttttggttgaaaaaaaaaaatgcttcaggacttccatcttaactctgaggttattctataatttatccctaggtgatttaagaagaacccttgttcttcttaaagtgtttacttctggtctggcacaacaaatacctgaaatgaaggccagtaagtattttttaaaaaaggaaaacaataaagatggttttgttaaaaagattcaggcagcagaaagaaaagtgatgtgtctctgaattataattaagtaaaagcttatcttatgtttctcatttaagaggcatcctgatgaatgacaatgcacagaagcatcgagaaat

SEQ ID NO: 103690 - DNA, 601 bp, Human
tgaaaattaatggggaggagcccacagagaaggcagagtgatagcctgatctttttcacagatatagtcaggaagttgaatttcgataataccaggaagaattgcttagtttgagcaaaagcattttaggaaacgcgcagtgggtaattagtttgggtgccgagatctggccatctacatgcatctgtccagtgagaaaaataatgtttagggaaataatttattcagatacataatcatttgatcataactgagtatttaaatgggttgttataaaatatgtttctacttttatcacaakctttaaataaacattgaaattatatactctcaaagattccatccaattcaagctttttaagtttgttttttaaaaatatttttccttctccaagttaattactgcaaggaaagtagcagggtagagaaagagaaatggaaggataaaatgacttagctccattcttcactcaccatatgacactttgcatatggatggaagttttttaaaatgtctgtaatttcttttatccccaacaatgataataaatcaaaagacatattctagacatccacttttcttaacatctgatttaaaagt

SEQ ID NO: 103691 - DNA, 601 bp, Human
ttcaagctttttaagtttgttttttaaaaatatttttccttctccaagttaattactgcaaggaaagtagcagggtagagaaagagaaatggaaggataaaatgacttagctccattcttcactcaccatatgacactttgcatatggatggaagttttttaaaatgtctgtaatttcttttatccccaacaatgataataaatcaaaagacatattctagacatccacttttcttaacatctgatttaaaagttgacacttttgtttttaaaaaaaaattgtggatggacataaaaattkgaccagctctaacagagtttggtattctgtcttgtgtctaaaatatagatagatagaaaacaggtcaaaaggttaggaggaaaacaaatgggaaatagtaatttcgatttttagattatcaatgatagattttaatatgtccttcaaagagatccagttcagaaacccatgtgggccagcattatccctcttagtggtagattgtattggggtgactaagaattatgtatgtattaataagtaatagataaatgacataaaccaagtcttatcaaataacaagaaaattagagaatttcc

SEQ ID NO: 103692 - DNA, 601 bp, Human
gactaagaattatgtatgtattaataagtaatagataaatgacataaaccaagtcttatcaaataacaagaaaattagagaatttccactaatgttcatatgtttcagtcagagaagtttatatttagaacagtgggcaagaggatatagatgattttcaatacattctacctcaaaaaatgaaaatgtaagtgacatattttagacacatcacaggtaaattacctcagaagaaaggaagatgttaatgccatctattcagacaagcacaaaatgacatgaatggacataaaaattatayacagttgaatttagcctttttagtaaaaaagtaaaaacatttgatgttcacacatttacaatttacagtgtttatttgtaagaagtctccttccttgtaggatatattttcaaatggacattgtatatgcttgtagggtgctgtgattacaccaaccatggaccatcccatgtcaatgcagccagccaacatgatgggcccactgacacagcagatgaatcacctttcgttgggcacaacaggaacggtgagttgaagagattgttttgtttccttgaacttttttgatcagatgtgaca

SEQ ID NO: 103693 - DNA, 601 bp, Human
attatgtatgtattaataagtaatagataaatgacataaaccaagtcttatcaaataacaagaaaattagagaatttccactaatgttcatatgtttcagtcagagaagtttatatttagaacagtgggcaagaggatatagatgattttcaatacattctacctcaaaaaatgaaaatgtaagtgacatattttagacacatcacaggtaaattacctcagaagaaaggaagatgttaatgccatctattcagacaagcacaaaatgacatgaatggacataaaaattatatacagttgmatttagcctttttagtaaaaaagtaaaaacatttgatgttcacacatttacaatttacagtgtttatttgtaagaagtctccttccttgtaggatatattttcaaatggacattgtatatgcttgtagggtgctgtgattacaccaaccatggaccatcccatgtcaatgcagccagccaacatgatgggcccactgacacagcagatgaatcacctttcgttgggcacaacaggaacggtgagttgaagagattgttttgtttccttgaacttttttgatcagatgtgacattctccat

SEQ ID NO: 103694 - DNA, 601 bp, Human
acgtgatagtccaaaagttgtcacatgggtggaaaaagaaaatttgggatttttgcttttaataaaggtcatataaatggaataagagtcacacaagaggacctatttaaccatgtgttggcagttgatttgaatctaaacaatatcaagtttcttttagagtttacccctccaaggggagtggggacaaaattagaattttccatttttagaaggggaccctaggcctatgccatattccaatctcctttttaagatccctggctaaagaaattgcagtgagccaaaagctcttttttcrtctttaaaaaatcagatatattttgtgccatgtaacccctaattttgaaatgattgccatgtagtttaattaagctttatctagaatttgacaccttcaatgctaggagacttgggataaagataaccgtcacgttcaatagattctgttctgtgtatctctgctcccacagttacaacacataaagctttttggccttgaggtgaaagcaccttccgctctgcctcactgacaaccactgggatcagagctggagctgagtaataaataatgaaattttgccttcaaaatgtgttagcc

SEQ ID NO: 103695 - DNA, 601 bp, Human
ctgattctattttattttcttttgtacttcattgcattctttctcatgctcttttcattcaaagattcaatcccaagacaggattatgatactccaccagctgttgtgtcaggtaggaaaattctaattcttttaagactggattggaggggagagatggaggttgcctggttttttcccaaactctttaaagcagtgattctcaacagaggtgggtgcaggaaatttgaattccagtttgcaagggggcatgtgtagttcagaaacataaacttaatattataattcagttatatatctrgaaaataaatgtgttgcattttaaatagaaagtaaaaactcaaaaccattttatctgtcaaggatacacagaagatagagtctgtgttctgtgtatcagtgattctcagtgttagacacagtcatcaaattcctgaaaagtgggaaaataattttatgtatagcaaaagacggcacagattaataaaaaatagtttgagaagcactgctttagagaccagaattcttctaaattggaaaatcatcccatttgcttgctcagcaccctgcatagggtctgacacatagtaggtactcaata

SEQ ID NO: 103696 - DNA, 601 bp, Human
aaatacccagcttaatctattttcccttagccttggttatcaggatagttggaattagatggagtacattgcaaatgttcctggtagcatgttctctctattgctcttaactgtttgttgatttgctggtatttttaattgtgcttcttaatgcagtgcttaattttgtaaatcttccacaaattcaacttggaagtacaaagcttctaattcctttagtaaaaaataaatgaagaaatactattgggctaatgggaagtttgtgtgctaaacatcttaggagaaggacaaaatgaaagaygattttgattgtgtgttgatcttatctaaaaatttaccaccagacactgtttgttttcattctcacacatgcagttttaaacaggaaaaagtatggtagaaaaaatcaaaatgatttttagaattcacaggatgtatgtgatttctgagtcatattatttaataattatttaacaattagagttacttaaattttctgaagcttagcttttctctccttaagagtagagagtatataatctattcattaccctttatatatacacaacaataaaaggattaattgaaaggatatgtccaa

SEQ ID NO: 103697 - DNA, 601 bp, Human
atacttcaatgttggcttttactcttaataaatgtggagagaaaaagtgggggaggtaatactaggctagtcagatgcctgaattttctctcacagttctaaaatttaaaagtatctcttccagaaagttactctaggtaactgccatcctttggcaggactagcacaatatccatctaactggtcggactgattcaagccttctttccattcaattcattttctctacagccccagagccacgtttctgaaacaaacaggacatgtttgaaatccttttgcagctttcaggacataatcytcagtccttagcctgtgcaacaaggcccttcatgatcctgatgcctcctttttcacattcatctgttactacttctgttctcccgccataatgaactgctttcagtttctgggatgggccaagcctgcagggtctttgcataagtgggagtagataaacatgagcaaatcctcatctagaatgtgtttcctttactcttcaacctgctaatgctggcttgtttcacagcaattgtctcaaatgttttcttcttcttggaaggttgccttatccttttgtcttgtcttagagttttctctc

SEQ ID NO: 103698 - DNA, 601 bp, Human
ttctcccgccataatgaactgctttcagtttctgggatgggccaagcctgcagggtctttgcataagtgggagtagataaacatgagcaaatcctcatctagaatgtgtttcctttactcttcaacctgctaatgctggcttgtttcacagcaattgtctcaaatgttttcttcttcttggaaggttgccttatccttttgtcttgtcttagagttttctctccccttaggtgtctgggaatacctttattgtaacatttagcacactgaatcaccatttccagtttaattatcatttctsccctctagagtaaaggctataaactcttagagcagagactattcatatttaccttatttctccataatccagcaacatctggcccatggtaggtgtttattaaatattcattgattgaataaatgatacctatatgtaaaaatgctgattcgttagacacacattctacataatcctaactttctcctcaaaagattaaaatagcaagaggaaaacagactcagaattcccaagaagtctggaaatgtgaatgaacaactaagtgcagagagctttctgaaggggataggaaagactcat

SEQ ID NO: 103699 - DNA, 601 bp, Human
gagctttctgaaggggataggaaagactcatgacaagaaaatggagttgggaggatgtcaaaggatttggagacagtagaataattggaaaatgatgcttatatgaaataatttaagatattggtggaaatgtacaatgtgtctattagaaatatgaatgcccttcagcaatgttgcttatctgaaaggtttcattttcttattttccctagatagccatcatattcatttatcttactaacatcctcataattgattccccagtgtcaccttgtaaaagtacttttatactcttttcatygccaagatacctcacacgtacaccattgcaaacatacactggtcccaatgacatcgcatctttgctttatttttatttttttaaatagattcttcaatagcctatgttatgccttttacagattctctggacacacatcaggtgcctcaccatcattgttaatggcaatcagagcaagtaatgtcttttagttctttttcattaatgaaatggaatagcaccatattcagtctgttagtgatacactattacatcgagagcttactgaagaaatgcagccagcctgtgtacatagggctg

SEQ ID NO: 103700 - DNA, 601 bp, Human
tctagcagaaaagtttgctgtcttcccctctttctttctcatttgttttgtcctatttttttcctgacagtctgcaagaaatataatgttttctaaatgacattgaaaattcttgcagattaggtattcaaagggataaaatatcaattaatcttttgaaagcctttcttttttgttgttcctgtctttggatttcagtttcttgaattccttactctcaaagaaatgtttttcctcttgatttttctcattataaaactggatataaatgtaaagtaagcagtcattctaggtatttttwaaattcctttagcattcatgcagaaaaaaaaactctgctgttattttaatccctttaggaaagtatgtttgattgatgccctcgaacttggctagttgaggcaaaatctgagagtttttttttaatcctctaaactcaattgaattatattgccttagcttatactttataaggtgcccgttagctttaaaactcacactaccggcatttgtgcttgtcaaccaagccatttagactttaagttcatttgaagaattaaattaatgtgatgctaaagcgtctatttgtgtataggtccca

SEQ ID NO: 103701 - DNA, 601 bp, Human
ctatttttttcctgacagtctgcaagaaatataatgttttctaaatgacattgaaaattcttgcagattaggtattcaaagggataaaatatcaattaatcttttgaaagcctttcttttttgttgttcctgtctttggatttcagtttcttgaattccttactctcaaagaaatgtttttcctcttgatttttctcattataaaactggatataaatgtaaagtaagcagtcattctaggtattttttaaattcctttagcattcatgcagaaaaaaaaactctgctgttattttaatcyctttaggaaagtatgtttgattgatgccctcgaacttggctagttgaggcaaaatctgagagtttttttttaatcctctaaactcaattgaattatattgccttagcttatactttataaggtgcccgttagctttaaaactcacactaccggcatttgtgcttgtcaaccaagccatttagactttaagttcatttgaagaattaaattaatgtgatgctaaagcgtctatttgtgtataggtcccagttcctaaaataacttttcttagcagtctcaccaagagtgaaatgctgttag

SEQ ID NO: 103702 - DNA, 601 bp, Human
tttttcctcttgatttttctcattataaaactggatataaatgtaaagtaagcagtcattctaggtattttttaaattcctttagcattcatgcagaaaaaaaaactctgctgttattttaatccctttaggaaagtatgtttgattgatgccctcgaacttggctagttgaggcaaaatctgagagtttttttttaatcctctaaactcaattgaattatattgccttagcttatactttataaggtgcccgttagctttaaaactcacactaccggcatttgtgcttgtcaaccaagcmatttagactttaagttcatttgaagaattaaattaatgtgatgctaaagcgtctatttgtgtataggtcccagttcctaaaataacttttcttagcagtctcaccaagagtgaaatgctgttagtgggctaaaggaaagtatatcaacttcacaggccttattctagaatcagtaatttgtgtgttaaaaaatgagtattaaagtaggcagtacagctgatgcattcttgttaaataaagcatgaaagttcagcttttgtgttcatttctgcagtgagttccctttactacccctttttc

SEQ ID NO: 103703 - DNA, 601 bp, Human
acaagaattcgactgctcaatagaagtacctcatcccatcttaatgctgagcaggcagcatatggtgaaagaatgaatacaagttttgaacaagatgagcatttaaatcccagctcttgcatggactgtatgtatgggttctctgaagctgtcttaccatctgtaaagaagataatgacaatactcacagagatatactatgagagttagatgagatattggcatagtcataatagatactcaatctttcccacatcacaggattccaagcttttgacttagcatgttcaattttttaaascaatagttctcaaactgtgatcccagtctagcagcacagcatctcctgagagcttgttagacatacagattctcaggccttgacccagatctactgaacccaaaagggttgggcagggggtgagggtggaggtggaaccatcttatttttaaaaagcctccaggtgactctggtgcatgattctgatggtgagtttgagaaccacttaagccaatcagcaaatcacaaacattggctgtgtgtgaatggggaaaggataaaatgattaaaacagtgggaggtatataagttcattttcat

SEQ ID NO: 103704 - DNA, 601 bp, Human
gaagcaaacacatccttattcacatggcagcagcaaggagaagtgccaagcaaagtgggaaaagccccttataaaaccatcagatctcctgagaactcactatcacaagaacagcatagaggaactgccccatgattcaattgtctcccaccagatccttcctgcaacatgggattatgggaactacaattcaagatgagatttgggtggggacatacccaaaccatattatttcaccccggcccctcccaaatctcatgtccttacctttcaaaacacaatcatgcctttccaacagtcstccaaagtcttagctcattccagcgttaacccaaaagtccaaatccaaagtctcatcagagacaagggaaattccttccacctatgagcctgtaaaatcaaaggcaagttagttacttcctagatacaatgtgagtacaggaattggataaatatacttattccaaatgggagaaattagccaaaccaaagggactacagaccccatgaaagttcaaaatccagtggggcagtcaaatctcaaagctccaaaatgatctcctttgactccatgtctcacatccagggatgtggtacaaga

SEQ ID NO: 103705 - DNA, 601 bp, Human
cctagcagaagttctccatgagagttctctgtccctgcagcaaacttctgcttggacatccagatttttccatacatcctctgaaatctaggcagagattctcaaacctcaattcttgacttgtgtgcacctgcaggctcaacaccacgtggaagctgccaaggcttggggcttgcactctctgaagccatagcccaagccgtaccttggcccctttctagccatggctggagcagctaacacagaagtcactaagtcctaggctgcacacagtgaagggaccctgggcctggttcaggaractatttttcctccttagcctctggtcctgtgatgagaggggctgctatgtagacctctgacatgccctggagacatttttcccattgtcttggtgattaacagttggctcctcattacttatgcaattttctgcagccagcttgaatttctccctgaaaatgggtttttctttcctatagcattgtcaagatgcaaattttccaaacttttatgctgtgtcacctcttgaatattttgtggcctagaaatttcttccaccagataccgtaaatcatctctcttaagttcaaagttccac

SEQ ID NO: 103706 - DNA, 601 bp, Human
ctcatgctgctatgaagaacttcatgagactgggtaatttataaaggaaaaaggtttaattcactcacagttctgcaggactggggaggcctcgggaaacttacaacaatcatggtggaaggtgaaggaaatatatccttcttcacatggtggaaggaagaagtgccaagcaaagaaggaaataaccccttataaaaccattagatctcatgagaactcactcactatcctgagaacagcatggaggtagctgcccccatgattcaattacttcccaccaggtccttcccacaacatgtgrggattatgggaactacaattcaagatgagatttgggtggggacacagcaaaatctaatcaggagggagttaaactgacagtagacattttagtcttgtgtagaatgttaatttttctttatcagtcaaactccttccttccagaattatacatatatatgtataatatatattaatatatataatatatatattatatatttttatatatattttgtatgtataatatattatatatgtgtatatataatatattattatatattgtatatataataagatatatatacatatctttctt

SEQ ID NO: 103707 - DNA, 601 bp, Human
gagaacagcatggaggtagctgcccccatgattcaattacttcccaccaggtccttcccacaacatgtggggattatgggaactacaattcaagatgagatttgggtggggacacagcaaaatctaatcaggagggagttaaactgacagtagacattttagtcttgtgtagaatgttaatttttctttatcagtcaaactccttccttccagaattatacatatatatgtataatatatattaatatatataatatatatattatatatttttatatatattttgtatgtataatatattatatatgtgtatatataatatattattatatattgtatatataataagatatatatacatatctttcttttatgatttccttccttttgcatgactttttttgaagactgacataatttcacttaggttggaaatgagtgtattggtccccttggagaaaaataaataaatccctatttgagtttatccagtacaataaaaactatcaggataaaatgatataagtaggaagtcctagaaaaaatgaaatccaatgatcagtaccttcgcatagtatgtgtatccgctatggaatagttg

SEQ ID NO: 103708 - DNA, 601 bp, Human
agtattttttttcagctaggggttgagttctcgatttgattctccacttggtcactgttggtgtatagaagagctactgatttttgtacattaaccttgtatccagaaactgctgaattctttgatcagttctaggagttttctggaggagtccttagggttttcaaggtaaataatcatattctcagcaaacggacagtttgacttcttctttactgatttggatgccctttatttatttctcttgtctgattgctctggctaggacttccagtactatgttaaagaggagtggtgacartgggcatccttgtcttgttccagttctcagagggaatgctttcagcttttccccattcagtgttatgttggctctgggtttgtcatatatggcttttattacattaaggtatgtcccttgtatgccaattttgctgagggttttaatcataaagggatgctggattttgtcaaatgctttttctgcatctattcagatgaccacgatttttgtttttagttctgtttatgtggtgtatcacacttattgacttgtgtatgttaaaccatccctgcatctctggtaggaaacccacttgat

SEQ ID NO: 103709 - DNA, 601 bp, Human
ttttttttcagctaggggttgagttctcgatttgattctccacttggtcactgttggtgtatagaagagctactgatttttgtacattaaccttgtatccagaaactgctgaattctttgatcagttctaggagttttctggaggagtccttagggttttcaaggtaaataatcatattctcagcaaacggacagtttgacttcttctttactgatttggatgccctttatttatttctcttgtctgattgctctggctaggacttccagtactatgttaaagaggagtggtgacagtggrcatccttgtcttgttccagttctcagagggaatgctttcagcttttccccattcagtgttatgttggctctgggtttgtcatatatggcttttattacattaaggtatgtcccttgtatgccaattttgctgagggttttaatcataaagggatgctggattttgtcaaatgctttttctgcatctattcagatgaccacgatttttgtttttagttctgtttatgtggtgtatcacacttattgacttgtgtatgttaaaccatccctgcatctctggtaggaaacccacttgatcatg

SEQ ID NO: 103710 - DNA, 601 bp, Human
acttggtcactgttggtgtatagaagagctactgatttttgtacattaaccttgtatccagaaactgctgaattctttgatcagttctaggagttttctggaggagtccttagggttttcaaggtaaataatcatattctcagcaaacggacagtttgacttcttctttactgatttggatgccctttatttatttctcttgtctgattgctctggctaggacttccagtactatgttaaagaggagtggtgacagtgggcatccttgtcttgttccagttctcagagggaatgctttcarcttttccccattcagtgttatgttggctctgggtttgtcatatatggcttttattacattaaggtatgtcccttgtatgccaattttgctgagggttttaatcataaagggatgctggattttgtcaaatgctttttctgcatctattcagatgaccacgatttttgtttttagttctgtttatgtggtgtatcacacttattgacttgtgtatgttaaaccatccctgcatctctggtaggaaacccacttgatcatggtggattatcttctcattttgttgttggatttggttagcta

SEQ ID NO: 103711 - DNA, 601 bp, Human
ctatcttgtggaatagtgtcaaaaggattggtaccaattcttctttgaatgtctagtagaaatcttctatgaatccgtctggtcctggatttgtttttgtttttatttttgtttttgagacagtctctggcctcactgcaacctctgcctcccgagttcaagtgcttctcctgcctcagcctcctgagtagcttggaatacaggtgtgtgtcaccatgtccggctaattttttgtatttttagtagagacgggatttcaccatgttagccaggatggtcttgatctcctgacctcgtgatytgcctgcctcagcctcccaaagtgctgggattacaggcgtgagccactgtgcccggcctggactttttgttgttgttggtaattttttaattactgtttcaatcttgctgcttgttatcggtctgttcagggcatctaattcttcctgatttaagctaggagggttgtatttttccagaaatttatccgtcttttctaggttttctagtttatgtgtgtaaatgtgttcacagtagccttgaattatcttttgtatttcagtggtgtcagttgtaatactgtttcatttcttagtgaggt

SEQ ID NO: 103712 - DNA, 601 bp, Human
cctgacctcgtgatttgcctgcctcagcctcccaaagtgctgggattacaggcgtgagccactgtgcccggcctggactttttgttgttgttggtaattttttaattactgtttcaatcttgctgcttgttatcggtctgttcagggcatctaattcttcctgatttaagctaggagggttgtatttttccagaaatttatccgtcttttctaggttttctagtttatgtgtgtaaatgtgttcacagtagccttgaattatcttttgtatttcagtggtgtcagttgtaatactgtttcrtttcttagtgaggttatttggattttctctcttcttttcttggttaatcttactaatgtcctgttaattttatttatcttttcaaagaaccagatttttgtttcatttatcttgtgtatttttgtgttttgttttaatttcatttagttctgctctgatcttggttattttctttcttctgctaggtttgggtttagtttgttcttgtttctctagttctgtaaagtgtgaccatagaatgtcagtttgtgctatttcagactctttgatgtaggcatttagggcttgatctttcctctt

SEQ ID NO: 103713 - DNA, 601 bp, Human
tttcaaaagaaatgtggattatcatcaagaataggaaatgaatgctgagttgtaagaaaaaaatgcaaatagaagttcacccttgtcatcattcttcatatccttctgtctatagtgtacaacttttgattgatttttacttttgaccttaagtcattgatccctcttttaaaaatctgtcttgttttataaatatccttgagacaagacttaagagtatttttaggaaattcaaacctacatatttttattttctataagtgtgtatgaaattcattaaagaggatgttcgtttatatcyaccactttaaaacttacagcagtttaaatataattggttttcagtaaaaattgtatataatgtaggaaacatgacttcattgggcaaaactctagaaaaatatgtagttaacatttttgggaaaaactgtccgtagtagcctgtgagttagtgaaggagtgtccccaggccctaaacagaaactaatgttttctaggatatagcattcaaggaccaagaaactaggtgagaccagatcaagaaaattaggagataaaaatgaagagtaatatgatatctgtattgctttttctttttgtt

SEQ ID NO: 103714 - DNA, 601 bp, Human
caaaactctagaaaaatatgtagttaacatttttgggaaaaactgtccgtagtagcctgtgagttagtgaaggagtgtccccaggccctaaacagaaactaatgttttctaggatatagcattcaaggaccaagaaactaggtgagaccagatcaagaaaattaggagataaaaatgaagagtaatatgatatctgtattgctttttctttttgtttgattttggctgccttcttctttgctaccacccaataatgagcacttctggtttgcttatctatttatttcattagttttatttyttttcgaagctaattcttacacgcctctcttaatgttcagaccctttatatcttattttttccagtgaatgggagatattaagatttgtccttttgagttgattatatccaatttattttctttgtttgagaatgtaactgagatatcactgggtctctcaatattttgaaaccagatgattgtctaaaatcctcaatcccataccctttagaagtccaaagctttatgcaacatgtatttgagttttcaagggcattaataatcacttttatttgctccctttattctaggttgatttt

SEQ ID NO: 103715 - DNA, 601 bp, Human
ttatttcattagttttattttttttcgaagctaattcttacacgcctctcttaatgttcagaccctttatatcttattttttccagtgaatgggagatattaagatttgtccttttgagttgattatatccaatttattttctttgtttgagaatgtaactgagatatcactgggtctctcaatattttgaaaccagatgattgtctaaaatcctcaatcccataccctttagaagtccaaagctttatgcaacatgtatttgagttttcaagggcattaataatcacttttatttgctcyctttattctaggttgattttgatgtaaaatttaatcttttttcaattttctcataaaaatcccactcagagtcacattaatgaagatttgggatgtgttcaggaatcgaaacatattgttcgttccaataacttcaacttgaatataaagctacatctctgtggtttaaatgccttttaatagcttcaccaaagtggaatttcaggcccataccactcatgggctcctctctcctccgtcttcccgccagcttcttcaggttttctctcttcccatctttcttagaaacacaagatgctc

SEQ ID NO: 103716 - DNA, 601 bp, Human
agatattaagatttgtccttttgagttgattatatccaatttattttctttgtttgagaatgtaactgagatatcactgggtctctcaatattttgaaaccagatgattgtctaaaatcctcaatcccataccctttagaagtccaaagctttatgcaacatgtatttgagttttcaagggcattaataatcacttttatttgctccctttattctaggttgattttgatgtaaaatttaatcttttttcaattttctcataaaaatcccactcagagtcacattaatgaagatttgggaygtgttcaggaatcgaaacatattgttcgttccaataacttcaacttgaatataaagctacatctctgtggtttaaatgccttttaatagcttcaccaaagtggaatttcaggcccataccactcatgggctcctctctcctccgtcttcccgccagcttcttcaggttttctctcttcccatctttcttagaaacacaagatgctcccattccccgctttataactgcctcctctcttggactcacttctccagctcctccagtgtcttctctcttcccatctttcttagaaagacaaga

SEQ ID NO: 103717 - DNA, 601 bp, Human
gtccttttgagttgattatatccaatttattttctttgtttgagaatgtaactgagatatcactgggtctctcaatattttgaaaccagatgattgtctaaaatcctcaatcccataccctttagaagtccaaagctttatgcaacatgtatttgagttttcaagggcattaataatcacttttatttgctccctttattctaggttgattttgatgtaaaatttaatcttttttcaattttctcataaaaatcccactcagagtcacattaatgaagatttgggatgtgttcaggaatcraaacatattgttcgttccaataacttcaacttgaatataaagctacatctctgtggtttaaatgccttttaatagcttcaccaaagtggaatttcaggcccataccactcatgggctcctctctcctccgtcttcccgccagcttcttcaggttttctctcttcccatctttcttagaaacacaagatgctcccattccccgctttataactgcctcctctcttggactcacttctccagctcctccagtgtcttctctcttcccatctttcttagaaagacaagattatcccattcccc

SEQ ID NO: 103718 - DNA, 601 bp, Human
gtttttatattgcccaaattgtactcacatggatagagtagtaccatttaattgtttccctctaaatatgcacagttcccagaggtattttaatcagatagctttatgccctgttgtttgcagtttccaactttttgttttctattactttctgtttatttagaatgttgctgcctcttcttttcttctctccattttctccctgtcttcatttgctcaccacccatcttggatcaacctctaatatgaatattcaaaatagttgagtaagtcaagttctgtctctgaaaatctcttgacyaaaaaaacagattaaaaaataatatcactgacccttttagaggctgagctctgtttcagaaaacattaaggaatgccttcaacattttctcttgtttagttgcatcatttacttgagtccactgggatgattggcattcacgatgtgtgggctggagaccatcaaaaggaaatgttttgtgtggaaatggaatttactctgtgtgtggcagtttgaataagttccctttctctttggctaaagcatctttaccaagcccaatctaatgcattagtcacagaacttaaatagaaaacaaca

SEQ ID NO: 103719 - DNA, 601 bp, Human
gacccttttagaggctgagctctgtttcagaaaacattaaggaatgccttcaacattttctcttgtttagttgcatcatttacttgagtccactgggatgattggcattcacgatgtgtgggctggagaccatcaaaaggaaatgttttgtgtggaaatggaatttactctgtgtgtggcagtttgaataagttccctttctctttggctaaagcatctttaccaagcccaatctaatgcattagtcacagaacttaaatagaaaacaacaaagcttccaggcacattgaggatttcttcrttcctttgtctttttgatgaagtccctcagttctttcatttccaaaataaagaagcaagcctagtcgacagacaaaattaaatgaacctaaagaggctaaggacattagttgtttatgtgttcatattagtttctggaagaactaactagataatagatcagtcaggccagttaaactaatttcttgattatttcaaatttaaagactgataataaatgttggtttgaccttaacagactctcttatttaaggaggtcaccactttacaggcacttttaaattctttattatttacaaac

SEQ ID NO: 103720 - DNA, 601 bp, Human
aaagaagcaagcctagtcgacagacaaaattaaatgaacctaaagaggctaaggacattagttgtttatgtgttcatattagtttctggaagaactaactagataatagatcagtcaggccagttaaactaatttcttgattatttcaaatttaaagactgataataaatgttggtttgaccttaacagactctcttatttaaggaggtcaccactttacaggcacttttaaattctttattatttacaaaccagactaatatggcaaaaagaaaacagaatgttaaggaacactgaagarggtatgagcagacaagaaattcaaatgtgaaatagaaacactaagaagaaagtagtaacaatacgaaagatccaatttgcaggaatttgattatctacttggttcctgggtactatggtgaatgtaatattggcaatgataaataatacctaaaattaaatagctttatatatgtaagattaacaaggagaaatgagttctccaggatacccaatgtattagtaactcaaccagttttttctgggttttatcatgtcctattacccagtctatgctttattgccatagtatatggcttct

SEQ ID NO: 103721 - DNA, 601 bp, Human
tgggggctcacacctgtaatctcagcattttgggaggcagaggccagaggatacttgaggccagaagttcaagaccagtctgggcaagaccctgtctctacaaaaataaaagtaaaaaagcatatctaggcatggtggtgcatgcatgtagtcccagctacttgggagggtgaggcgggaggatcacttgagcccaggagtttgaggttacagtgagctatgattgtaccactgtactccagcctgggccacatgagcaagactgcctctaaaacaaaaagaaacgagaaggaaagaaacracaacaacaacaacaacaacaatgacaaaactggagtttatcctcgttatataagaacctatatttctccatctgtaaaataggtaaagcattttgcttgactcagtgttgctctgaagagaagttgattgtgaattgcatgacaggcagttcagttttggtcatgttgacaactttattgaatgtcatgaaagaagtaaagatactctgattcagttttactaaaacaaaatgcagatggagttttaaataagtgtcatttgaagaagtttagctaagattcacctaaaatgctacttt

SEQ ID NO: 103722 - DNA, 601 bp, Human
ctgtaatctcagcattttgggaggcagaggccagaggatacttgaggccagaagttcaagaccagtctgggcaagaccctgtctctacaaaaataaaagtaaaaaagcatatctaggcatggtggtgcatgcatgtagtcccagctacttgggagggtgaggcgggaggatcacttgagcccaggagtttgaggttacagtgagctatgattgtaccactgtactccagcctgggccacatgagcaagactgcctctaaaacaaaaagaaacgagaaggaaagaaacaacaacaacaacarcaacaacaatgacaaaactggagtttatcctcgttatataagaacctatatttctccatctgtaaaataggtaaagcattttgcttgactcagtgttgctctgaagagaagttgattgtgaattgcatgacaggcagttcagttttggtcatgttgacaactttattgaatgtcatgaaagaagtaaagatactctgattcagttttactaaaacaaaatgcagatggagttttaaataagtgtcatttgaagaagtttagctaagattcacctaaaatgctactttattattaagttct

SEQ ID NO: 103723 - DNA, 601 bp, Human
atgcatgtagtcccagctacttgggagggtgaggcgggaggatcacttgagcccaggagtttgaggttacagtgagctatgattgtaccactgtactccagcctgggccacatgagcaagactgcctctaaaacaaaaagaaacgagaaggaaagaaacaacaacaacaacaacaacaacaatgacaaaactggagtttatcctcgttatataagaacctatatttctccatctgtaaaataggtaaagcattttgcttgactcagtgttgctctgaagagaagttgattgtgaattgcaygacaggcagttcagttttggtcatgttgacaactttattgaatgtcatgaaagaagtaaagatactctgattcagttttactaaaacaaaatgcagatggagttttaaataagtgtcatttgaagaagtttagctaagattcacctaaaatgctactttattattaagttctgggatacatgtgcaggtttgttacataggtatacacgtgccatggtggtttgctgcatccatcaacccgtcatctacattaggtatttctcctaatgctatcccttccctagccccccaccacctgac

SEQ ID NO: 103724 - DNA, 601 bp, Human
ctaaaacaaaaagaaacgagaaggaaagaaacaacaacaacaacaacaacaacaatgacaaaactggagtttatcctcgttatataagaacctatatttctccatctgtaaaataggtaaagcattttgcttgactcagtgttgctctgaagagaagttgattgtgaattgcatgacaggcagttcagttttggtcatgttgacaactttattgaatgtcatgaaagaagtaaagatactctgattcagttttactaaaacaaaatgcagatggagttttaaataagtgtcatttgaagawgtttagctaagattcacctaaaatgctactttattattaagttctgggatacatgtgcaggtttgttacataggtatacacgtgccatggtggtttgctgcatccatcaacccgtcatctacattaggtatttctcctaatgctatcccttccctagccccccaccacctgacaggctgcagtgtgtgatgttcccctccctgggctcatgtgttctcattgttcaactcccacttatgagtgagaatatgcagtgtttggttttctgttcctgtgttagtttgctgagaatgatggttt

SEQ ID NO: 103725 - DNA, 601 bp, Human
gccacattttctttatccagtctatcattgaagggcgtttgggttggttccaagtctttgctattgtgaacagtgctgcaataaacatatgtgtgcatgtgtctttacagtagaaagatttataatcctttaggtatatacccagtaatgggattgctgggtcaaattgtatttctggttctagatccctgaggaattgccacactgtcttccgcaatggtagaactaatttacacttccatcaacagtgtaaagtgttcctatttctccacatcctctctagcatctgttgtttcatgasttgttaatgatccccagtctaactggtgtgagatggtatgtcactgtggttttgatttgcatttctctaatgatcagtgatgatgagcttttttttcatatgtttgttggccacacaaatgtcttcttttgagaagtgtctgttcatatccttcacccactttttgataaggttgtctttctcttgtaaatgtgtgtaagttacttgtagattctggatattagccctttgtcagatggatagactgcaaaaatttgctcgcattctgtaggtcgcgtgttcactctgatgatagtttct

SEQ ID NO: 103726 - DNA, 601 bp, Human
cctggataatatcctgaagagcgttttccaacttggttccattctccctgtcactttccagtacaccagtcaaacgtaggtttggtcttttcacatactcccatatttcttggaggctttgttcattctttttcattcttttttctctaatcttgtcttcatgctttatttcattaagttgatcttcaatctctcatatcctttcttccacttgatcaatttggctaatgatacttgtctatgcttcatgaagttctcatgctgtgtttttcagctccatcaggtcatatatgttcttttytaaacgggttattctagtcagcaattcctctagccttttttcaagtttcttagcttcctttcattgggttagaacatgctcctttagctcagaggagtttgctattactcaccttctgaagcccacttctgtcaattcatcaaactcattctctgtccagttttgttctctcactggcgagaagttgtgatcctttcaaggagaagaggcattctggtttttggaattttcagcctttttgcactggttttttctcatcttcatggatttatctacctttagtctttgatgctggtgacc

SEQ ID NO: 103727 - DNA, 601 bp, Human
catgagggtcaggggcccacttgaggaggcagtctgtcagggacccacttgagggacccacttgaggaggcaaagctcaagcgctgtgctggaagatctgctgctctcttcagagccagcaggcaggaacatttgtctgctgaagctgcgcccacagccactcatacccacaggtgctctgtcccagggagatgggtgttttatctacaacccctaactggggctgctgcctttctttcagagatgccctgcccagagatgaggaatctagaaaggcagtctgactatagtggctttgccrcccagtttgaacatctcagcagctttgtttacactgtgaggggaaaacagcctgctcaagcctcagtaagggcagacacccctccccacaccaagcgccagcatcccaagtggacttcagactgctgtgctggcagcaagaatttcatgccagtggatcttagcttgctgggctccgtagaggtggcaccctggcttcagccccttttccaagggagtgaatggtttgtctcactggcattccaggtgccactggggtatgaaaaaaaaaagctgcatctagcagcccaaatagctgccc

SEQ ID NO: 103728 - DNA, 601 bp, Human
agatgaggaatctagaaaggcagtctgactatagtggctttgccacccagtttgaacatctcagcagctttgtttacactgtgaggggaaaacagcctgctcaagcctcagtaagggcagacacccctccccacaccaagcgccagcatcccaagtggacttcagactgctgtgctggcagcaagaatttcatgccagtggatcttagcttgctgggctccgtagaggtggcaccctggcttcagccccttttccaagggagtgaatggtttgtctcactggcattccaggtgccactggrgtatgaaaaaaaaaagctgcatctagcagcccaaatagctgcccggttttgtgcttgaaacccagggccctagtggtgtaggcacccaagagaatctcctgttttgccagttgtgaagactgtgagaaaaggcatagtatctgggccagaatgcatgttcctttccgcacagtccctcacggcttcccttggctaggagagggagttatccaaccccttgtgcttcccaggtgaggcgataccctacgctgcttcggctcaccctccttgggctgcacccactatctaaccaatcccaat

SEQ ID NO: 103729 - DNA, 601 bp, Human
aaaggcagtctgactatagtggctttgccacccagtttgaacatctcagcagctttgtttacactgtgaggggaaaacagcctgctcaagcctcagtaagggcagacacccctccccacaccaagcgccagcatcccaagtggacttcagactgctgtgctggcagcaagaatttcatgccagtggatcttagcttgctgggctccgtagaggtggcaccctggcttcagccccttttccaagggagtgaatggtttgtctcactggcattccaggtgccactggggtatgaaaaaaaaaagctgcatctagcagcccaaatagctgcccggttttgtgcttgaaacccagggccctagtggtgtaggcacccaagagaatctcctgttttgccagttgtgaagactgtgagaaaaggcatagtatctgggccagaatgcatgttcctttccgcacagtccctcacggcttcccttggctaggagagggagttatccaaccccttgtgcttcccaggtgaggcgataccctacgctgcttcggctcaccctccttgggctgcacccactatctaaccaatcccaatgagatgagccaggta

SEQ ID NO: 103730 - DNA, 601 bp, Human
actatagtggctttgccacccagtttgaacatctcagcagctttgtttacactgtgaggggaaaacagcctgctcaagcctcagtaagggcagacacccctccccacaccaagcgccagcatcccaagtggacttcagactgctgtgctggcagcaagaatttcatgccagtggatcttagcttgctgggctccgtagaggtggcaccctggcttcagccccttttccaagggagtgaatggtttgtctcactggcattccaggtgccactggggtatgaaaaaaaaaagctgcatctagsagcccaaatagctgcccggttttgtgcttgaaacccagggccctagtggtgtaggcacccaagagaatctcctgttttgccagttgtgaagactgtgagaaaaggcatagtatctgggccagaatgcatgttcctttccgcacagtccctcacggcttcccttggctaggagagggagttatccaaccccttgtgcttcccaggtgaggcgataccctacgctgcttcggctcaccctccttgggctgcacccactatctaaccaatcccaatgagatgagccaggtacctcagttggaa

SEQ ID NO: 103731 - DNA, 601 bp, Human
gactgctgtgctggcagcaagaatttcatgccagtggatcttagcttgctgggctccgtagaggtggcaccctggcttcagccccttttccaagggagtgaatggtttgtctcactggcattccaggtgccactggggtatgaaaaaaaaaagctgcatctagcagcccaaatagctgcccggttttgtgcttgaaacccagggccctagtggtgtaggcacccaagagaatctcctgttttgccagttgtgaagactgtgagaaaaggcatagtatctgggccagaatgcatgttccttwccgcacagtccctcacggcttcccttggctaggagagggagttatccaaccccttgtgcttcccaggtgaggcgataccctacgctgcttcggctcaccctccttgggctgcacccactatctaaccaatcccaatgagatgagccaggtacctcagttggaaatgcagaagtcacccgccttctgcattgatcttgctgggagatgcagaccagagctgttcctattcatccgtcttgccaactacccccaatgcttattaaccatactacctaggaactccagtttggcaaggaaagt

SEQ ID NO: 103732 - DNA, 601 bp, Human
gcatctagcagcccaaatagctgcccggttttgtgcttgaaacccagggccctagtggtgtaggcacccaagagaatctcctgttttgccagttgtgaagactgtgagaaaaggcatagtatctgggccagaatgcatgttcctttccgcacagtccctcacggcttcccttggctaggagagggagttatccaaccccttgtgcttcccaggtgaggcgataccctacgctgcttcggctcaccctccttgggctgcacccactatctaaccaatcccaatgagatgagccaggtacctyagttggaaatgcagaagtcacccgccttctgcattgatcttgctgggagatgcagaccagagctgttcctattcatccgtcttgccaactacccccaatgcttattaaccatactacctaggaactccagtttggcaaggaaagtctaaataatggaatagatactcatgtgaactagtgaacattgctgtatatggccacaagtcatgtttctaatgacctctaattcacagaatttcttcttagagatgtagagagtggagtggggatggaccagagtagtattctacagagggtgcc

SEQ ID NO: 103733 - DNA, 601 bp, Human
aagaagaggatatatcaggcagcattgctgaaatacattggaacacagaaagctttactctcagtatagctagtgttccaaggaatatattgtaaaaagggctaaattaaaggatatttagaacctatatagcagaggcaaattacctatctgaaatgtccagggaactgttatctacaacatactctatagagtaatcttgttgaaaaggcagatgctggctgggcacagtagctcacacctgtaatcctagcactctgggaggctgaggcaggtggatcacttgaggccaagagttcargaccagcttggccaatatggcaaaaccctgtctctactaaaaatacaaaaattaaccaggtgtggtggcacacacctgtactctcagctactggggaagctgaggcatgagaatcgcttgaaccctggaggcagagcttgcagtgagccaagatcacgcccctgcactccattctgggcaacagaatgaaacccagtttgaaaagaggaggaaaacaacaacaacaaagaaaaagaaaagatggactagtgttcagatgctttccttgattcagaatcagcatgcctcttaaatactgaa

SEQ ID NO: 103734 - DNA, 601 bp, Human
tgctggctgggcacagtagctcacacctgtaatcctagcactctgggaggctgaggcaggtggatcacttgaggccaagagttcaagaccagcttggccaatatggcaaaaccctgtctctactaaaaatacaaaaattaaccaggtgtggtggcacacacctgtactctcagctactggggaagctgaggcatgagaatcgcttgaaccctggaggcagagcttgcagtgagccaagatcacgcccctgcactccattctgggcaacagaatgaaacccagtttgaaaagaggaggaaamcaacaacaacaaagaaaaagaaaagatggactagtgttcagatgctttccttgattcagaatcagcatgcctcttaaatactgaatatactaagatacacaaaacagtaatttagctttttcatattgatacatgaacttagtatttgatctcagcaaatttagtaaaataatcaggagcttttgatttgccacaaaaaatcattcctctaaactttatgaattgagaaaacttgtctttatttgatgattccagttttgatgttttgtgttattggtgaagttcagaaactcagaaaca

SEQ ID NO: 103735 - DNA, 601 bp, Human
actattacattactttgctgcttttttaaattcaaaaaataaatattactaaccatttatatgatcattcattcaacaagtacttgttgagagcctactatgtgataggtgctagcaataaaagagagtaaaaaagagacatcatccccaactctcctggagtttgtgtttagatgtgaaatgtgaaatgtttgagatcttatttagaatagaatgtgtaaaaggacaaagtgaggaaatgggggtgaattaactcatattgataattaagaggtagggctactgtgggtacttaatcagsaagcaaaggcctttcaatacagagaggagctgccttatttttagtgaaaattgagctgggaaaaaatacacactggctatgggccccatagctaaagcagtctcctgtggtatttaataattttctcactggttgcagctcaaagttcacatgcatttttctttgattctctctagtatatgactgctgctgctcctatgcaagggacctacattcctcagtacacgcctgtgcctccgacagctgtttctattgaagtaagtctacccctgtctaataaagaggttagaagaaataaat

SEQ ID NO: 103736 - DNA, 601 bp, Human
taagaggtagggctactgtgggtacttaatcagcaagcaaaggcctttcaatacagagaggagctgccttatttttagtgaaaattgagctgggaaaaaatacacactggctatgggccccatagctaaagcagtctcctgtggtatttaataattttctcactggttgcagctcaaagttcacatgcatttttctttgattctctctagtatatgactgctgctgctcctatgcaagggacctacattcctcagtacacgcctgtgcctccgacagctgtttctattgaagtaagtctayccctgtctaataaagaggttagaagaaataaatctcagtcacatatactgtagtcccccataaccataggaatcctcacttgcaatttttgtgctactctaaaatatgacattgtaaattcagtgtatgaaagtataaacatttacttgaatgtggctgtgttttgctttgcacatgaaatgagctcatctgctatggaggcacgacgggagtctctttcatatttagagaaaattccagaggccaaatcacaactccatcaaattttaatcacaaatacttcttataaaaggaaaaaag

SEQ ID NO: 103737 - DNA, 601 bp, Human
tgtggctgtgttttgctttgcacatgaaatgagctcatctgctatggaggcacgacgggagtctctttcatatttagagaaaattccagaggccaaatcacaactccatcaaattttaatcacaaatacttcttataaaaggaaaaaagtttgcaactatgtgaatgaactaattctctaatgccttgttcctcaaagagtggttcctagaccagcatcattggtatcccttgagagcttgttagaaatgcagacttgctgggcatgatggcatgcacctgtaatccttgctacttgagakgctgagacaggaggatctcttgagaccagaagttcgagaccagcctgggtcaaacagtcaaacagtgagaccctgtcagaaggaagatcagaaggaagaaaaggaaaaaaaaagaaatgtagacttttaggtactatccagacctactgcatctgaatttgcattttaagatgatcactcagtgatccaaatgcacattaaaatttgagagacactggactaatgcactggttctcaaattttctgcacatttgaattattttgagagctttaaaaatattgattcctgagtcctatccc

SEQ ID NO: 103738 - DNA, 601 bp, Human
aaatctggacattctaggcagtttaagtgtaaacttctgccacatattttcatttctctgtgtacaccaaagacaaatacttatctacaaaatttgaccattttgatgattattatgagacatttgacagcgtggcttattggaaacagtctaattatatttagggattaaaagaaatatttcattgataaaaatataaatatactctgatatattgccttgaaccagtgattataaggaaaagcattaattcattctctatgtgaaaacactcattgaacatttatcaatatctataaasgtgggaggtttcaaaaaataaataataccaaatagtaaattaggaaagaaaagattgaatagagagacttttcaaattctaaagaagaaatttagggaatttcagcgacagaattaaccaagaacttctgaaatttgacatcactgcaggtatccaggactacaaataaaaccaggaaaatttatcaggataggtgctcttcttaggcctactaacaaccaaataaaatcacctatgcctctctggattccaaaaatatattcctgattgtgaccaattccggaaatccactcttgccag

SEQ ID NO: 103739 - DNA, 601 bp, Human
acagcgtggcttattggaaacagtctaattatatttagggattaaaagaaatatttcattgataaaaatataaatatactctgatatattgccttgaaccagtgattataaggaaaagcattaattcattctctatgtgaaaacactcattgaacatttatcaatatctataaaggtgggaggtttcaaaaaataaataataccaaatagtaaattaggaaagaaaagattgaatagagagacttttcaaattctaaagaagaaatttagggaatttcagcgacagaattaaccaagaacwtctgaaatttgacatcactgcaggtatccaggactacaaataaaaccaggaaaatttatcaggataggtgctcttcttaggcctactaacaaccaaataaaatcacctatgcctctctggattccaaaaatatattcctgattgtgaccaattccggaaatccactcttgccagcatctgtgagaaacaaaaaaaaaaaaaaaaaaaaaaatagggtgaaggaaaagcaaaccaaaattaaggacaagttttgttgttgttttcttaaaacttcttgatgactttcagttcatataccag

SEQ ID NO: 103740 - DNA, 601 bp, Human
atataccagaaaacaaaacaaatcaaatcaaattactggagagaaaaatctacttaatagcatcctttaaaagatttccaaactttgatgtatatttttattaaggtcactttccattgttatcccaaatggtatagacatgatacagtgaaatatgccaggaaaatgtttggacatacaagtttgtataggaatcctgaatgaggataaattggcatttattgtggataaatgtgcaaacctggtttaaaagttccaagtataggcaaaattattttctgaccacttaactactccaacracttctaatggcaaggcttcttggtgtcacattaggatgaattacttagcccttatctaaatgtgctctctgggtttcctctgagtacttattgtgacttcatgtagctgagggtatctctacttaagccaaatagaagaggggtacttacagcctatctagagagggcccttcactgaagcaagtaaggcttttatgttcttatttgcctccttagggtgttgttgctgatacctctccccagacagtggcaccttcatcccaggacaccagtggtcagcagcaacagatagcagtgga

SEQ ID NO: 103741 - DNA, 601 bp, Human
attgttatcccaaatggtatagacatgatacagtgaaatatgccaggaaaatgtttggacatacaagtttgtataggaatcctgaatgaggataaattggcatttattgtggataaatgtgcaaacctggtttaaaagttccaagtataggcaaaattattttctgaccacttaactactccaacaacttctaatggcaaggcttcttggtgtcacattaggatgaattacttagcccttatctaaatgtgctctctgggtttcctctgagtacttattgtgacttcatgtagctgagggyatctctacttaagccaaatagaagaggggtacttacagcctatctagagagggcccttcactgaagcaagtaaggcttttatgttcttatttgcctccttagggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcctcaagatcagccatcttgacatcactctctcatgttgtat

SEQ ID NO: 103742 - DNA, 601 bp, Human
atacaagtttgtataggaatcctgaatgaggataaattggcatttattgtggataaatgtgcaaacctggtttaaaagttccaagtataggcaaaattattttctgaccacttaactactccaacaacttctaatggcaaggcttcttggtgtcacattaggatgaattacttagcccttatctaaatgtgctctctgggtttcctctgagtacttattgtgacttcatgtagctgagggtatctctacttaagccaaatagaagaggggtacttacagcctatctagagagggcccttcrctgaagcaagtaaggcttttatgttcttatttgcctccttagggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcctcaagatcagccatcttgacatcactctctcatgttgtatgtgttagcttttgctgaaatataaaccatcccaaacttagcaacaggcatttatttagct

SEQ ID NO: 103743 - DNA, 601 bp, Human
cacctggcctcctccccacttctcacctgggcgagttctcaggactcagggtctttgcacctgggagctgaccagcctccggccagaccccacccctgcacccctgctcactaacgaggtcgtgggtctgcgcgtgaccctgctaacgaggtcgtgggtctgcacgtaatagaggggtctccaccatgggcccctgcccgacggcctctttacagcctcccctgcttgttgcttgggtcccccgggagctaaccctacacagcctgtgactcacgcacacacacagtgggtgcccaatcamtgatgagaaacgcgggatctcaggagcgtgaccctcctcagcctgagctccgggcagctgtggaagccagggccaggccacaccagctgctgtctggttccccgcagggcacagcaggcaggaagtttgcccggcagccggcccgctcccctaactaggtcgtgtgtctggttccggcactttggaaactgggcaagcttcaagcttcgtttcccccaaaggccctggaacgctccgacagaccttgtcactggccaccgggccccagaagtccaccctggaccctctgtcctccctggg

SEQ ID NO: 103744 - DNA, 601 bp, Human
ttttttttttcccaagacggggtcttgctctgtcgcccaggctggagtgcaatggcgcgatctcagctcactgcaatctccgcctcctgggttgaagcgattctcctgcctcagcctcccgagtagctgggactacaggcacatgcctccacactcggctaatttttgtatttttagtagagacgtggtttccccatgttggccaggctggtctcaaactcctgacctcgtgatccgcccaccttggcttcccaaagtgtggggattacagatgtgagccaccgtgcccggcctaaaattytcttttataataaatgtatttaggtaaaaacataggtgcaattgaaagggaaccactctcgcatggacgctgtgggtgctgcttggggctcgaggccagaggtccctgttggcggggtgggagggtggcccagggcaggcacggggccacacagagccctgatcggggcccactcacctcgagaaatcaccttaatggccacctggacccggtctttccagagcccctcgaagacctccccaaagtagccggaccccagcttcctgcagagcgtgaactcctccctcggcctctcccagt

SEQ ID NO: 103745 - DNA, 601 bp, Human
caggccaggtgcagtggctcatgcctgtaatcccagcactttgggaggctgaggcaggcggatcatctgaggccaggagtttgaaaccagcctggctaacatggcaaaaccccatctctactaaaaatacaaaagttagctgggcgcagtggtgggcgcctgtaatcccagctactcgggaggccgaggcaggagaattgcttgaacctgggaggcagaggttgcaatgagctgagattgtgccattgtactccagcctgggtaacagagcaagaatccgcctcaaaaaaaaaaaaaaaaagatgtaattacatatactaaattacttcagttatctgctttgtggattagttgttgaatactttattgaaagttggtttccctctgttatttaggacccagctgtttttctcccattattctttgccccagtcaacagcatctgcagggaatgaaaacatttttatattaatccaaaccaaataaaaaaagaaaaagccagctaaaattttttggaaagtacatttgctacttttaggtcacctaatggtattataaaatgaaacagggcgaggcgcgatggctcacgcttgtaatctca

SEQ ID NO: 103746 - DNA, 601 bp, Human
taaataccttcctggctgggcatggtggctcaggcctgtaatcccagcactttgggaggctgaggcgggtggatcacttgaggccaggagtttgagacatggcaaagccccgtttctactaaaaatacaaaaattagctatgatggcacatgcctgtaatcccagctacttgggaggctgaagcacgagaattgcttgaacccaggaagcagaggttgcagtgagctgagattgcgccactacactccagcctgggtgacagagcaagactctgtctcaaataagtaagtaagtaagtaartaaataaataaataaataaataaataaataaataaatatttttcttccccaaaggcctatcagagttagtgatgagagatgcttctacaaatccattttgtaaaaggtttcccatgtaattctgatgcaacctcccaatataaaaatcactgtcctggtacttcctatcctcttcccccaggagctaatgacagtttttcaactgctacactggaatggcagccttaaggccatgagggaacgacaatgctctcggcaggtaagagattttatgagtgggggcgaatgaggggagcacaa

SEQ ID NO: 103747 - DNA, 601 bp, Human
tgtctcctaatcgctttttaaattttatttttcgttttactcttattcactttttttttttttttttgagacagagtctcgctcttgtcccccagactggagtgcagtggcaagatctcggctcgctgcaacctccgtctcccgggttcaactgattctcctgcctcagcctcctaggtagctgggattacaggtgcactccaccacgcccagctaatcagcttccgtttctcgggttcaagcgattctcctgcctcagcctccctagtagctgggattacaggcagggagttttatattwaaaaaaaaaattgatatctgtctcaccaaccgtattgcaaccaagtctgttagtttcctgaagagaaatttggtgctgcaggttccagaagcagctctttatgccctcactgctgatcaaactattttttaaaaacgctcctatcatacaccacgctgcctaaagacagggtacaggcctgggatttttgaaagaaaagggtttcttcaattaccatttcccagtttgggatgaagagacgtaaagaagccctctaataaggaaattacgccgggcctcactgttaatagtacagtattt

SEQ ID NO: 103748 - DNA, 601 bp, Human
gtctcctaatcgctttttaaattttatttttcgttttactcttattcactttttttttttttttttgagacagagtctcgctcttgtcccccagactggagtgcagtggcaagatctcggctcgctgcaacctccgtctcccgggttcaactgattctcctgcctcagcctcctaggtagctgggattacaggtgcactccaccacgcccagctaatcagcttccgtttctcgggttcaagcgattctcctgcctcagcctccctagtagctgggattacaggcagggagttttatatttwaaaaaaaaattgatatctgtctcaccaaccgtattgcaaccaagtctgttagtttcctgaagagaaatttggtgctgcaggttccagaagcagctctttatgccctcactgctgatcaaactattttttaaaaacgctcctatcatacaccacgctgcctaaagacagggtacaggcctgggatttttgaaagaaaagggtttcttcaattaccatttcccagtttgggatgaagagacgtaaagaagccctctaataaggaaattacgccgggcctcactgttaatagtacagtattta

SEQ ID NO: 103749 - DNA, 601 bp, Human; identical to SEQ ID NO: 31881

SEQ ID NO: 103750 - DNA, 601 bp, Human; identical to SEQ ID NO: 27142

SEQ ID NO: 103751 - DNA, 601 bp, Human; identical to SEQ ID NO: 27143

SEQ ID NO: 103752 - DNA, 601 bp, Human; identical to SEQ ID NO: 27144

SEQ ID NO: 103753 - DNA, 601 bp, Human; identical to SEQ ID NO: 27145

SEQ ID NO: 103754 - DNA, 601 bp, Human; identical to SEQ ID NO: 27146

SEQ ID NO: 103755 - DNA, 601 bp, Human; identical to SEQ ID NO: 27147

SEQ ID NO: 103756 - DNA, 601 bp, Human; identical to SEQ ID NO: 24782

SEQ ID NO: 103757 - DNA, 601 bp, Human
ctgctgtggcccctccgaggcctccacaggttcctgaggccaccccacacactcatactgtgtccatgccgcacaaacacagggggtggggcctggttcctcccctgaacgtgccccctctgcctgcacttcctgacttccctgtctacccttaggcctgcaggccaggccacagccttccccggacccccagtcaggccttaaggcccaaagcccctgctcactctccaccccaaaccccctttccccaaggccacagggctctcagcctgctgtccattctgattgtggccagtgggtytttggggccacccaggcaggtgtggagagatgtggaggagagctcgtgtttgagcagtaacatgcctgttgagtgtgtggacgcgcctccaggcactccccgctatctgctcctgtcccattgagtagaagtgtggagcagggagcaagggctcaaggtcactcactgcccatggggccgagtggggactcccaacgtgtccagaggacacgtggctccggctctgcaggcagcgcgatgtcagccgataatcggaactgactgcctgtctgctgcccaaggtcgggcatcgggaggtca

SEQ ID NO: 103758 - DNA, 522 bp, Human
tcctcaagggctgctggtgatggtggtgatggtggtcctggtggtggtgtttgtggtgatgatggtggtaatggtgatggtgggggtggtgctgctgctggtgattgtggtgatagtgatggtggtggtggtggtgattgtggtggtgatggtagtgatggtggtggtgatggtggtggtggtgctggtgctggtgattatggtgatgatgatggtagtggtggtgatggtggtagtggtggttgtgatggtgttggtggtgctggtgctggtgattgtggtgatggtggtagtgatggtsgtaatggtcgtggtgatggtagtgatggtgatggtggtagtggtggttgtgatggtgttggtgctggtgctggtgattgtgatggtggtagtgatggtaatggtcgtggtgatggtggtgctggtgattgtggtggtggttgtgttggtgttggtggtgctggtgattgtggtggtggtggtgatggtgatggcgtgatggtggtggtggtggtagtggtt

SEQ ID NO: 103759 - DNA, 601 bp, Human
tcctgaacgcatgggcgggtacctggacttttgagaaggcccctggcttagcatttggtgtggctatgaatggtgctgagaaagatggggagggaggatctgtttgtcccaacggggcttagatggtcaacaattcatctcagggcaaggaccaggtgatctctggattgccttctgcctggggacctggttgggtcccagtgagggtgctgggtgctgggctgccagctgcagacaggcactcagtgggggcaggtgtggggccggggagcacctgcccagcctgccccgccctgggccycacacaggtggtgtgcacgctggtggccgccttcctgcacttcttcttcctgtcctccttctgctgggtgctcaccgaggcctggcagtcctacatggccgtgacgggccacctccggaaccgcctcatccgcaagcgcttcctctgcctgggctggggtgagccgcggccttcccgaccctcctggacagatacccttcctcccccactgcttgttctgtcctggcagcccctcctctccccatcccctgtggacccctggggcctcagttgctgcttgggtgggcttccccctctggg

SEQ ID NO: 103760 - DNA, 601 bp, Human
ccttctgctgggtgctcaccgaggcctggcagtcctacatggccgtgacgggccacctccggaaccgcctcatccgcaagcgcttcctctgcctgggctggggtgagccgcggccttcccgaccctcctggacagatacccttcctcccccactgcttgttctgtcctggcagcccctcctctccccatcccctgtggacccctggggcctcagttgctgcttgggtgggcttccccctctgggccctcgttcttccatggagtcaccagataaagcacaggacacccagttccctttcakgtctagataacgaaaacgtttctagcacaagtatgtccggtgcagtatttgggaggtacatttacaaaaagatgattcctgatttctctgcgagtcagatgtgccgggcaccctatgtgttctctgctcattggaccaccctgcgcccagctccgcaggcccttgccttgttcacctcctgccccatctcttgctcagccccatcctctgttgggggcttcagaagcgcctgcctggcccccgcccttcacggcagggctaggaggaggtggaggctggctggggacttgggtggggcca

SEQ ID NO: 103761 - DNA, 601 bp, Human
tgagcataggaccaggtgctgaggccacggggcctgagccccagcattcaagcatcgcgtcaggaaggagggtcggccagagaccccaagagaagagccaggaagggcccaggcctggggaaggagggacagtcaggtggccttggccctgccagcctggtgcccctgctgtgtggctctaagcaggtgggtccccccctctggtactgtccccatctgtaaaatgggggtgacagtggctgcctggggtctcctgaggattctaaggctaaagagtgggtgtgacctgccctgcatgccraaggcgcttaataagtgccagttttcttctgccacttcccagctcacccctactcctgagaggccggcagcacctctctgcacgcccctctgcacacgggcggtgctgatggcctgtctcctccccagctgctggctctccctggaggggggactgctctatgccttcgtgggacctgccgctgccgttgtgctggtactgacccgcccaggccccactccccacgaccccacctgggccccccacctgcctcctgggcctcggtgctgtctcatgccccaggctgtgcacctgctgtcc

SEQ ID NO: 103762 - DNA, 601 bp, Human
tgggcctgaggaagtcaggccttgcccctcggggtcctagcagcatctttctgcagagtggggatgcaggaggagggcctcagggagcctctggcagttggggagcagagagtatggcctgagactcctccttccccccagcagaggaggccaggagacagggggagaccccaggatgctcagggccagtggcttcccgggggtgctccaggaacagctcttgtattgactggtagcctggacagtggcaggcatgggagacttatgttagagcccaagaagagcctccctgggtgcaggygcccagccagggcccttatggggtgggcagttaatctgatgggaataggggagggagatcaggaaggaagtctagagagaggaggtggcctgcccagagcagagagccaggaggagtgtgaccccagggagagccaggattggtgtcccttagacaggtttcagctgcaggctggcaggggcctccgggccctgtgggtggggagctcgctggtggaagggatgcaaggagttgcagcagaggtgccgacggtgcgggtgacacacagagagggccctgcacagttggcagctgggctgg

SEQ ID NO: 103763 - DNA, 601 bp, Human
cagtggcttcccgggggtgctccaggaacagctcttgtattgactggtagcctggacagtggcaggcatgggagacttatgttagagcccaagaagagcctccctgggtgcaggtgcccagccagggcccttatggggtgggcagttaatctgatgggaataggggagggagatcaggaaggaagtctagagagaggaggtggcctgcccagagcagagagccaggaggagtgtgaccccagggagagccaggattggtgtcccttagacaggtttcagctgcaggctggcaggggcctcygggccctgtgggtggggagctcgctggtggaagggatgcaaggagttgcagcagaggtgccgacggtgcgggtgacacacagagagggccctgcacagttggcagctgggctggaggtcacctgacatcccatcaggcactggggttcctgtgatggaggcacgggaggtgaccctgggtggggtagggggtcgtggttggcgtagccagcatcggtccggccagtgtcagcccctgagcctacggcggcccccacccccacacccccaccactctctgcccggcaggtgaacatggtca

SEQ ID NO: 103764 - DNA, 601 bp, Human
taccacaaggcttgctccatggccagggggaggatgtcgcctgtccatgcagggactccctgtctttgtgggaccttcatcatggggaggatggtgcagaggacaggtggagctgatgttcctccctccggggaacccaagcccagggagtgctctcagcacagcagctggacagggtgctggagcaagacagaggcgcttgggatgtgtggctgcacccacctttgagggacagggccctgggcacagaggggaagctgcggggcgtggggagctgactagggcggacaagcccctcttkgtcctcccgcccctcacctctgcctgctgttctgtgtcatccagccctggctggtgtctgcgtgggcccctcccctccgtgccagtcttgcttggatgcttggtgtctctctgtctctctctctgttcctgtctctctcttcctggctcctcctgctgtccccagtgaacagacgctttcaggaagccttccccttgggtgcctgtgggttctggtcctggttaggaaccagccgagctggtgtctgatgctgagtgcgtgccatggccctggggtctgtcactctgggtgggagtcgcg

SEQ ID NO: 103765 - DNA, 601 bp, Human
tcctgctttgctccctgagccaggcactaggggtccagggttttaggagccgtgggagaagagctctgggccctggcactgtgcagatgcgagtcggggcgaggctagcctgggtgggaggagcaagcccggagctggggcagcgtccacactggcctgccaggccccgggaagttcaggttctttggggctagtgttgccctttctttgtctcaacaccagggatgtggcaggggctgtgggatccaccccatctcattccatcagagagaagtgggggccagaaggatgttccctttgmagtcactcagagcctctccccgcaccccgggcacctgcctctccagacaggagcaggcgcggtgcagctgggcactcctggcctccccttcagcagctcccgggcctttctgcttccttcccaccgctctctgcagaaatgtttcccagccgcagaggctgagctgctgtgtgggagtaatttacaggtccccaggccccaggccacctgccagccgcagcagatcgggctgtaaatgtcaggcctggagacccagctgcaccactgtatcccctgacgggcagcagcaggggtgactga

SEQ ID NO: 103766 - DNA, 601 bp, Human
caggtgttctgcactaggggtgggagcagcattggtggccaagccacactagagagggctgaggagcagagcgtgtggttttggaggcccttgtcctggcagactccaggtcattccagcatctctcctgccagccctggtgtgccagctcctgcctggcattctgaccgcacacctgggccccctactccctattcagtcctcctgccccagctccccctgtgtaggaggaggggaggagggaagctggcgccagcacccattccgggtggtgatgacagtcctgcgggctgtggggccycctgcgggcaggcacagggccacctcccgagcactcaccgcagccggggtcctgctggcctctgtctgtgttccacagccccgggaagcaggttggtgtccccactgtgagcaggagagcacaggctcagaggccacgcgcggaacccagtgggtggatgtggggaggggcccaggccttcactgctcccagcgaggctgggctgcaggggcgagggctgctgtgaggctcctggaggacctcctgggagggggtggcactgagcggcagaggcagcaggaagggtctacaggcaggtgg

SEQ ID NO: 103767 - DNA, 601 bp, Human
tccccctgtgtaggaggaggggaggagggaagctggcgccagcacccattccgggtggtgatgacagtcctgcgggctgtggggccccctgcgggcaggcacagggccacctcccgagcactcaccgcagccggggtcctgctggcctctgtctgtgttccacagccccgggaagcaggttggtgtccccactgtgagcaggagagcacaggctcagaggccacgcgcggaacccagtgggtggatgtggggaggggcccaggccttcactgctcccagcgaggctgggctgcaggggcgrgggctgctgtgaggctcctggaggacctcctgggagggggtggcactgagcggcagaggcagcaggaagggtctacaggcaggtggccgctggggctcaggaggcatgggcggagctggcccacgaagaggaggaggcgcctgtcagtctgtctgttgccgtctgtctctgtctctcccctgctcctcccctgctggccttggccgtctgtctgtcctcatctcattccctctaagcttctctctctccaggtctctgagttctgggctccaccctcccctccccaccatggccatcttg

SEQ ID NO: 103768 - DNA, 601 bp, Human
ttggtgtccccactgtgagcaggagagcacaggctcagaggccacgcgcggaacccagtgggtggatgtggggaggggcccaggccttcactgctcccagcgaggctgggctgcaggggcgagggctgctgtgaggctcctggaggacctcctgggagggggtggcactgagcggcagaggcagcaggaagggtctacaggcaggtggccgctggggctcaggaggcatgggcggagctggcccacgaagaggaggaggcgcctgtcagtctgtctgttgccgtctgtctctgtctctccyctgctcctcccctgctggccttggccgtctgtctgtcctcatctcattccctctaagcttctctctctccaggtctctgagttctgggctccaccctcccctccccaccatggccatcttgctctgcccttcagggcctggacccctcgcctggggcctgtgggctctctgagggtcctggaccaggggatcctccttggcgcaccccacaccagacagcccatccctctccagcctgtctcccttcccctgtcacctcctagactgtcaggaacctggatcttcccaaagagcccttcc

SEQ ID NO: 103769 - DNA, 601 bp, Human
ggtgcactgtatcctccgtagagaggtgggtgaggcagcctctgtcgggccgggctcctgcggggtcctggggctgccgagtggcctcctccttccccgaggacctcggcagggagattgtgggtaggcgcagcatccatgaccctgacacatctgcaggcctcggtggtccacagagcggggcctgcaggtgagcgtgtccaccccactctccctgggagcggcccaggcagtgcagcaccttcccaaggatgccctgcgcccgcactggcttgggggcgtgggggacgaaagcacatgrggcccccatcctcaaggggcctacaggagtgaggaagctggcagcagaagtagcttccagggcaatagagactcctgcttccggcgttttctggatctttccagaaggtgtcactagaaggttttcaccaaactacatcccaactaccgcctggctggtggccacgattgggatgctcttgcggaggctggaatgtgggaaagcatgcatgtcgacctgggtggcgtaggacacctgcttccagatcagcgccaggagggcggaaggcccaggagcggggcggccacctcccccttcctg

SEQ ID NO: 103770 - DNA, 601 bp, Human
gttttcaccaaactacatcccaactaccgcctggctggtggccacgattgggatgctcttgcggaggctggaatgtgggaaagcatgcatgtcgacctgggtggcgtaggacacctgcttccagatcagcgccaggagggcggaaggcccaggagcggggcggccacctcccccttcctgggtccccctggagagacggcagaggggctgttgaaaagcacacaggttcccgaggatgaagaatacaggagaagccgacagcaggggagccggtaggcggggaagcaggatgagaggtgcrgtcccagctaactggagacagcccaggcttcggccagctgcaaggagccagacggtgtcaggagtggggcccgccccctccccaggatctctggctgccacaggaaggtcaggcgtgggaggcctggttttccggccttaggtggcgatttccatcccagcctggaagggcagggctgccctcttggcctccgcggcctgggcctcactctctgggcagagtgaacagaggggctctggcctggggcagctggcacagctgaagatggggatgccgcctggaaacaagtcagggaagtgg

SEQ ID NO: 103771 - DNA, 601 bp, Human
cctccccaggatctctggctgccacaggaaggtcaggcgtgggaggcctggttttccggccttaggtggcgatttccatcccagcctggaagggcagggctgccctcttggcctccgcggcctgggcctcactctctgggcagagtgaacagaggggctctggcctggggcagctggcacagctgaagatggggatgccgcctggaaacaagtcagggaagtggatgtgctgagcctgggtcacgtgtcagcgcaggcctcccagacccagacctctgcggggaggtgtgaacgcccctcycaaggcaatctgacttcgaggaaagacaagaggaggaagagccagagttctgatgtccagcagcgaaacggctcctgtaccagtcaaccaccagccgggcagtgctccacacttacatcccagcagctcctgatgaggacagcagagctcctgttggagttgcaacccaaccagacaagcaggaaaacagcgtggggacagaggcagcccaggaaggagaaacctcagtggccccttcttatcctcacctgggagaagccgctcaccctggtgcacgccacatgggccaggccctggtcc

SEQ ID NO: 103772 - DNA, 601 bp, Human
gcctcaactcttccacacctcgacctcagcatcttcctcctgcagccttgtgcccctggggctcagccaggaccgtagtgggctcctagtcaccaagtctgctcccacccacacccgtcactagacctcctgcttctgcacccagaggctagcacacagggtggagccaggcccccttctccaccctctaggcctcaggacagcatccacgccctggcctggtcctgtgcagaacccgcagctgtgctggtcttgctcctgcccctgtgtccttcacacaagcttccaccccaggtgttgsccaccctgcgcactcccgtgggtcccctcctccagggagccctccttgactcttgccccatggtgccacctttctgggctcaggccacgcccctggtgaactctgcacggctggtgcgcgggaggtgctccctgggtcccggggtgcccagccacctcacagtggttgtgaagctcacaggcagggcctcagcagatggcatgtccagccccgggtgagggtgaggtccttcagtgagagacggccacttcggctcttgggtgacgtccaggcaggcccctcatggctccatgcctcagt

SEQ ID NO: 103773 - DNA, 601 bp, Human
tccacacctcgacctcagcatcttcctcctgcagccttgtgcccctggggctcagccaggaccgtagtgggctcctagtcaccaagtctgctcccacccacacccgtcactagacctcctgcttctgcacccagaggctagcacacagggtggagccaggcccccttctccaccctctaggcctcaggacagcatccacgccctggcctggtcctgtgcagaacccgcagctgtgctggtcttgctcctgcccctgtgtccttcacacaagcttccaccccaggtgttggccaccctgcgyactcccgtgggtcccctcctccagggagccctccttgactcttgccccatggtgccacctttctgggctcaggccacgcccctggtgaactctgcacggctggtgcgcgggaggtgctccctgggtcccggggtgcccagccacctcacagtggttgtgaagctcacaggcagggcctcagcagatggcatgtccagccccgggtgagggtgaggtccttcagtgagagacggccacttcggctcttgggtgacgtccaggcaggcccctcatggctccatgcctcagtgtctccatcag

SEQ ID NO: 103774 - DNA, 601 bp, Human
cctgagggtggtgggtgccggccttggccctgaattgcatgttcaacatccccccccaccacctctccctccccagaccctggatggggcccccttggagggatgtgggggaccaagggggagagttctggtgccgcaggcccagagccattcctgaggcctggggggagagatgagaccagaggaagcaggaggtcatcagctcccagacgccttggagagagcacacatgtgtgcctcacaaacagtctcacacacacctcagaaacacacacacagccacatacagaaatacacacgyatgtacgtgtacaaaacactcagatgcattctctcacatttacaaacacctgaatccacacgcaaacacagggacacaaattcacccacttatacacagacatatccacaaacacgcacacatacactcacacacgcatccacccagagacacaaacgcccaccacacaggcaggtgcatggggaggcatggtcgcccacgtggggcactgggctgtggacatggacaggggttcctcggggcagcaggagcaccgtggccctcccgagcggtctgtgcacgcgtgcacacacccccgct

SEQ ID NO: 103775 - DNA, 601 bp, Human
gagagttctggtgccgcaggcccagagccattcctgaggcctggggggagagatgagaccagaggaagcaggaggtcatcagctcccagacgccttggagagagcacacatgtgtgcctcacaaacagtctcacacacacctcagaaacacacacacagccacatacagaaatacacacgcatgtacgtgtacaaaacactcagatgcattctctcacatttacaaacacctgaatccacacgcaaacacagggacacaaattcacccacttatacacagacatatccacaaacacgcacrcatacactcacacacgcatccacccagagacacaaacgcccaccacacaggcaggtgcatggggaggcatggtcgcccacgtggggcactgggctgtggacatggacaggggttcctcggggcagcaggagcaccgtggccctcccgagcggtctgtgcacgcgtgcacacacccccgctcccagaggcgctcaccctgccctgttgtctctgtcctacagaccgacttcgagaaggacgtggatctggcctgtagatcaggtgagcgcccgacaggtgagaggacagtgccagcccggc

SEQ ID NO: 103776 - DNA, 601 bp, Human
gcctggctgcgtcccctgcccacctgacatctcttcctctgtcgtggccccagcgaggagcacagcctcaccctagtgccgctccccccacctgcctcctgcccaccgccctctagcacctgtgttctgtgccaccttcatttcctcattgccagtcccagcaggggcagaagtgagtggggctttcaggctagggggacaacggggagcaagaggaaggcggggagaaggacccaccatggagcccccggccggtgctgagcttcctggaaccaagtgcaaaaaacgaacgactgcccartaaaggaagctccgccgcccatccccaagcatcagactgcgagggtctgtttctgtccccaccactgttctgtgaaccaggtcctgaggcagtgacaggcagtggctttctgagctgtggagaggccaatggaccatgctccctctggtcatttagatatttgaagagcaccttctctagagacagccctggcagaggagctgggacagccccaggtggggagtgtgtgctggtgccagttgggccccaggagggcttcctggaggaagtgacttcggggctgggctgaatgggagctgg

SEQ ID NO: 103777 - DNA, 601 bp, Human
ggtgggcacccctctgtcaggggcaggcggctgggtcagagtcagcttggggttctccgccagccagtaggggctagattcattggcaggaagtcgggggcaaactggagccccactcagaggtcaaggcggctgggccccttgcaactgaccagagacagaatcagaggtgtctgggtatggagacctctctccagggaccaggcggccctcagggcagagcagggaggcttgcaggccccaggggcagcgatgcaggaagggccgtgacagagggccagggcctcgtggctgcactcakcaccactgggctcccgcacactgccccccacccacacaaggcccagggccgtgggcgtcgggagcgttggagggccggctgggctctgccaccagcacagaccgttctgcctgtgtccctgtgcttccgggagtcaaggccgccctcgcctgctcttctcagcgctggggagggcagtgtgtgggtgacagccatttgtcttcttggggccagtggagagggccacccttgtgtggcagcctcatctgaggacacaggaaccctaggggccgtagcgccaggcttgggtagggtggtacc

SEQ ID NO: 103778 - DNA, 601 bp, Human
aagcaaacttaagagtggttggaatggtgggatttcgggatattcttttcaaaaaatgtcttcatggttgcattacctactacagttttgcagcatgacccatctaaaccgatgttgactctcccaggcctagggagtgaagaggttttgaatgctgtaaggaaacccactctgactcaccaggaccttccacttccatttgttagatgtgaggtccttttactcagcatgttccaagtgacctctaatcccatgcagagcaaaggagggtggatgatagtgaccaggtcttctccctgcrgtgaatgtttatttttacccccaagcttctaacttggcaaggaagatgtaaagattcatagtgctggctgggtgaggtgggctcacacctgtaatcccagcactttgggaggccgaggtgggtggatcacttgaggtcaggagttggagacaagcttggtcaacatggcaaaaccccatctctacaaaacttagccaggcatggtggcacgcacctgtaatcccagctactcaggaagctgaggcatgagaattacttgaacccgggaggcggaggttgcagtgagctgagatcatgcca

SEQ ID NO: 103779 - DNA, 601 bp, Human
gaggacagattatctcctgaaaccaagttctgaccagagtggcccttcagacttctggttctaagcctttcctaaccatctggttcatcctgaatgccttgtacttttgttaaaaagctgccagaatggcatatctactgcttatgaccttgaaggcctgcatttttttcaaagaaacatctactgctcttgtatctcttagaaaatgtatctttctggtgcctctaaagatccccattcctagcaagtgactagactagctgatctgaatagctcaggtctctagattagtcctcatttkgtgtccccactccatccccattcctatcacacatccctggatcccattccttatgggtagttctgaaaaataagagctagtttggggacaagcacctaacaattgttcctaggttgccagtcattaggcaacattatagtaaagaagggcctggcagagactagagctgctatatcgtgacttgagggactggtgttattttcatttgtttcaccctcctgttgacatttaatgttacccaaaatcaactcaaacaaacaaaaaccctgatgcagtaaccttatccctaacagtagcact

SEQ ID NO: 103780 - DNA, 601 bp, Human
gttcatcctgaatgccttgtacttttgttaaaaagctgccagaatggcatatctactgcttatgaccttgaaggcctgcatttttttcaaagaaacatctactgctcttgtatctcttagaaaatgtatctttctggtgcctctaaagatccccattcctagcaagtgactagactagctgatctgaatagctcaggtctctagattagtcctcatttggtgtccccactccatccccattcctatcacacatccctggatcccattccttatgggtagttctgaaaaataagagctagtytggggacaagcacctaacaattgttcctaggttgccagtcattaggcaacattatagtaaagaagggcctggcagagactagagctgctatatcgtgacttgagggactggtgttattttcatttgtttcaccctcctgttgacatttaatgttacccaaaatcaactcaaacaaacaaaaaccctgatgcagtaaccttatccctaacagtagcactgctgagtgggaaagacactggggaaggcggccttctcacatgctgtcttctgtgttctctccttgcttattttaaccaagga

SEQ ID NO: 103781 - DNA, 601 bp, Human
tctcttagaaaatgtatctttctggtgcctctaaagatccccattcctagcaagtgactagactagctgatctgaatagctcaggtctctagattagtcctcatttggtgtccccactccatccccattcctatcacacatccctggatcccattccttatgggtagttctgaaaaataagagctagtttggggacaagcacctaacaattgttcctaggttgccagtcattaggcaacattatagtaaagaagggcctggcagagactagagctgctatatcgtgacttgagggactggygttattttcatttgtttcaccctcctgttgacatttaatgttacccaaaatcaactcaaacaaacaaaaaccctgatgcagtaaccttatccctaacagtagcactgctgagtgggaaagacactggggaaggcggccttctcacatgctgtcttctgtgttctctccttgcttattttaaccaaggaagtcaccccagcatgacagccaaagggatggatttttcatctaagtttttattctctcttctcaaggacattgggaacagggagacttttccctcgaagaccatgtattctg

SEQ ID NO: 103782 - DNA, 601 bp, Human
ggccttctcacatgctgtcttctgtgttctctccttgcttattttaaccaaggaagtcaccccagcatgacagccaaagggatggatttttcatctaagtttttattctctcttctcaaggacattgggaacagggagacttttccctcgaagaccatgtattctgggagaagcgctccccttctttctagtggagctacacccccagtgtagcctgcagaaccacctgagcccagccctgccagtgactgacttcacatagaacagcagctgagtcttcagtcaatctcatgctcagagrcccatttgagaaaacggcatttcccctagtcctgactttggggcagttctcttttctggcctgccctgagaccggctggcccacatgtccttctcttgctctgacacaagttccccaagatgcccagggcaagtggggggattccttctatcccacctgtctagaaggccaatactcatctcccaggtccacaagccaagccattcatagaagaatcacagatattttattttcctgctgaaactaacttaattctacctaatttgggtggggagtagttggccaaatcatgaaattgtt

SEQ ID NO: 103783 - DNA, 601 bp, Human
gtttttattctctcttctcaaggacattgggaacagggagacttttccctcgaagaccatgtattctgggagaagcgctccccttctttctagtggagctacacccccagtgtagcctgcagaaccacctgagcccagccctgccagtgactgacttcacatagaacagcagctgagtcttcagtcaatctcatgctcagagacccatttgagaaaacggcatttcccctagtcctgactttggggcagttctcttttctggcctgccctgagaccggctggcccacatgtccttctcttactctgacacaagttccccaagatgcccagggcaagtggggggattccttctatcccacctgtctagaaggccaatactcatctcccaggtccacaagccaagccattcatagaagaatcacagatattttattttcctgctgaaactaacttaattctacctaatttgggtggggagtagttggccaaatcatgaaattgttaactttttgctaacatattgtgtaatcaaccttaggtgttaaaaaaggtttgcttgtttctttcatgcaaatactaatgtagcccttttttcttagcg

SEQ ID NO: 103784 - DNA, 601 bp, Human
ctgggagaagcgctccccttctttctagtggagctacacccccagtgtagcctgcagaaccacctgagcccagccctgccagtgactgacttcacatagaacagcagctgagtcttcagtcaatctcatgctcagagacccatttgagaaaacggcatttcccctagtcctgactttggggcagttctcttttctggcctgccctgagaccggctggcccacatgtccttctcttgctctgacacaagttccccaagatgcccagggcaagtggggggattccttctatcccacctgtctggaaggccaatactcatctcccaggtccacaagccaagccattcatagaagaatcacagatattttattttcctgctgaaactaacttaattctacctaatttgggtggggagtagttggccaaatcatgaaattgttaactttttgctaacatattgtgtaatcaaccttaggtgttaaaaaaggtttgcttgtttctttcatgcaaatactaatgtagcccttttttcttagcgtatagcttctggcctgggcttggcctggattgttggacgagttctttatgcttatggctattaca

SEQ ID NO: 103785 - DNA, 601 bp, Human
ccctgccagtgactgacttcacatagaacagcagctgagtcttcagtcaatctcatgctcagagacccatttgagaaaacggcatttcccctagtcctgactttggggcagttctcttttctggcctgccctgagaccggctggcccacatgtccttctcttgctctgacacaagttccccaagatgcccagggcaagtggggggattccttctatcccacctgtctagaaggccaatactcatctcccaggtccacaagccaagccattcatagaagaatcacagatattttattttccygctgaaactaacttaattctacctaatttgggtggggagtagttggccaaatcatgaaattgttaactttttgctaacatattgtgtaatcaaccttaggtgttaaaaaaggtttgcttgtttctttcatgcaaatactaatgtagcccttttttcttagcgtatagcttctggcctgggcttggcctggattgttggacgagttctttatgcttatggctattacacgggaggttagtatatattgacatttgccaaggaaacaactttaaaattttaaatcctatgctggccaggcac

SEQ ID NO: 103786 - DNA, 601 bp, Human
cagctgagtcttcagtcaatctcatgctcagagacccatttgagaaaacggcatttcccctagtcctgactttggggcagttctcttttctggcctgccctgagaccggctggcccacatgtccttctcttgctctgacacaagttccccaagatgcccagggcaagtggggggattccttctatcccacctgtctagaaggccaatactcatctcccaggtccacaagccaagccattcatagaagaatcacagatattttattttcctgctgaaactaacttaattctacctaatttgsgtggggagtagttggccaaatcatgaaattgttaactttttgctaacatattgtgtaatcaaccttaggtgttaaaaaaggtttgcttgtttctttcatgcaaatactaatgtagcccttttttcttagcgtatagcttctggcctgggcttggcctggattgttggacgagttctttatgcttatggctattacacgggaggttagtatatattgacatttgccaaggaaacaactttaaaattttaaatcctatgctggccaggcacagtggcttacacctgtaatcccagcactttg

SEQ ID NO: 103787 - DNA, 601 bp, Human
gctcagagacccatttgagaaaacggcatttcccctagtcctgactttggggcagttctcttttctggcctgccctgagaccggctggcccacatgtccttctcttgctctgacacaagttccccaagatgcccagggcaagtggggggattccttctatcccacctgtctagaaggccaatactcatctcccaggtccacaagccaagccattcatagaagaatcacagatattttattttcctgctgaaactaacttaattctacctaatttgggtggggagtagttggccaaatcatsaaattgttaactttttgctaacatattgtgtaatcaaccttaggtgttaaaaaaggtttgcttgtttctttcatgcaaatactaatgtagcccttttttcttagcgtatagcttctggcctgggcttggcctggattgttggacgagttctttatgcttatggctattacacgggaggttagtatatattgacatttgccaaggaaacaactttaaaattttaaatcctatgctggccaggcacagtggcttacacctgtaatcccagcactttgggaggccaaggcaggcagattgctt

SEQ ID NO: 103788 - DNA, 601 bp, Human
ctgactttggggcagttctcttttctggcctgccctgagaccggctggcccacatgtccttctcttgctctgacacaagttccccaagatgcccagggcaagtggggggattccttctatcccacctgtctagaaggccaatactcatctcccaggtccacaagccaagccattcatagaagaatcacagatattttattttcctgctgaaactaacttaattctacctaatttgggtggggagtagttggccaaatcatgaaattgttaactttttgctaacatattgtgtaatcaaccytaggtgttaaaaaaggtttgcttgtttctttcatgcaaatactaatgtagcccttttttcttagcgtatagcttctggcctgggcttggcctggattgttggacgagttctttatgcttatggctattacacgggaggttagtatatattgacatttgccaaggaaacaactttaaaattttaaatcctatgctggccaggcacagtggcttacacctgtaatcccagcactttgggaggccaaggcaggcagattgcttgagctcaggagttggataccagcctgggcaacatggtgaa

SEQ ID NO: 103789 - DNA, 601 bp, Human
tttattaatctttcaattgtaacgaaacttatttttattgagcattttctatgtgccaaccactactctaagaactttgcatatgttatttaaccttacaacaattctgtaatacagatattattgcattttacaaattaggaaactgggactcagcatgattaaagctctaggtcacagagctactaagcgtaaactagtaaactaggaatcaaacccatgcagtccgactccagagcctcaccattactatacctgctatatctgagtaaggaggaggaaaagccatttttagctgtamttctttgaaacagagggaactccttccaaaggtcctagagcaaagttgctgtaattattatcccataattttctaagatccaagcaatactactgtggcacgttacttggcatgtggtatctgacttgccaacagcttcaggctaaagagttagttaacctcctaaggccagtttgtctaatgtacaacctcagatgcgatgatagaatggcttgcgaatgttgaaagcatcataattctggagcactcctggtaacttctgttctttcttctttttcagaacccagcaagcgtagtcga

SEQ ID NO: 103790 - DNA, 601 bp, Human; identical to SEQ ID NO: 18500

SEQ ID NO: 103791 - DNA, 601 bp, Human; identical to SEQ ID NO: 18501

SEQ ID NO: 103792 - DNA, 601 bp, Human; identical to SEQ ID NO: 18502

SEQ ID NO: 103793 - DNA, 601 bp, Human; identical to SEQ ID NO: 29328

SEQ ID NO: 103794 - DNA, 601 bp, Human
agcaacggcaacatggcggggtccccgggggtcacacacatacagattgtggtcattttctggcaagaggtccacatcgtgcaagaacaggcagtcccactcttcatcacgcagggcctctcgcaccccaacgttcaacagttttgccctgttaaatgttccatttccagcctggaagataatggaggggaaccagactatgtctgtaggtggcacggagaaaagggggctaaagaataaaagtgaaggccgggcgcggtggcttacgcctgtaatcccagtactttgggaggccaaggcrggcagatcacaaggtcaggagattgagaccaccctggctaacacggtaaaaccccatctctactaaaaatacaaaaaattagctgggcatggtggtacacgcctgtagtcccagctactcaggaggctgaggcaggagaatggcgtaaaacccgggaggtggagcttgcagtcagccgagatcgtgccactgcactccagcctgggggacagagtgagatctcaaaaaaaaaaaaaaagaaaaaaaagaataaaagtgaaaagagggaaatcaaagtggggtggagggcaaggagaatga

SEQ ID NO: 103795 - DNA, 601 bp, Human
gccttttacaaagcgattctgggaacatggagcagagcccctctctcctaaccccataggaagtggcctggctggaaccccagcagaaggcaagactaagctgtctctgggcccctttccagttctggaatccgacgatactatttcctattgatcttatgtcctctcccaagaacaaactaaccaggagactgaaggatgacacaatgggcagtagcatgcaagcctgacctgggtatcctaaaaagactaagggaaaggaatgggctcagtgcaggaccagggagctaaaggttagtgytgaagggctatggtcaaaggtggtcttagaggacagggatccagactggggtcaggagggaggaagtggcaggaagtctgacctggtagcaatgtcgtcatcctcaccaccccagccccagtattcattggggaagccattcatcttcaggtactggtcaggagtaagtgctgagactcctccgaagtactgggggtacgggaggctagggagagaaagatccttgcataccccgagtcttctggggacacatccccaaccacaatccgcttggctctcctccttccacaggatagtagg

SEQ ID NO: 103796 - DNA, 601 bp, Human
tgaggctgaaggtcagaatgtttcacatgctaaaaatgagttggccctgtgccaatggcacaggccttttacaaagcgattctgggaacatggagcagagcccctctctcctaaccccataggaagtggcctggctggaaccccagcagaaggcaagactaagctgtctctgggcccctttccagttctggaatccgacgatactatttcctattgatcttatgtcctctcccaagaacaaactaaccaggagactgaaggatgacacaatgggcagtagcatgcaagcctgacctgggtrtcctaaaaagactaagggaaaggaatgggctcagtgcaggaccagggagctaaaggttagtgctgaagggctatggtcaaaggtggtcttagaggacagggatccagactggggtcaggagggaggaagtggcaggaagtctgacctggtagcaatgtcgtcatcctcaccaccccagccccagtattcattggggaagccattcatcttcaggtactggtcaggagtaagtgctgagactcctccgaagtactgggggtacgggaggctagggagagaaagatccttgcataccccgag

SEQ ID NO: 103797 - DNA, 601 bp, Human
gcaggaaacaaggacacttttcaatttttttttttctgagacagagtctcactgtcaccctggctggagtgcagtggcgtgatctctgctcactgtaacctctgcctcctgggttcaagcaattctcctgcctcagcctcccaagtagcttggattacaggcgtgtgccaccatgcctggctgattttttgtatttttagtagagacgggttttcaccatgttggccaggctggtctccaactactgacctcaggtgatccacctgccttgacctctcaaagtgctgggattacaggcatragccactgcacccggcccactttttaattttttgtttgtttatatgtttttattttttgtaaagatggagtcttactatgttgcccagggtggtctcgaactcctaggctcaagcagtcctcctgccttggccttccaaagtgctgggattataggtgtgagccactgtgcccagccgacaagggcaccttattattattcttattaattaatttatttttgagacagagtgttgctctgtcacccaggctggatgtagtggcctgatctcggctacagcaaacctccgcctcctgggtt

SEQ ID NO: 103798 - DNA, 601 bp, Human
ctaggtcacctgaccacatcctgtaccatgaggacacatgccccctattgctctagcaccatctcaccacgggctccatcttcaattgtgtagcgaagaggcccgcagaggaagttttgtgtttggagacagaaagtggtattgagtacgatgtgacagatttccacagctgctcccttgagaagggagatctggtcttcaatgggcagggaactgtggaaagcaggaaacaaggacacttttcaatttttttttttctgagacagagtctcactgtcaccctggctggagtgcagtggcrtgatctctgctcactgtaacctctgcctcctgggttcaagcaattctcctgcctcagcctcccaagtagcttggattacaggcgtgtgccaccatgcctggctgattttttgtatttttagtagagacgggttttcaccatgttggccaggctggtctccaactactgacctcaggtgatccacctgccttgacctctcaaagtgctgggattacaggcatgagccactgcacccggcccactttttaattttttgtttgtttatatgtttttattttttgtaaagatggagtcttacta

SEQ ID NO: 103799 - DNA, 601 bp, Human
ctctaggtcacctgaccacatcctgtaccatgaggacacatgccccctattgctctagcaccatctcaccacgggctccatcttcaattgtgtagcgaagaggcccgcagaggaagttttgtgtttggagacagaaagtggtattgagtacgatgtgacagatttccacagctgctcccttgagaagggagatctggtcttcaatgggcagggaactgtggaaagcaggaaacaaggacacttttcaatttttttttttctgagacagagtctcactgtcaccctggctggagtgcagtgkcgtgatctctgctcactgtaacctctgcctcctgggttcaagcaattctcctgcctcagcctcccaagtagcttggattacaggcgtgtgccaccatgcctggctgattttttgtatttttagtagagacgggttttcaccatgttggccaggctggtctccaactactgacctcaggtgatccacctgccttgacctctcaaagtgctgggattacaggcatgagccactgcacccggcccactttttaattttttgtttgtttatatgtttttattttttgtaaagatggagtcttac

SEQ ID NO: 103800 - DNA, 601 bp, Human
agaagttggactagtgaggtaatggatgtcatcaatctcaggaatgctattacccagagcctctgagctactactttgcatctgtactgaataaaaaaaaaatctggaaaaagtgagatgaaacagcagtatccaaatacagcaatttggatgctgaaacgatgtgagacagggatggccagggggaaggactagaccccaagatacctgaattccctaaggaaaggacagtaaaaaaacattcctcccaagctcaatgtttcaccaaccccttcctgccctggtgtggcctccaagccckcagtgtcccaccgtaccgatcccggggccttcgctgctggcccttgatgtagctttgcagagtcagtgccatctcctcttgcagctgatcaatctcatctctctgggtaactccaggtcggtctgtaagatagggagctgggaaggacaagttgggtggcaggggtgggcctgcgtggtgccccggggactgaggctgggatagacctagtctgcaggtttgatagctaggctagaaggcctgggtggatggactcaaggagctgagtatttgggcagaggtggtgcagcaaaaggctac

SEQ ID NO: 103801 - DNA, 601 bp, Human
tttcctctctcccccttgttattatttttagtctgtgcgtgtggacacttttggagagttggaagggatttttttctcctgacttgaacatagggtgactttttaatattgtattttagtgtggattatctctttggaccgcgccggacttggcctcaggaaagcaaccaaggctgcggaaggcggctggtgcagaacgctctgctctacagaagggggtcccccgccctcttttccaattttttttttttggccttcctctccttccctccctcttcctccctctctctctctctctcttcactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagc

SEQ ID NO: 103802 - DNA, 601 bp, Human
ggacagtgagtgaggggcgcatgcccacgggggtgtgtgcccgggacagagggcggggacccgtgtagggcagctagagcccgtccgcggccagaaagacaaggtcctgggaccaggagaggtgatggcagacttcaaaggaagggccagtcacaggggaaaccagatgagaaaagcgggtctcggccgagggcatagccaaggaggacgctggagagaggctccaaggtccggggacactccgaggccctgcggtctcaggcagggactctgtccgcggcggactctctttacttcggcyaggcaccggctcggttcatcccgcacgcggggcggcggggctgggctgggaaaaggtcttagcggggtgcaaactcagagagccagcgctgtttgggaaagcagcaggttaaagatgctgagtcgggttggaagggcttctctcgggcagcgtatgacggcttgagggagggcaccaggcacagggagcaggacttggcgctgctcaggctgcactctccacgcgggcaccgtaaggccgggcgcgaccgggaggccccgagagaacgcccggccccagacgctggagctgctctctgcc

SEQ ID NO: 103803 - DNA, 601 bp, Human
aaatttggaaatcgtggaaccggggggccctccagcattctatgattttcacaaaacgttgcctatttcagactctcaaagaatagacatacaaatcaaactgcacatagaaacaattggaaacagggtccgggcacagtggtggccccgcgggccacgctacagcaagccgcagagagagcctctggtgtgctcaagacgcctggtcttcaccctgcttccttagttccggcctgggcgcccctgggtgtttttagccaaaagcggcctagggccgatccacccaatgcattagcagackgctacaggaactgaatgaggaagtctggcctggacaccagagaaaggtggccaactctgaggaatgaagaaccaggtgtccccaagttccgcataaagggctaggcgcagagacagagacgttctctttagggtttgggtgcttgagaggctgcacccgcagcattacttaagtgtttgcataggcactcttagttctaacaaaatgcactgagaaatactatgattgtttttaaacgttttaccagggaaaatgaaaaacgaaaaatgtagggagagtccaggcgcggtggctcacgcc

SEQ ID NO: 103804 - DNA, 601 bp, Human
atagacatacaaatcaaactgcacatagaaacaattggaaacagggtccgggcacagtggtggccccgcgggccacgctacagcaagccgcagagagagcctctggtgtgctcaagacgcctggtcttcaccctgcttccttagttccggcctgggcgcccctgggtgtttttagccaaaagcggcctagggccgatccacccaatgcattagcagacggctacaggaactgaatgaggaagtctggcctggacaccagagaaaggtggccaactctgaggaatgaagaaccaggtgtccycaagttccgcataaagggctaggcgcagagacagagacgttctctttagggtttgggtgcttgagaggctgcacccgcagcattacttaagtgtttgcataggcactcttagttctaacaaaatgcactgagaaatactatgattgtttttaaacgttttaccagggaaaatgaaaaacgaaaaatgtagggagagtccaggcgcggtggctcacgcctgtaatcctagcactttgggaggccgaggcgggcagatcacgaggtcaggagttcgagaccagcctgaccaacgtggtgaaa

SEQ ID NO: 103805 - DNA, 601 bp, Human
tgctttgccctatgaggaggctggaggatgagaaaaccagggccaaggccagcggcctcggccagcctagggaacaagccagccgtggtggccctcagatactgcaggggaagagggatgaaaattgtaccggttgtttggctctgagtggacgccactcccaagaagggagctcgggattcgtcgtggccttagagtgggtatggagccgggctggccagaggaagctagctatggagcgcccccgagcagattcggaggcgacgcgcggtggctgggaggctgccctggactggggacwggcttctgtgagacctgagcctggcgcctcagaggccctgtggagcacgtggagtcctcaggagcgctcgaggacaagctcagcatcccgggcggaattggggactgtatgtcccgggagaaggggagaagactctagaaactcgcccacgtgatactcgggctcatctcagagttacaatgactagagaggccttgtggggagaagacccagaaaggaaactgaggctcagaaagaggatgctctgcggaagcatgatcaagagacagcttccggaggaggccgcagaaggcagagtga

SEQ ID NO: 103806 - DNA, 601 bp, Human
ccaggccttgcttcctagagagatgagggtagcgttctaacgaatagtttgttgcttttataagcacttttctcaacctctcttttctccgctggcatgagaatgggagggcctgacgagtcttatggtagcaagcgtccaggggaacccgcaatcctagtttttgggctcccatcaagagttgccaagaaagctgttgtgagctacttggaagtcaggacagctgggcctccagcctgcagtgacaatgaggctcagactgtgaatcagggaagaggggagtgtctcgggaaaggatggmtagagcagactctcccccacccccaaagggactcagggatgaaaccaggagtctggcgctctttgtatcccgctggaagtctactcgagtgggaaacgattgtctcctgcggagagatggggaatattaaaaagaagcctttggctcttttagctatatagaaacagtcctcgtcctttctaaattttctcttcagctgaaattagcaaaacaaactccacttacaccttcaatattagattcttaattttgcaaaattcctaactataacctgggccgaatatagttagaaggagtagg

SEQ ID NO: 103807 - DNA, 601 bp, Human
gttagacgtcgtgcagtcctgcattttggctgagacacctaaccccggtgcactcaggtcagagcgccagggcttcaggcagacagcaatgggtcacacgggtccttatagttccttcctcttcccaggagtgtcattttagattttacaacacgagcgaataaatcatctccaaaccaacaagatgtcaccttcaggctccccactgcaaaaaaaaaaaaaaaaaaaaaaaaaaaaattcagaagcagtgatgcgtttctattccaccgacccagctttgaatgtctctcccagccaggmcccttttccaagaaataacaactgtagattttcaaccacgacaatccctagaccagtctgattttttattttaaaaggcatgtttcttttacaatccctctcctacacactgtttcccgctccatccatcagcctaccacaccaccatcgcagacccctaactcctggaaaaccctccttggcggaagcactagggccctcaggtaccggattgttgcaaaggtctgtacgtgcctgtgcctgcattgcgacccccggcgcgcctccagttccaaggccgagctcactttcaacagctct

SEQ ID NO: 103808 - DNA, 601 bp, Human
tttctgctaattcattttataatagctaagttagagacttcttggagatttaggttttggggactggatatcattctgttttattttcagctaactcataaatatatgaatttgaaagttcccattgaagtaggtattcaatgtaaacttttatacctgggcattttcacatatcaccattaattcaaactgggaggtaacattaaataattatgtacattgtgactttccattttctaccagtgctgcttccctaaatactggtctagactccagcagtagtatactactgggacagttrctaaattgttgcctgtgttcagttaatgcttaccaagtgagagaatgagctctccatccttggtggaacacctttctaatctagcctaagtactagccactttaccctccccttcccatttcataccttttgcctaggagttatcttctaggcccaccattttaataaccatctatatactaaccactcccagtttacagcttcaagactctccattggagctgcaatccatatctgcagccacttatttgacatttccatttgaatatcacaaacgtgcttcgacctcaaaatcaacaa

SEQ ID NO: 103809 - DNA, 601 bp, Human
gtactagccactttaccctccccttcccatttcataccttttgcctaggagttatcttctaggcccaccattttaataaccatctatatactaaccactcccagtttacagcttcaagactctccattggagctgcaatccatatctgcagccacttatttgacatttccatttgaatatcacaaacgtgcttcgacctcaaaatcaacaaaacatggaactaacgaactttctttccccagtctgatcctcctacagctttccctgttttcctatatggtaacatgtggatgcaagactyatgcacttcagactcatccttgactctccttcctttatgtttctgttccatccatccccaaatcctatcaagtttaccttctaaaataatttgaattcatctactgtttaagtctctatcctggctcacctgcactgctgtaccaccctcctagcctgtggaaactctctgtatccatgcttgtccttaatgtgttggttacaaagactggatataatagatccctaaagaatatttgttgaatttccaaatgacaaatgctagtgtatttttctacaagtacatgtaaaaaatcatgtc

SEQ ID NO: 103810 - DNA, 601 bp, Human
tctctgtatccatgcttgtccttaatgtgttggttacaaagactggatataatagatccctaaagaatatttgttgaatttccaaatgacaaatgctagtgtatttttctacaagtacatgtaaaaaatcatgtcatgttctttctttagaactcacaatcacttttcattctttacatcaaaattgaattatcttgattttaaaaatcactcttgatagtctaccttcccatccctgctctagcagcctgcctgatacctctctctctctctctctctgtcacacacacacacgtgtgcrcgcttgcgcacgcacgcacacacacacacacagattgtaactgttttcctattgttccctagtatgctagctaggctagtatactaactccctgtgttctagtctcctttcatgtgctctggtctcattttggcttctctgacttctgatgtgaagtgtccttgctctgtgcctcgtttttgcaaatcttcccatgctttcttccaagattctgctcccatcacacctccttgcgaaaccttctctgactactttattccagaccacacaaatctcttttctcaagacttactatgggaa

SEQ ID NO: 103811 - DNA, 601 bp, Human
gttacaaagactggatataatagatccctaaagaatatttgttgaatttccaaatgacaaatgctagtgtatttttctacaagtacatgtaaaaaatcatgtcatgttctttctttagaactcacaatcacttttcattctttacatcaaaattgaattatcttgattttaaaaatcactcttgatagtctaccttcccatccctgctctagcagcctgcctgatacctctctctctctctctctctgtcacacacacacacgtgtgcgcgcttgcgcacgcacgcacacacacacacaccgattgtaactgttttcctattgttccctagtatgctagctaggctagtatactaactccctgtgttctagtctcctttcatgtgctctggtctcattttggcttctctgacttctgatgtgaagtgtccttgctctgtgcctcgtttttgcaaatcttcccatgctttcttccaagattctgctcccatcacacctccttgcgaaaccttctctgactactttattccagaccacacaaatctcttttctcaagacttactatgggaaataacaatcagtggctccacaagtagtgctca

SEQ ID NO: 103812 - DNA, 601 bp, Human
tgtttttaaatgaaagtttatctttatcttcttttcttacaaagtccttccttactttcagacagttgataaagcacaatatttctattttgaaattttgtttacttatcttttttatggtctgataaagccaagttttaattttcccttttttctgatgctgatttttgaaaaggttgtgtacgaaatttcaacataacctatccaaatgtatcatttaaagacaactgcatttattccactagtagttttgacatatgctaaagttatatctcaaatatccccttttaaggtacgtttyagggctcttgtcctaaatggattttctattaaatatcaggctttttttttctaatgaagtatatataattatgaatcgttgtccaaaggatgtatttgttcatctgccctgaatgatagaccaatgaatgaattaaaaggaactacatttagaaaagcaggataagtatgattttagaaaacttgaaggaagaaaacaagaaagaagggcacttgtagagatgtgaaggggcagaaaacagaggtgaaagggtttcctggacccacgtctgtagtagagaccactactgagttacagttc

SEQ ID NO: 103813 - DNA, 601 bp, Human
tttttaaatgaaagtttatctttatcttcttttcttacaaagtccttccttactttcagacagttgataaagcacaatatttctattttgaaattttgtttacttatcttttttatggtctgataaagccaagttttaattttcccttttttctgatgctgatttttgaaaaggttgtgtacgaaatttcaacataacctatccaaatgtatcatttaaagacaactgcatttattccactagtagttttgacatatgctaaagttatatctcaaatatccccttttaaggtacgtttcarggctcttgtcctaaatggattttctattaaatatcaggctttttttttctaatgaagtatatataattatgaatcgttgtccaaaggatgtatttgttcatctgccctgaatgatagaccaatgaatgaattaaaaggaactacatttagaaaagcaggataagtatgattttagaaaacttgaaggaagaaaacaagaaagaagggcacttgtagagatgtgaaggggcagaaaacagaggtgaaagggtttcctggacccacgtctgtagtagagaccactactgagttacagttctc

SEQ ID NO: 103814 - DNA, 601 bp, Human
attttatatttaatcatttgtggagcatactggcagcatactcaggggaactatgtggttatgctcctgcaaatcttgttgttgcataattaagtacgtcagaagtaattcaccaagtgtcataacatcccatagttcacgccttgcagatgctggcattggttatgattgtcctgaaagttatcctggctgcatcaccttctcaatgagttttccttttggaggaacagttaccaaagacagctgggcttcctggtttaaataaaatacaattttctgagtagcaagcatattgcttccrtagaaagacaactccagaaccatgtaggagtgacttctataatgtgactgtaaaatgtggttctattcctgttaacccatgggtatgtaaaatgtatcaatgaaacaacaaaggcagtttttaggtgagcgaggagacttcggatttgtctccatatttatttgtgtttaaccttgagactcagaaatgattccacttaacttgtgcctttgggtctcttaatggaagaagggaactaaagggaagaaattaaggtgtattgagtaccataatggatcaggtactgtgctgggtaatgta

SEQ ID NO: 103815 - DNA, 601 bp, Human
cttaccaatagggctttgagactcagaggagttggagcaatgtgcctgaagcctcaaagttagttattgacaaaccagaacttgtcttgacccctctgttctactgtattccagtattttctaactccagtggctagaaaattggaaggaagtggttgagttcaatggtttttcagtggcatttattcagtggaacatagaactcttgtaactgtggtacctgactgtgctagaattacaaattaaaactgcagataatcctgcagaaaatgttatctttgcaaaaaaaaaaaccctcttratagcactagacatttagatgtcagataagcagcaaatctgaagtcaattacagggctcagtgaacataaatgaagaagtgagttggaagatagtactagagaagaaacaggtgagccagagagctttcctgaaggtgaggagttgattttgaccatggtccttccaaaagtatggccttgaacatgccacccagcccttatgagctctaatcacaggaaaaatagaaatatcttcttgacaagtctattgaagattaaatcagatatttatgtaacaaccttaactcacaggtggaacc

SEQ ID NO: 103816 - DNA, 601 bp, Human
agcctgggaagtcttgtcaaagggtgattcaagtgtgggctagcagctgactcaggaacaacccggcagtgctctgaaggctgactcgagctaggggatttgttaggccatctgcaagacacatttagagggaaaatgatttgagaatgaaagtgctgtcatccaaacttgaaagtttaaaaagtattcattttgatagatggagactaaaagattttggaatttggagtcagaaaatctagatttcaatcctgcctctatttctgccactcttggcttgtattacctacctgtaaaatgraaacggtaatgcctgcttgatttctttctttctttctttctttttttttaatcatggagatctgaagagggcacaatgtggaggaaaagttatacatggtttgaagtctaatgaatacctctatgaagctctaatataataagagggtaacaagctgctagggattcagagggtggatttttcatatctagcaagggtatataaggacaggccttgagtgcacaaggcagcatgtgaatgcaacttgagtgtaattgattttttttttacaagtcagactattgagagttaagaacaata

SEQ ID NO: 103817 - DNA, 601 bp, Human
tagcagctgactcaggaacaacccggcagtgctctgaaggctgactcgagctaggggatttgttaggccatctgcaagacacatttagagggaaaatgatttgagaatgaaagtgctgtcatccaaacttgaaagtttaaaaagtattcattttgatagatggagactaaaagattttggaatttggagtcagaaaatctagatttcaatcctgcctctatttctgccactcttggcttgtattacctacctgtaaaatgaaaacggtaatgcctgcttgatttctttctttctttctttctttttttttaatcatggagatctgaagagggcacaatgtggaggaaaagttatacatggtttgaagtctaatgaatacctctatgaagctctaatataataagagggtaacaagctgctagggattcagagggtggatttttcatatctagcaagggtatataaggacaggccttgagtgcacaaggcagcatgtgaatgcaacttgagtgtaattgattttttttttacaagtcagactattgagagttaagaacaatataaacactaaacaagcaaattcaattggacatatacctgt

SEQ ID NO: 103818 - DNA, 601 bp, Human
ttaagggtacaaaaaaaaaaaaaaaacaagttgctatttacgtttcagatattttttaaaaatactgtctggtgagtggaaaatggcagctcggaaaaaatgctagcttagaggactaaaaacctaagagggcaagagcaagcagctctgtgcttcataagcgagcttttctttaaaaggagctacagcagcactggggcgtaggggaagcagaagggaaggaagagacgtggggaatagaatttcttgttccaataatcccatagttttcagcaaggtcaaaagtctgagagttgtgtaragccttggggagtgggtctaagaaaaatgtgacctgccaaggtcagcaattctgacactgattcaaattctagccttagggggtagctgtttgatgagaacagagaaggaggtggcatgaatagatgacatttcgcattggtaggagacgggcggctgcagcggcttgtgcagtcgattccatgagagatatttccagaacaaacagagtcaccttttaattgcctgcatatggatttaccacttggtgtattcttttaaaatctatagttgacacctctctctaacttgcacactccag

SEQ ID NO: 103819 - DNA, 601 bp, Human
aaggtatgaatattgacttatttaaataaaaacatttaaataaacctcctatagtctgctgactatatcgtttcatagacgaaacattataagaccaaaataataaaactgctatgcttgcaaagtaaaataaatgggcatatttaacatataaaactttactatgttgtactgatttttgcacccatttaattgtgacacttgaagagtttgtctttgttctgggaactgtttacaggaaattcctgactgacatttttttcttcccatatcttaactatatacttgctaatttcagtaytgaaacttatttgataattttgtgctgactcaagttcaagtgaaattcatattattctttagctatgcatcttttggtttttagttctgtgacaatataattgttatcaatatacattagaaatcaatagcatattgataatgagatgaaagattaactgagctaaacatagatatttgagactttttcttcaggaattattgatctgaagttgtatttaatctatcagaatatgctcttttctaatccattggttccccatctcagattccctaacttctttgggcagtaatagaggac

SEQ ID NO: 103820 - DNA, 601 bp, Human
tcaagttcaagtgaaattcatattattctttagctatgcatcttttggtttttagttctgtgacaatataattgttatcaatatacattagaaatcaatagcatattgataatgagatgaaagattaactgagctaaacatagatatttgagactttttcttcaggaattattgatctgaagttgtatttaatctatcagaatatgctcttttctaatccattggttccccatctcagattccctaacttctttgggcagtaatagaggacctttatttttttttctgttatttcaaaaakattaataaaaatgtatgtttactctctataagcaaaagaagaacttaagatttttgacaggattgataataatttagtgagactctttctgtggagctgtgtactgttcttagaacaaagtagggactcattaaagagctgaataagtcaatgaatgaacaatattcctggctatctcaggctaaatgatatcatagtctgacaattttgaatttacttaatgcaaatgacaaaatatagttgatttagtagaaaaggttttaaatcatggaatctatgtgggaaggtagtccatggggc

SEQ ID NO: 103821 - DNA, 601 bp, Human
agctatgcatcttttggtttttagttctgtgacaatataattgttatcaatatacattagaaatcaatagcatattgataatgagatgaaagattaactgagctaaacatagatatttgagactttttcttcaggaattattgatctgaagttgtatttaatctatcagaatatgctcttttctaatccattggttccccatctcagattccctaacttctttgggcagtaatagaggacctttatttttttttctgttatttcaaaaagattaataaaaatgtatgtttactctctatargcaaaagaagaacttaagatttttgacaggattgataataatttagtgagactctttctgtggagctgtgtactgttcttagaacaaagtagggactcattaaagagctgaataagtcaatgaatgaacaatattcctggctatctcaggctaaatgatatcatagtctgacaattttgaatttacttaatgcaaatgacaaaatatagttgatttagtagaaaaggttttaaatcatggaatctatgtgggaaggtagtccatggggctgcaacaattgagaacattcataaagatgtg

SEQ ID NO: 103822 - DNA, 601 bp, Human
agatgtctatgccaagaagcacatgtttttgtttttgttttaaactttcagtttatggttccaaggtcctgatacttatcagctttaaaaaaatcgttttcattttttaggtagttttcttgcttttgggcaccaggtggcgatatggagtgaggtggggagtgcatgggatacacaggttgggttgtcataaagaccaagcatctgtagagccgaactgatgagatttaatattccgtctctctctctctctctctctctccctctctctctctctctctctctctctctctctctgtgsgtgtgtgtgtgtgcgtgtgtgtgtgtgtgtgagagggagagagatccaaaaagagaaaactttgtaaagatttggttccattttgtctgagaaagactggattggcattcctcatctgtatgaaacacttctcaacagattccatacaatatatcgcttggaaaattcaagagctgccaggtctctagctcttgctagcatttggttagcatttcactgtatataagatccttactcctcccctccccccccattttttcaacatttactgagcacctataatgtcccacgcactgtaat

SEQ ID NO: 103823 - DNA, 601 bp, Human
aatgcacagttattgtgtgcttggtactgtgttaagtgctatgaggaatacaaagctccctgtcctttaggaaacttaagaggtcatatatgggtctagaatctagactctagatatacacataaatataatatcaaatggaaagtcatgccatgagagaggagccaattccataataaagttgtttttatcctggcagaccaaaattgaagttggatctattcaggtttacatttccaggaaaaatatacatttgtattattaataacaattgtccaggatcaggaagccctttctaatractgacataaatccttatggggtaagaacccaatttattttccattgtttcaatacttttgattaaattcttaatttgaagggtttaactcaaaataacagcctacaaaattccaataaatagaattggtgagcctgtcgggatatctttccttaattcactcttgacatattttacaatgtagctaactttctagaatgtagttaagggatcaccttacattattcttaaattgttgtgtgtatttgatgaaaagttaaagctgttttttttttttaaattcaggccactagagttcta

SEQ ID NO: 103824 - DNA, 601 bp, Human
ctggaggaaagttgtcgccacgaaggactttattaccacatactttggtttccaggtgcaagtgagtccaaaccccaggtgcaaatatatccaaatttcagcaccataaggtttcagtttctcacttgtgttttttttatagtacctgccaacacatgaaacacggtagaaaggtttgatcaattttttaaaatgaatttaggaaaaaatagtaacttacagaaactttgaattcagagttgaaagagagcttataaatgatcaaaccaaacctattctgggagccgaaattccttctccrgtattcctggcagacaggatccagccttgcttcaagattttcacacagaacagctgttttcgttgtagagtggaaatgattcttatgaaatttatatgaaaattctgtgaatgtctatgtgtatgtgcatgcaaaatttatatttccatctaggagaggcatattccctatataattgcatttgcttattcaaaagctagtcacacgggttgagaagtatgagggtacttatggggaaaataagacagaattaggatagtactttaaatctgggaaatgtgcccacagtatttaccgctg

SEQ ID NO: 103825 - DNA, 601 bp, Human
gagtaacagctgtgcttgaagtggccttatagataaaaattaaaagtatgataacatctaaggattttgttgtttttaaaataacggtagacttaagaattaagaggaggctaaaggcatcaatgcttctaatatgtcagtcagcctcttcatgtagtaagttggagaaactgacatagtctaacaatccgatgcattgggagatatgctgtggtgatctgaccttacttgtagttgcaaagacttgcactggaagagtctatctcctcagtgatggtggagatggtttgctaaatgtccrtgaaggcctgatttgcaagatatccgatgttgttatgattaaatgcaacaaccataccccatgaactattagagacagaaggagctagagagggtgcccttccaaatctcttactggcaaaatgaggaaactgaagtgatttgcacaagatcagccagctagctgcacaactgtgactggaaactgagcccctacataatgcttattatgtcccaccaatggctttcccatagctgcattatggttgtagacactctaaacgagatgctattttaatactacatacctaaggttcaatca

SEQ ID NO: 103826 - DNA, 601 bp, Human
agttgaatagaagagagtattttcttcttcagaatcaagaccacaattttttatgtggccaggcttgagtttttgcaacttaattaaacatatcaattccaatcaattatatttcctattagttcaaacacttctccagtcaacaacaaatctgtaaagagtccctgagtgcctgccctcactctcacacacttttctttgtgtgatcagtatgaacgtgcatcttttccttcaaatatcgtgatccccatccttcttttctcttttctcttcttttcctgggtatgctttttttcccccctctctattctctgagacctttgatggaacctttattgaatgcatagcacatgcttggagcaatttaggatgacttttctaggatcatccagatgtccagtgtggagaaataaaataaaacatgcttttctctacatttcaacataaaggctttgtttggccttttagttttctctatctttagcagtagacatgtccaaagaccagtacagaaaaagagacagaagggatcagcatgtgcctcacacctgcactggtcactcattcaaggtgcaaggtaggcaggagcaaaggagagagt

SEQ ID NO: 103827 - DNA, 601 bp, Human
accctgtgggtgttatccccacactgcaagaatagtgataaatacgtcattaaccatgaccagcagagatatgtctatattagagaaaaagaggcaaccctgaatcttaacattatattttacgtcctacattgcctattctctagtgtgcggttctcagagaggaatgtgccacagtattccaatagttatgaaaagataacataaggtgcagccagcagtccagaagagatgtggtcaagatttgtcaaactatttgaagtcgtttataagtaaaaatacctcactcaatgattcttaygaattcaattttccagttaaaaaaagggcaaagaacacattttgccatttgtgctagagattaatatccctttatttacatgcaaattactttaaaaggtaggaaaacctataaaattttaaaggttccacactgggggcttacactaagagtctttgtcaaataaaatgaattctcacaaatctgctttgagctactttctttgcttctaagcacagcctctcttagaggaaggaaacagtaaagttctcacagagaaagaaaacgtttaccactcagtaaaaatccctgggcctcact

SEQ ID NO: 103828 - DNA, 601 bp, Human
catagtttttcatagggctgttatgaggaataaatgaggtaaaaatccacttttaggaatgagtaatactgcctttatcaccctgctctgtccattacaaacagtatttttccactggtcaaaatgtgtatttttccatcaaaatctagtgcaattagttcctcttctttatgactcatctattatctcatctattaagttacagttgatccttcctttgcatcacagctttacaatatatatcctccattatcttacataactcatttttgaagttacttgcttatatatctgtttttcytcactaaattttgagctccttgtgggaaagattgacctttcatacttaccagccagtactcatcaccagtagtaagcatatattacattaaatagaaagaaaacacaacataggaactctgaattgtgatttgtcattgcaacttaatttgaattccatggtttaaaggctcatataatccttgggcatgaaatcagtttaacttgtgggcatctgatcattccatttctactcaggccaaatgttttgcttgttttgttcaagaattacaaatttagagtttatgaaattttatttcca

SEQ ID NO: 103829 - DNA, 601 bp, Human
aatgaggtaaaaatccacttttaggaatgagtaatactgcctttatcaccctgctctgtccattacaaacagtatttttccactggtcaaaatgtgtatttttccatcaaaatctagtgcaattagttcctcttctttatgactcatctattatctcatctattaagttacagttgatccttcctttgcatcacagctttacaatatatatcctccattatcttacataactcatttttgaagttacttgcttatatatctgtttttcttcactaaattttgagctccttgtgggaaagaytgacctttcatacttaccagccagtactcatcaccagtagtaagcatatattacattaaatagaaagaaaacacaacataggaactctgaattgtgatttgtcattgcaacttaatttgaattccatggtttaaaggctcatataatccttgggcatgaaatcagtttaacttgtgggcatctgatcattccatttctactcaggccaaatgttttgcttgttttgttcaagaattacaaatttagagtttatgaaattttatttccaaaaactattaagaagtagaagaatttttttaa

SEQ ID NO: 103830 - DNA, 601 bp, Human
tctgggagctcctaccagaaactactatgtcaaagtgagctagcagatacagttagtactgtactaggtaatgacagtaagtctcagcagttttagtgggctacgtagagaactcaaacaagtaaaacttttgcattgcaagaagttgttccttctcatgtgagcaattgaatctgcttctagttctcatgtttctagcactgctgttaccagttcaattttgggttctctgggctaagtcacacatatacccacatagacacacacacacacacacacacacacacacacacacacacacacacaaacattttatgagaaattatgccccccacccttaaatgttagattttttaaaaactctggaactttataaatagtttttcaacagttttctttggtctcttgttaagtatttgaatacctgctaaatctgaacattatctttaaaagttatctaaaagaaaataagcattcatgcaatgttgaaataaccctgatatctgcaaatatcattactagtgttatttaaaaatagtcaaagacattgcagatttgaccacaggaatgtatatccatggaattacacagtgtctagtta

SEQ ID NO: 103831 - DNA, 601 bp, Human
tgggagctcctaccagaaactactatgtcaaagtgagctagcagatacagttagtactgtactaggtaatgacagtaagtctcagcagttttagtgggctacgtagagaactcaaacaagtaaaacttttgcattgcaagaagttgttccttctcatgtgagcaattgaatctgcttctagttctcatgtttctagcactgctgttaccagttcaattttgggttctctgggctaagtcacacatatacccacatagacacacacacacacacacacacacacacacacacacacacacacacaaacattttatgagaaattatgccccccacccttaaatgttagattttttaaaaactctggaactttataaatagtttttcaacagttttctttggtctcttgttaagtatttgaatacctgctaaatctgaacattatctttaaaagttatctaaaagaaaataagcattcatgcaatgttgaaataaccctgatatctgcaaatatcattactagtgttatttaaaaatagtcaaagacattgcagatttgaccacaggaatgtatatccatggaattacacagtgtctagttaat

SEQ ID NO: 103832 - DNA, 601 bp, Human
aaaatggaggtaattagcaattaagtatattattctttactatatacctctttgaaggcacagatgtatctattggtcaagtacttgaagaggagtttgtaatttaaaattagaaagagttattaaaaacaatttaatactatgccctttttcaacagcaacagtaatagaaacctagattggcaaagttacattctcaagatcacatgacttttttgggccagagacagagaactcatgttgtctggcttctgatccactgacgttcccccgtaccccattatataaagttgacttctcatacatttctatgaaaaaactttactaacattgaattgctgaaaatgtgggaaagagtataaagttataattgtataaatttggtctggggctatgattaattagagacaagttttgatataaaaaatgggttctctcaggtcaagaagttacctatattcgtatcacttggtgaccacctacacttcatggccagaaaagcttagtgccatttggtcttgggaagacctgagactggtgctcaaaccagaagtctcagcagggcacagtggctcacacctgtaatctcaacactttggga

SEQ ID NO: 103833 - DNA, 601 bp, Human
gagtcctcatgatggaattagtgtctttataagaagagaccaggaagcttgctctcttttgctctctctgccatatgaggatatagtaagaaggcagttgtttgcaggccaggaagcaggccctcaacaggaacccatataggccagcccctcttcctgaggcttccagcctctgaaacatatttctgttgtctaaactacccagtctatagtattttgttttggcagcctgagctgactaagccaacaacccattttacagatacagaaattgaaagcttcagatgttaaagaatggtawtttcctcaaaaaagtcaagctttaagccactatttacacttcgacttttcttattttttaaacaaaatttgaatttttgttctttaaagagaattttatttcatctaaaaagtatttaaaaatatcaagcttcttattttgaccattttagcatgttttcatcttcagatttatttgacatccaagaccagagtaacaccaagaagaactttgatatccttttcagccctcttcatttattctatatagtgttacagaattacctttggttctatctcttactgtgatggaaagctaatt

SEQ ID NO: 103834 - DNA, 601 bp, Human
tttccaaaggttacggggcctgaaccacacaaatcccattaaagtaagtagctgttgtgcaatataagttcctttgaaaacattgttcaatgcccataaaatgatcagcgggctgcactttagatccgcttgcctgccatgctttcaaccaaaaggcagatgacaaactttgatgtggtagttggtttctgctactggagctggcattttatcttcttgcatcagattttttcccaaactgatgtgacccaggcataggaaacgcatttttcttcagattttattcctaaaatatgttttaccgtacctttaaattacgtttggctgaccaatgatttggaatctctaaggttcctcccacaggatgcagagcagaagagggtgaggggtgttggagttagctgaagcttgcatggcaagagcaaggccttagtgaatagggatcaccacatgctgtcaggtccccatgcttgaggatggcactttatgccttcttctccaccttccctctagggcaacttcagcagccacatgaggagtccagagtgaacttcatactagagccgaggtcagggctattgttctctttaactcatatttg

SEQ ID NO: 103835 - DNA, 601 bp, Human
ccccatgcttgaggatggcactttatgccttcttctccaccttccctctagggcaacttcagcagccacatgaggagtccagagtgaacttcatactagagccgaggtcagggctattgttctctttaactcatatttgaatgcacagagggtagcctaccttgggcttacagtcttcttttctcaagaagttcttcatatgtattctaacattgtgatccattagaaacacccatctcttttagtacctctttcttgtgtattttcttggtggtttaagtaattcatgtatcctgcagcygcttttctagtaaaagataaaaatgaaagaataattcctacatttgcagaggaatcagaccacaaggctttttccctctctaaatctggtgactatcctatctgataaagaaacactgcaaaagaatttttcctctgtgggtaaaactatccagagacaaaagacaatgctaacataattacttgctatgtattgttaaaaagaattcagaaattactcagtcctttaaaactttaaataaatcactaaaattctaatattgtgggactgcttctataccatgacattactataactctt

SEQ ID NO: 103836 - DNA, 601 bp, Human
ttttcttggtggtttaagtaattcatgtatcctgcagccgcttttctagtaaaagataaaaatgaaagaataattcctacatttgcagaggaatcagaccacaaggctttttccctctctaaatctggtgactatcctatctgataaagaaacactgcaaaagaatttttcctctgtgggtaaaactatccagagacaaaagacaatgctaacataattacttgctatgtattgttaaaaagaattcagaaattactcagtcctttaaaactttaaataaatcactaaaattctaatattstgggactgcttctataccatgacattactataactctttcaacttttactgtaatgtaatatgtcaaggaatcctatctcttttctatagaaatacctgaatacattaaggtgacaaaatatttacagagaaaatattgaaccataatttttaaaaagtatttgataatatactaatatatgtatataaatttagagcctgagaaatcaatatgaattggtgctatcagaaaaggtttatagagaaggtaagatttgagatgtgttttaggaacagagagattttaaactgtgtcctaaa

SEQ ID NO: 103837 - DNA, 601 bp, Human
gagctgtacaactgctcactccacaaaaagaattttcttctcccataccttgttatacatttctataattgcacttaaaatacttgttttgtagtttttcaaatttacatgtcttcatttaataggttttgatctgcttaaaagcagagaataagtttctcatctctctctttccagcatttagtactgggcctggaccatagcaggtgctccataaagatttcttgaatgagtaaatgaatgagtagaattccatagcactctagaagagttgtatgatcatgaattggatgtccttgasttcagaaactcagccatttattatttatgtgaatttcaacagattacagtcatacaatgcttaacaatggggatctgttctgagaactgcatttttaggtaattttgtcattgtgcaaacatcatggagtctacttacacaaatctagatggtataactgactgcacacctaggctatagggtatagcttattgctcttaggtcacaagcctgtacagcatattactctactgaatagtgtaggcgattgtaataccatggtaagtatttgcgtatctaatcatatcaaatagcaaaaat

SEQ ID NO: 103838 - DNA, 601 bp, Human
agtcatacaatgcttaacaatggggatctgttctgagaactgcatttttaggtaattttgtcattgtgcaaacatcatggagtctacttacacaaatctagatggtataactgactgcacacctaggctatagggtatagcttattgctcttaggtcacaagcctgtacagcatattactctactgaatagtgtaggcgattgtaataccatggtaagtatttgcgtatctaatcatatcaaatagcaaaaatttggtattataatttaatgagaccactgtcgtatatgaggtccatcatatgtggtgcatgactgtatttaatctcattgaaattgcttcctcaactgtaaaatagaaataataaaacctaatacgtggaattgtcatgttgactagaaataatgtatgtagtgtgcttatataagttcctagccctggtaacacttaaaaaacaatatcgtttgcccactttttcatgggattgtttgtttttttcttataaatttgtttaagctccttgtagattctggatattagacctttgtcagatggatagattacaaaaatcttctcccattctgtgggttgcctgttcact

SEQ ID NO: 103839 - DNA, 601 bp, Human
tattgctaattcttgtctacttgtctgaagttttctctggggatcagtttgtgtgtatttgtgtgtgtgcgtgtgtgtgtgtgtctgtgtgtgtttcttttaaataaaaaaggaatgtataatttacactaaacttttatattaaaaagttgaacatttttaaagaaacaaatatcagagtactatttcaatctcataaagaggcttttaacctcccattattatgctgttcagaaaatataggctgccagaagggaagctgagacacaaattcctaacccattggattagtctagagtgmctttctttgaaaatatacctgagtactctgagaaaccaggccaagcctacgtgttctccctggctgatttcagtggaggaagaactattcaaaaattcatttattatgcttttgtttacctttttattgtcaaggttaattattggtttaaggagaggttttaaatgaaatataggagattatgtctcagatgaagttgaatttctgacatgaaatgctacatttttgaaatgcaagtgtttttcaaaggttcttagctttaatcaaagcaaaaagcctcatctaaaagtttctttctgt

SEQ ID NO: 103840 - DNA, 601 bp, Human
gtgatgacattaggcaggcaactgagtcaccagagggacaaagcattccctatcacggacactgttgtcctggcaggtgccttctttacatccgtggccagttaaaggaagcttgtttttggcacacacacccattgcttaactcagaactatttttcttaggcaacttgtaagagtgaaagcacacacaagcaccagaattattcagactcactaatcttgcagtgctttgcttcgtgcttcgtgggtagcagtgatcaaccaagtcctgaacttttgactgttatttgagatgaagtarccaagaaacattttctcagagacatcctttcctaggtgaagtggatagtgaatggcctggttttgcattatttacctgaagtgccatttccagagggagggctgggcttaaaagaaagctagtgatgagtgaaagagaggtcagctatccttgtccacagcttccctccccatccttctcctcccctcatttgatcgtggtcatggtgctgcctgacatctgctgaacgcatttggcttatttctccctttcacactttcaaaaatagatcctcgtccctcccaagatgttgtttacacg

SEQ ID NO: 103841 - DNA, 601 bp, Human
tgttcactttaagagataaatatacgtattagaaaatcaacttctgaatttcaaaacagaagttagaaatagaagttagttatttaaatcacaaaagatccctttccaaagaatttaccagatctctttttaaaagtaaatttccctaggaaaactggtattacattttatcaggtgaagcaagtatgcctccgttgttcttgcactgacaaaagaacaaacccgagactttctgcaacttctatgcatcacagtcttgaacaccgtaacccctacagtctttgaaaaaatcctgagctggtgaaacccaaggatttcaggaaaactcatagacttctcggctgacagatttgtctttagggtgaaattgtaaacatcttgtcatcatttgttcaaagggccaaatagaaaacaaagagttgaaaatagagtcaggtattatttttttcccaagctatcaattgttttgtgatttgtgggacttaacactataggtgtttagaaagcagaggggcagttgtccatacgtttcctggctttaaaatcgtagtacgaatagtattttccatacttcctcaatgtttgacagtcattttaacac

SEQ ID NO: 103842 - DNA, 601 bp, Human
aggaatctccaaacaagtaaatggaaacatttgaagctgatttaaatgtgtcagctctgtgtaagtctcagggcagattagctgaatcaacagatggggtgcaagcatttattattaatctctaatttctcaatgcactttattcagtaatgtggtttcttggtcactgacacaaagaacttaactaaaactaactaaaaatggggctttagccaaagcctaaaaactcagtcccagaacttatgtctgtaccccacttccaagaataagtgggttttacttagaaggcaagaccaacagkcaggatctctggttgttgttaagcaggcttctggttgttgtcatgtgcttaatctgtacaaatcacttagcttcaatctcaccattttacccgagcaagcttaatcctgtataggaaggactggtcattttacatgttccgaatggccctataaattggttgaaaacagttaattaccctctttggacttttaagaaaacatttcagggttctctttcttttcctaaagcagaacgtcagaagtctccgtgacatggaaagcagatggtcacaaacaatttcatattggcagccactcaa

SEQ ID NO: 103843 - DNA, 601 bp, Human
ctttattcagtaatgtggtttcttggtcactgacacaaagaacttaactaaaactaactaaaaatggggctttagccaaagcctaaaaactcagtcccagaacttatgtctgtaccccacttccaagaataagtgggttttacttagaaggcaagaccaacaggcaggatctctggttgttgttaagcaggcttctggttgttgtcatgtgcttaatctgtacaaatcacttagcttcaatctcaccattttacccgagcaagcttaatcctgtataggaaggactggtcattttacatgytccgaatggccctataaattggttgaaaacagttaattaccctctttggacttttaagaaaacatttcagggttctctttcttttcctaaagcagaacgtcagaagtctccgtgacatggaaagcagatggtcacaaacaatttcatattggcagccactcaaggctctcttgcatctgttgacactttaggaggcaggtcctctgcatcttacttctaatgccatttttgaagaatgactaagatactcttagagtactcactcactaattctgtcttttctgacttgtaatacaagtt

SEQ ID NO: 103844 - DNA, 601 bp, Human
gttgagatcatctatcatgaaatgatgagtaagagttaagcaggcaaaactgaaatagaagaaggtaggatccttttgaaacctttctgagtctcctgtgtcagaacacatacatgtatgtgtgcacacacacacacacagtcacccatacacttaaccagggctataaagattttaaattaaagatgtatatttctggaaagacctagtgatctgggactcattatatttcttaacttaattttcttgagttaattattagtaactgagctgaaataggttattatgagttttgactccrtggtgtcccaaataagtatcaatgatatattctatttgtggagtagctttacttttctctctttctgatcttgtcacttgatccccagaaccacaaagtcttatgtggctgacaaaattccattggaatgcaggcaacagaagagcacatgtcattccatttataagtctatctcattccagccctgagttgaaagggattttgctaatcttagaagcaactaaaaacatttttattgaagtaaaatatgtatacttttaactatttagtagaaagactaatttgctattaagtctatga

SEQ ID NO: 103845 - DNA, 601 bp, Human; identical to SEQ ID NO: 103801

SEQ ID NO: 103846 - DNA, 601 bp, Human; identical to SEQ ID NO: 103802

SEQ ID NO: 103847 - DNA, 601 bp, Human; identical to SEQ ID NO: 103803

SEQ ID NO: 103848 - DNA, 601 bp, Human; identical to SEQ ID NO: 103804

SEQ ID NO: 103849 - DNA, 601 bp, Human; identical to SEQ ID NO: 103805

SEQ ID NO: 103850 - DNA, 601 bp, Human; identical to SEQ ID NO: 103806

SEQ ID NO: 103851 - DNA, 601 bp, Human; identical to SEQ ID NO: 103807

SEQ ID NO: 103852 - DNA, 601 bp, Human; identical to SEQ ID NO: 103808

SEQ ID NO: 103853 - DNA, 601 bp, Human; identical to SEQ ID NO: 103809

SEQ ID NO: 103854 - DNA, 601 bp, Human; identical to SEQ ID NO: 103810

SEQ ID NO: 103855 - DNA, 601 bp, Human; identical to SEQ ID NO: 103811

SEQ ID NO: 103856 - DNA, 601 bp, Human; identical to SEQ ID NO: 103812

SEQ ID NO: 103857 - DNA, 601 bp, Human; identical to SEQ ID NO: 103813

SEQ ID NO: 103858 - DNA, 601 bp, Human; identical to SEQ ID NO: 103814

SEQ ID NO: 103859 - DNA, 601 bp, Human; identical to SEQ ID NO: 103815

SEQ ID NO: 103860 - DNA, 601 bp, Human; identical to SEQ ID NO: 103816

SEQ ID NO: 103861 - DNA, 601 bp, Human; identical to SEQ ID NO: 103817

SEQ ID NO: 103862 - DNA, 601 bp, Human; identical to SEQ ID NO: 103818

SEQ ID NO: 103863 - DNA, 601 bp, Human; identical to SEQ ID NO: 103819

SEQ ID NO: 103864 - DNA, 601 bp, Human; identical to SEQ ID NO: 103820

SEQ ID NO: 103865 - DNA, 601 bp, Human; identical to SEQ ID NO: 103821

SEQ ID NO: 103866 - DNA, 601 bp, Human; identical to SEQ ID NO: 103822

SEQ ID NO: 103867 - DNA, 601 bp, Human; identical to SEQ ID NO: 103823

SEQ ID NO: 103868 - DNA, 601 bp, Human; identical to SEQ ID NO: 103824

SEQ ID NO: 103869 - DNA, 601 bp, Human; identical to SEQ ID NO: 103825

SEQ ID NO: 103870 - DNA, 601 bp, Human; identical to SEQ ID NO: 103826

SEQ ID NO: 103871 - DNA, 601 bp, Human; identical to SEQ ID NO: 103827

SEQ ID NO: 103872 - DNA, 601 bp, Human; identical to SEQ ID NO: 103828

SEQ ID NO: 103873 - DNA, 601 bp, Human; identical to SEQ ID NO: 103829

SEQ ID NO: 103874 - DNA, 601 bp, Human; identical to SEQ ID NO: 103830

SEQ ID NO: 103875 - DNA, 601 bp, Human; identical to SEQ ID NO: 103831

SEQ ID NO: 103876 - DNA, 601 bp, Human; identical to SEQ ID NO: 103832

SEQ ID NO: 103877 - DNA, 601 bp, Human; identical to SEQ ID NO: 103833

SEQ ID NO: 103878 - DNA, 601 bp, Human; identical to SEQ ID NO: 103834

SEQ ID NO: 103879 - DNA, 601 bp, Human; identical to SEQ ID NO: 103835

SEQ ID NO: 103880 - DNA, 601 bp, Human; identical to SEQ ID NO: 103836

SEQ ID NO: 103881 - DNA, 601 bp, Human; identical to SEQ ID NO: 103837

SEQ ID NO: 103882 - DNA, 601 bp, Human; identical to SEQ ID NO: 103838

SEQ ID NO: 103883 - DNA, 601 bp, Human; identical to SEQ ID NO: 103839

SEQ ID NO: 103884 - DNA, 601 bp, Human; identical to SEQ ID NO: 103840

SEQ ID NO: 103885 - DNA, 601 bp, Human; identical to SEQ ID NO: 103841

SEQ ID NO: 103886 - DNA, 601 bp, Human; identical to SEQ ID NO: 103842

SEQ ID NO: 103887 - DNA, 601 bp, Human; identical to SEQ ID NO: 103843

SEQ ID NO: 103888 - DNA, 601 bp, Human; identical to SEQ ID NO: 103844

SEQ ID NO: 103889 - DNA, 601 bp, Human
actgaaattagaataatcctccatactactccccaaaagacagaggcaatgtatattaaagacattactaaaactgtttatcattcaactttgcagtagtcttatgagatattggtatttgctagttatttgagtaaaaactgagggtgggaaatttgttagtgctttgccacacacagttgtccaatctggaaacctttgactgcttcctctctcaacccctaaatctaattggttttgcaatcctatgtgttctaccttaccgccatctcacaaatctcacccttctgggttccagctrtcattgcctctgctcatgccctcattagcaatcaagtggatttgtgtattaggctcctggctagcgcccccttccttccttcccagctccctctaattcaccttttgtagaacgagagttatctttccaaaatttagaagtgatatgaatcacttctatatttagaacgttcagtagattggcataaccttcctgtaaaatccaaattccttaactttggatacaagatccttcatactctgaaccatcttctccataatcatttccagaataccccataaaaccaaattacctagcaat

SEQ ID NO: 103890 - DNA, 601 bp, Human
cttactcttgatttctgtatttatcctgtaacagactagtaacaaaccattcatatcagtattgctctgcagactatgtttgaataacactgcattagatattccagctgaataaaatatcaagatttaaatagtcatctttcgcaagcattttagctgagtctgtgtgacaggtgggccacagacaagcaggttgtaatcaactcttatcagtcaatgagataaataacattaatttaaaccacagagatatgtttataattttgttatctgtgattgctgtgtatttcagacagatacrggaatctatatatgatatcaattcacatcctttgcagaaacagagaaagccctctccatatgtgagatttatgttcatgtttctacttgttcacataaattaaataatttttatttcacaggaaaaatgaactatacatatgcaagatggtaaataatgttaaaatacaagaaccttgccactgaaattagaataatcctccatactactccccaaaagacagaggcaatgtatattaaagacattactaaaactgtttatcattcaactttgcagtagtcttatgagatattggtattt

SEQ ID NO: 103891 - DNA, 601 bp, Human
tcaaaaaaaaaaagataatttcataatgtctcaaatacttaatatcagttgaataggactatacaaaacccttaaagctcatatttgccatcatttgagtgaggttaccaaggtatcaaatatagggatgtatgtcatgtgaaaagtaattgtaaatcttagtgacaaaggctacaataaaacataaactatcttattctactatatttcatgacttatttggtatttaggaagctcaacagcttatactcattttttttttttttttttttttttgagacagagtcttgttctgtcgccyaggctggagtgcagtggtgctatctctgctcactgcaagctcggcctcccaggttcacggcgcgatctctgctcactgcaagctctgcctcctgggttcatgccgttctcctgccagccttccatgtagctgggactacaggtgtctgccaccatgcctggctaattttttgtatttttagtagagatggggtttcaccttgctagccaggatggtcttgatctcctgaccccgtgatctgcctgcctcggcctcccaaagtgctgggattacacgcatgaggcaccgcgccaggccact

SEQ ID NO: 103892 - DNA, 601 bp, Human
tgctcattacaattaactaatattggtattcatgtttgtaatattatttctacatcaaaattttacatcactatgagtgagttaatgcttggcacttttgtaaatagatgattcaaattgatttgagtattgactgtttgtgaattttaagctcaaatgtaggatttcattcattattcattaaaacaaaatttaaaaatgcacttaccagttttagtaatcgtttatgtgttatttcaagtctgaccacatgagggcagcatggtaccttttaagacaaagcatagcctaagtggagggraaaaaaaatctagtattaaagctattaaaaatcatgggtacaaaattaaaactagaagtctccataatgatcttcttatccaaacttgaattttacaactgaaagaactgaggtctaaggaggacaattagcaagtccaatcacacaactgatatcttttgaaggtagagcaaagaaccattcaacagcattaatagtagcaataataattgcattattggagcacctagttactttaagagactttttattaagcactaatatcttgtgtgacaatactttagaggcaatcgaatgttt

SEQ ID NO: 103893 - DNA, 601 bp, Human
gatatgtaaaatatttatggtgcctagcacatggtagtgctcattacaattaactaatattggtattcatgtttgtaatattatttctacatcaaaattttacatcactatgagtgagttaatgcttggcacttttgtaaatagatgattcaaattgatttgagtattgactgtttgtgaattttaagctcaaatgtaggatttcattcattattcattaaaacaaaatttaaaaatgcacttaccagttttagtaatcgtttatgtgttatttcaagtctgaccacatgagggcagcatrgtaccttttaagacaaagcatagcctaagtggaggggaaaaaaaatctagtattaaagctattaaaaatcatgggtacaaaattaaaactagaagtctccataatgatcttcttatccaaacttgaattttacaactgaaagaactgaggtctaaggaggacaattagcaagtccaatcacacaactgatatcttttgaaggtagagcaaagaaccattcaacagcattaatagtagcaataataattgcattattggagcacctagttactttaagagactttttattaagcactaata

SEQ ID NO: 103894 - DNA, 601 bp, Human
tgggctatggagtcacacaacttgagtttgatgatggccttaccattttatttattgtggtgtcttcgcccattccccaaaagtggtttaatttcttcatctgacaaattatagataaaaaaaacctatcttagaaaaatcaaatgagataagatatgtaaaatatttatggtgcctagcacatggtagtgctcattacaattaactaatattggtattcatgtttgtaatattatttctacatcaaaattttacatcactatgagtgagttaatgcttggcacttttgtaaatagatgawtcaaattgatttgagtattgactgtttgtgaattttaagctcaaatgtaggatttcattcattattcattaaaacaaaatttaaaaatgcacttaccagttttagtaatcgtttatgtgttatttcaagtctgaccacatgagggcagcatggtaccttttaagacaaagcatagcctaagtggaggggaaaaaaaatctagtattaaagctattaaaaatcatgggtacaaaattaaaactagaagtctccataatgatcttcttatccaaacttgaattttacaactgaaagaactga

SEQ ID NO: 103895 - DNA, 601 bp, Human
actggtactcatttgttatggctacatgttttatctctttattcatgccatgattaagagtgaatatagggctgggtgcggtggctcatgcctgtaatcctaacactttgagaggctgcggcgggtggatcacctgaggtcaggagtttgagaccagcctgaccaacgaggtgaatattaattattaaatgaatgagtatcgtacattattaaaaaacacgtgaacattctgtgagctaattctgtatcagacgttatgttaatgcagttttcacatatgttacctcatcacatttcaagytttctatgtgcatttccttgtgaatgtgtccaggaacgagctcttataaatataaaatggttgagtgggaagctagtgatgaaagagtttgggctatggagtcacacaacttgagtttgatgatggccttaccattttatttattgtggtgtcttcgcccattccccaaaagtggtttaatttcttcatctgacaaattatagataaaaaaaacctatcttagaaaaatcaaatgagataagatatgtaaaatatttatggtgcctagcacatggtagtgctcattacaattaactaata

SEQ ID NO: 103896 - DNA, 601 bp, Human
tgtcaaatgacataatatagtagatacaacacattcttgaattccaattaacacggattcttcttcttgtttgtttactggcttttgtgaccttaggaatgttagttatccttctttagcttctatttcattacctgtaaattggaaatgataatttctagttctggtggtgttctgaaggtcagagacaatgaatacagaatgcttggatcataggtgttcattcataatggcagttataattggcgataaagtttccttttgtggtaagatttaggatcaacattattagactttactytcttcattgataagtccttggacaaaaataattttatatttgaggatcatcgccctttcctgtctattctgcttcttaatgattttctttgctaacatcaacattgcattaataattatatcatattagaagtagctatcattaatactggaggaatatggcaattttttaatgactttacttgtttaggttttataaatacagtaattcctccctagccataatctctttttagatatctcgctgatccagaaaacttagagaatttttgtctaaggtgatgtttctaaggttggagat

SEQ ID NO: 103897 - DNA, 601 bp, Human
tgctctaagaaaataactccggtatctttaatgtgtcattaacactaatgcatgtcattaatgctaatgctccattctgctttaacagccctccatttccctcaagttagatggagactgcaagaattacacaccttttgacttctattgcctgagcaaaaatcacattatcccaaaggaaggatgcaagagaacgcaagactcacagggaagacatacacctagagaaaactgtctttagatggaattcatataaaataaggtgactcgtcctaattgtaaatcctgccttccaactaayaattatagaaaaccctgtagctcaggcagcatatgagaaagacagccaaagaggcagttagctctaaaaaaattttgtttcgggcatagtggtgcacacctctagttccagctactccggaggctgaggtggaagcaactcttgagcccaggagatcaaggctgcagaaagccaagattgcacccctgcactccagcctgggcaacagagtgagaccttgtcaaaaaaaaaaaaaaaaaaaaaagacaaattttgtttcattgctttgaagaactatttggtttaaatgatttttatttg

SEQ ID NO: 103898 - DNA, 601 bp, Human
gtggtaactccaccagccaactcctaacgacaaagtaaatagcataaatgaaaagccatgatgtatacctctttctccaaacagttaatggaacaaaaagccccaagaaacacctgaactcaagagcagtttctatggaaacctcaatccatttctattctgctgacatttgaataaatgtgagccgacgcgtgctttagctcagtcccattacacacactgtggagacagcgctaatgggtttatcttagaaccattattaactactcagagcaaaatcgcatcagttctcccctcatakacttaaactattccacagtcttaagtacttctgaaaaatctgggatcagtaggcaaaacaacacttttgacatgactactattttgtaggctccaaaaactcgctctcctactcatgtaaaaatgttaaagagccaaaatttgtcattttcatgctctaagaaaataactccggtatctttaatgtgtcattaacactaatgcatgtcattaatgctaatgctccattctgctttaacagccctccatttccctcaagttagatggagactgcaagaattacacaccttttgacttctat

SEQ ID NO: 103899 - DNA, 601 bp, Human
cagcctcccaggtagctgggattacaggcaagtgccaccacgcccagctaattttttgtatttttagtagagacgaagtttcaccatgttggcaaggctggtctcaaacaactgacctcaggtgatctgcccgcctcagcctcccaaagtgttaggattacaggtgtgagccaccgcacccagccttgtttttatttttacttgaaacacaacacattaatgtgtttattatgatttaccactgtgctaaacattttgcaaatattaaccttaattcccccttgcagaaggtagtattatsatcgtttctgttttatagatgagaaaacttaggcagagaaaagttaagtactaattgcatgagatattgcaaacctcatataatcagctagagattattaaataatttgaaacataaactgagaaaaatgctagggttaatctggggaaaatattggaatgaatactaattgtataagagattaggtatttagtgagtttttcacgatatgaagaattttgcatccccacaacctcatgattgcagggtttcagatatttaatacactgataagaaggaaccatgtctattactgctaat

SEQ ID NO: 103900 - DNA, 601 bp, Human
tcagatatccagggaaagagaagctaagacagaaagaactgtcaacacaaaggccttgagatggaagtttgcttggcacgttccagaaacataaaagacgtcagcatggatggagtaaaggaaaaaaaaaaggatgggggagagtagaatatgagataagtaagaagcgcacagattgtgaagaattttgggtcagttaaaagggagatcagaatcatctattaagtagtaaaacaaagtttttgaaaagtggcttgaaaagtgaaggtggcaagtatctgctaattcttagaataaacaytacaaattacatgtatatgtagagatgtgtttttttcatcaaatttgcaaaatagcacatggaacttccctcaactctgtattagatatctattgccatgtaaaatataaccctcaaacttagcatcttaaaaatacgaatttttcttatcttaaacagtttctgtggaccaggagggagcagcttatctgggtggttccagctcagagtgtctcatgaggacgcagacaagctgttgcatatggctgcaatcttctgaaggtttcccaagtttaaaggattcaatttcaagctcatgtg

SEQ ID NO: 103901 - DNA, 601 bp, Human
aaggagaagaaagtgagccacatggatattcagatatccagggaaagagaagctaagacagaaagaactgtcaacacaaaggccttgagatggaagtttgcttggcacgttccagaaacataaaagacgtcagcatggatggagtaaaggaaaaaaaaaaggatgggggagagtagaatatgagataagtaagaagcgcacagattgtgaagaattttgggtcagttaaaagggagatcagaatcatctattaagtagtaaaacaaagtttttgaaaagtggcttgaaaagtgaaggtggmaagtatctgctaattcttagaataaacactacaaattacatgtatatgtagagatgtgtttttttcatcaaatttgcaaaatagcacatggaacttccctcaactctgtattagatatctattgccatgtaaaatataaccctcaaacttagcatcttaaaaatacgaatttttcttatcttaaacagtttctgtggaccaggagggagcagcttatctgggtggttccagctcagagtgtctcatgaggacgcagacaagctgttgcatatggctgcaatcttctgaaggtttcccaag

SEQ ID NO: 103902 - DNA, 601 bp, Human
taaaattactacaggttgaggatcccttatccacaatgcctgggtctggaagtgtttcagatttcagattttttccccccagattttggaatatttgcatatacataatgagatctcttggggatgagacccaagtctaaacacaaaattcatttgtgtttcacttatgctactgactgaaggtaatcttactgactattttaggtaattttatgcataaaacaaggctttgaatgcattttgactatgacccaccacatgaagtcaggtgtgaaattttctaggtgtggcatgatgtcartactcaataagttttagattttggagtattttgggtgtttggattagagatgctcaacttgtacatgtgttaaaggacaataaatccagataaggagcatcatcagtgtgaggggtggtactgctattttaaataagctgttcaatactgtcctcactgatgaggagagttttgagcaaagatttgaaggagaagaaagtgagccacatggatattcagatatccagggaaagagaagctaagacagaaagaactgtcaacacaaaggccttgagatggaagtttgcttggcacgttcca

SEQ ID NO: 103903 - DNA, 601 bp, Human
aagtggataagtgactaaagggatgaaaatccccatccctatgggactgatatttcaattgatttacatcaacaaatattttattgagtacttcctaagtgtcaggcattgttctaggtcatcaggacacatcatggatggaagtgcataagtgactgaagagatgaaaagccccaccctgttgaagctggtatttcagtgagggggagagacgcaataaaattactacaggttgaggatcccttatccacaatgcctgggtctggaagtgtttcagatttcagattttttccccccagaktttggaatatttgcatatacataatgagatctcttggggatgagacccaagtctaaacacaaaattcatttgtgtttcacttatgctactgactgaaggtaatcttactgactattttaggtaattttatgcataaaacaaggctttgaatgcattttgactatgacccaccacatgaagtcaggtgtgaaattttctaggtgtggcatgatgtcagtactcaataagttttagattttggagtattttgggtgtttggattagagatgctcaacttgtacatgtgttaaaggacaataa

SEQ ID NO: 103904 - DNA, 601 bp, Human
atatcaagtaagtggataagtgactaaagggatgaaaatccccatccctatgggactgatatttcaattgatttacatcaacaaatattttattgagtacttcctaagtgtcaggcattgttctaggtcatcaggacacatcatggatggaagtgcataagtgactgaagagatgaaaagccccaccctgttgaagctggtatttcagtgagggggagagacgcaataaaattactacaggttgaggatcccttatccacaatgcctgggtctggaagtgtttcagatttcagattttttycccccagattttggaatatttgcatatacataatgagatctcttggggatgagacccaagtctaaacacaaaattcatttgtgtttcacttatgctactgactgaaggtaatcttactgactattttaggtaattttatgcataaaacaaggctttgaatgcattttgactatgacccaccacatgaagtcaggtgtgaaattttctaggtgtggcatgatgtcagtactcaataagttttagattttggagtattttgggtgtttggattagagatgctcaacttgtacatgtgttaaa

SEQ ID NO: 103905 - DNA, 601 bp, Human
gctgcctttttccttcttgccacaatccctaagttcaagacctagttctgaagtgatgtgggccaatacatagagtcatccattcagcagatgtttataaatacgtaacaaaattgtacagatgtgaaaagcatacacagtttttggatctattatggcagtttcaaaactcttgaagcctgtttctccgtttgcaaaggaagatagagccaagtacataatttgcagggttccgtgtaaactgaaaatgaagttcccttgttcataaattgtgaagaatttcaagacggcaacagcagarcattaacccaagccatgggccttctaagcacccacttctgcacaggtcacacactcatgaacctggctctaccgagcctttctattataatctattctgaacaaggcttccatgtctgtgaaattcatatcattacccttgtagatttttagaactaacatcagatttatgtctttagtttttacctaggtgcagtgagttacaatattctccaatgcaaacttcgtaataaaaataaaaataatgttccgagtattaagaggaaagacacaagagttttttatgtacgttcatgataag

SEQ ID NO: 103906 - DNA, 601 bp, Human
agctgcctttttccttcttgccacaatccctaagttcaagacctagttctgaagtgatgtgggccaatacatagagtcatccattcagcagatgtttataaatacgtaacaaaattgtacagatgtgaaaagcatacacagtttttggatctattatggcagtttcaaaactcttgaagcctgtttctccgtttgcaaaggaagatagagccaagtacataatttgcagggttccgtgtaaactgaaaatgaagttcccttgttcataaattgtgaagaatttcaagacggcaacagcagrgcattaacccaagccatgggccttctaagcacccacttctgcacaggtcacacactcatgaacctggctctaccgagcctttctattataatctattctgaacaaggcttccatgtctgtgaaattcatatcattacccttgtagatttttagaactaacatcagatttatgtctttagtttttacctaggtgcagtgagttacaatattctccaatgcaaacttcgtaataaaaataaaaataatgttccgagtattaagaggaaagacacaagagttttttatgtacgttcatgataa

SEQ ID NO: 103907 - DNA, 601 bp, Human
gtaagaggacttctggttttgaaagctagaactgaactcaagaataataaagtggagataacagtacacatctcggtttggacaaaacgtaagagtggacagaatcagggaaggctggccttcctaaacattggagctttccaggagagtcgggggaaaagagcacagctatgaaatcctgtgagaaattccaacaaacaccaggaaaaaagatacacttccttgagcaatattactcaactcagacttatgtttgattcagaatgaaagaattttcttttccaataaattaaatcatgayaatggcatctttcatgaatttaaaaatgtgttaaatagtatcagctatctagaacatagtgaggcgaacactaaatcggcatcccttgcagtttccttggtttcaggaaaatcattatttgtgctcagctaactggtcccttccagagttttcatgctagactcaaatctaagtatttattataaatattataaattataaattatattatatttcgtataataatatgaaaaggaaattaaatgcttctcttttcttcaactcagtctccgccaaggcaggaagaacttttaaggtggt

SEQ ID NO: 103908 - DNA, 601 bp, Human
gtggtgaggggcctgcgagcatgcatcaccacctgatctccaccttctgtcagatcggcagcagcattagattatcataggagcacaaaccctactgggaacggtgcatgtaagggatctagtttgcacagtccttatgtgaatctaatgcttgatgatctggggtggaacagcttcattctgaaatcatccgcatcctcctcaccccacccccacaccccagtccgtggaaaaattgtcttccatgaaaccaatccctggtgccaaaaagtttggggaccactgaggtagaaaataggtwttaaagctttcttggataaagcctatttggaggacctaattccagatttcaaggggctgattacggcaagcacatataagtggctcattagttaggatcacttgttataaagatgctatggccatctatttacacataaataaatattcctaaatatataaataatcttataataatataacctgtgtcattacggcaactggtcttaaggtaaagctttggaaattttatgtaaaatcacatgtactttggcatagatattattctaaagtgagtgtatcaagcaaattttattggatc

SEQ ID NO: 103909 - DNA, 601 bp, Human
ttaacgaccaggctgcacagcaggtggtgaggggcctgcgagcatgcatcaccacctgatctccaccttctgtcagatcggcagcagcattagattatcataggagcacaaaccctactgggaacggtgcatgtaagggatctagtttgcacagtccttatgtgaatctaatgcttgatgatctggggtggaacagcttcattctgaaatcatccgcatcctcctcaccccacccccacaccccagtccgtggaaaaattgtcttccatgaaaccaatccctggtgccaaaaagtttgggraccactgaggtagaaaataggttttaaagctttcttggataaagcctatttggaggacctaattccagatttcaaggggctgattacggcaagcacatataagtggctcattagttaggatcacttgttataaagatgctatggccatctatttacacataaataaatattcctaaatatataaataatcttataataatataacctgtgtcattacggcaactggtcttaaggtaaagctttggaaattttatgtaaaatcacatgtactttggcatagatattattctaaagtgagtg

SEQ ID NO: 103910 - DNA, 601 bp, Human
ttatataaggtagaacaggagtctcaaaaccctgggccatggaccagtactgttctgtggcctgttaacgaccaggctgcacagcaggtggtgaggggcctgcgagcatgcatcaccacctgatctccaccttctgtcagatcggcagcagcattagattatcataggagcacaaaccctactgggaacggtgcatgtaagggatctagtttgcacagtccttatgtgaatctaatgcttgatgatctggggtggaacagcttcattctgaaatcatccgcatcctcctcaccccaccccsacaccccagtccgtggaaaaattgtcttccatgaaaccaatccctggtgccaaaaagtttggggaccactgaggtagaaaataggttttaaagctttcttggataaagcctatttggaggacctaattccagatttcaaggggctgattacggcaagcacatataagtggctcattagttaggatcacttgttataaagatgctatggccatctatttacacataaataaatattcctaaatatataaataatcttataataatataacctgtgtcattacggcaactggtcttaaggta

SEQ ID NO: 103911 - DNA, 601 bp, Human
tctttatataaggtagaacaggagtctcaaaaccctgggccatggaccagtactgttctgtggcctgttaacgaccaggctgcacagcaggtggtgaggggcctgcgagcatgcatcaccacctgatctccaccttctgtcagatcggcagcagcattagattatcataggagcacaaaccctactgggaacggtgcatgtaagggatctagtttgcacagtccttatgtgaatctaatgcttgatgatctggggtggaacagcttcattctgaaatcatccgcatcctcctcaccccacscccacaccccagtccgtggaaaaattgtcttccatgaaaccaatccctggtgccaaaaagtttggggaccactgaggtagaaaataggttttaaagctttcttggataaagcctatttggaggacctaattccagatttcaaggggctgattacggcaagcacatataagtggctcattagttaggatcacttgttataaagatgctatggccatctatttacacataaataaatattcctaaatatataaataatcttataataatataacctgtgtcattacggcaactggtcttaag

SEQ ID NO: 103912 - DNA, 601 bp, Human
aaacataacgatattcattttttgtgtacatttcttacaggacagcacgcgtcttattctccactgtatccctcagaaaacccagaccagttctttagacacagtagaaattaaataaagtattggataaatgtatgggaagatgaataaattataacctatgattttaagtttatgatatatttccatttagtccatgtatgctttaagtgagattcatcagaaaaagtctgctgaacaaccttatctaacatcaaattcgtgttatcatctttatataaggtagaacaggagtctcaamaccctgggccatggaccagtactgttctgtggcctgttaacgaccaggctgcacagcaggtggtgaggggcctgcgagcatgcatcaccacctgatctccaccttctgtcagatcggcagcagcattagattatcataggagcacaaaccctactgggaacggtgcatgtaagggatctagtttgcacagtccttatgtgaatctaatgcttgatgatctggggtggaacagcttcattctgaaatcatccgcatcctcctcaccccacccccacaccccagtccgtggaaaaattgtct

SEQ ID NO: 103913 - DNA, 601 bp, Human
atacatacttttgtgaactacttgggagaatctatttctccagtgtataagtctttacattctttttatttacaggaaaatgtttatttacaggatacaatgcttaaacataacgatattcattttttgtgtacatttcttacaggacagcacgcgtcttattctccactgtatccctcagaaaacccagaccagttctttagacacagtagaaattaaataaagtattggataaatgtatgggaagatgaataaattataacctatgattttaagtttatgatatatttccatttagtcmatgtatgctttaagtgagattcatcagaaaaagtctgctgaacaaccttatctaacatcaaattcgtgttatcatctttatataaggtagaacaggagtctcaaaaccctgggccatggaccagtactgttctgtggcctgttaacgaccaggctgcacagcaggtggtgaggggcctgcgagcatgcatcaccacctgatctccaccttctgtcagatcggcagcagcattagattatcataggagcacaaaccctactgggaacggtgcatgtaagggatctagtttgcacagtcctt

SEQ ID NO: 103914 - DNA, 601 bp, Human
ctacccacttgttttgattttgcaaaaccattaataacattaaaagtacttccttggaggcttctgaacacagcataataataattattattattattttgaggcggattctcgctctgtcgcccaggcgagtgcagtggcgtgatctcagctcactgcaagctccgcctcccgggttcaccccattctcctgcctcagcctcccgagtagctgggactacgggcacccgccacaatgcctggctaattttttttgtattttttttagtagagatgaggtttcaccgtgttagccaggatrgtctcaatctcctgacctcgtgatctgcccgcctcagcctctcagagtgctgggatcacaggcatgagccactgcgcctggcctctttttaactttgcaacaatttgaaatgtcttaccattgctgtgcaatttttggctatataatcaacctctctgagctttatttccatcaacaaatggagtaatactgatctggaagaatgtaaggatgaaataaaataataattggaaaacacttattacagagactggcaaaataaatgctcagttaaaatactctcatcctctatcttccttt

SEQ ID NO: 103915 - DNA, 601 bp, Human
aacagcaaaatactctaaaccactaagtgctctgcttcgtcctctccctaccactaatctctacccacttgttttgattttgcaaaaccattaataacattaaaagtacttccttggaggcttctgaacacagcataataataattattattattattttgaggcggattctcgctctgtcgcccaggcgagtgcagtggcgtgatctcagctcactgcaagctccgcctcccgggttcaccccattctcctgcctcagcctcccgagtagctgggactacgggcacccgccacaatgccyggctaattttttttgtattttttttagtagagatgaggtttcaccgtgttagccaggatggtctcaatctcctgacctcgtgatctgcccgcctcagcctctcagagtgctgggatcacaggcatgagccactgcgcctggcctctttttaactttgcaacaatttgaaatgtcttaccattgctgtgcaatttttggctatataatcaacctctctgagctttatttccatcaacaaatggagtaatactgatctggaagaatgtaaggatgaaataaaataataattggaaaacactt

SEQ ID NO: 103916 - DNA, 601 bp, Human
tccacttgttcaaccaggagccaacttctaaaagaattccatttgctattctggtgtaatgactcctgtcatttcacagctctccatagcccatgtcagggctactcaatctttatacaaattgttgacttcctgccaacagcaaaatactctaaaccactaagtgctctgcttcgtcctctccctaccactaatctctacccacttgttttgattttgcaaaaccattaataacattaaaagtacttccttggaggcttctgaacacagcataataataattattattattattttgagrcggattctcgctctgtcgcccaggcgagtgcagtggcgtgatctcagctcactgcaagctccgcctcccgggttcaccccattctcctgcctcagcctcccgagtagctgggactacgggcacccgccacaatgcctggctaattttttttgtattttttttagtagagatgaggtttcaccgtgttagccaggatggtctcaatctcctgacctcgtgatctgcccgcctcagcctctcagagtgctgggatcacaggcatgagccactgcgcctggcctctttttaactttgcaacaa

SEQ ID NO: 103917 - DNA, 601 bp, Human
aaaccagaaaaatgtatctaaataaaatagaactacataccagtatccctcataaatacgctgtagacacaaaatccttaacaaaatagcaaatcaaatctaacaatatatgttaaggacaatatattgtgaccaagtgaagtttatttagaaatgctaggttggtttaaaatttcaaaatcaatcatcagtacgatacaccatattaacagaacaaaaaaggaatataccacacacacaccacaccacaccaaatgcgcacacacacacatacgcacgcacatgaggtatagactggtaygccctttcaagatccttaaaattacacaaattgtttaattaagaaaatctaattctaggaatggattttagactcttgagtgtaggcaatgctgtacgtgtgggttctacacgtgtgtctgggaggggaggcagtagttgagccacatactctatttagttggagagctaatgcaagtttatctcactagatcatttgtgacatctacgagagaaacaatatattgccactcaagttggcaaatgccagatgaaacaaacttatacatcgttggcagggagttcccatgtacttctctta

SEQ ID NO: 103918 - DNA, 601 bp, Human
aaataagaccagtgttaccctgattctaaaccagaaaaatgtatctaaataaaatagaactacataccagtatccctcataaatacgctgtagacacaaaatccttaacaaaatagcaaatcaaatctaacaatatatgttaaggacaatatattgtgaccaagtgaagtttatttagaaatgctaggttggtttaaaatttcaaaatcaatcatcagtacgatacaccatattaacagaacaaaaaaggaatataccacacacacaccacaccacaccaaatgcgcacacacacacataygcacgcacatgaggtatagactggtacgccctttcaagatccttaaaattacacaaattgtttaattaagaaaatctaattctaggaatggattttagactcttgagtgtaggcaatgctgtacgtgtgggttctacacgtgtgtctgggaggggaggcagtagttgagccacatactctatttagttggagagctaatgcaagtttatctcactagatcatttgtgacatctacgagagaaacaatatattgccactcaagttggcaaatgccagatgaaacaaacttatacatcgttg

SEQ ID NO: 103919 - DNA, 601 bp, Human
aatttaccaatattaggaatgaaagaagagccatgattacagatgcttcaggcattagaagaataatattttgacaactttatgacaataaattggcaaactgtacaaaatggacaaactttttgcaaggcacagattgccaaagatgaaaggagaaatagaaaacttgagcagccttttatcagctaaaggcattaaatttgtaagtgaaaactgactcacaaagaaaacttcaggcccaggtggctttttggtgaactttatacaatgaagaaagaagtaataccaatattatcctttragaaaatcaagaagaagggaatacgctgcaacttaaataagaccagtgttaccctgattctaaaccagaaaaatgtatctaaataaaatagaactacataccagtatccctcataaatacgctgtagacacaaaatccttaacaaaatagcaaatcaaatctaacaatatatgttaaggacaatatattgtgaccaagtgaagtttatttagaaatgctaggttggtttaaaatttcaaaatcaatcatcagtacgatacaccatattaacagaacaaaaaaggaatataccacacacac

SEQ ID NO: 103920 - DNA, 601 bp, Human
acctggacctctccctattagttcacaggaattgctcctgtgattgattaaaaaaaaaaaaaaaaaaaagcctgggagcagtggctcacacctgtcatcccagcactttgggaggccgaggtcggtggatcatctgaggtcaggagttcgagaccagcctcgccaacatggtgaaagcctgtctctactaaaaatacaaaaattagccgggcgtggtggtgggcgcctataatcccagctactcagggggctgaggcaggagaatcgcttgaacctggaaggcggaggttgcagtgagccsagatcacagcactgcactccagcctggacgacagagcgagcctccaactcaaaaaaataaataaataaataaaaaataagaaaagaatgagaagacatgaataaccaatttaccaatattaggaatgaaagaagagccatgattacagatgcttcaggcattagaagaataatattttgacaactttatgacaataaattggcaaactgtacaaaatggacaaactttttgcaaggcacagattgccaaagatgaaaggagaaatagaaaacttgagcagccttttatcagctaaaggca

SEQ ID NO: 103921 - DNA, 601 bp, Human
agggaagccacagttcttacgggctgcacctagctcatgacttagtgctaaggcttgctatttgggagacaaatgggactcccctgacagctggtttttgattaatgactccctgatggccttgccaaaccaaactttccttggactgtgagacagcatgggactcttccccagtcttccttccttttttccttcactcagggtcagaattacattgcaatcagatagctctacctggacctctccctattagttcacaggaattgctcctgtgattgattaaaaaaaaaaaaaaaaaaaagcctgggagcagtggctcacacctgtcatcccagcactttgggaggccgaggtcggtggatcatctgaggtcaggagttcgagaccagcctcgccaacatggtgaaagcctgtctctactaaaaatacaaaaattagccgggcgtggtggtgggcgcctataatcccagctactcagggggctgaggcaggagaatcgcttgaacctggaaggcggaggttgcagtgagccgagatcacagcactgcactccagcctggacgacagagcgagcctccaactcaaaaaaataaataaataa

SEQ ID NO: 103922 - DNA, 601 bp, Human
tcttcacctttgtgtttcccggaactaagtaatgaagcatgaaaaacagactgggtaaataaattaataaatcaatctgattctattaaagctttatagatatctctatctcatgtagggtacaaaggctctgtgacagatgcaattctggaaatatttgaagaagatagcctggtttctctatctggaggggaaatgtgaccattatttactgatttctcaactttgaattttgtgacaatttatcttaagcttatcttttatatataaacatgcttcaatttcgtaatactaaccaatyacatagaataaataaaatttcagggggctatcatttggtacctttccaaccctagcgcttctacatatttgtctatgtacttatgtgtttattgtgtgtctgtatcaaaaacctataagcaaaatgatgactgcttatatgtcttattccttatggtgagacactcacttagcacatggctgacacacaatagatccttgataagtgtttgttgttgaataaatagataagtgacattttccatatcatgcccttaataactttaagctgtttatttttaagtaaattattgctggaagt

SEQ ID NO: 103923 - DNA, 601 bp, Human
atgtcagttttccaaagtaaactgtgtataactaacttggagaaatttttcaattataaagttaaagcttgatttccttcagactacaatgtaaagttgtataagatatccataggagattcataaatattttctattagaattattatctaattgcagacattttttgaggctgagaaaagtgtattttattcatttataattccccatcaccaggtttgttgcaagcattccatatacagctgttaaagtattgacatagtgggaaaaaagaaatagactgcaaataaacactagatamtagaagcaaattgtcacctttagacattcactcatgtggttaaacaattatgaatatggaatatgtcctcttcacctttgtgtttcccggaactaagtaatgaagcatgaaaaacagactgggtaaataaattaataaatcaatctgattctattaaagctttatagatatctctatctcatgtagggtacaaaggctctgtgacagatgcaattctggaaatatttgaagaagatagcctggtttctctatctggaggggaaatgtgaccattatttactgatttctcaactttgaatt

SEQ ID NO: 103924 - DNA, 601 bp, Human
tgccaactcccatgtcctcagcacactttgagtctcttttcaaggtaaattgctatatttattgcagtacttacatatttcttaatcagtaaacatgtgtaaaactgtgctactgtgtctattagttttctgtcttttaaaacatatgtcattgactaagctcgtaggtagtgtaacctaacctcatttctcccataatccctgtcatgctactgctcaattctgcataggtggtgattttctggaatgtatgcgtcacgttatggctgaactgactactaactatacttttaaggcccayagattcaaaggtatatgatcctgtgaagacgggggcagattttctgacagagcttgcaagatgaggcttgagaacccaggagattcggccacactgttggtaaatgtatccattttcattttactttttcactttttttttcttgaaccatttaagcctttagtgctcatgtttaccttctccagcctctcatctgctattgtacagaaagcttggtatctgtgatacagctactgggaagtatccctgagctgttattacagctactgggaagtatccctgagttattgtgttggtggc

SEQ ID NO: 103925 - DNA, 601 bp, Human
ccctcttcaatacactgtggacaatttttgaaaggattagatttatgtctaattgacatgttattacaaatccaataataaagcaaatgatttggtggtaaaacttaatgtacaaaaataaatatagactctgagaagcaaaaatcattctaactacacattgactgcgaaacagctggcaccaaaacactttccataaaagggaaggctgaatgatctgttgaggtttccactgcagacaaactgagactatcccctctggttaggggtttgactttgcctgtttggcaggcattccctwtgccaacagttgggagtgtagacgggtagggaaggtcagcaaagtatgcacacacccctcaaacgtctgccagctaggtgggttcactacatgcattataggtcatacccacccacatctgctcttaccactttccttcctagttcaaaggcacctccttccaccacttcagaataactcacaagctgctgccctgccaactcccatgtcctcagcacactttgagtctcttttcaaggtaaattgctatatttattgcagtacttacatatttcttaatcagtaaacatgtgtaaaact

SEQ ID NO: 103926 - DNA, 601 bp, Human
tgaccaacatggtgaaaccccgtttctactaaaaatacaaaaattagccaggcatggtggtgcgcacctgtaatcccagctactaaggaggctgaggcaggagaatctcttgaacctgggaggtggaggttgcagtgagccgagatcgcatcactgcactccagcctgggtgacagagtgagactccgtctcaaaaaaaaaaaagagaaaaggtaacaggctgctgacatcacccctatagccagctttagtcaagccacaagggcagttcctgcttaaaaaaaaaaaaagtctctcatayattcctttaattaaagatctctaattaaaagttccctcttcaatacactgtggacaatttttgaaaggattagatttatgtctaattgacatgttattacaaatccaataataaagcaaatgatttggtggtaaaacttaatgtacaaaaataaatatagactctgagaagcaaaaatcattctaactacacattgactgcgaaacagctggcaccaaaacactttccataaaagggaaggctgaatgatctgttgaggtttccactgcagacaaactgagactatcccctctggttagg

SEQ ID NO: 103927 - DNA, 601 bp, Human
ttgacaaaggtgaacacagggcagctcatgcctgtaatcccagcactttgggaggccaaggcaggcggatcatgaggtcaggagttcaagaccagcctgaccaacatggtgaaaccccgtttctactaaaaatacaaaaattagccaggcatggtggtgcgcacctgtaatcccagctactaaggaggctgaggcaggagaatctcttgaacctgggaggtggaggttgcagtgagccgagatcgcatcactgcactccagcctgggtgacagagtgagactccgtctcaaaaaaaaaaaagagaaaaggtaacaggctgctgacatcacccctatagccagctttagtcaagccacaagggcagttcctgcttaaaaaaaaaaaaagtctctcatacattcctttaattaaagatctctaattaaaagttccctcttcaatacactgtggacaatttttgaaaggattagatttatgtctaattgacatgttattacaaatccaataataaagcaaatgatttggtggtaaaacttaatgtacaaaaataaatatagactctgagaagcaaaaatcattctaactacacattgactgcga

SEQ ID NO: 103928 - DNA, 601 bp, Human
gcttttacttaacaaactagaacaaaagaataaaagaactagtcctgaaagaaagagaggagacagagggaatgaaattagggatcgtaggatcacgtaaaaggaagaaggatccacagaaaaggcagaagagagtaggatttgagactggatgaaactaacataactggagggccatgtgtggcagagttagaccaaaaaaaaaaaaggaatgacaattggatatctttgcagagttaagttttgagcaactttatggctttaagtgcttttttaaaggttatatctctatctctagtgyctatggcatagtaaaaacactcactaagtgaccatacagcagggtctccaaactttgacaaaggtgaacacagggcagctcatgcctgtaatcccagcactttgggaggccaaggcaggcggatcatgaggtcaggagttcaagaccagcctgaccaacatggtgaaaccccgtttctactaaaaatacaaaaattagccaggcatggtggtgcgcacctgtaatcccagctactaaggaggctgaggcaggagaatctcttgaacctgggaggtggaggttgcagtgagccgagatcgc

SEQ ID NO: 103929 - DNA, 601 bp, Human
ccccaccacgctgaaggcccagcatcctccacactgtttaaaaacagaaaaaggggtggtatttccagggtttaaatcaacttaccaacatctctaaatgtaacaagttatcaaatcaagtaaggcttccagattctggaaacctacaaaataaatacgcctatcctctagatttttaaactgaaaaaaagagaaaaccaaaagtctcttttgagcatcatttaattattagttcatgttgtcagcattattactattctaaatttggcaatgcaagataaaagtgaatttttagagaccraggaaatacttgggctaactgatgatcttctaaaagaccattcagttcactgaatatgtgacttctctttgtaagtggcttttcttctggagagtgtgtgccgactcccgccccaaccttccatcccccttgcttttttaaggacactctgcttccatggtcatacaccacttccatcctaagggtgaggaggggaaagatgcatgttgtgctaattatttgatggagataagagaattaataaatattaatgaattactctttaggctataaagatgcccgattaagtatgcttatagt

SEQ ID NO: 103930 - DNA, 601 bp, Human
tatagggcatactttctgattttagaaagcacattacctttatccccaaatgagatgttgaccacggtactcagtgaccctgcacattttattataaatcctacatggtctgccagctgtggaattaaggctgtctggtgtatggttcctggtgtcaccctgaggacccttgttgcagaccagagctgtgttgacaacctgacagttctctggcacacttatgctcatttaaacgggtacattttgttcaaggacgcaatttcacccttgatttctttcagatcccatgggtagataccatctggatcaagggattattttatattcaggaccactaagtcataggggattctgttaccttatccaaatttaatttagttcctgttttctctgtttcaaaagactgcaaagttcccatcatatattttcttaatgaagccaggagttggttgggtctccctttgtccttttcacccatgaacacctattttgcactctatcaaatggtcatgatgagtctccagccagctctgtgtttttcatgtgtttttaaagcatttttaatgattgttttccccaaaactatccaaagttatcctgc

SEQ ID NO: 103931 - DNA, 601 bp, Human
tttttttttcaatttcctaccatgataagggattcccttaatcccttttaatgatattttgtaaatctagttttttcttgtacacatccttcccttatactctcaaggaagtcagagtttatagggcatactttctgattttagaaagcacattacctttatccccaaatgagatgttgaccacggtactcagtgaccctgcacattttattataaatcctacatggtctgccagctgtggaattaaggctgtctggtgtatggttcctggtgtcaccctgaggacccttgttgcagaccrgagctgtgttgacaacctgacagttctctggcacacttatgctcatttaaacgggtacattttgttcaaggacgcaatttcacccttgatttctttcagatcccatgggtagataccatctggatcaagggattattttatattcaggaccactaagtcataggggattctgttaccttatccaaatttaatttagttcctgttttctctgtttcaaaagactgcaaagttcccatcatatattttcttaatgaagccaggagttggttgggtctccctttgtccttttcacccatgaac

SEQ ID NO: 103932 - DNA, 601 bp, Human
caatgccaacaactcctgcattctctctttcccttaattcagactaatgcctattattcttttgcttcttcttaatttttttttcaatttcctaccatgataagggattcccttaatcccttttaatgatattttgtaaatctagttttttcttgtacacatccttcccttatactctcaaggaagtcagagtttatagggcatactttctgattttagaaagcacattacctttatccccaaatgagatgttgaccacggtactcagtgaccctgcacattttattataaatcctacatrgtctgccagctgtggaattaaggctgtctggtgtatggttcctggtgtcaccctgaggacccttgttgcagaccagagctgtgttgacaacctgacagttctctggcacacttatgctcatttaaacgggtacattttgttcaaggacgcaatttcacccttgatttctttcagatcccatgggtagataccatctggatcaagggattattttatattcaggaccactaagtcataggggattctgttaccttatccaaatttaatttagttcctgttttctctgtttcaaaagactgc

SEQ ID NO: 103933 - DNA, 601 bp, Human
atttgttctctttgttaattattacagccaacatgccacatgtatttttattttttgtgactgtctgtctcaattactaatgagggcaaggtttttgtctgttttgttctctgccaaatccccagaacttaaaaaaaagtcagtaaatatttgaatgaataaataaatcaaagaaagatcttcttgcagtcaaatgctatcagtttagcattgcactgttagagtttaatcttcaatataaacaagagattttgattgggacctcttccttcctaatcaaaggcccaatgccaacaactcytgcattctctctttcccttaattcagactaatgcctattattcttttgcttcttcttaatttttttttcaatttcctaccatgataagggattcccttaatcccttttaatgatattttgtaaatctagttttttcttgtacacatccttcccttatactctcaaggaagtcagagtttatagggcatactttctgattttagaaagcacattacctttatccccaaatgagatgttgaccacggtactcagtgaccctgcacattttattataaatcctacatggtctgccagctgtgg

SEQ ID NO: 103934 - DNA, 601 bp, Human
tgttttcatttgttctctttgttaattattacagccaacatgccacatgtatttttattttttgtgactgtctgtctcaattactaatgagggcaaggtttttgtctgttttgttctctgccaaatccccagaacttaaaaaaaagtcagtaaatatttgaatgaataaataaatcaaagaaagatcttcttgcagtcaaatgctatcagtttagcattgcactgttagagtttaatcttcaatataaacaagagattttgattgggacctcttccttcctaatcaaaggcccaatgccarcaactcctgcattctctctttcccttaattcagactaatgcctattattcttttgcttcttcttaatttttttttcaatttcctaccatgataagggattcccttaatcccttttaatgatattttgtaaatctagttttttcttgtacacatccttcccttatactctcaaggaagtcagagtttatagggcatactttctgattttagaaagcacattacctttatccccaaatgagatgttgaccacggtactcagtgaccctgcacattttattataaatcctacatggtctgcca

SEQ ID NO: 103935 - DNA, 601 bp, Human
taagtagcaaggagcctaatgttaatccccaacaccatggggaaaatgtcttcaggttatgtcagacaccttcacggcagcccctcccatcacaggctcggaggcccagaaggaaaaagtggttttgtgggataggcccagggtccttgtgctgtgtgcagcctagggacttagtgccctgtgtctcagatgctccagccatggctcaaaggggccaacatagagctcaggctgtggccttggcagcttccatttggggttgagcctgcgggtacatagaagacaagaattgagattgggraacctccacctagatttcagaagatgtatggagatgcctggatgcccaggcaaaagtttgctgcaggagcagggccctcatggaaaacctctgctagcgcagtgcagaagaaaaatgtggggttggaggctccacacagagtcccacaggagctgcgagaagagggccactgtcctccagaccccagaatggtagatccactgacagcttgcactatgcacctggaaaagccacagacactcaatgccagaccgtgaaagcagccaggagggaggctgtaccctgcaaagcacagaggca

SEQ ID NO: 103936 - DNA, 601 bp, Human
agagagatgatttagggtatctggcggaagaaatttctaagcagcaaagcattcaaaaggtgacttgggtgctgttaaaagcattccattttaaaagggaaaacagagcataaaagttcagaaaatttgcagcctgatgatgcagtagaaaagaaaaacccattttttgaggagacattgaagccagctgcagaaatttgcgtaagtagcaaggagcctaatgttaatccccaacaccatggggaaaatgtcttcaggttatgtcagacaccttcacggcagcccctcccatcacaggctyggaggcccagaaggaaaaagtggttttgtgggataggcccagggtccttgtgctgtgtgcagcctagggacttagtgccctgtgtctcagatgctccagccatggctcaaaggggccaacatagagctcaggctgtggccttggcagcttccatttggggttgagcctgcgggtacatagaagacaagaattgagattggggaacctccacctagatttcagaagatgtatggagatgcctggatgcccaggcaaaagtttgctgcaggagcagggccctcatggaaaacctctgctagc

SEQ ID NO: 103937 - DNA, 601 bp, Human
gactggcagcattttgccactgccctagagatttgtggaactttgaacttgagagagatgatttagggtatctggcggaagaaatttctaagcagcaaagcattcaaaaggtgacttgggtgctgttaaaagcattccattttaaaagggaaaacagagcataaaagttcagaaaatttgcagcctgatgatgcagtagaaaagaaaaacccattttttgaggagacattgaagccagctgcagaaatttgcgtaagtagcaaggagcctaatgttaatccccaacaccatggggaaaatrtcttcaggttatgtcagacaccttcacggcagcccctcccatcacaggctcggaggcccagaaggaaaaagtggttttgtgggataggcccagggtccttgtgctgtgtgcagcctagggacttagtgccctgtgtctcagatgctccagccatggctcaaaggggccaacatagagctcaggctgtggccttggcagcttccatttggggttgagcctgcgggtacatagaagacaagaattgagattggggaacctccacctagatttcagaagatgtatggagatgcctggatgccc

SEQ ID NO: 103938 - DNA, 601 bp, Human
cttgtgggaaatggagcaaaggtgactcttgttatgttttagcaaccagactggcagcattttgccactgccctagagatttgtggaactttgaacttgagagagatgatttagggtatctggcggaagaaatttctaagcagcaaagcattcaaaaggtgacttgggtgctgttaaaagcattccattttaaaagggaaaacagagcataaaagttcagaaaatttgcagcctgatgatgcagtagaaaagaaaaacccattttttgaggagacattgaagccagctgcagaaatttgcrtaagtagcaaggagcctaatgttaatccccaacaccatggggaaaatgtcttcaggttatgtcagacaccttcacggcagcccctcccatcacaggctcggaggcccagaaggaaaaagtggttttgtgggataggcccagggtccttgtgctgtgtgcagcctagggacttagtgccctgtgtctcagatgctccagccatggctcaaaggggccaacatagagctcaggctgtggccttggcagcttccatttggggttgagcctgcgggtacatagaagacaagaattgagattggg

SEQ ID NO: 103939 - DNA, 601 bp, Human
gattaataatttccaaaacctacagttttggaaataataattcgttattattataacgaattattattataattattattaatcattgattaatgaattataattattattcattattattataatgaatggaataataataatagttcaaataattttcctaaattttattgtcatcaagatgcggcgatgaaggcaagtctgacctgttactgacgcttcataatgtggattttcatctcatcttccctagaattcagtgtgttatactgtgtctgaatttttctgactactgttatakgtagtaggttcctacagtttttgtttatttacatagtcattctcatattctagtttgagtcctgaaatttctggggtctgataaacaaaaattcatgaagaaccctgggtgggaatggtcattttgctttaaaattaggttatgtttttatattttagattatttttttcccttcttagatgctttcaggttctgtacaatgttttaaggagcgtttggctgaaaacctaagaccacatgacgttaccaatagtgttgggagtaaaagcacaagctttggagttgaacagatatgagttc

SEQ ID NO: 103940 - DNA, 601 bp, Human
gctgggatagggtttcaggatatcaggaacccaagctctttctctatcattgtcctgctattcaaaggtttccattttcagggtccattcatggtccaagatggttgctgggactccagccatttaacacatatttaagacagcaggaagtagaaagcagaagtgatacatctctgttgagaagacttcccagaaataacccgcaacacttccacatatatcttcacggatctcattggccagaactcagtcatatggctaagtctagcttaaaggaagatggggaatgagttctgtagcyggctggaaaattagttaagacatagggcttcttttattaaggaaagtggaaagactagatatttggcgataccttgccatctctgccacaccatgagaatcaagagactaactcatgttagtcattgtcaaatatagaaattatagggaagggctactcaaaagtggctaatataattatacaatagaagcaatgttaagcaaatattttaaaaagagaagaaatgttaggatgcccggagaactaggtgttcaactgtgaagactgcaaaatacacaattattgttttcacacatggac

SEQ ID NO: 103941 - DNA, 601 bp, Human
gagtctgtagtcccagctactcaggaggctgaggcaggagaagagtgtgaacccgggaggcggagcttgcagtgagccgagatcatgccactgcactccagcctgggagacagagcgagactctatctcaaaaaaaaaaaagttgtcactcaataaaaaagcatgtttggtatttgcctaagcctctcaattctagtgggtgttttgctagaattttgtaggtggcaaggggcatattaaatcacaaacaatactaatgcttagttttcgtatattttaaaacaaagaaaaactcttgatmatcattgagcagatattataatacagaaattaagaaaaatttatagttatgaaatgtaaatttggaacaagaagacatttctgcaggagtccagtctcctaagctgtgtgtttatctcatttttaaagcaattaaccttggtaaattattactttatcttatgttttgagatatatatgtaatatatattttttactaaggtccctcttcctttttcaaatactaatatgtttaacagttcctcttgcaaaacactttttttttttatcatttggttaaaggacaaaaattattactgct

SEQ ID NO: 103942 - DNA, 601 bp, Human
cagaaataattttcttgtattgattcatttaatatggttgtgcttatattcaatcagaaggtcaactcctttgctctaaggttcttacactgctaacaagaaatggcttttttcctgttgcaggtcatgagcagcacacagtgtcctttctaggcacataggatcatcgatcactgtgtggacgcaggctaatcagaattgcacctgaaatcacttgtgcaattagtgatgcaagagtgatcacaggaatcaagactgggagccaagagaaagaacaagaggtgcacaaagaagcagttcrgatgggagaccaggaaagctgaggggaaaactgggaaacagattctggaaaactcacagtttgtttgatacccagggttaagagatgggactttgataggagtggtgcttatgaattaagggaggaagaaagaggtgagatcctaatgttggtaaaggtacagagacaaagggagccaaccaagtggtaagaaaatagaaatggaaagtaaaaatgagacttaattctttagtcagggaagccaagccaccaggaaaacttggtaagagtaagagaaagagggagaaaatatgagataat

SEQ ID NO: 103943 - DNA, 601 bp, Human
cttacctccattgtggagtagtagactgatttcgtcttcatagtccaggtcaatcaccctggccaatactgtaactcccttcttagcctgttgcattagtctgctgttatgctgctaataaagacatacctgagactgggtaagtcataaaggaaagaggtttaatggactcacagttccacatggttgtggaggcttcacaatcatggtggaaagcaaaggagaagcaaagtcatgtcttacatggtggcaggcaagagtgcttgtgcaggggaactcccatttataaaaccatcagatmttgtgagacttattcactaccatgagaacagtatgggagaaaccaccctcatgattcaattatctccacctggccctgcccttgacatgtggggattattacaattcaaggtgagatttgggttaagagacagctaaaccatatcatagctaaaccatatcatagactatatggttatatttagttctttacacctatatttcttggtgtgactaagctagaagttgcaagagttttatcaaaggatatatcagtcattcttcatgtaaatatcaaaataatttagactgcaagttccca

SEQ ID NO: 103944 - DNA, 601 bp, Human
tggaggccagaagactcagcaggtctgttctctccatgcctcctttcacactggcagctgattagacagggcccacccaggctgagggtgggtctgcctctcccagtccactgactcaaatgttaatctcctttggaaacaccctcacaaacacatccaggaacaatactttgcatccttcaatccaatcaagttggcactcaatattaaccatcacaactttgtcaacttgaacccatccacatctcctgaaatcacacataatcttcaactgaagccaataataaggtcataattacayctaacacaatacagctatcctttgtacaactggaagtgcaccaatccccaatccaaatgctattacctaaagttaacacttaaatgctgatatgaagtcaacaaatcttacatcacatgataaaggaaaaataaaggaaataaaatgaatatattttcttagtacaagtatatatatgtgcaaacatgttctcaacaaaataaagaggaaatactcatgacaattacagtcctcatttctgcaactggtcacatggctgaagctgctattgatgactaccttattccactacccccattc

SEQ ID NO: 103945 - DNA, 601 bp, Human
taacagtgcttacatccaggcagaaaagtcttcaactcattgtggctcaagttttgaccagactaaaacatttatcattaattctactaatgtcttcctggctagataaatgacacagttaaagtagcgtcttgttttctgatatgactattttatattataaaactatttccatctactccagagagtgccccttttaaagtgtttacaaggaaagagatcaacatttattgaggacttaaaatatgctagagaggtttctaagggatgtacattcttattttgatattcacaatatcayagataaatggacaaatggatacatcgggaaactgaaaaacttctgtggtcccttgaaaaagaagaatcaattcaagaataaattagacatttgcatttagccccacctcaaatctttacagcacattgctttcgtccctactgttattaccagattggttggtttctgaaatacacaggtttaaattttcatcatttttagacattttcactgtccctggaaatgaattctgtaagcacaaaacagttgataactgcctataccaaatgagcacacacatcagtgggtggtgggaataat

SEQ ID NO: 103946 - DNA, 601 bp, Human
gctaccaagactggaagaaagcgcgggtagttgaaccgtgatggtggggaggtggtcttggggggacccctgccgtggggaatgcaggaatggacgcggcaaaaggagggaagagaacttcaggtgcggagtgaaaacgggagttaacggttttgggaaactccagggggatgaaagtggaatggatgttctttagtctttagaagacccgtaacgaatgcccagctgggcacttgttgtttgcgtaagcaccagacctcgcgtttagtaaacaaaggtgagacgggaatagcgtcgtccrgttgtttcaggaagcagagtctatgctgcttttgtattttttccttagccactgtggtgcagaacctcatcttcagatacttacaaaatgtacgtaagttgcttgtttcgtaactactttttaaataagaggtgaactgatttagttttttgtgttaacctgagcgatcgctgtgttctagaatttaaaaatagatgtaactggagattggagggtaattgaggggaaggagtacttagaaagcactaatgtgatgaagtggtgtgtatccatgccacttcccaacatgcaaagaattgt

SEQ ID NO: 103947 - DNA, 601 bp, Human
caaaatggttaggttttgtatacttcaattttttggggggcggggggcggggagatcttgcttaatgttgcgcaggcttatattgaacacctggccacaaagcgaattattccgctttggcatcccaaagtatgggaacggtgtgaatcgaggcacctggcctgtttttcttttcttttttttgagacggagtctcactgtgcccaggctggagtgcagtggcgcgatctcagctcactgcaacctctgcctcccgggttcaagcgattctcctgcttcagcgtcccgagtagctgggacwacaggcgtgcgccaccacgcccagctaattttttttgtatttttagtagagatggggtttcaccatgttaacgaggatggtctctatctcttgaccttgtgatccacctccctcggcctccgaaagtgctgggattacaggcgtgagccaccgcgcccggccctatttttctttttttaacgtttccacttttatgattatttcagagatcgcggattcaggtgtggctctatgagcaagtgaatatgcggatagaaggctgtatcattgtgagtatccaggcgatttcatctcatagca

SEQ ID NO: 103948 - DNA, 601 bp, Human
aaatattttattcacttgcagaattcagtgacctgcaactcagttcatgtttgaatttattttgcatttgagaagttattattcagagtagtagtacacttttgaaatcatcctctactactcactcctcaccacactccattttggcttctccacccagagagctctcaccaagggaaccaaagactagtggtattaaatctaatgatcagtactaatcctcattttattaaactctcaacagcatttggcactgttggctgctccctccttaaagcgctttgttcccgtgtctgagtgrcaggaaaaacccaagtagatttttctgtttcctcagttgacaataattaacacagaagacttctgtgaccagatgtatgggcatatttccccacacaccaagcaagcaatcagttcggcagtggacatcagctcggagtcgtcaagttcagttcagttctaacactatctacctgagatagcgtcagttcccagaggttgagggctcaatccccaagattgccttccatgcccctcagtcctccaccagatgctaattgtcagctccagattgttttacctgtgcttcttactgactggc

SEQ ID NO: 103949 - DNA, 601 bp, Human
tgtgaccagatgtatgggcatatttccccacacaccaagcaagcaatcagttcggcagtggacatcagctcggagtcgtcaagttcagttcagttctaacactatctacctgagatagcgtcagttcccagaggttgagggctcaatccccaagattgccttccatgcccctcagtcctccaccagatgctaattgtcagctccagattgttttacctgtgcttcttactgactggctataaactgggtcccatgacccctccgttggtttgattaatttgctagagcagctcacagaacycggggaaacacttgtatttactggtctgttataaaggatattacaaaaagtacagatgaagagatgcgtagggcaaggcatataggaagggatgcgaagcttttgtgccctctgcaagctcaccactctgggaacctccacatgttgagctatcagaaccccattgttttcagtttttatgtaagcttcattatgtaggcatgactgattaaattggccgttggtgatcagcttaaccttcagctcctttcctcctccccgggtgggagggtggggctgaaagtccgacatcactaatgc

SEQ ID NO: 103950 - DNA, 601 bp, Human
cttttgtgccctctgcaagctcaccactctgggaacctccacatgttgagctatcagaaccccattgttttcagtttttatgtaagcttcattatgtaggcatgactgattaaattggccgttggtgatcagcttaaccttcagctcctttcctcctccccgggtgggagggtggggctgaaagtccgacatcactaatgccttggtcctttcagtgagcagctcccatgctgaaacgttgtaggggctgctggccatcagtcaatcattagcatacaaaaaggcaacatcttagagattytaaggattttaggagttgtatgggattgaagaccaagtaaatattttgcagtatcacaccttggctctacgatattatacttgggtttttatttttcacttctggctatttttcagacttatatattcattcttgggacccaatcactaaatgagttgctccaggcttggttctaggccctcctgtcattcagtattgtctgcctaggcactggagtacagcttcagttaccatctataaatactgactcccaaatttgtttgtctgggcctattcaccatttctacttgaatgtttcaa

SEQ ID NO: 103951 - DNA, 601 bp, Human
ccatcagtcaatcattagcatacaaaaaggcaacatcttagagattctaaggattttaggagttgtatgggattgaagaccaagtaaatattttgcagtatcacaccttggctctacgatattatacttgggtttttatttttcacttctggctatttttcagacttatatattcattcttgggacccaatcactaaatgagttgctccaggcttggttctaggccctcctgtcattcagtattgtctgcctaggcactggagtacagcttcagttaccatctataaatactgactcccaratttgtttgtctgggcctattcaccatttctacttgaatgtttcaaaggcttcttaaagtcagcatatcagaaagcaaactcaattccaactcacactgtttagagctattgtattattatttcctgccttattgaatggcaccagtttccagttcagcttactaattgatttctctgcagctacctccagtttgctttccaggcctcactcatcttttaaaaacaccagtctgaacatgtgtcatccctttgcttgaaatactgcaatgacttcctgttgctgttaggataaaaaaaaa

SEQ ID NO: 103952 - DNA, 601 bp, Human
ttttatttttcacttctggctatttttcagacttatatattcattcttgggacccaatcactaaatgagttgctccaggcttggttctaggccctcctgtcattcagtattgtctgcctaggcactggagtacagcttcagttaccatctataaatactgactcccaaatttgtttgtctgggcctattcaccatttctacttgaatgtttcaaaggcttcttaaagtcagcatatcagaaagcaaactcaattccaactcacactgtttagagctattgtattattatttcctgccttawtgaatggcaccagtttccagttcagcttactaattgatttctctgcagctacctccagtttgctttccaggcctcactcatcttttaaaaacaccagtctgaacatgtgtcatccctttgcttgaaatactgcaatgacttcctgttgctgttaggataaaaaaaaatctaatgattctgcaaatctaatgatcttcatgatctagtcttatctccctctgctcatctcgtatcactgcctcactttctgagctttagcaacacttgtcttatttcagttctttgaatctgcagatttgc

SEQ ID NO: 103953 - DNA, 601 bp, Human
tattgtctgcctaggcactggagtacagcttcagttaccatctataaatactgactcccaaatttgtttgtctgggcctattcaccatttctacttgaatgtttcaaaggcttcttaaagtcagcatatcagaaagcaaactcaattccaactcacactgtttagagctattgtattattatttcctgccttattgaatggcaccagtttccagttcagcttactaattgatttctctgcagctacctccagtttgctttccaggcctcactcatcttttaaaaacaccagtctgaacatrtgtcatccctttgcttgaaatactgcaatgacttcctgttgctgttaggataaaaaaaaatctaatgattctgcaaatctaatgatcttcatgatctagtcttatctccctctgctcatctcgtatcactgcctcactttctgagctttagcaacacttgtcttatttcagttctttgaatctgcagatttgcccaaccattaatctttgtatatgatattccttgtgtctgtagagctcagatcaaatatcacttcaagacagcggtcccctaggccaggtgcagtggctcacacctgt

SEQ ID NO: 103954 - DNA, 601 bp, Human
ttctctgcagctacctccagtttgctttccaggcctcactcatcttttaaaaacaccagtctgaacatgtgtcatccctttgcttgaaatactgcaatgacttcctgttgctgttaggataaaaaaaaatctaatgattctgcaaatctaatgatcttcatgatctagtcttatctccctctgctcatctcgtatcactgcctcactttctgagctttagcaacacttgtcttatttcagttctttgaatctgcagatttgcccaaccattaatctttgtatatgatattccttgtgtctrtagagctcagatcaaatatcacttcaagacagcggtcccctaggccaggtgcagtggctcacacctgtaatcccagcactttgggaggccgaggcgggtggattacgaggtcaggaattcaagaccatcctggctaacacggtgaaaccctgtctttcctgaaaaaaaaaaaaaaaaacaaaaaaattagctgggcatggtggcgggtgcctgtagttccagctactcgggaggctgaggcaggagaatggcgcgaacctgggaggcggagcttgcagtgagctgagatcacgccactgc

SEQ ID NO: 103955 - DNA, 601 bp, Human
atgacttcctgttgctgttaggataaaaaaaaatctaatgattctgcaaatctaatgatcttcatgatctagtcttatctccctctgctcatctcgtatcactgcctcactttctgagctttagcaacacttgtcttatttcagttctttgaatctgcagatttgcccaaccattaatctttgtatatgatattccttgtgtctgtagagctcagatcaaatatcacttcaagacagcggtcccctaggccaggtgcagtggctcacacctgtaatcccagcactttgggaggccgaggcrggtggattacgaggtcaggaattcaagaccatcctggctaacacggtgaaaccctgtctttcctgaaaaaaaaaaaaaaaaacaaaaaaattagctgggcatggtggcgggtgcctgtagttccagctactcgggaggctgaggcaggagaatggcgcgaacctgggaggcggagcttgcagtgagctgagatcacgccactgcgctccagcctgggcgacacagcgagactctgtctcaaaaaaaaaaaaaaaaacagtggtccccaaccattttggcaccagggaccggttttgtgga

SEQ ID NO: 103956 - DNA, 601 bp, Human
tgcaaatctaatgatcttcatgatctagtcttatctccctctgctcatctcgtatcactgcctcactttctgagctttagcaacacttgtcttatttcagttctttgaatctgcagatttgcccaaccattaatctttgtatatgatattccttgtgtctgtagagctcagatcaaatatcacttcaagacagcggtcccctaggccaggtgcagtggctcacacctgtaatcccagcactttgggaggccgaggcgggtggattacgaggtcaggaattcaagaccatcctggctaacayggtgaaaccctgtctttcctgaaaaaaaaaaaaaaaaacaaaaaaattagctgggcatggtggcgggtgcctgtagttccagctactcgggaggctgaggcaggagaatggcgcgaacctgggaggcggagcttgcagtgagctgagatcacgccactgcgctccagcctgggcgacacagcgagactctgtctcaaaaaaaaaaaaaaaaacagtggtccccaaccattttggcaccagggaccggttttgtggaagacaatttttctgtggactggggtgtgggggatggctttcgga

SEQ ID NO: 103957 - DNA, 601 bp, Human
ctccctctgctcatctcgtatcactgcctcactttctgagctttagcaacacttgtcttatttcagttctttgaatctgcagatttgcccaaccattaatctttgtatatgatattccttgtgtctgtagagctcagatcaaatatcacttcaagacagcggtcccctaggccaggtgcagtggctcacacctgtaatcccagcactttgggaggccgaggcgggtggattacgaggtcaggaattcaagaccatcctggctaacacggtgaaaccctgtctttcctgaaaaaaaaaaaacaaaacaaaaaaattagctgggcatggtggcgggtgcctgtagttccagctactcgggaggctgaggcaggagaatggcgcgaacctgggaggcggagcttgcagtgagctgagatcacgccactgcgctccagcctgggcgacacagcgagactctgtctcaaaaaaaaaaaaaaaaacagtggtccccaaccattttggcaccagggaccggttttgtggaagacaatttttctgtggactggggtgtgggggatggctttcggatgattcaggcacattacatttatagtgcacttta

SEQ ID NO: 103958 - DNA, 601 bp, Human
tagagctcagatcaaatatcacttcaagacagcggtcccctaggccaggtgcagtggctcacacctgtaatcccagcactttgggaggccgaggcgggtggattacgaggtcaggaattcaagaccatcctggctaacacggtgaaaccctgtctttcctgaaaaaaaaaaaaaaaaacaaaaaaattagctgggcatggtggcgggtgcctgtagttccagctactcgggaggctgaggcaggagaatggcgcgaacctgggaggcggagcttgcagtgagctgagatcacgccactgcrctccagcctgggcgacacagcgagactctgtctcaaaaaaaaaaaaaaaaacagtggtccccaaccattttggcaccagggaccggttttgtggaagacaatttttctgtggactggggtgtgggggatggctttcggatgattcaggcacattacatttatagtgcactttattattattacattgtaatatataatgaaataattatacaactcaccatcatgtagaatcagtgggagccctgagcctgttttcccacaactagacagtcccatctgggggtgatgggagacagtgac

SEQ ID NO: 103959 - DNA, 601 bp, Human
caccagggaccggttttgtggaagacaatttttctgtggactggggtgtgggggatggctttcggatgattcaggcacattacatttatagtgcactttattattattacattgtaatatataatgaaataattatacaactcaccatcatgtagaatcagtgggagccctgagcctgttttcccacaactagacagtcccatctgggggtgatgggagacagtgacagatcatcaggcattaggttctcataaggagtgcgcaacctagatccctctttgcccggttcacaataggtttygcgctcctatgagaatctaaggcttccactgatatgacaggaggcagagcccaggcgggaatactagtgatggggagtggctgtaaatacagatgaagctccgccacctcgcccactgctcacctcttgctgtgtgacccagtttctaacagggaccaggactggtactggtctgtggcccaggggttaggaagccctgctctaaaaagttcaaagtttaatttggttttgctggggatgggggaaggcgggattatgtgctccctgagtttgtagtaaaacctttattattgaaattat

SEQ ID NO: 103960 - DNA, 601 bp, Human
gacagtcccatctgggggtgatgggagacagtgacagatcatcaggcattaggttctcataaggagtgcgcaacctagatccctctttgcccggttcacaataggttttgcgctcctatgagaatctaaggcttccactgatatgacaggaggcagagcccaggcgggaatactagtgatggggagtggctgtaaatacagatgaagctccgccacctcgcccactgctcacctcttgctgtgtgacccagtttctaacagggaccaggactggtactggtctgtggcccaggggttaggaagccctgctctaaaaagttcaaagtttaatttggttttgctggggatgggggaaggcgggattatgtgctccctgagtttgtagtaaaacctttattattgaaattattttattagtgtctctcctgttatcagatgcttcaccgtaagtgtatgagtcatgccttttttgatcccagtgtgctcagtacctaactcaatgcctggcacataatagaaactaaaaaatatttgaacaatgaatggtatttctttcttttgtttttggagacagagtctctgtcgctcaggctggagtgta

SEQ ID NO: 103961 - DNA, 601 bp, Human
cataaggagtgcgcaacctagatccctctttgcccggttcacaataggttttgcgctcctatgagaatctaaggcttccactgatatgacaggaggcagagcccaggcgggaatactagtgatggggagtggctgtaaatacagatgaagctccgccacctcgcccactgctcacctcttgctgtgtgacccagtttctaacagggaccaggactggtactggtctgtggcccaggggttaggaagccctgctctaaaaagttcaaagtttaatttggttttgctggggatgggggaaggygggattatgtgctccctgagtttgtagtaaaacctttattattgaaattattttattagtgtctctcctgttatcagatgcttcaccgtaagtgtatgagtcatgccttttttgatcccagtgtgctcagtacctaactcaatgcctggcacataatagaaactaaaaaatatttgaacaatgaatggtatttctttcttttgtttttggagacagagtctctgtcgctcaggctggagtgtaatgacgtgattttggctcactgcaacctctgcctcccaggttcaagcaattctcctg

SEQ ID NO: 103962 - DNA, 601 bp, Human
tggtctgtggcccaggggttaggaagccctgctctaaaaagttcaaagtttaatttggttttgctggggatgggggaaggcgggattatgtgctccctgagtttgtagtaaaacctttattattgaaattattttattagtgtctctcctgttatcagatgcttcaccgtaagtgtatgagtcatgccttttttgatcccagtgtgctcagtacctaactcaatgcctggcacataatagaaactaaaaaatatttgaacaatgaatggtatttctttcttttgtttttggagacagagtttctgtcgctcaggctggagtgtaatgacgtgattttggctcactgcaacctctgcctcccaggttcaagcaattctcctgccttagactcccaagtagctgggactacaggcgtgtaccaccacgcctggctgattttttgtgttttagtagagacggggtttcactgtgttgcccaggctggtctctaacttctgagctcaggcaatccacctgcctcggcctcccaaatgctgggattacatgtgtgagccactaagcctggcaatgaatggtatttcttaacccagttaatgaatgg

SEQ ID NO: 103963 - DNA, 601 bp, Human
aggttcaagcaattctcctgccttagactcccaagtagctgggactacaggcgtgtaccaccacgcctggctgattttttgtgttttagtagagacggggtttcactgtgttgcccaggctggtctctaacttctgagctcaggcaatccacctgcctcggcctcccaaatgctgggattacatgtgtgagccactaagcctggcaatgaatggtatttcttaacccagttaatgaatggtcttaggattcacggtttcatcaagacacactgaatcatttctgttaacatcccattcacktgaggtttatttaggcattttgtctttatttgttaaatgctcactaatacttttatcagtggtgggtttcaggtgtctctctttcagaccctcaggattctcttcaacctgaactagatatatggaaagtagattctgagaagcagtatggtgtttcgctggctgcttcctgcttagactatttttatgaaagcctgggttttttagatttattgttatttatttatttatttttttggagacggagtctcactctgtctcccaggcttgagtgccatggcacaatctcagctcactgca

SEQ ID NO: 103964 - DNA, 601 bp, Human
ttaggaaattttgggtaaaacaggtttgtttattgtaggatggagtctttttttttttttggttccttttttttttttttggagatgaattttgctcttgttgcccaggctggagtgcaatggtgccatcttggctcactgcaacctccgcctcccggattcaagcaattctcctgcctcagcctcccaagtagctgggattacaggcacgcgccaccaggctctgctaattttgtatttttagtagagatagggtggagtctttaatatactaacagctttaagaatggagttataataygctgtatttcccaaacttgacatacgactcatttccaaacttttattacaaattcagcattgggaaatgttgtatgaggcctattgagttgacttagtccatagaaatgatatttgtcatgaaatgtcatctacctatgttagtctcttgaaaagataaatgtattctaatggagccagaaagcctttcactatatggacacttgaaaatgttcacatatttttataagaaagcattttcaaaatattgttcaaaaactggatacaaaattctgagagtaaaacatctgagtgtgtggct

SEQ ID NO: 103965 - DNA, 601 bp, Human
tggctgtaatctcagggacccccgctggctggagagggctgaagagagagggaaaggacgtcaagagtgtgcgcattagggagccggggtgagggttggagccagggagggcggctttcttgggttcaaggggttttcgctcatcttgagtgcttcaggagaagccctcccacctcgctccccatcgagcgcctgttggcaccctgcccacagagaacacgttgttccccagggcgcgcagtcgggctgttggacaaatcccacgagggactgccggagcccagtggcctcctgccccagyagctgccgctctcgcccgctgcccccagtttagatccgcagcaccggctgggctcaccctgcggccctcgcgagctccacgttctcctctttgggacaagttgttgaaatggttccggagttgggatcggggctgttacataacgcccacccgaggggcgaggagcggggctgacgcaggctcaggccggccgggtggcgtgggggtggggcggggaggcggtggaaagggggagcgctgtcaatttctcctgctcagttgcgcttccgcttaagttggagggggcgaggccgccagggg

SEQ ID NO: 103966 - DNA, 601 bp, Human
aatagggtattttatttctatgaagtttattttcccttcatgtaaaattgatttcacatgataaatgctatgatgtttacttgttatagtcctctaatactttcacgctgatgaatttcagtgaacctgagaaggtactcctgcaatgtaaatatttttagtctaatcttcctaagtacccaacttactgatagaaatgactgaaatgtgtttatataaactaagtatattctatgcttgttaaagcatagtagaatattacctgattctttatccctacaagaatagaatatgacctaarttaataatgtctaacttcagcataaatttaatggaaactcaagttaaataacttgatataagaaaagtttcctcagctcataaaccctttgcagctaaaattctctgtatcaaaataccgttctgtttcagatttagcattcattttacaatttctctagcatcagtattcaagatattgcagtaagaatatgtcaacaatttttttatatatattatttattgtgcatgaataaaaggatagagtgggcatgttcaaacaaatagtttcaaggtaagggaaaatatttttttccttatt

SEQ ID NO: 103967 - DNA, 601 bp, Human
ccttctttccttccttccttccttccttcttccttccctccatccatccctttctgcttcctttcttccttttttttgtttaagcatctctttcatttgatgtttgcttagtttgcatgtctgtggtcaatcttctatattaaccttgagctactatagaacagtgaattcttataataattttaattttgtcaaataatggaagctagttattatttctagagggagacatgaaagaaaggaggcactatgcatttggttttgattttttttccttttattttattttattttatttctwagcgaaagggtctcgctctgttccccaggctggagtgcagtagagctatcacagctcgcttcagtcttgagctcttgggctcaagcaattctcctgcctcagcctcccaagtagctgggactacaggtccatgccatcacgctgagctaattttattttattttttatttttatttttcatttttctgagatggagtctcgctctgtcacccaggatagagtgtggtgttgcagtctcggcccactgcaacctccgcctctgggttcaagcagttttcctgcgtcagcctccccagtagc

SEQ ID NO: 103968 - DNA, 601 bp, Human
aaccttggttattataggggtttgagaatttcaggtagaaaatcatgattatctgaaaaaagttgatgcagctttaacatgtaacaaaaattatctaatagaattaaaatatttgcttacaatagcattttggtactatggatgatttagaatgtaaaacatgcagaaaattttaatttagcttcttgtggtctttatattttgaagcttaaaaattgtgatgaaaataatcatgcatatggtaatttaaaaaaaacactacacacggggatataataaatattgtcttctttcacctcawttctatgtctctgagataatcaccattgatggtttccagaaatggtagcataatatacactgttctttatcttgattgttttcttcttaacataaatcggagttctgcttttatgtgcagagattttcctcttctttttttctagttattgcatggtattctgttgttatgtggcctttttgttgatgattgttttcatttttgctgtttcttttaataatatgtccaagtgggtttgtagaatagtttgctatgagtggaataacttgtagtcaaaaagtgtttgcatttaaaactttg

SEQ ID NO: 103969 - DNA, 601 bp, Human
aatttccaaatgttattatacattatgtggttttaaaatatttttaagttcttactatcgtatatctaattcatgtattctagtctttcaagagactttattcatcttccttgtgcaaactagattggcttctcttgatcctcctgaacaactgacatattgagatagcactgtccttttgtggttgaccatgtaattatttcttgacttatttcttcatatgctttaaatacattttctttattacttacaatagattatttaaaacaagttttaaaataataaatcatatacacacgcrcatataagtgtgcatgcatgcatgtatatgcatgggtgtgtgtgcataatattttaatgaaatccctcattgatagctttttccatgttgggaaaaggcataaatgccttcatgatatccgtaatatttttcatcttactgagtatttctattcctcagaatacattaaatttttcttcaatatcaattatgttctaatttggagcaattaatctaggtttaaattacattttttccacaaaaatttttgaaatatcttggagtttctcatttttttgtttttcttgcactgtgaacttt

SEQ ID NO: 103970 - DNA, 601 bp, Human
ataatctccaactcgattattgtttgtattttcaggtaataattaaggtggcatcatatacttcagggtttgtttctgctgccaggttcaatctttgtctatggaatgaactctaccttgcttgtggaaaaaaaatacactctgcttttcctttctctatattctagtgataatagacttggagttacatgtcattcaaaggaatagagtccaacttataaacaagtctcctgaatcttctcctatctgcttcattaagatacttatgatttctaagtgaattaagaccaggtttttttttggaaactgttaaaatctaataactttggaaaaatgaaagtttaggggaagcttccttgtactgctagaaacataagtgaaatgaaatccaactataatatatcaggacttcaaagccccaggatggatgtcatgctaagtagtaaaggcaataaattatcagtatttgggggatgctttctagaaagaaagattccaagacctctcttgataatctttatcacaaaataactcttcttgtcaaggagttttgcctatgtctgtctgaattttattctctgtaatttaaacatcctttcat

SEQ ID NO: 103971 - DNA, 601 bp, Human
agagagtattgggctgttttctatcttatcattgaggcacagggaggttataattatggcatcctggtgctaaacatggagcagggtcaattttcgcaattgaagaaaagaagttataatagtcggtccttttttctcacctgggcaatgcatgcattacatgaatatccagagtttcttttcattcgttcctaaatggagtcaaatgcagattcaaagatataaatggggctacctacttttaaagttcacgagatacagatctatatagatgacaaaggtgataaatatatagaaacayataaacacataaacttcactcccaagttaaaacccacaattaaatcaagaaggcccatttgctacttggtaaaaataacaaatcaggaaaaggatatgataatcttgctatataataaaaatctttctccacatcgttttacataaaacacaatcttctcaacttattcccaaagtaaaaatcctcctccactcacatacttcatgatcccaggggacatttatggtattagcacagttactagaaagtattagagagggtgcttcccattctccagctatgcttgcttttcctcttctt

SEQ ID NO: 103972 - DNA, 601 bp, Human
ctgagttgtttcacttaaaataatggcctgcaggtccatccatgttgctgcaaaacacgatttcattctttttatggctgaatacacacacacacacaccatattgtcttcatccaatcatccactgatggacatttacgtttatttcatatctttgcttttgtgaacagtgatgcgataaaaatacgagggcaggtatctttttaatataataatttattttcctttgggtatatgcccagtagtgggattgctggataaaatcctagttctatttttagttatttgagaaatctccatrctgttttccataggggttttactagtttatattcttaccaacagtgtataagcattcccttttctctgcgtcctcaccaacatctgttgttttttgtctttttaataatagccattctgactggtgtaagatgatatctcatgggacttaattaaactaaaaagcttctacacagcaaaagaaatgatcaacaaagtgaacagacaacctgcagaatgggagaaaatatttgcaaactatgcatccagcaggggtgtgatatcttgaatttacaagggactcaaacaactcaacaaccgt

SEQ ID NO: 103973 - DNA, 601 bp, Human
gcaaaataaaacgtcaatgagatatcattcgtacatgtagttttatatacagtgacacagaaaaattttatcatgttaagtataaaaattcttgattcttttaaataaaagtactgtgtatatgtgtgtgtaatacatatctataggtaccaataaaatgtcttcagaagatacagcaaactattgagagctgctttacatcaaattgtaatattatatattacatatatatgttatatattatatataatatataacatatattacatatatatgttatatataatatataatatataatatatatatataatatataaattatatattacatatatatgttatatattacatatattatatataatattatatattacatatatatgtttgttatacagttatgagaggtttccactctcactgttttatgtgttttctttattttttaacaataagcatgtattcatggtaaacataattagattccaatcttatccttaccacacacataacttgaataagctcattaaatattaattgaagtgtatttttctagtgaaattaaaataatgcaacagctcaaaacaacttaaatcat

SEQ ID NO: 103974 - DNA, 601 bp, Human
tttcctacagctctgtcatgctatccaggcaattcaagctcccttactgctctgtaatcctgtagagagtttatttcacaggccattttatgttcacagatgatatgaactttagggtacattcatcctgtgtcctggaagaagaacaaaatgcaaataatttaaaagaggagcaagaacattatatgattctgttttctgttctctttactttcgttctatataatcctccttcctgtccattttgtttactaccaagtcttccactgctgttcctatttgaaagtactgaatatagatwacaaactctaacttgtcctccacacttgcatttccaattgtcacttagacttgattagaatttaatgtaatttttaaaattccttataactcactgccaggtaacaccattacatctgtactttcttttatgatacttaactagattagaattgtatttgattacacatattttttatgcctcctccttgctcatacattcttcttttttacttgcacaattctgtcagttcaatctccaaattagaattcttctcattcctactcctactgttgtggtcacaagtctatgtcataacag

SEQ ID NO: 103975 - DNA, 601 bp, Human
caaataatttaaaagaggagcaagaacattatatgattctgttttctgttctctttactttcgttctatataatcctccttcctgtccattttgtttactaccaagtcttccactgctgttcctatttgaaagtactgaatatagattacaaactctaacttgtcctccacacttgcatttccaattgtcacttagacttgattagaatttaatgtaatttttaaaattccttataactcactgccaggtaacaccattacatctgtactttcttttatgatacttaactagattagaatwgtatttgattacacatattttttatgcctcctccttgctcatacattcttcttttttacttgcacaattctgtcagttcaatctccaaattagaattcttctcattcctactcctactgttgtggtcacaagtctatgtcataacagagttcattgtccttttttcttgtaaagacaattccttatgatttgttctacacattttatttatttttctaacatacatatttgatcatgttctactccttttgaaagtgatctgtgactttccattgcagagaagctatatataatagttta

SEQ ID NO: 103976 - DNA, 601 bp, Human
cagcagagtgagactctgtctctacaaaaatatttaacaattagctgagtgtggtggtgtgtgcctgtaggttcagctactcgagtaggctcagctatttgagagacgtaggcagaaggatcacttgagcccaggatttcgaggttacagtgagctgtgattgtgtcactgcactcaaacctgagcaatttaaaaaaagaaaaaaaggaagaaaggaaattttgagaatctaggaaaaaaaggatgctagctttgtgttaaaaaaaaatgttgggctgggcacggtggctcatgccagtartcccagcactttgggaggctgaggcaggcggatcatgaggtcaggagtttgagaccagcctggccaatatggtgaaacctcgtctctactaaatatacaaaaattaaccaggcgtagtggtgcatgcctgtagtcccagctactcaggaggctgaggttacagtgagctgagatcacaccactgcactccagcctgggtgacagagtgagactccatctcaaaaaaaaaaaaaaaaaaaaaagttaaaaaactttgaatctttaatgtgggagggatatgaaaagcaaaattgctaaaca

SEQ ID NO: 103977 - DNA, 601 bp, Human
gagatgaagtaatagcagagttctagactcttgactggcctgaactgttcatcatcatcaccactgcagcttcctaagaggcatgacatgagctttcaactgatatcttttcttttcttaatagtagattatacaagcctaggtgtttcatcatttaacaaatatattatcctttagatgttaaatcaagaattatttgaaatttcatttttggaagacagttatggactccttaactattttgaaatataaatttaaatgtgtctgttaaattttacttattttaaaatgatttttattyggtatctacagcctttatctgtttaggtatcttttttactaagacagagactgaatgatatacttttgagctttcttttatgctcatatataagtaccttgaaaagtgggcccatcagtctttttataaataaactcggatttttctatctttaataattcataactgccttctattaatatctgactttttccattaaaagtgacttcttaagaggctctatttaaagtgattttgagaagattccctttgtaagtataaactgttttcataattaattcaaatgatgctcctcaaatt

SEQ ID NO: 103978 - DNA, 601 bp, Human
aacagtgtaacatacatacacataatgggaatatcacaaggaaaataaagaaaagaacagaactaataatgactgagaatttcaacagttagtgtcagacattagactacacatccagatatctcaaagaacaccacacaaaataaatgccataaaaccccatacctatctacatatttaaactgcagataatcagagataagtaaaagatatgtaaataaacatacatgggaaaaatatctcacctatagaagagtaaataaaagaattatatctgacttaccctcagaaaccatgtaawcaagaggagagtggagtaaaatagttgaagtgttgagagaaacaaaaccactagtgtagatttatgtattctgccaaattatcatttagtagtgaagaggaaatacatattttcccagacaaacaaaacctgagggaattttttgccggtagacctaccttgcaagaaatgctaaagaagttcctcatcaagaaagaaaattatataggtcagatatgcagatttacataaagaaaggaattccattgcagaaggaataatgaagataaataaaatattttattttttttccaatttgga

SEQ ID NO: 103979 - DNA, 601 bp, Human
atttattttctccttattttgtaggtattactctactgtcttccagtttcctttgtggcagtcaacacatctgctgtcattataattcaaattcctttatagctgttctttcttttctatttgattactctcacattcatctgttttcctggataaacagtatctgaagtagcctttgtgaaagtcaatttattgagttgtgttttctaaaatttaaaatatttttttgatcaattctagaaaaatttcagccttctctttaaattactgtctcctattctctattctgtctggaaacaaytccaatctgttgtctggtgttgtctatttctttgcttgctttgatgattctgactaattctcagtaaaacatctattttaataattatttaccaggatgatctcatataactcctaaatcaatccattggatttttatgtttaatagttaaatttattattttggagattatttttctttcaaatttaactctgaatactttatagttccttactgaatgcttatattttcaatatcttatttactctttaaagacttaaaatattttacattgtgcatctgaaatgtaatattgctgtt

SEQ ID NO: 103980 - DNA, 601 bp, Human
actaaatattgatgttatgtaacttgcaatatattttctcctattttttttaattggctgaggaccacagagtaaaacagagaatttgaggaattattcacataacctatgggctttttaaaagtccatctattgaaaaggaagaattatgagctgcataaaagagtttaattatatacattgatcaaatgcatcagataattattgaaattctcaattttcattgcacagataacatattaattgcatagatcccatattaatggtatactttgtagtttatcatttttattagaagtamagtagaaatacaaagctaaggagaaataatttcacaaagtagaaagttccaaaagtgagtagagtaaaattcttacaaaaatcattgctttctcacctagaagaatccaaaagaatcaacccaaaagctcatagaactgataagagggttcagtaagatcactagatataaaattatgacttgaaagccaatggtactatcaatatctaaaatagaaaatataaagaaaaatcatctgacagtaatataagaaagatataaaatatctagggataaatctaataaaatgtttgaaaggta

SEQ ID NO: 103981 - DNA, 601 bp, Human
attgaaaaaaatgtgtcctttgaaaataaatgtatgtgggttaacacataagtactatggcacatgcgcaggaacccgcttgcttaccaacaagtaagaagagcaagaaagttctgtgaaaccttcagaacctctttgagtcattcaaaagcaaaagtgttatacaagctaatttgagggtatccagacagtaaggtgataaagttctgtcttttttttttttgtattttatttaaaggataaattttaagtagaaatcttatagtcatttgaacatttttcagttattttgtttaaaagtaggttttatcatagactctaaaatgattatttggactgagatgtcattgaatctatgtttaacacatacataatccctcggtcttgtacattctaattaagatcagacaagagattgcaggttttttaggcattaagaccaatggtggctataaacatgaagaagagaaaaaaaaagagagagagagaaaacagagcaagaggaaagaagaaatataaaacaaagaggaagaaatgtaaaacaaagaggaagaaatataaagaaagaaaaagtaataaaacagagaatgatattatttaa

SEQ ID NO: 103982 - DNA, 601 bp, Human
cccagtttgttctcacttttagcccctagagctgctgtttctgaggtcagagccgcccaagattcttgaaaacagaataataatctctctgtgatatttaattgtttagattaaagtaatatgtgtttagatattgtaaaacagtggcattttatgtatttcttttttctttttttattctagaaagctcacacatgagttcatgaaagaattgaatatttttaattaaaaattataccaacagggaaataaatacaaaataatcatgaaaatacattattgaaaaattaatatatatttmcagtatatatttttatcagtaaataaaggatgacagctagggtgatgatgaaagtttggaaaatatttgcataaggagttgaatttgaccttgttaatagggatgagaccgctaaaagatagattttgaagaaaaagaaaaaaaattggaagacagatccttgactgatgcctttatgtgatgtgctttaggaagactaatatgacaagagtgtaaattgaaggaaggagagagaagaggtgggtcacatggcagaaccaaggagaaagaaaaggaaagtgaaggtgcaagagatgctta

SEQ ID NO: 103983 - DNA, 601 bp, Human
ttcagtctgctttgtagaagattggtaataaaggatgtgtaaatttacatattacacaggttttcggcaaataagggccacttaaagaggcaatcttgctttcctttggattcataccgtacaacagttactaaacagtattgcctaatattttttgattgtctagaattggcaattagaatctgtacatattttagcaatgctcgtattcatgaaacaaatctattttttctacagaccatctatttttgtgaagtaaatacaatgatataagatagggtttgttttatccttcaaaaakgattattttaaaaggatggtagatgttatgttctaggttgttagattgtgtttctggatgactggtttccagtttttggattgaaatgaccccgagattgagaaatatcagctatttatctatttaaagccacatatttggccaggcatggtggctcatgcctgtaatcctagcactttgggaggccgaggctggtggatcacgaggtcaggagtttgggaccagcctgaccaacaaggtgaaaccccgtctctactaaaaatatgaaagttatctgggcatggtggcacatgcctgtaa

SEQ ID NO: 103984 - DNA, 601 bp, Human
caaaattgataattgactctttttcatagcaaaaagatttaaataaaatttggtatctgaatttagattttgaagagatatgttcacattaggtgaatcctacattttattaatcaaaagggactaatattgttagagaaagatgcaggcttttctagaataaggaagatgatttgctgagttctggattcattctggagtctcgattttgcgttgtttattaagttatcagtataaatgatgaatttggttttgctgtgaatagtagaaataatatgaaagacaagtttatgtagcatgwctccaagtgctaaactgaggatataacttttcaggaaataaatcctctagttgttgtaactcttagtcctaaatatgaggtaatatatggacaattaaaaaaacaataaaaattttccaagtgatatgatgctataagcaaagttactaacaggaaaatagacatatttggaaagagaagtaaatctatgctagagaaataactgccaccatctggttaataggtgaccacttcaatttctctgggatcattcccaataacaaaaaaaataacataacagaagactgtggaaggaaaaaa

SEQ ID NO: 103985 - DNA, 601 bp, Human
aattcaataaataattcctgacttttatgttttatatgataaatgttaccctaaactttgatattttcatttgaaaattttaaatttaagtctgatgaactttttagagttaaagaaatagacatgtattaacttaagacaagttgagttctaagggaaaagtgagtaattcatgaaatttttggagttacatagaccatctatgcctccagaaagagtatgtagttatctttgcaagatatattttttttcttctgttaagggacttgtgccactataaaaaacattgatttgtgaaatyaaaatatgtaggaaggacacatttgggctgtgtttgctatttgagaagtaaactagatgcatccccttggactgtttgaaagaatcactgacaccagtgataaggatatttttatctgtgcttagatactaccttgcttcagtttaaggtctttcagggtaggggagccatgcagtgttatcttaataatacaggtaaaatccaccatgatttacaaatagggtaagtgactagggatgatagtggcacagcatcaacattatgattgattgaataaggtctcctttactgatatctgca

SEQ ID NO: 103986 - DNA, 601 bp, Human
tgatactttgctctctagagctggcaataatgtccctttggactaaattataaacatttcacggtccttaggataggaatgttattttacatatccatgtaagaattcttttatatgcttttaaatattcttttgaaatgtatgtagtactataaactctaggtgtatttatttgaatatagacatatgaatataaaatctcagatgttaaacagtttgagatgtttaatgttttattaaaaagacaaaaacatagcctttgtaggaatagaattctgacttgtcatggactaaagatacyttggtttcatgcttcttaacattctgtggttttattttttactattgacaaaaatgaggtaataatttttgtttagtgacttcctgaaagagaatcatttattaagcgttaatatgtattattactttttatgagagaaatattatctaattttgataattatattttatcaaaaatgacttattttggcacatcaacaaacctagcagataaaattccacgtttttccctgaatcagatcataataccattaattttacacttgcattatttgtattaattaaataattacttatttgt

SEQ ID NO: 103987 - DNA, 601 bp, Human
actactttaatgttattaagtgtctgtaaccacatggtggttctccgctgtagaccaagtaagtaaaacctagtccttatcaatggaagatttctcaatagagtggagaacatttatgtaggtacaaccatgagtgtttcatgagatgatccatcagtaaacgtgtattgattagggaaccactatgatgctaatgtggggttaggtgctgatgaagaacactggctgataaatacatgggacattttctgcaggcttattatatctcatatgttctttgaaatatctaaaaccacaatgyatagagttatttggtaaatgttaagtagcattttgttctcaaacaaaaagcgtgatatcaatgtgttctatgtttagggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaaggtttgctttggtttctgtcttttctttttctttcatatgtgaggagagagaagagtcttgg

SEQ ID NO: 103988 - DNA, 601 bp, Human
accacatggtggttctccgctgtagaccaagtaagtaaaacctagtccttatcaatggaagatttctcaatagagtggagaacatttatgtaggtacaaccatgagtgtttcatgagatgatccatcagtaaacgtgtattgattagggaaccactatgatgctaatgtggggttaggtgctgatgaagaacactggctgataaatacatgggacattttctgcaggcttattatatctcatatgttctttgaaatatctaaaaccacaatgtatagagttatttggtaaatgttaagtarcattttgttctcaaacaaaaagcgtgatatcaatgtgttctatgtttagggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaaggtttgctttggtttctgtcttttctttttctttcatatgtgaggagagagaagagtcttggcaaataaggaggaaggagaaaataataa

SEQ ID NO: 103989 - DNA, 601 bp, Human
tgaatggaataaagacaaaagcattgacagaagaatgccacgagggaagagaacagaaaactcttagcgacatggagggggtagggaatttttaagctgagacctgaagaataagggacaattttaccctgactgctgtttagaatattatgtttgcaaataaattaaagaacaataggtgtcagtttgttcctaatcttcaaaaagccaacttgcagacagttcttagttcagtcaataaacgtatggccacaaagagagagagagagaaagagagagagtgagaaagagagagagagattgtgtgtgtgtgtgtgtgtgtgtgtgtgtgtgtgtataaaataacagttgatgagtagcctggtctcttgaacactttaaaaagaagataaaaatctcaatttgccttaataattaaaacataactgtaatgctttatgcaatcaaacaaaaaattcttgaacgctaaatattatttgttcctcaggtataagagctacacagactgatctttgttctccatgggtttggacacaatgagatcttcacttgtttatttgatgcattttattgggtatacacatgcgtgcatgaatttact

SEQ ID NO: 103990 - DNA, 601 bp, Human
tctaatgaaagatgatctccttaaaaataaggattatttcccttgtttttactccaaatttcagcactggttggcacatagctagtacacaaaaaatgcatattgaatgaataaggaaaaattgaactggatcttcaacacccaggctttggatagatggaagagagatgtggatcagcatgacaagctgttggtgaaatgaaatggagaaaatggtgttcgttataggacagaattttgtgacaaactattttgttgtattttcttttacaaaaaaaaatgggcttagcagtgaagttgtaaattggtgtgatttattctcctaacaatattgagagcagatatagatagattggtaagggatttgaattaaaacattagtaggcaattgaaaatctcttgataagtgcaaattagacatttgaggatttttgcctttatcatgccattgagaggaactatctcactgagaccccaaatatcctcagtgccactttccaatggagaatattggactgtgttgattcattttttcttgcttcctttttcttatgtttacagggggaagctactctctagctatccttgtagcatcattcta

SEQ ID NO: 103991 - DNA, 601 bp, Human
ggttggagaacttgtatatggggtaagtatagctcttctcatagataaagtcattcaatttgaattgttgttgacagactgcttcctctccctgtgaagtatctatatctgaggttgttgatttcccacattactctagaaacattatcttgttgatttgtgaacatctgaaagattaagattgaagccagaagtagacatgtagattaactgagacaagcatttcatctctcttgaagcatatgggccatatgtattgtcaaaaggctgcaaatgcatggatgcagtgcagatgtgtaawgatcatagtcaagccagctgggtatactgtgtattcataaagaggaggggcattcggggaataattcctttttgtttatcctttactgggactataccaaggaaaaaattattgtcatttttctgatttcctctcctttttctttgatccagtgacataaccacgattcctttttcaccatgactccaggtactattactttcctttttttcccttacagaaagctgatattgcaattgctccattaactattacccttgtgagagaagaggtgattgacttctcaaagcccttcatgag

SEQ ID NO: 103992 - DNA, 601 bp, Human
ttacctctgatctcttttctgaataacttcacttcagctgaagatactatgggagaaagggttctgggagtgggggtggtagaaccatggctaataacagatagtaacttgggtgtatgtgaagagtccaggaccttgatgaattaattaggtacctcaatataagtgcaaaaatgtggaccatcagcagctttttttactttaatgcagattttagaatgaatcttgtaatgtagatttcttactaatgaaaatgtattatcatttctaaacatatatgcaatatgtgtatgaatactcrgtttaaaaatgtatgttcctcaattagaagtgcatttgaaagcatttttaatatttgtatgcagtgtagcttgcttttatcttatttggaaaaatgaggtgctccctcttgaagtaaatgagatctatgagaatgatgcagatgcctgttataacaggatttacttggtgctacttatgttgattaaaataatcttaattattttcagactctctcttccagttgagcatgcatctatggagagtttcagttattaccttgtttggacagtagtagtgtcagctacttttcactactaca

SEQ ID NO: 103993 - DNA, 601 bp, Human
attgtcctatataattttgctccaaatacttttctgactagtctttcattcctgacatagcaaaaagaatgcagacttaagctaaatccttttataaggcagacagtgactattgatggaacaactttgatctttttatcagaaagatggagatcagagtcttcaaacatttatttcaggatacagatacactttccatctatggcttagtaatatgatatttgagggtaagaaatgtagaaagtatcgtggtccttgacttaccaaagggatttatactgatactacaaggggcccattytatcttatgtatattagtgggattttcctgggtactctttgaatttgcagccatttttccttttatgttacttcctgcgttccagggtttttgtacatttccttattttgaaatcaaattcagtgctgtttttttttcatagtcaaattttcttaagattgttaaaatcttccttctttccttccttcctccctccttcccccgcttcctccccccacccttccttccttccttccttccttctttcgttcttttttgtaacctcaaaatattgaaacaccactctttagcttggcagtg

SEQ ID NO: 103994 - DNA, 601 bp, Human
tgtcctatataattttgctccaaatacttttctgactagtctttcattcctgacatagcaaaaagaatgcagacttaagctaaatccttttataaggcagacagtgactattgatggaacaactttgatctttttatcagaaagatggagatcagagtcttcaaacatttatttcaggatacagatacactttccatctatggcttagtaatatgatatttgagggtaagaaatgtagaaagtatcgtggtccttgacttaccaaagggatttatactgatactacaaggggcccattctrtcttatgtatattagtgggattttcctgggtactctttgaatttgcagccatttttccttttatgttacttcctgcgttccagggtttttgtacatttccttattttgaaatcaaattcagtgctgtttttttttcatagtcaaattttcttaagattgttaaaatcttccttctttccttccttcctccctccttcccccgcttcctccccccacccttccttccttccttccttccttctttcgttcttttttgtaacctcaaaatattgaaacaccactctttagcttggcagtggg

SEQ ID NO: 103995 - DNA, 601 bp, Human
tttcctgggtactctttgaatttgcagccatttttccttttatgttacttcctgcgttccagggtttttgtacatttccttattttgaaatcaaattcagtgctgtttttttttcatagtcaaattttcttaagattgttaaaatcttccttctttccttccttcctccctccttcccccgcttcctccccccacccttccttccttccttccttccttctttcgttcttttttgtaacctcaaaatattgaaacaccactctttagcttggcagtgggacatatagagatatttcctaargcaatggtagctggtttatagagcacagcaccaatggtctagtagtgttcctagtttccaaaaaaccaactgtgctggccttaaaatttgtttatttataatgaaaaagaatatcatagacttttaaattaggatagtttgctaacacaaccaatttttctcataattattttcactttttaattgcataaacacacacacatatacacaaacattgaaaatgccctatttctgaatgcatgttgttgaggttggatcaagatgctgaattaaagtattttaaaagccaactctcacatt

SEQ ID NO: 103996 - DNA, 601 bp, Human
actggttctatcatatacagtagtaatatctgcaaatttgaaatatttgtcatgtatatcttcatccaaattgttgactgaaatactagacataatggaaatgagtatataatcagtggtataacaacagcttctgttgaaatcagcatttgtatatgaagaaataataatcaatgttctttaaatatgattgatattttcatcacaaactcacctaattttgataaagctaattttctacctaaggcacaaaaatatgatatacttttcaagtgttttgatcgtaatcaagatgttcatratagatcttgaatgtgccaattgaataacactattaaaaataacactattaaaaaatgaaagacagggtcataggggtatcacttgctcttcctctacattatcagttcacattgtatgcatatatgtgcacgtatagttaatacataaggtataatgagtaggcattccattaatgatataatttaccattcgtaaggtaatgagaacatatggaaataacatttgcattgacaactttaaagtcattgttttttaagcataaaaattaccaaaaagatatgattctatgactagtaca

SEQ ID NO: 103997 - DNA, 601 bp, Human
attaaaaaatgaaagacagggtcataggggtatcacttgctcttcctctacattatcagttcacattgtatgcatatatgtgcacgtatagttaatacataaggtataatgagtaggcattccattaatgatataatttaccattcgtaaggtaatgagaacatatggaaataacatttgcattgacaactttaaagtcattgttttttaagcataaaaattaccaaaaagatatgattctatgactagtacaagcattaacatgtgatatggctagcctttgggtcactacccaaatctyaccttgaattgcaatccctataatccccataatccccatgtgtcaaggaagagaccaagtggaggaaactgattcatggaggcagttttccccatgctgttcttgtgatagtgactgagttctcatgagatctgatggttttataagtggctcttaccctttgctccatacttcttcccgccaccttgtgaagaaggtgccttgcttcccttttgactttcaccacaattttaagttaaatgagtcctctccagccatgctgaactgtgagagaattaaacttcttccctttataaatta

SEQ ID NO: 103998 - DNA, 601 bp, Human
actgaaacatgacattttaggagagcttaatgtgcaaaggaatgtcgagagaaatatttttattgacttcaagtatttaccattaagtttttaatttcatataggtaatatatgatgtagtttttgtgtaaaataaaattaatatataagcaaaaacctaccatctttagccaaatgaataagaagtagtaagtcaatggaattaagctctgtgaaaatctttattggtacaacacaactttattattcaggcgtgcttaatttatatgaaatgtttcttcaacaatgctagacaatgagyatgtttttcctttgactctttaaggatattaatatgatacactgttattttctgtgaattattagttggactgatatgcctattaataacacaaaaccatggaaaaagatttgaatagctatgtttaaagaaacttgacttcttaagaaacacagagaagtcaaagtatgcaccagattaaactgtaggcatcatttttctcctcatcaaaatgtgatggcagatgttgttactggtgcactgggttcttgcagtctcccaggatagaaatcaagagaaactaccagttatagcagcaaa

SEQ ID NO: 103999 - DNA, 601 bp, Human
gaagtcaaagtatgcaccagattaaactgtaggcatcatttttctcctcatcaaaatgtgatggcagatgttgttactggtgcactgggttcttgcagtctcccaggatagaaatcaagagaaactaccagttatagcagcaaaaatgaagtttatttagcttgtgcacaagggtcccagcactgagaggggaaaagaatgctccattagggtagtgcgtatgttagttttataggatctttctatagggaaggattctgtcaggacttttctagagcttgggcagtggcgcaacatgctmcatatgtcatatgtagcattagcattttaagtcttcccccctgggaactatttataccattaaaataaggaaggggtaactataggttggagtttaattctaactgtgcatgcagtggctccagggaagaccctaaccttctgaaataaaaacttacaattaagagcttcttgggtcttttgttactgattgactgagagttagataagctagagcttgagtgaggggcttttatcatttttctccagctcatattaaaacagggaaccaaccagcctgcttgtctcaatgtcatcctga

SEQ ID NO: 104000 - DNA, 601 bp, Human
ttaggtgagagaataagtattaagaagtaaggaatgttgacatatctttagagttaaagtgcctttttcaggagacagctggccttctgcctgcatagaccactgagctgaaatgatccatgagcctgtctcaatacaacagcccctactccaatggtgacagtgagaaacacaacttaagtctgagcatctctgttatgctatcataaaccccagtgacacaagcatactctatactctatttgcacttgacccaagattttcaccaaaatagagtgcttttatatgtaaagctacctgratcctcagagcagtattataaaccatttggatttatatcatatgtctgctttttgtaaggtaaaagttatattttttaaattccttagaataaaaaacaaacaaaccccccccaaacctcttaagttttaaaagtaagtcttcgatttcaatttttcatttcaaacttactaaattaaaataacaaaaggggttattcaaagtcatcttcccaaaagggattaaagtcatgagaaagttgtgaatagaaaaataagcagacattcaaatgctttgactttccaactctatgctcagcttc

SEQ ID NO: 104001 - DNA, 601 bp, Human
cacacctcccttccctcggctcagaggacatgttagaggggagaaaagggaggaaagagagaagtgaaggctctattcaaagctgcagtattaataggcttgggggaggaggggcccagatctttgcacctatggattgggccagctttcctgtagcctcagaggcactggggcccttctcaggggataggaggggccatagggacccagctatccccttggagatggagaaactgggggcaatagaggcaacactgtaaggtgaggagggtgcctccatggcatccttcatgccggagcmtgggagtcacagcctctttcccaacccagggttcagccgactcctacaccagccgcccatctctggactcagacgtctccctggaggaggaccgggagagtgcccggcgtgaagtagagagccaggctcagcagcagctcgaaagggccaaggtatactttctgggcatggggcaagacaggaggccaagctaggtggaaacctgcactcggtcctaagtcccaaggggtccttgggcaggatgtccttgagtgtgagagggtgtgtgtgatgggcagaggccacggccttctgctgttg

SEQ ID NO: 104002 - DNA, 601 bp, Human
ggtggcccgaacttggctgtcctttcccctggccccttctgcccaccgccccttgcattgcattcctcagaccagctcagtgactgcctcgctggctccttcacattgaagagccaggactggggcggggcgcttctctcaccaccccttcctgctccacctgcccccagaagtacagcaatgactggtggatcgggcggctagtgaaagagggcggggacatcgccttcatccccagcccccagcgcctggagagcatccggctcaaacaggagcagaaggccaggtgagagttgggccrtgagtcagtaaacacaccccaaacacttgcactgtacccacaggacacgtcaccatgcatgccatacacatgcatatccccctgaaatacacatacacgtatgcccagctctacacactcaacactaaacaaatctacaaacacacacacatattgcatgtacacctgtctcactagataaagcatatggaattgtgtacaattattaaataatgcatagaacatacatacacagagacacattcttctctctctctctttcacctccctttcttctcaggagatctgggaacccttcca

SEQ ID NO: 104003 - DNA, 601 bp, Human
aacagagaggggagggagcccagaacctctggatctgccctgacgccaaccaggcatgagacaggcaccagggccatggtttctactgacctcatgtccattctgcaggcggaacatgttcccccatatgacgtggtgccctccatgcggcctgtggtgctggtgggaccctctctgaaaggttatgaggtgagaggaggtccttgaccccaaagagtcacctctaccaagcctgccacaggaagtccctagggaaagtggaaggggtgtgtctcctccgtccagggtgtgtatgtggagsgcattgactctggggccatgcatggggaggctgcttctctccaaaggggcccttcatcagtgccatgccttcccccaggtcacagacatgatgcagaaggctctcttcgacttcctcaaacacagatttgatggcaggtaagctgccctggcctgaggtggcctgagaaccaaggagaagctcatggcctacttccagatgcctgtagctagtcttctctaagggaagagttagtgggagctgagtaaggagaggctgaggcacaggtttagaagcaagctgtgattctccactcccacc

SEQ ID NO: 104004 - DNA, 601 bp, Human
ctcctgagtagccgggactacaggcgcccatcaccacgcccagctaatttttgcatttttagtagacgtggggtttcaccatgttggccaggctggtctcgaactcctgacctcaagtgatcggcccaccttggcctctcaaaatgctgggattacaggcatgagccaccatgcctggcccctcttcccttttctcttccttacctccttgtctttctgcccaactcctctacctgcccccaggattggcaagaacacacccctcctcctcaattcccattcctctgcctgtccaggcttsgatgaatgcccttttcctccaattccttcctgtccaccattcgggagccctcaaagcctgctggagtgagcagtgggcagagctcctggtgagcactgctgctgcctccctccatagcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtaagtcagctgggctcatggaggaggccca

SEQ ID NO: 104005 - DNA, 601 bp, Human
tgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatcygtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcata

SEQ ID NO: 104006 - DNA, 601 bp, Human
gtgagagcaacctgggcaatacagcaagaccctgcctctattaaaatttcaaaaaattagcctgggccaggcgtggtggctcacgtccgtaatcccagcactttggaaggccctggcaggtagatcacaaggtcaggagttcaagaccagcctggccaagatggtgaaacctcgtctctactaaaaatacaaaaattagccgggcgtggtggcgggcgcctgtaatcccagctactcaggagctgaggcaggagaattgcttgaacccgggtggcagaggttgcagtgagcaaagatcgcrccattgcactccagcctgggtgacagagtgagactccgtctcaaaaaaaaaaaaattagcctggtgtggtggtatgcacctatagaccgggccattcaggaggctaaggcaggaggattgcttgggccctggtggtggaggctgcagtgagccaggattgtgcaccactgaactctagcctgggcaatagccatagcctgaaaaaaaaaaaaaaaaggaaggaaggaaaaaaggagggagggagggagagagggaaggaagggagggaagggagggaaataaaataaaataaaataaaat

SEQ ID NO: 104007 - DNA, 601 bp, Human
cgcttgaacctgggaggcagaggttgcagtgagctgagatcgcgccactgcaccactccagcctaacgacagagcaagactccgtctcaaaaaaaaaaaaaaaccacaaaaaaaacaggtaagttctgttctgcagcacaggctgggtggagaagggcatcatgccagagaacctagcttctcaccctgggatccccaggcaacttcctctctgtgcctgaggcagggtgggcaacaggccacaagccttcaaaaccttgagcaagacagcactctctagttagggtccagtggaggaccmaggcgctgtgctgatggcggggctgtgcctacagcagcgcctgaaggaccctggcctctgctccctgggcaggggggtaacaggagatggcagatccacaaactaacatctctctgaaagggacttcccagaaaccccttcactgggtaccatgccttccagcactccccaaacctccctgcccccaggtgtgaacactgcccagtcgggttctactccactctaggaaagggtggggccccaacagcaacatgagctagatgctatttttattccagctttgcagactgggaaactaag

SEQ ID NO: 104008 - DNA, 601 bp, Human
gagagccaccctggaagagaagctttggggcagaaggacctggccctttaagatgtctgacagtgccctaagggcacgtgctccacaaacaaacgggctataaagttactttttaaaaggtacgttctggcattctggcattctggccaggtgcggtggctcacgcttgtaatcccagcactttgggaggccaaggcgggtggatcatgaggtcaagagatcgagaccatcctggccaacatggtgaaacttgtctctactaaaaatacaaaaattagctgggcatggtggcgcgctcctstagtcccagctactcaggaggccgaggcaggagaatcgcttgaacctgggaggcagaggttgcagtgagctgagatcgcgccactgcaccactccagcctaacgacagagcaagactccgtctcaaaaaaaaaaaaaaaccacaaaaaaaacaggtaagttctgttctgcagcacaggctgggtggagaagggcatcatgccagagaacctagcttctcaccctgggatccccaggcaacttcctctctgtgcctgaggcagggtgggcaacaggccacaagccttcaaaaccttgagca

SEQ ID NO: 104009 - DNA, 601 bp, Human
cagtcctggcctccctgggactgcacctccccagtcaggcactgggcctggctctgggcaccatgccagtcgagagcagggaacagatgcccacccagcccatgcctggccagagaggaagggggaaaggagacaccacctctaagctccttccccaggagggcagtccagccataaagccctggttgagagccaccctggaagagaagctttggggcagaaggacctggccctttaagatgtctgacagtgccctaagggcacgtgctccacaaacaaacgggctataaagttacttttwaaaaggtacgttctggcattctggcattctggccaggtgcggtggctcacgcttgtaatcccagcactttgggaggccaaggcgggtggatcatgaggtcaagagatcgagaccatcctggccaacatggtgaaacttgtctctactaaaaatacaaaaattagctgggcatggtggcgcgctcctgtagtcccagctactcaggaggccgaggcaggagaatcgcttgaacctgggaggcagaggttgcagtgagctgagatcgcgccactgcaccactccagcctaacgacagagcaa

SEQ ID NO: 104010 - DNA, 601 bp, Human
gactgaaataactctgtacacacacatccctatctgactatgagaaaaaatggatgccaggggaccggaggagactccaagctgggcctgggtcactgggtgacactgttcagtatgtctaaatgagtgggtcggtaggggacaaagtctccttcctgtgattgtgagtaggggtggatctgggaaggggctgcccaagtagacgaggaaggaggccacaaaccccacctgtctagaaacccacatacccaaatgggcacagggaatgtttctcagcccagaggaagttgtatgggcagcyctggccccaaggactggcacaggggcagcagtgaatttcgccactgccccaagaatgtgcctatcgagatccactacatgaagctgtagccagacactcctggggagacgggcacagtcctggcctccctgggactgcacctccccagtcaggcactgggcctggctctgggcaccatgccagtcgagagcagggaacagatgcccacccagcccatgcctggccagagaggaagggggaaaggagacaccacctctaagctccttccccaggagggcagtccagccataaagccctggt

SEQ ID NO: 104011 - DNA, 601 bp, Human
caccctgctctgtggtcccttctccatcccccagaaacacctgtgccctcacctgtgctcagccttccctgctgcgacctgcccctcccccagcccttgtccttctgccctgtatccctcaaaccttcttctcaagatcctctctctggaaggtgagcagaaaccggcgcacatggtccttccgcagctgatcaatgctgcgggcatcgatggcacggctcaggaactcatccacctcatcctcagggttcagggcatcttgggtgccccggctgagggcaggagacatggtttcaccagwtgcatgggcatggccatgtgagaaacaatgaaaggaaaggtatggacagcacctgagggagggagggagagccaggggggtggctcctgctcccacacaacactcctaaggtcagggaaaaggaggatctcggctccccccagccccatcccagggtgcaagtgccttctccctcctcagtaacctgacttacttgtctttgctggaatcatcaatgccctggagaaagggacagagtgtggagtgaggtgaagggccaacaaccttcatctctgcagctccttcccccaccccaacact

SEQ ID NO: 104012 - DNA, 601 bp, Human
gcatcagggtggagctggggcagaacagggccagaaaaatcatttaattctggaagatctgggcattcttgtcccaccctctggaacaagcagggatgcaggctccagggattgtgggcttgtgtgggtatttaggaagcttctgggaagtggtgaagagagaagctaagagaggaaaggcagggctctcactgtgggaagatgagaagctggatgaagcagatgaagcagaagaccaacagggcacaggcaacgtaggctccgaagcggggatccaccttccgggagtactgagggagasgaggctgagctgagtgctgggccctccctaaggaaggcagggacagcaaggacagggcactaccaggggtctcaacagggaggagatgcagttggctcaactgatgaaatcctcaccctgctctgtggtcccttctccatcccccagaaacacctgtgccctcacctgtgctcagccttccctgctgcgacctgcccctcccccagcccttgtccttctgccctgtatccctcaaaccttcttctcaagatcctctctctggaaggtgagcagaaaccggcgcacatggtccttccgcag

SEQ ID NO: 104013 - DNA, 601 bp, Human
gaagacagagctggccaagagactcagcagcatgttcccgatgaagtactgcgggggtggcagaggcagcgttgggtgaaggcagaggccacagcacccttgggcagggagagccctgcactctcctgcctgacctaaccttcccaccacacccctcaaacccccatatcctccaccttccatgcccagcccctacaacacaccagggcccctggttgctcctagtgtgggagactctggtgagttcctgggtccccagcgcccatcaccaggcctggcacagaagggccaatgtctgtgmcaggacagcccccccaccgcctgagcactgctcgaacacctcaggaaagctgcaggtgggcatggtgccctcacacaggggagcatccaggcccagagagtaattgagctgctgcaggtggcaggcagtgatgtcagcaggtgttaaattcagcatccgggctgcacagctccgtatgggggtgtggttacaggtgaactgcaaaagtggaggggtatatcagggtaaccaaggagggaaagggttgcaaggtacctggtgaagccatgtaccctaacctgggctatgcccaggtacctt

SEQ ID NO: 104014 - DNA, 601 bp, Human
ccccaagcaggaatcagaagctttggttcctaaccagagccctgccaccaagcagctgtatgtcctataggtggttaagatggtggatgtgaaagcaccatgcaaatgtaagagggaatttttttttttaatgtctagcctaaagacacaaggatttcccaggactagggtttccttgggggtaactatttggggtcacatgctgggagctcctccatctcctccctttcccccacaggggtgttgtggcattccaaggcacaaggggcatgggcaccagagaggctcacagtgacctagmaaggtgagggaagctcctggggtattaaaggacctgagaataaactcacaagccatggacgccaagcagtaggtcatagttgtcaaagatggtggctgggggacccagcagaagcagcaccaaatagatgagccccaagacaaagatcatggccaacttcccgatgctgctgatgtgcaggaagacagagctggccaagagactcagcagcatgttcccgatgaagtactgcgggggtggcagaggcagcgttgggtgaaggcagaggccacagcacccttgggcagggagagccctgca

SEQ ID NO: 104015 - DNA, 601 bp, Human
acatatcaaaggaatggggttttgcagaggaaaagccagtgtggtgtcccaggcaaagcccccaagcaggaatcagaagctttggttcctaaccagagccctgccaccaagcagctgtatgtcctataggtggttaagatggtggatgtgaaagcaccatgcaaatgtaagagggaatttttttttttaatgtctagcctaaagacacaaggatttcccaggactagggtttccttgggggtaactatttggggtcacatgctgggagctcctccatctcctccctttcccccacaggggwgttgtggcattccaaggcacaaggggcatgggcaccagagaggctcacagtgacctagaaaggtgagggaagctcctggggtattaaaggacctgagaataaactcacaagccatggacgccaagcagtaggtcatagttgtcaaagatggtggctgggggacccagcagaagcagcaccaaatagatgagccccaagacaaagatcatggccaacttcccgatgctgctgatgtgcaggaagacagagctggccaagagactcagcagcatgttcccgatgaagtactgcgggggtggc

SEQ ID NO: 104016 - DNA, 601 bp, Human
ttaactcattaagagtagaggttaagaaaacctctgctcttagagactcctctacttaccagctatgtgacctgagacaagtcgcttaactctctaagcctccttcctcatcagtacaacagggatcagatctaaataatgtatgtaaaaggcttagcacagtgcctgccatatagtcagccttccataaatgttagttactataatctttacaactaccctgtgatttaggtgacattgccattttacagatgaagaaattgaggctcagagaagctaactcacctgtctaaagtcacayagctaatgagcagcagagcagggattcaaacccagcagagaccagaggctttttctactacaacaagctatggccacatatcaaaggaatggggttttgcagaggaaaagccagtgtggtgtcccaggcaaagcccccaagcaggaatcagaagctttggttcctaaccagagccctgccaccaagcagctgtatgtcctataggtggttaagatggtggatgtgaaagcaccatgcaaatgtaagagggaatttttttttttaatgtctagcctaaagacacaaggatttcccaggact

SEQ ID NO: 104017 - DNA, 601 bp, Human
ggcattgggccagggcttttacttacattaattaactcattaagagtagaggttaagaaaacctctgctcttagagactcctctacttaccagctatgtgacctgagacaagtcgcttaactctctaagcctccttcctcatcagtacaacagggatcagatctaaataatgtatgtaaaaggcttagcacagtgcctgccatatagtcagccttccataaatgttagttactataatctttacaactaccctgtgatttaggtgacattgccattttacagatgaagaaattgaggctcrgagaagctaactcacctgtctaaagtcacacagctaatgagcagcagagcagggattcaaacccagcagagaccagaggctttttctactacaacaagctatggccacatatcaaaggaatggggttttgcagaggaaaagccagtgtggtgtcccaggcaaagcccccaagcaggaatcagaagctttggttcctaaccagagccctgccaccaagcagctgtatgtcctataggtggttaagatggtggatgtgaaagcaccatgcaaatgtaagagggaatttttttttttaatgtc

SEQ ID NO: 104018 - DNA, 601 bp, Human
cgccaagcaacaaagccctcttaccaatcttcatctggaaattgttgaaggagtgctcattgatgtgcttcatctgctccatgagccgcatggcgtagtcagccagggcagtgatgtgggagcggcccacctgatcgtaggtgctggcgttcagccctgaggcagccatgtaggtgctaccaatcgtcttgatcttttccagctgccggaaccgctcctcgctgataatctgaacaacacaaggagacctggctgtcaaggcaaagaccccagacccagccctgccccaacactcatttcytgccacgccttggctgccttccccacttccctgtctcaagagcccccttccagctgctgctatcagtgtaagactgaggagctgggaaaacaggcagcctaggactccaggcaggacttgggcatacagcttcagaaggtccctccagtagctcactcacagaacacagacccacaagtgcaatattaagcaatttctccaatccttaccttttgggatactgagtcccagagtgagcaagtgacttccctccagaacagtgaacagcccattcctgatctggatgttcaggacactacc

SEQ ID NO: 104019 - DNA, 601 bp, Human
aggcgtgagccactgcgcccggcctaatttttttttttttttttttttcagtagaaaaggggtttcactatgttggtcaggctggtcttgaactcccgacctcatgatctgcccacctcggcttcccaaagtgctgggattacaggcatgatccaccgcgcccggcatggcttcatcctttcaacacctctaaaaggtaggtattattatccccattttatagataaggtaactgaagcttagagaagttagaagacttctcaaataagccagtaaatggagcagccagaattcaaaccamatagtccatctctagtagccatgctattaaccactcccatccaccagttcatttgagaggaaatacctcttattggactggtcacagataaggacagaagtattcaagtttatataaacctgatttttaatcccagctctgccacttactagttgtttgaccttgggcaagttatttaatctctctgagagtcagtctctatccaatgaaaggcgataatagtatcaggattaaaatatgctcaaaaatttataggacagtgcctaatgatctctgttcttaatatcagacttgatatag

SEQ ID NO: 104020 - DNA, 601 bp, Human
cagctccacccagtgagcacagagtccactcaatgcccaccttggtcccttcagctgaatttgtggctgggccctgttaactgctggggcccccattgaggaagtaggtggtcatctcccccttgcccttcaccttgaccacccctcgacactccagctggtagcccttggcagctagaacctggtacaggtccgtggtcacctgggggagtgggaggggagcccgcttagcctggaatccttcctgctgcatttgcaggggcccaggggttctctagtcaggctagctcccttcccccartccctgccccaccatacacagaacactagccaccctacccctgtcctagcagactgcagagacacctgtggaagccctccgggcccatgttcctcccagcccctgctcatatccccctcacctggattcggtcggggacccccgtgctgtccatacgactagagacattcactgtgttcccccagatgtcatactgtggcttccgagccccgatgacacctgccacgactgggcccatgttcagccctgaggtggagagaacagcaagagactagtggatgctccagggtaaacccaggg

SEQ ID NO: 104021 - DNA, 601 bp, Human; identical to SEQ ID NO: 104006

SEQ ID NO: 104022 - DNA, 601 bp, Human; identical to SEQ ID NO: 104007

SEQ ID NO: 104023 - DNA, 601 bp, Human; identical to SEQ ID NO: 104008

SEQ ID NO: 104024 - DNA, 601 bp, Human; identical to SEQ ID NO: 104009

SEQ ID NO: 104025 - DNA, 601 bp, Human; identical to SEQ ID NO: 104010

SEQ ID NO: 104026 - DNA, 601 bp, Human; identical to SEQ ID NO: 104011

SEQ ID NO: 104027 - DNA, 601 bp, Human; identical to SEQ ID NO: 104012

SEQ ID NO: 104028 - DNA, 601 bp, Human; identical to SEQ ID NO: 104013

SEQ ID NO: 104029 - DNA, 601 bp, Human; identical to SEQ ID NO: 104014

SEQ ID NO: 104030 - DNA, 601 bp, Human; identical to SEQ ID NO: 104015

SEQ ID NO: 104031 - DNA, 601 bp, Human; identical to SEQ ID NO: 104016

SEQ ID NO: 104032 - DNA, 601 bp, Human; identical to SEQ ID NO: 104017

SEQ ID NO: 104033 - DNA, 601 bp, Human; identical to SEQ ID NO: 104018

SEQ ID NO: 104034 - DNA, 601 bp, Human; identical to SEQ ID NO: 104019

SEQ ID NO: 104035 - DNA, 601 bp, Human; identical to SEQ ID NO: 104020

SEQ ID NO: 104036 - DNA, 601 bp, Human
tgttagttgaatcatatgaaattatcctttttgtagatctgaaataaacaaatagtggaaatttcatatggtccaaccagaaaactttaataatggcagggttttatcttaaaccatccttacaactcatttcaaataattctaatcactcaaactgccctgtcccctccactggtttaatttctggtttttgttttgtttttaaaataacattgtttaatactacgttctctagaggaaaggtccaaacaatgccaattcaatatacccaccaaataaaccattaaagttaatttaatcrtatgaaaacatctagatttccttcattcactcaccttttaattcattcaacaattcttattttattttattttatttatttttttgagatggaatcttgctctgtcgcccaggctggagtgcagtggtacgatctcagctcactgcaacctccgcctcccgggttcaagggattctcctgcctcagcctcccaagtagttgggactacaggcacgtgccaccatgcccagttaattttttgcattttttagtggagatggggtttcaccacattggccaggctggtctcaaattcctgac

SEQ ID NO: 104037 - DNA, 601 bp, Human
aacaataaggaaatagtgaagaaaatacgatgcatggatgctatggaagcttacatagcaattaaaaacaatcacaaaggctaaacatgaaaacaatgcttacaataaaatattaagaaaaaaagcacttgaaactttttaatgatatgttttatgttttgattatgatatgacttatgtttttatgttaactataaaaagatagtaaaattttttacacttgtaaaaaatgttggattggaatataaagaagtgagaatgcaatattattgggctggcttggtaggaattttgaaaaaawtttaattaaattttaacttccgtcagtgatttttatatctttactaaaatatctcaaactaagagaacagaaaaatgttggctacctgaaatatttatttagtaacctggatcaaaccagactaatagtaagtatcttgcttttttttctttctatattttgaggaaactgggtgattggatactgtggtttatactataatccagtcttttgctacctgatgcctttcattagtttatttttagttcattagttaacaatctccaacagtgttagccttgcttattttccgctttcctc

SEQ ID NO: 104038 - DNA, 601 bp, Human
gtgaagaggcaccattgccgccatctcacagaggaagaacagggctctgaggtggggaggggaaggcggctcaggacttctggctccagagcctcctctccttccaccatagtgcctgctccagaggagacacaaaggcttggagatggtaacagagagttagagaaacattttctttccttgatgggattgttttcaacagaagtctagagcatcctgcaaaatgctgttttactttaacctattctttcaaatgtcattcctggatttgcccaagaaagtaacaaaagctacatatgtraagattttcttgtaggattagctaaaataacaaaaatcagaaatagtccaaatgtacaacaataaggaaatagtgaagaaaatacgatgcatggatgctatggaagcttacatagcaattaaaaacaatcacaaaggctaaacatgaaaacaatgcttacaataaaatattaagaaaaaaagcacttgaaactttttaatgatatgttttatgttttgattatgatatgacttatgtttttatgttaactataaaaagatagtaaaattttttacacttgtaaaaaatgttggattggaa

SEQ ID NO: 104039 - DNA, 601 bp, Human
tcgtaggcaagtcaccagacctacgagcctcactttcttcatttacgagaagagatagatcctgctgctttttctgctatttgccataggatggttatgaggatccagtaaacaaaggcatggaaactcattttgcaactgtaaagggatggctgcactcagagaacggcggtctggactggcaagggtcctgcttgtctttgttctaatgctttctatttatttttttctccttgagcctgaaaattagttgctgagtagcacaaatcaaaacaggcaagcaaagtggacagtgcaaacrcctaacattttcaccactgcaatttggctgcttcgggcagtaatttgctttctcttcaagtctgttctcaccaaccgaagtccttgcacggcccccaataaatctgcagccgacgcacaagcagaagggatggactttgtccttggatttttcacagcagaggctcccacttagaatgttaaaaatattgtggtaaggtgagagcccagatttaaaaagtatttggagaggcaaggaagaaggaagttcaggctctgaattctgagagccaatacctgtggggtggggtaaggatcgggg

SEQ ID NO: 104040 - DNA, 601 bp, Human
caggtgaaccccaggctaaaatatgacgtaaataattgtgaatagattatagacatttgtcattcaaagataactctcccagtcctggaggagttagtgaaaaaacaaatctcaattcagagtctgtgcgtgacggtgtgctgttcttttagagaatctcatacacataaaacctttcacaccatatggagatccactcttaccaagcagattaattacaggcaatttattcagggcaaaacctctcaaatatgatttaatttacattttacttataacctctgcatacagtggggtggtragcggtgtgcatacctgcacacacaggagtgggttgaactgcaaattgaggcgcatccctctaaggaagttccagaatagatgcattttctgagagtaaaatggaaactatggatttatcagctttggagaaaatgtaagttctccatttagaaccatcataatacgttctagaaaaacatatagttctatattaataacctaatattcatactcagcagaaaatgtatattaaatgagaatattcagcatcaaaataattattttttactgtaaaaattgagaggaaaagagtaagtgc

SEQ ID NO: 104041 - DNA, 601 bp, Human
gcagggagatggatgggtgagcgatggtggatacaattatttgactttctgagctgttcttttgaagcctctatgtttaatagaaagaaaaaggataatcctctttgccaaccttttgtagctcaatctttattgttcccaatgaaacccaaagaaaacggacaagattcattttgtccagaaagcatttgtgtattttatgtaggtctgggctttgaagtgttgatagttaagtgggagaaaagacaaagatttctctcgactctgtggaaatcaaaggaggaatttctgaagctctctyggctgactcaaaagtcctgggtggtatcctccatatatgcttcctttgctactaaactcagcatggaaattagcacaggccccacacaatgatgaaaattagatgagaccataaagaagtgagcctgaagacaaatttagacttttttgcaaaaattgagaacatggtttccgggaccagggacactttcttgtgcttatgggctctcaatcatttaaccttcatcttcaaaacactggcctggccagtgggctggttgagccaaccatctacaggactgttggtttgatttggggcaca

SEQ ID NO: 104042 - DNA, 601 bp, Human
cctcccctccccttccctttctttttctctcactctgttgtccaggctaaagtgcagtagtattatcacggctcactgcaacctccgcctcccaggctcaagcatttctcccacctcaacctcccaaatagctgagactacaggggggtgtcaccgtgcccagcgaatattttctctctctctcttttttattttttttgtattttagaagagacaggtttttgctatgttgccaaggcttgctgtctactcttcttatcactgaaggtagaactaagtggcagcacccctaacccctacmccagcctaatcacgatattgccacaggccacttctgactacaaagtagctacactttacatgagagatgcattcctaaagactttgcaaaattctgattaatttatcataggaataaatgtaaaatcttacattatcttgaatactacaaatagtgagaccttatgaatttttagattgcatttttttcaaatttacataattcagaactccattaaatatggcttattgtatgttccctctgattttttttttttttttttttttgagatggagtcttgctctgtcgcccaggctggag

SEQ ID NO: 104043 - DNA, 601 bp, Human
tctcctctccctcccctcccctccccttccctttctttttctctcactctgttgtccaggctaaagtgcagtagtattatcacggctcactgcaacctccgcctcccaggctcaagcatttctcccacctcaacctcccaaatagctgagactacaggggggtgtcaccgtgcccagcgaatattttctctctctctcttttttattttttttgtattttagaagagacaggtttttgctatgttgccaaggcttgctgtctactcttcttatcactgaaggtagaactaagtggcagcamccctaacccctaccccagcctaatcacgatattgccacaggccacttctgactacaaagtagctacactttacatgagagatgcattcctaaagactttgcaaaattctgattaatttatcataggaataaatgtaaaatcttacattatcttgaatactacaaatagtgagaccttatgaatttttagattgcatttttttcaaatttacataattcagaactccattaaatatggcttattgtatgttccctctgattttttttttttttttttttttgagatggagtcttgctctgt

SEQ ID NO: 104044 - DNA, 601 bp, Human
ccagaagtgccatttacttataacagggcagcttgtcagcccagaggacaggcagctagagcaagaatcaaaagtcctgggtttaagggctgaatttgccatttgcttatgacatggcaatttcttgatctgtattatttttctctagggccatcatttctcccctggtaaaatccagaagtggaacttgaaggtatctataatactttccaggtcaaatattccgagattctgacataccagcccagtcccactctggtcacagaaaatcttcccagagagacgccatctttcttttttcttttcttttcttttctttcttttcttttcttttcttttcttttcttttcctttcctttcttttcttttcttttttctttctcctctccctcccctcccctccccttccctttctttttctctcactctgttgtccaggctaaagtgcagtagtattatcacggctcactgcaacctccgcctcccaggctcaagcatttctcccacctcaacctcccaaatagctgagactacaggggggtgtcaccgtgcccagcgaatattttctctctctctcttttttattttttttgtattttag

SEQ ID NO: 104045 - DNA, 601 bp, Human
ctatttttgaaaagttaatatatctgtcgattctacaaaaatccaataaatgaaaattcatactcatgaaaacaagtagattagaagaagagtcctcacaataccaaataactcacgacagcttttctttaaatattctacctatatttacatattattataatattctcttgcacaaaaccttccaagggcttcctctggtgagtgaagattcccttgtacatagctgacattttcttttctttttctttttttagagacagggtcttgctctgtctcccagcctagactgcagtggtaygatcatagctcactgcagcctggaactcctgggctcaagcaatcctcctgcctcagcctcctgagtagctttttttgttgttgttgttgttgagatacggtttacataccataagacattgtctgagcctagatatactaataatacatggtatttttgtcacttcttcactcattaaacttttactgaacatctttatagactaaaagcactctggctaaatttacttgtatgtgtttgcatgtatgtgtgtgtctatagctttcttgctgcctgcctgcctgcctgcttcgtttctga

SEQ ID NO: 104046 - DNA, 601 bp, Human
tggggtagggattagagtcacggctggtgtttcctggttttctggggcagaaaatcctattcctaccaccagatcttccctttgctaattcccttctccatgtggcagacaaacctcaactcctccctccaagtccgtgacaagcaaatatgagggagacccttacctctgggctcccggggtgctgtgtataggcaatgcggttcatggcggggggagcgagggcaggctgcctggggccaaaggctggctgtgctcctgctagccatggacccccagggctgaattccccacctatcawgtggggacatcaataaaagtgccacaggattagttgacctaatgcatgcaaacagcacataaaacaagccccggcatcacaagtgttcacagttaccacccctctatcactttaccagccaggcatatccctctcctctagaaatgtgagtactttgagagcagcaactgtaatgcagccgctgacatacaatcgcttgctcagaaaatacactgaaagtgaattaatgcgcagctatgttctgcattttatttctatctctgataatatttctgacgatgaaatgtatgattaaaacag

SEQ ID NO: 104047 - DNA, 601 bp, Human
tcaagaagtgccttcctatcctgcccatctgctcacatttctatcactgcagctcacagacttcggttgtctttcacaccccaggtaagatcaactgctaaaaccaacaatgccttgacatccttctacatgaatccacatcttcctaacatctattttggaatgctcaggtccctcaggagtcagaagagcagggacactgggtgaggccaggtgaagagggcctcaagggagctgaagatgagcacaggcttcagggactgtcaaaagagtcttgcgatcagccacagacagacatggycactggcaccctcctccatggagatgcctcagacactctatttggcctttctacctttccattcagtcattcatttttgtaaaatgtacagtaatcgaaaacatttattacagtgctgctatgggcctagctccatctgggcccattacacacattttctttaattatcccaatgaccctgcaaggtaggtaatcttcattttataaagaagaggacagtttcagagaggtcaagaaacctgcccaagatcacgttgctgggtagtgataaagccaaaactttaatttaggtctgattgc

SEQ ID NO: 104048 - DNA, 601 bp, Human
aggcaagacaagaagtctaatcagggactgagtcggttagaagtttaaggattgttcctaaatggttatcagctccatctgttggacagcaggctggtggcaggggtgtgggtgacgtgtaccacatcacccaggagatctccatcagaaggagatagccctggaacttaggaatctttacggggaggcgggtgatgaaaaaagcaggccccggagagcggggacactgacagtgaggggagacctagcaaccctactgccaggagtgcattccaaagaaatagccacaaatgtgagcacrgatgtatgcacaggaatgtccacagtgacactattcataatgcgtccaaacatgaagccatctaaatgtctgacaaaagacagtggtaaaataaattacggcattttacaggcactaaagttgatgtagagacatagttcatgacagggagagatgaccatgatttattgctaagtaaaaagaacagttacgaaataaaatgcacatatccaagcctagaaggacagtcaccaacatactaatcagtcttgggggtaacattttttaaaatgatttttattttctctttgttcttttcta

SEQ ID NO: 104049 - DNA, 601 bp, Human
aggaagaaggaacctagacgatctctggctgggccaagagagaaattagcaaggccagctgacaaactgggcctcctgcatggggctgagaagtgggtaagggttgggagggagaagggacataaccagggataaggcaagacaagaagtctaatcagggactgagtcggttagaagtttaaggattgttcctaaatggttatcagctccatctgttggacagcaggctggtggcaggggtgtgggtgacgtgtaccacatcacccaggagatctccatcagaaggagatagccctggaayttaggaatctttacggggaggcgggtgatgaaaaaagcaggccccggagagcggggacactgacagtgaggggagacctagcaaccctactgccaggagtgcattccaaagaaatagccacaaatgtgagcacagatgtatgcacaggaatgtccacagtgacactattcataatgcgtccaaacatgaagccatctaaatgtctgacaaaagacagtggtaaaataaattacggcattttacaggcactaaagttgatgtagagacatagttcatgacagggagagatgaccatgattt

SEQ ID NO: 104050 - DNA, 601 bp, Human
tgggttgacttggatttggggtcaataaacatagcggctccactacactagtgtgaggaggacctcgggagaaatcgcatagctccctgggctgcagttttcccatctgtgatatggggataatgtcctcaccctgtcgacctcatggggctgctgtgagggtcagatgagaaaatgggtggggaggtaataattagtgaacagcaccattcaaagctacagtggtcttattgctgtgttttcctaattgtattttgcactgtggctttacacagcccatgtctctggattgttaaaaggmtcaaaaaagatcatgagtagtgcattcctcggcattttgtatctcctataattcctggatacagataaatgtttattaaagaatgtgaaggtctcatcaaaaaccaagcatgagaggcaagacaattattacctcagatcacatacgccttggatttcagagctggaaagagggttagagacctattccaggactttactctacagcaaagcagtccgggttccagagagcccaggtgacttgccttggctgggctggactctgttctctccccacctggaccttgtgtccgaggagcag

SEQ ID NO: 104051 - DNA, 601 bp, Human
tgcaggtgcagcctccgggacccaggactttcttctcagggctctgctgagttgggtgggggaggctggaggctgcaaaatgatgacagagcttggggctatgatctggactgggtacccagagctaataggagaagaggacaagcagggggacagaactgagtcaggagacactttagacgatggagggttgggggatggaggtggctagtgaataaaacacttctgaagggtctttgctgcctgtgttgatggccatgatcaattcggatccccagggccagttcagcaaaacctctgycaacaaatagaggatttgtttaatcttttctgaaagagtccgatgttatctaagtgaggactggccaggtaattggaacgttctagagactgttgggttgacttggatttggggtcaataaacatagcggctccactacactagtgtgaggaggacctcgggagaaatcgcatagctccctgggctgcagttttcccatctgtgatatggggataatgtcctcaccctgtcgacctcatggggctgctgtgagggtcagatgagaaaatgggtggggaggtaataattagtgaacagcac

SEQ ID NO: 104052 - DNA, 601 bp, Human
aggcttaacccctgcggcgccaactagaccaggagaccttgcctctctattattctcccactggctgttgcttatttttgttagtccaatattttccactgctctcagagacaaaggtaggcaacagtttgcaaaatttagacgcttatgtgtgcacaaaggaaaaaaagaagaaagaaagaaaacaacagtctggtgagcttctgtgaagcttcttaactagcagggaggggaattttcctttctggtcacgtaggctgctgtcttcggcttcgattcgtaagccacctcccaagccccsattagccccaggtaggggacatcccatccccctaaacctccttcttgaactgacagttcacccctagaaggaggtgggaaaccactcagatccatctcaaagggatgcctaccagggtaggtgtgtgggaggaaggctgagcccatgctgtgttcaggggcccccccagaaggtgtcagcctggaggaacatgccccacagttataaaaggcatcattccaggagctatcatggcgtctgctaggggcagagaggaaggggaggcaggaaaggggctgagtattttggggctgtatgctt

SEQ ID NO: 104053 - DNA, 601 bp, Human
aaataagccagacacagaaagacaaatatggtatgatttcacttatatgagttacttaaagtagttaaaatcatagagacaaaaagtagaatagtggttgtcaggggctgggaggaggcgggaatggggagttatggtttcatgggtacagagtttcagtttcgcaaaatgaaaagaattctagagacggatggtggtgatggttgcgcaacaatatgaatgtacttgacaccactcaactgtgcgcttaaacatggctaagagggtaaattttatgttatgtgtattttaccaggcaaamaaacaaacaaacaaaaaacctggaggaaaaattagcagcctgtgctatgaaaattgcctcaggtgtaagacagtcttgtcagtattggagcgtgctcacagttgacatgtgtgaaggaccaggagagccggaagaggtcagcaggctcagggggtgctgttagcctgtttcaccgacagaaaggcttaacccctgcggcgccaactagaccaggagaccttgcctctctattattctcccactggctgttgcttatttttgttagtccaatattttccactgctctcagagacaaaggta

SEQ ID NO: 104054 - DNA, 601 bp, Human
aattatatttgaggccgggcgcggtggctcacgcctgtaagcccagcactttgggaggccgagttgggtggatcacgaggtcaggagtttgagaccatcctggccaacatggtgaaaccccatctctactaaaaatacaaaaattagctgggcttggtggcgcacgcctgtagtcccagctactccggaggctgaggcaggagaatcccttgaacctgcgaggcggaggttgcagcgagccgagatcgcgccactgcactccagcctgggcaacaagagcgagtctccgtctcaaaaaagaaaaaaaaattatttttgaaggtcgggtacagtgactcacgcctgtaatcccagccctttgggaggctgagacgggcagatcacttgaggtcaggaattcgagaccagccttcgtctctactaaaaatacaaaaattagcctggtggggtggtgggtgcctataattccagctactcaggacgctgaagcaggagaatcgtttgaacatgggcaggagaactgtttgaacatgggaggccgagattgcagtgagctgagatcacaccactacattccagtctgggttgacagagcaagact

SEQ ID NO: 104055 - DNA, 601 bp, Human
agacctcacctgggggatggagtgggatgaggaccctgatcagacactgaggggaaccggatattgaaggttgatggttgtgctcaactaactgggcagagttctttgctaaacctggattttgcaagaaagtacacagatgggcctaggagaaagtttggaagcctgattaagtttttgtcaagcagggaatctttagcagttgacataatgacaatattgagagatttttgaaaaatattctctctgatggagcccaacaagtatttccctttctgcatgtgcgtgcgtgtttttatgycacgtacgtgagtatgttcttgtagctcagacagctccgaataaaaacccagggaagcgagggtgtgctgagcccagggagggcctgccaggagggttttctgaaggatggctgtgggccgggcctcttctgagagggctgagggcagctgcttcccttgccgtttgattcattagtccacacctcgtggagaggtaacttgaaaggcagcgccgagaagcacgtaatggatttgtgaggttttaacaccggacagcagacaaaagactaataaaaatccggggcaggaatttcccaaga

SEQ ID NO: 104056 - DNA, 601 bp, Human
atacctgttaaagcacagtaaggcagacttcattcaaaactgtcatgataggtataaggatgattgcaatggggtcttgcagtgggacagaaagattgggctcaactccaagtacagcaagtgggcatttatgccaaggagcagagtagggggtcaatggatagaaaattcccaaaaagagtgagagggattctggctaaaccaacctaacaggactctagctgaacacaggccagggggatcagacctcacctgggggatggagtgggatgaggaccctgatcagacactgaggggaacyggatattgaaggttgatggttgtgctcaactaactgggcagagttctttgctaaacctggattttgcaagaaagtacacagatgggcctaggagaaagtttggaagcctgattaagtttttgtcaagcagggaatctttagcagttgacataatgacaatattgagagatttttgaaaaatattctctctgatggagcccaacaagtatttccctttctgcatgtgcgtgcgtgtttttatgccacgtacgtgagtatgttcttgtagctcagacagctccgaataaaaacccagggaag

SEQ ID NO: 104057 - DNA, 601 bp, Human
acaatactactttctagctgtgttcccctgaggaactcattcaaactcagtttctccagctatcacatggaaataacaattgttaccccaaaaggtttgttaaaggcacaaatgagatgataatatgagcactctattgtaaagtggaaatcaggatacagctataagagatgatgatcatacattctaagaaaattttgaagataattttactgctaagatgtgttaaagaaaaataattcaatgatacctgttaaagcacagtaaggcagacttcattcaaaactgtcatgataggtakaaggatgattgcaatggggtcttgcagtgggacagaaagattgggctcaactccaagtacagcaagtgggcatttatgccaaggagcagagtagggggtcaatggatagaaaattcccaaaaagagtgagagggattctggctaaaccaacctaacaggactctagctgaacacaggccagggggatcagacctcacctgggggatggagtgggatgaggaccctgatcagacactgaggggaaccggatattgaaggttgatggttgtgctcaactaactgggcagagttctttgctaa

SEQ ID NO: 104058 - DNA, 601 bp, Human
gcagttgggaggtaaattaaggggcacaagctcaggaatccctcctttcagtcctgtcaccagccccaaatccaacccaccaagaatggtgggtataattcatcttaactatttcccaccaaaacaatatgacttttactctctgcctccttctggctgagctctgagaccaagagggctgtggatgttgggggtggggaaagaaactatggagctgccaaggaggttgaacaaccaggtaattaactgaaagaaaacgactggaggctggggaggggagggttaagagtcattgtgggcygccttccagaagcctccttccacggcccccactgccatccacacaccactctgacccctgcaaggacacaccaccatgctccgaggggcaggtggcctcagctctgctgctctcaagacagcaagagaacaggcattgtcaggccaaagaaattagcaacatggaaaagtgagtggaaagaaaacatgttttcatcacaagatcaagaaactggtttggttcttgcaccagccccctcggttgtcaaatgagaagtcaaattcagaagggacacaggacctgcccgaatcaccacagcca

SEQ ID NO: 104059 - DNA, 601 bp, Human
gccaaacactggccctgtcctgaatcctttagtccccatccttcagcacccccttgtgagggacaaccaggcacatcacaccctcatggatgcagatggcatggactccttcacttggttacaacccacactcacctggggtcttttctgccttctgtggacctattggaagatctaaggggggcatttgaaaatgaaaagggagcttgcagggagagcagccaactcagcccatccaagagcagacagacccctgcacgccctgctcacagctctgtccctgtgccgctgtggcctggcrctgcgtctggggagctcagtaaatatttgttgagtgaatgaatgaatgggatggcctgaccgcttgacattgcagaaggagaaggacaaagtggagaggctgaggtttgtttttgggtggggaagctcccatcttggattgtagtgggggtggaagcagaagcaaaaacctagtctagggtgtggattgagggagacccaggaaaacgacccactcacacacctgcctttcctgaaacactgagagctgcctgagattagggagctgccttactcctccttttgtcagcatgctggctgg

SEQ ID NO: 104060 - DNA, 601 bp, Human
tctgggaggtggcacaatgtgcccagtgatgacgatgacaataactatgaaaggattttatatttgcacagcattttgcagcagtgcccctcagctttgaacccagggcatgcactgagtccaagaaggggttcccctccccactccctccccagcacacatcaccttagccacttccggaggaacaggagaaatggcttgcccacttggctggctgcagtggtagcaggaggcttcctgaacagaggctgcccagactgcccacagcaagtgtcccactgctctgccaccgctggtgccrtgtgggagtcaaggctggggagcctgaatggtgggccaggccgggggccgtggggttcagaggcagagtggagaatacaaaatcgcaggtgagatcacagctctctcaagcctcattcctcgtgccccacacaggcagagtcttgagtcctccctttgttcctttcttgtttctctgggggtaatttggccttttagagaccacttcctttacccccaatcagcagacaccaccagctccctgcccatcttccttccctctgtttcctcctcttccctataggctgactgtgttgtgggg

SEQ ID NO: 104061 - DNA, 601 bp, Human
agtgcctgctctgggaggtggcacaatgtgcccagtgatgacgatgacaataactatgaaaggattttatatttgcacagcattttgcagcagtgcccctcagctttgaacccagggcatgcactgagtccaagaaggggttcccctccccactccctccccagcacacatcaccttagccacttccggaggaacaggagaaatggcttgcccacttggctggctgcagtggtagcaggaggcttcctgaacagaggctgcccagactgcccacagcaagtgtcccactgctctgccaccrctggtgccgtgtgggagtcaaggctggggagcctgaatggtgggccaggccgggggccgtggggttcagaggcagagtggagaatacaaaatcgcaggtgagatcacagctctctcaagcctcattcctcgtgccccacacaggcagagtcttgagtcctccctttgttcctttcttgtttctctgggggtaatttggccttttagagaccacttcctttacccccaatcagcagacaccaccagctccctgcccatcttccttccctctgtttcctcctcttccctataggctgactgt

SEQ ID NO: 104062 - DNA, 601 bp, Human
ggtctcaaactcccgacctcgggtgatccacctgcctcagcctcccaaaatgttaggattacaggcgtgaaccaccgcacccagtgagctaaccaatatgctaatgacttcagttgatcaaccacagtgtccagtgaagaaaatcagggctcttctcagggtggtggtatctagaccctaaaaatagcctccctccccctccctaccctgctttcccaccaaccttgaagattctgatattttgttaaaaattcatgctagtttttcccacaagggagctggaatttattatcatctcctrtgttcctaacactggttataaatgtttatttcatttaatcctcagaactggctcagaaaataggccacactctccccatctcatagaggagtcagaggctcagagagattaacttacttgcctgaggtcacacagctagttggtagaggagctcttccataagatagcaaggccacatcacctgcagggcagtgcctgctctgggaggtggcacaatgtgcccagtgatgacgatgacaataactatgaaaggattttatatttgcacagcattttgcagcagtgcccctcagctttgaa

SEQ ID NO: 104063 - DNA, 601 bp, Human
agactctgatgatcaagaaagaaggcgggtcttccctcaccaacagccaagaggctgcttgagagtcaaggcagcttcttcagggctttgcctgggtttgttctgaatctgccctggcctctgtgggggtggggtggagtgaacgtctttcctctctgggtgtcttccaaacacacttctgcactaagagttgccactcccttcctttctcccctcagcctctccagaagcaaagcccatgctggctggggccagggactgacttctaagagtggagaaccgtgactccacagcaggggaracctagctgctatgaaagcaacaacttctagggaggctgggacctcgggcctccagcaccatggaggaccatggagtgaccttaaggaatccttctggacaaatatccaaagggctgtgtgcctattcacctgggagagaggccttgggctgcccgtaccctgggaagggaagatgaggtgagggtagtttatccggcccaggctaccacagcctgttaggacagagcccaggtctattcaaggatgggtgaaaaactaaaatgtggggagggggaaggtctgggtaagcccttgtttgg

SEQ ID NO: 104064 - DNA, 601 bp, Human
aattcccccctggtgctcacaagactctgatgatcaagaaagaaggcgggtcttccctcaccaacagccaagaggctgcttgagagtcaaggcagcttcttcagggctttgcctgggtttgttctgaatctgccctggcctctgtgggggtggggtggagtgaacgtctttcctctctgggtgtcttccaaacacacttctgcactaagagttgccactcccttcctttctcccctcagcctctccagaagcaaagcccatgctggctggggccagggactgacttctaagagtggagaaycgtgactccacagcaggggaaacctagctgctatgaaagcaacaacttctagggaggctgggacctcgggcctccagcaccatggaggaccatggagtgaccttaaggaatccttctggacaaatatccaaagggctgtgtgcctattcacctgggagagaggccttgggctgcccgtaccctgggaagggaagatgaggtgagggtagtttatccggcccaggctaccacagcctgttaggacagagcccaggtctattcaaggatgggtgaaaaactaaaatgtggggagggggaagg

SEQ ID NO: 104065 - DNA, 601 bp, Human
acctaaagctaccaggcccataaattcccccctggtgctcacaagactctgatgatcaagaaagaaggcgggtcttccctcaccaacagccaagaggctgcttgagagtcaaggcagcttcttcagggctttgcctgggtttgttctgaatctgccctggcctctgtgggggtggggtggagtgaacgtctttcctctctgggtgtcttccaaacacacttctgcactaagagttgccactcccttcctttctcccctcagcctctccagaagcaaagcccatgctggctggggccagggactgacttctaagagtggagaaccgtgactccacagcaggggaaacctagctgctatgaaagcaacaacttctagggaggctgggacctcgggcctccagcaccatggaggaccatggagtgaccttaaggaatccttctggacaaatatccaaagggctgtgtgcctattcacctgggagagaggccttgggctgcccgtaccctgggaagggaagatgaggtgagggtagtttatccggcccaggctaccacagcctgttaggacagagcccaggtctattcaaggatgggtgaaaaac

SEQ ID NO: 104066 - DNA, 601 bp, Human
ctgaacctaaagctaccaggcccataaattcccccctggtgctcacaagactctgatgatcaagaaagaaggcgggtcttccctcaccaacagccaagaggctgcttgagagtcaaggcagcttcttcagggctttgcctgggtttgttctgaatctgccctggcctctgtgggggtggggtggagtgaacgtctttcctctctgggtgtcttccaaacacacttctgcactaagagttgccactcccttcctttctcccctcagcctctccagaagcaaagcccatgctggctggggccagggactgacttctaagagtggagaaccgtgactccacagcaggggaaacctagctgctatgaaagcaacaacttctagggaggctgggacctcgggcctccagcaccatggaggaccatggagtgaccttaaggaatccttctggacaaatatccaaagggctgtgtgcctattcacctgggagagaggccttgggctgcccgtaccctgggaagggaagatgaggtgagggtagtttatccggcccaggctaccacagcctgttaggacagagcccaggtctattcaaggatgggtgaa

SEQ ID NO: 104067 - DNA, 601 bp, Human
tctggggccttctgcagcaggacctgcctgtatcttttactgtgtgtgatccctgcctaagaacctgcccactccctcttctgcctctcaaccaagacttctggggacctttctttttaccctctggacaactcttagaaggaggctcaacctctgaactgtctcagcatgaatgataggtcttctaggtcctgtgaaaagttctctggcctgaggatgaccatgaacccacagtaggttcagcccccaacaccacccgactggagacaacgccatccctgggtgctctggaatgaagggrtcaagctggcatctcctttctcagtgacctttctgaacctaaagctaccaggcccataaattcccccctggtgctcacaagactctgatgatcaagaaagaaggcgggtcttccctcaccaacagccaagaggctgcttgagagtcaaggcagcttcttcagggctttgcctgggtttgttctgaatctgccctggcctctgtgggggtggggtggagtgaacgtctttcctctctgggtgtcttccaaacacacttctgcactaagagttgccactcccttcctttctcccctcagcct

SEQ ID NO: 104068 - DNA, 601 bp, Human
ttgtgtgaaatgtcttacttcttttctaaaccatacatttcttgaggacagatgcagtaagttcatcgcacaatccagcagtgagcacaagggtctcattgaattgattggtgcacgtgatactccagatggagccacattgcaaatggcaccactgtccccatttcctccaggaaaagcagtggtggggtggggcggtcacaggaccatacctgtcactgcattcagttctgtgagggtggccagggactcctgtctgccccatttcaaaggggacacactgaggcccagggcaggcagygatggaacccaaggttgggtgctgagtaggactctaggcctctgaccaagttgatctggggccttctgcagcaggacctgcctgtatcttttactgtgtgtgatccctgcctaagaacctgcccactccctcttctgcctctcaaccaagacttctggggacctttctttttaccctctggacaactcttagaaggaggctcaacctctgaactgtctcagcatgaatgataggtcttctaggtcctgtgaaaagttctctggcctgaggatgaccatgaacccacagtaggttcagccc

SEQ ID NO: 104069 - DNA, 601 bp, Human
gctacttaggaggctgaggtgggaggatcacttaagcctgagaggcagaagttgcagtgagctgagatcacgccactgcaccccaggctgggcaacagagagagactccctctcaaaaacaaacaaacaaaaagaggcactgaaaggaaactgtcatttatagtagttagaatactaaaacttggaaatagcttacttctattaaaacaggtagagtcaaacttatacctatattaaaatcatttttactcatttgctttccaaaagatttcatgacgcaggggagaaagttgggagcagrgggaggatgggttcatacaagcccatgagaaacatacattttggtgccgtctataatgtgggtgggggcggaaagagaaactcagaatgactgctctgatcattttgtgtgaaatgtcttacttcttttctaaaccatacatttcttgaggacagatgcagtaagttcatcgcacaatccagcagtgagcacaagggtctcattgaattgattggtgcacgtgatactccagatggagccacattgcaaatggcaccactgtccccatttcctccaggaaaagcagtggtggggtggggc

SEQ ID NO: 104070 - DNA, 601 bp, Human
ttaaacattaaatatatatttatttttctatgaaaacagttgaaagcatttttataattttgcttttgaaattatttggttacaagtaattcatttaattcatgacaagctacaatttcttggcttttattgtgtattcttgggaacatttgtgacgtgataaaactctaagatttacatgtgaaacaacaaggctgacatatagcacaattataacattgtcttagattcgctttctagtacatatattgattctcaaccattatccactaagaggtgttgagctgggtgtggtggctcwtgcctgtaatcccagcactttgggaggctgaggtgggtagattgctggagcctaggaatttgaggtcagcctgggcaacatggtgaaaccccatctctacaaaaaatacagaaattacctgtgtgtggtggcatgttcatgtggtctcagctacttaggaggctgaggtgggaggatcacttaagcctgagaggcagaagttgcagtgagctgagatcacgccactgcaccccaggctgggcaacagagagagactccctctcaaaaacaaacaaacaaaaagaggcactgaaaggaaac

SEQ ID NO: 104071 - DNA, 601 bp, Human
taaacctgaaacttcaggctgtggagcatgtaaacaagagtgactgtgggatatcctgctcaggtgattttaaagaaaatagggacatagtttggaggatggtttaagcaagaccttttaaacccttttaactcttcagctcaccctgcattaaatcaaatgtgaagataaatgctcattaaacattaaatatatatttatttttctatgaaaacagttgaaagcatttttataattttgcttttgaaattatttggttacaagtaattcatttaattcatgacaagctacaatttcttgrcttttattgtgtattcttgggaacatttgtgacgtgataaaactctaagatttacatgtgaaacaacaaggctgacatatagcacaattataacattgtcttagattcgctttctagtacatatattgattctcaaccattatccactaagaggtgttgagctgggtgtggtggctcatgcctgtaatcccagcactttgggaggctgaggtgggtagattgctggagcctaggaatttgaggtcagcctgggcaacatggtgaaaccccatctctacaaaaaatacagaaattacctgt

SEQ ID NO: 104072 - DNA, 601 bp, Human
caggtttgtttttgcatcacatcacagacctccccgctccccatcatgtggcttttagggcctcatattctggtcacctcactttccacctgtgtccccagtccacatctcttccatccagccaggtccacacctttgggaactcaccaacacctaccctctccctgtctggactgccgctgatccctgacttggaatgccccttcctcctgccagtccacattctacccattggttgaggttgctccaggggcactgggcttctgcaaacgccagttctttgcctgcaccaaataatttrgcacaactgcattctttactgcttcgtgcctctcccctttggcatgagcttcgtgactgcagagccacattttctacttctcttttgcctcatatgccccagaccaaaacatctagcttgctgctgagagcggactcagaatccaaaacagcacgggctggatcactgttactcaatggccactgcatatggtctgatgccccgttccaaaataggccaagaaccgattaggccgacgttctttagatctggaaggatagtagacctgtgagttaaaggtgatttgtcagggcagcccca

SEQ ID NO: 104073 - DNA, 601 bp, Human
agttcaaagaaataaagagaggggtcgggctgtgggggaaggaattctagatatgcaagagacagagaaactgtctttgttggataaaatgaactgtgaagtaaaaaacatgagacagagaaattatttcaacaccaacttgatatttgatgatattaaggaattactgtaaattttgtaggagggataatggtagtatagtatatattttttttctttaaagggtgcttatcttttggaaatacacactaacgtatgtatatgtagtttattatattattttctttacttttctacatgttgaaacaggaagagttgtcctggaaaatagtcctggggtcccccttcagaagaaaagcagttggtgagaagtgaagcgctataacattatgggttgaaatggcgcctttcttgggctgctgacaccttctcagattctgctgagcttcctgagggtggactctgaatcttggcttctcttataccctctggtacaccaggcccagggatggcccactgtgcactctccccaagccctaccaagcaaatagaatgagcctttcagagagctcttggctctgtgtcatgtcttacttagctg

SEQ ID NO: 104074 - DNA, 601 bp, Human
ctctctatagaaatattccagcaaacaaatgaaaaaggaaagataatccctaatgaaatagaggctctaggcaatgattatcagtggcttttggtgtcaccaaaagaaagagcaggacacatcacaagcctcctgaggaaagtacaataaccaccttgaaatgttcttgctacattaaacctgaatcccatcaacctccagattcaacagccagtttagaaaaaacacaggaggcagaggaacacgttaaatgacaccacagggatgcaatcagcaaaaattcacactgtgggagattctrtggcacaaataacctagcttcgtacagttcaaagaaataaagagaggggtcgggctgtgggggaaggaattctagatatgcaagagacagagaaactgtctttgttggataaaatgaactgtgaagtaaaaaacatgagacagagaaattatttcaacaccaacttgatatttgatgatattaaggaattactgtaaattttgtaggagggataatggtagtatagtatatattttttttctttaaagggtgcttatcttttggaaatacacactaacgtatgtatatgtagtttattat

SEQ ID NO: 104075 - DNA, 601 bp, Human
ggaaattaaccactacactctcatcttctacttggttgcaccttgcatatctgatggctgctcctggcctgtgcccttttggtcttctatgccgttttcatcttgtacttgtctctggagggctctgcctgctctgcacaccctctcccttcaccacccccggaagactagataaagccgtgtgaaccagagataccccacttccttcttcctaaatatttctctctgatttcattcgcaagagaaatctgcctaattatagatggatagagatactgaatagtctcactgccctcttttkcttctccctggctctgagtctgggggtggggctgggaagggggagccagcctcaggcaaagttactgcctgagactttaaagtcagattttaatctccttaatctcctttcccttccacccacccaccagcacagtcaacgcatcactgagacacctgcttgggtaggggtgggagggtagcggtagtggggttagagggtggcagaggcacacttgtttggggtgtggggagaaaaattctgcttctggccacagaacctaactggaggctcaaagagatctttttagataacagtggc

SEQ ID NO: 104076 - DNA, 601 bp, Human
gtactttaaaatatcatccgtatactgttgaccccaccatttagatctacagccccagttctctcctgaaatccagacttgaacatccattcaatatctaacggacaactcagctctacttgtcctaagcagaactccttatttctcccccagcaaacctgccttttccagggtcattgggtaacatgaggaagaatttgatttctcaatccaaaactgggggaaatattttttttatttcctatatgacttttgggcttacagaagtaaaaatgttaattgtaaaaaaaaaaaaaaaaaraaaaagaaacaaggaaaatacagaaaagcgtggaaaagaaaataaaaattagccaaaaaccaaccactcaaacataatctttaacattttgctatattttcttctaatgtttttttctactgctttcctttttttcaaaattaggatcatatgttagggtttgtgtttgtttgatttttcttagtattacctattttttgactattttgaggtattgctatgtataataatttactcagctatgcccttattgttagaaatgcaggttatcgttgatttttagtattatagtgctgcagt

SEQ ID NO: 104077 - DNA, 601 bp, Human
ttttcttctgaatcatttttcaaacctctcatagctcaggcctctctgatgggagctctgacatgaagccaaaacacctcttccagacacagagagaccatcaatcagtttaattcgaagactcctcaaagtgagcctcctggtagcccagcaggaactgttttagagtcttcttccttcagttacagtcagtgacttgcatagagagctcaggtcacctggctcatctcaggcactcaccagacacctgggaagggctggtatttctacccttgatactttgctcccagtaaagggaaaycaaggctgagaaccctcacttttctttacccacctttgttcttagccctgccttctgctaaattgtaaccaacaaatccacagtggctaaaattcccagtcatgcagtcgctcctagactgagatgctccacccggctgatttgttgtgaattaagggaaccaaaaaataaagtgctctctttccttccaagcagggaaaggaagctacattcccaaacatagagaagagcaaactgcaataaaaaaaaaaaaaacaggagttcctaccactaaaaaatacgtgatctgttttgctttgt

SEQ ID NO: 104078 - DNA, 601 bp, Human
gcctggggacagaagatgacaacactaacttgaaacttcaattgtctctgttttaaaggcagacacttttaattagacaaaagcaaagggaaagaagaatagaagtacagttaccgaaaaggccccaagatcgcactatttatctgcagtgtgtgctctgtaaaaaacaaaaacaaaaacaaaaaacaaataacaacaaaaaaaaactgcagcaacttttagagagccacatagtattattccagctctttcttcccctctgtctccattttacgtttatttcctttttattggtttcacyatctcttgctttttctcttctccctccaatactcaatcttcctgtccatatatttatttctttccttccttccccacctcctttcttctccttcagagacctatccagacagagaatcatgtgtttacaagcctcatacacagagttgttggagaaggcgccagccccctccccaccaccctgctaggccaacctgcctccagtggccagtcccttataaactggagatcagtgagatagaaagtcactcatagatgccttccaccttcctttttttttctttttctttttttttttttt

SEQ ID NO: 104079 - DNA, 601 bp, Human
atggagttagtctgctgggatatttagaatctaggtttgtaacttgcatctcctttctcttgatcctacatttcagcctccaatttagtgggaacttgaactgaactgtgctaatttattacttggacaccaaagagtcattattttgtggaggaaaatcaactttgaacattcaagaaaaaagaccccattgcaatgattggttagaatttgatctggatctacatagattcattttctaaaactattcaattaaggataatgtcaacctattgcctgaatttaaatcagcgattcattyggctaatgaattttcctttttctgtgagtaccatgtcctacgaatttacaggggatggtcagagaaatggtgacaaagaaaaggaggtttgtttgtttttaatgttttgtttgctgacttaaaaagcacacagccctggaaatggccttctcattactcgagacaataaaacatcccagaaatcctgacactggctaataagacacatgcctttaatgacagcctcaaaaagaagcccctacggtggaaagtgttgtgtgtttgattgcgctagttttaccatggaatgtgccagttgtg

SEQ ID NO: 104080 - DNA, 601 bp, Human
tctggaagcagagacctgaaaaagtcatcatttctttttttaaaaggagaaagggagagggaggctaacacacatacacttattcacaaaaaataaaagatggtttcatggagttagtctgctgggatatttagaatctaggtttgtaacttgcatctcctttctcttgatcctacatttcagcctccaatttagtgggaacttgaactgaactgtgctaatttattacttggacaccaaagagtcattattttgtggaggaaaatcaactttgaacattcaagaaaaaagaccccattgyaatgattggttagaatttgatctggatctacatagattcattttctaaaactattcaattaaggataatgtcaacctattgcctgaatttaaatcagcgattcattcggctaatgaattttcctttttctgtgagtaccatgtcctacgaatttacaggggatggtcagagaaatggtgacaaagaaaaggaggtttgtttgtttttaatgttttgtttgctgacttaaaaagcacacagccctggaaatggccttctcattactcgagacaataaaacatcccagaaatcctgacactg

SEQ ID NO: 104081 - DNA, 601 bp, Human
gggccatcccaggaacccttcctgggttctgtttgtggcttttctgcgttgccactgagcatgggttgctctcggctggttagcataggaggtcacactatctgttctggtgcaggaattgtccagggaattacagtcaaggctgcaatgtgacctatggcctggggccagcaagcctttcttagtctccaggcaggccaggtacagacagcaaactcagaaacccacgattacattggctgtcctttatattagcacaccaggatgcacccaattagcagtgctcattcctgcctccctyctgacttcaaatacctaaagcccctcatatctggaagcagagacctgaaaaagtcatcatttctttttttaaaaggagaaagggagagggaggctaacacacatacacttattcacaaaaaataaaagatggtttcatggagttagtctgctgggatatttagaatctaggtttgtaacttgcatctcctttctcttgatcctacatttcagcctccaatttagtgggaacttgaactgaactgtgctaatttattacttggacaccaaagagtcattattttgtggaggaaaatcaact

SEQ ID NO: 104082 - DNA, 601 bp, Human
cgtatgtctcagatgttgaagggcaatatacctgtgcttcagaaaaatctgccctgtgtgccaaaatgtgcagaaaggagagccagcttctcagctggccccatgccccactactaactactcccacggcctcggcgagttatttcttctttttttaaaaattatactttaagttctagatgtgaacaacgtgcaggtttgttacataggtatacatgtgccatgttggtttgctgcacctatcaagtcgtcatttacattagatattctcctaatgctatccctcctccagccccctgaycccccgacaggccctggtgtgtgatgttccccgccctgtgtccatgtgttctcattgttcaactctcggggagttatctctgagttactcctgagtctgggctgggagacaccagggggacagggcacacacatttgcaagtttcctattcaggccatgctgtccaggcagccagaatgaagcccagccagagccaaaaggctttcctggaggtgtgtttgtcagtttggcaacccttggtgtgcccagcccacgcgctgtgagcattcgcctatgacgtactttgcgtggatcaaaggc

SEQ ID NO: 104083 - DNA, 601 bp, Human
tgaaagaacatttttatgggagcctacaccagtgctatcacctaaagtgcgtgaccttagggaagttgcttcaccccttgtttctgtgcctccaaaatactggtgttaatacagtaatttctgattccttccacctgtgccctgctcagcgatccagtgttcaagctggtcatcaggagaaagctacttatgatttcctaacaagccaccacagaacatcacattcccaaacatgctcttcaccgtccctgctgtccccacgtgcctagccctggtgtgggcaggaatgagtgggattggratgttttctcacaggtctttctcaggtgaggccccaggctgtgaccaggcccctgccctgcatgtgactcaggcctagcccctgctggggcaggaatgccacccagcacagcatcctactggtgcctgaataaagaatggactggaggttcacctgaaaggggctgccaggtttctgcgggggccagccaacggctcacaatgaccctgtgttcgactcatcttacgatgaaatttttcagcttgacgaacttttactcatctttcaaggctcggctcaaatgttatttccctgggaaaa

SEQ ID NO: 104084 - DNA, 601 bp, Human
gaaggacctcagctatacagaactttcacgataatggtatttggtgaatatggttacatttatatatgaacacagaaaaccaactactgctggtaaatagcatgatcactattgttattattatccagtgctgtaaggacgagatgctttcaccagcagccgagtgagatgaaagcgcttttccgatccaccgaatcagtcccactgcaactgtaagctggagaccctctgggccttgggagctcaggctgcctgggcaacgcaagggaggacaggggcggagggggagccaggagggcckcacctgcctcgctcgctggtcgccctcgctctgggatccgtcctgccggtcccaggctgttgagggcgcctcctcagagtccctgtggcccccgcagcttccccggaagaaacccgtgcatccatcggctagcccaagcccaagctcctcccggagctccccgagccggggccaggcctccgcccctcggtgcccgcgcctgggctcctcccgctgcgggccgcccgcccggacgcaaggcacagggggacgccccgccgagccgctgcccactgcaccgagtttttcggaggctgggag

SEQ ID NO: 104085 - DNA, 601 bp, Human
gaaaatagtaatgttatattattttacaagaaaaaacacgttaaaaatatatgtatatctggagggccgcacacacaaaaatgtcatccacggttacttctgcagaggagccacgggagggggaggctgggtgaatttcacttattttccaccttacacctttttgtggtgtttggaactctaactatgatagtatataatatttataatactaaacaaccaaaacaaaaacaaataacatgaacccttacatcaaagaaggtgtgtgcggcaagattctggcagggcagaaagtggaggmacaggggctggcccatttagcgaagcgctttgcgcccagccctggctcagtacatttctggtgatgacttgccggggtttggaaggacctcagctatacagaactttcacgataatggtatttggtgaatatggttacatttatatatgaacacagaaaaccaactactgctggtaaatagcatgatcactattgttattattatccagtgctgtaaggacgagatgctttcaccagcagccgagtgagatgaaagcgcttttccgatccaccgaatcagtcccactgcaactgtaagct

SEQ ID NO: 104086 - DNA, 601 bp, Human
cactttgggaggctgaagctggaggatttctcgagctcaggagtttgagacatagcaagacccgtctctgcaaataatgacaataacaaaattagctgggtgtggtggcacacacctgtagccccagccccctcctccggaggcttaggtcggaggatcacctgagcccaagaggtggaggctgctgtgagctgtgatcatgccactaccctccatcctgggcaacagagttagaccctgcctcaaaaacaaaaacaaaaacaaaaaaagctctagatacttgtgtatgaaaaaaacactrtgtaagctgcatatatatgtatatatacataaaaatatatctagatggagtttctgtttgggatggtgaaaatgttctggaaatggatagtgctgatgattgtacaataatgtaaatgtacttacttcatgtcactgaattacacttaaaaatgaaaatagtaatgttatattattttacaagaaaaaacacgttaaaaatatatgtatatctggagggccgcacacacaaaaatgtcatccacggttacttctgcagaggagccacgggagggggaggctgggtgaatttcacttattt

SEQ ID NO: 104087 - DNA, 601 bp, Human
gaacctgataaattttggtgtattcatatataaccgttaaaaaaaacacaacagataattctacatgtgctaccatgaaagatcttcaagataattaggttttaaaaaaggtggccaggtgcagtggctcatgcctgtaatcctagcactttgggaggctgaagctggaggatttctcgagctcaggagtttgagacatagcaagacccgtctctgcaaataatgacaataacaaaattagctgggtgtggtggcacacacctgtagccccagccccctcctccggaggcttaggtcggargatcacctgagcccaagaggtggaggctgctgtgagctgtgatcatgccactaccctccatcctgggcaacagagttagaccctgcctcaaaaacaaaaacaaaaacaaaaaaagctctagatacttgtgtatgaaaaaaacactatgtaagctgcatatatatgtatatatacataaaaatatatctagatggagtttctgtttgggatggtgaaaatgttctggaaatggatagtgctgatgattgtacaataatgtaaatgtacttacttcatgtcactgaattacacttaaaaatg

SEQ ID NO: 104088 - DNA, 601 bp, Human
ctctgagaatttaattttttctgaggataaactctcacagtatacagagaaaataatgtaaatgtccatcaactaggaacctgataaattttggtgtattcatatataaccgttaaaaaaaacacaacagataattctacatgtgctaccatgaaagatcttcaagataattaggttttaaaaaaggtggccaggtgcagtggctcatgcctgtaatcctagcactttgggaggctgaagctggaggatttctcgagctcaggagtttgagacatagcaagacccgtctctgcaaataatracaataacaaaattagctgggtgtggtggcacacacctgtagccccagccccctcctccggaggcttaggtcggaggatcacctgagcccaagaggtggaggctgctgtgagctgtgatcatgccactaccctccatcctgggcaacagagttagaccctgcctcaaaaacaaaaacaaaaacaaaaaaagctctagatacttgtgtatgaaaaaaacactatgtaagctgcatatatatgtatatatacataaaaatatatctagatggagtttctgtttgggatggtgaaaatgttct

SEQ ID NO: 104089 - DNA, 601 bp, Human
ttgtcataccaaacatttgctctacactttcagtttacaaaacccttttatattttttatttcatttgatcctaacaacaattgagtgaggtaagccgggtagatcttatttgctccactttgcagataaagagactgaaggtcagggaggtgaagtgactctcccgcagtcaaacagctcatgtgtcagagcctggacgagaagccaggtcttgccgggcctttgttctttctcacgcagcacactgccctcaagttttgctcttgaaaattagcaccatttcaaaaaaatctactttcragcaaaccccttatgtcaaaattccaggcagtattttgccatttctctgagaatttaattttttctgaggataaactctcacagtatacagagaaaataatgtaaatgtccatcaactaggaacctgataaattttggtgtattcatatataaccgttaaaaaaaacacaacagataattctacatgtgctaccatgaaagatcttcaagataattaggttttaaaaaaggtggccaggtgcagtggctcatgcctgtaatcctagcactttgggaggctgaagctggaggatttctcga

SEQ ID NO: 104090 - DNA, 601 bp, Human
atatattatagatatatattatatatatatattatagatatacagagagaaagacacttattcttacctcttgttgccaacttggacatgtagctttctctggctgactccagggactgatgctgtaacaatcattgtcataccaaacatttgctctacactttcagtttacaaaacccttttatattttttatttcatttgatcctaacaacaattgagtgaggtaagccgggtagatcttatttgctccactttgcagataaagagactgaaggtcagggaggtgaagtgactctcccrcagtcaaacagctcatgtgtcagagcctggacgagaagccaggtcttgccgggcctttgttctttctcacgcagcacactgccctcaagttttgctcttgaaaattagcaccatttcaaaaaaatctactttcgagcaaaccccttatgtcaaaattccaggcagtattttgccatttctctgagaatttaattttttctgaggataaactctcacagtatacagagaaaataatgtaaatgtccatcaactaggaacctgataaattttggtgtattcatatataaccgttaaaaaaaa

SEQ ID NO: 104091 - DNA, 601 bp, Human
catagagagcaatatgtgtgtgtatgtgtgtgtgtgtgcatatatatatattatagatatatattatatatatatattatagatatacagagagaaagacacttattcttacctcttgttgccaacttggacatgtagctttctctggctgactccagggactgatgctgtaacaatcattgtcataccaaacatttgctctacactttcagtttacaaaacccttttatattttttatttcatttgatcctaacaacaattgagtgaggtaagccgggtagatcttatttgctccacttygcagataaagagactgaaggtcagggaggtgaagtgactctcccgcagtcaaacagctcatgtgtcagagcctggacgagaagccaggtcttgccgggcctttgttctttctcacgcagcacactgccctcaagttttgctcttgaaaattagcaccatttcaaaaaaatctactttcgagcaaaccccttatgtcaaaattccaggcagtattttgccatttctctgagaatttaattttttctgaggataaactctcacagtatacagagaaaataatgtaaatgtccatcaactagg

SEQ ID NO: 104092 - DNA, 601 bp, Human
cagtcacgctctgggagtaaacaatgacaggcaagtgatctcctttggtgagcaggttgcatgtttcagttccctccgctcattccaccaagagccccccaaggccagtggacaagtctctcaggttagcagacaacacttgctatatgccaggcacatagagtgtaagatacacacacacacttgcatacatatgtgtatatacacacacataaatagaacaatacaaacatatatgtatgcatgtacatatatacatagagagcaatatgtgtgtgtatgtgtgtgtgtgtgcatatatatatattatagatatatattatatatatatattatagatatacagagagaaagacacttattcttacctcttgttgccaacttggacatgtagctttctctggctgactccagggactgatgctgtaacaatcattgtcataccaaacatttgctctacactttcagtttacaaaacccttttatattttttatttcatttgatcctaacaacaattgagtgaggtaagccgggtagatcttatttgctccactttgcagataaagagactgaaggtcagggaggtgaagtgactctccc

SEQ ID NO: 104093 - DNA, 601 bp, Human
tgcctgcagtcacgctctgggagtaaacaatgacaggcaagtgatctcctttggtgagcaggttgcatgtttcagttccctccgctcattccaccaagagccccccaaggccagtggacaagtctctcaggttagcagacaacacttgctatatgccaggcacatagagtgtaagatacacacacacacttgcatacatatgtgtatatacacacacataaatagaacaatacaaacatatatgtatgcatgtacatatatacatagagagcaatatgtgtgtgtatgtgtgtgtgtgtgyatatatatatattatagatatatattatatatatatattatagatatacagagagaaagacacttattcttacctcttgttgccaacttggacatgtagctttctctggctgactccagggactgatgctgtaacaatcattgtcataccaaacatttgctctacactttcagtttacaaaacccttttatattttttatttcatttgatcctaacaacaattgagtgaggtaagccgggtagatcttatttgctccactttgcagataaagagactgaaggtcagggaggtgaagtgac

SEQ ID NO: 104094 - DNA, 601 bp, Human
atgcctgcagtcacgctctgggagtaaacaatgacaggcaagtgatctcctttggtgagcaggttgcatgtttcagttccctccgctcattccaccaagagccccccaaggccagtggacaagtctctcaggttagcagacaacacttgctatatgccaggcacatagagtgtaagatacacacacacacttgcatacatatgtgtatatacacacacataaatagaacaatacaaacatatatgtatgcatgtacatatatacatagagagcaatatgtgtgtgtatgtgtgtgtgtgtacatatatatatattatagatatatattatatatatatattatagatatacagagagaaagacacttattcttacctcttgttgccaacttggacatgtagctttctctggctgactccagggactgatgctgtaacaatcattgtcataccaaacatttgctctacactttcagtttacaaaacccttttatattttttatttcatttgatcctaacaacaattgagtgaggtaagccgggtagatcttatttgctccactttgcagataaagagactgaaggtcagggaggtgaagtga

SEQ ID NO: 104095 - DNA, 601 bp, Human
cgatgcctgcagtcacgctctgggagtaaacaatgacaggcaagtgatctcctttggtgagcaggttgcatgtttcagttccctccgctcattccaccaagagccccccaaggccagtggacaagtctctcaggttagcagacaacacttgctatatgccaggcacatagagtgtaagatacacacacacacttgcatacatatgtgtatatacacacacataaatagaacaatacaaacatatatgtatgcatgtacatatatacatagagagcaatatgtgtgtgtatgtgtgtgtgtatgcatatatatatattatagatatatattatatatatatattatagatatacagagagaaagacacttattcttacctcttgttgccaacttggacatgtagctttctctggctgactccagggactgatgctgtaacaatcattgtcataccaaacatttgctctacactttcagtttacaaaacccttttatattttttatttcatttgatcctaacaacaattgagtgaggtaagccgggtagatcttatttgctccactttgcagataaagagactgaaggtcagggaggtgaagt

SEQ ID NO: 104096 - DNA, 601 bp, Human
gggcacagggtgctaaggaaacatgagggagggacgatgcctgcagtcacgctctgggagtaaacaatgacaggcaagtgatctcctttggtgagcaggttgcatgtttcagttccctccgctcattccaccaagagccccccaaggccagtggacaagtctctcaggttagcagacaacacttgctatatgccaggcacatagagtgtaagatacacacacacacttgcatacatatgtgtatatacacacacataaatagaacaatacaaacatatatgtatgcatgtacatatatacrtagagagcaatatgtgtgtgtatgtgtgtgtgtgtgcatatatatatattatagatatatattatatatatatattatagatatacagagagaaagacacttattcttacctcttgttgccaacttggacatgtagctttctctggctgactccagggactgatgctgtaacaatcattgtcataccaaacatttgctctacactttcagtttacaaaacccttttatattttttatttcatttgatcctaacaacaattgagtgaggtaagccgggtagatcttatttgctccactttg

SEQ ID NO: 104097 - DNA, 601 bp, Human
aaacaaatcatcccacgagagaggggcacagggtgctaaggaaacatgagggagggacgatgcctgcagtcacgctctgggagtaaacaatgacaggcaagtgatctcctttggtgagcaggttgcatgtttcagttccctccgctcattccaccaagagccccccaaggccagtggacaagtctctcaggttagcagacaacacttgctatatgccaggcacatagagtgtaagatacacacacacacttgcatacatatgtgtatatacacacacataaatagaacaatacaaacatayatgtatgcatgtacatatatacatagagagcaatatgtgtgtgtatgtgtgtgtgtgtgcatatatatatattatagatatatattatatatatatattatagatatacagagagaaagacacttattcttacctcttgttgccaacttggacatgtagctttctctggctgactccagggactgatgctgtaacaatcattgtcataccaaacatttgctctacactttcagtttacaaaacccttttatattttttatttcatttgatcctaacaacaattgagtgaggtaagccggg

SEQ ID NO: 104098 - DNA, 601 bp, Human
agtggcgcctcacgagtggtcatgtggtggccatccttactaggagaaaatgtcacgcactgtgctgggcagtgagggtggaggtgacagacacagatgtagcctcccagccgagcagagaggtgggcaaggaaacaaatcatcccacgagagaggggcacagggtgctaaggaaacatgagggagggacgatgcctgcagtcacgctctgggagtaaacaatgacaggcaagtgatctcctttggtgagcaggttgcatgtttcagttccctccgctcattccaccaagagccccccaasgccagtggacaagtctctcaggttagcagacaacacttgctatatgccaggcacatagagtgtaagatacacacacacacttgcatacatatgtgtatatacacacacataaatagaacaatacaaacatatatgtatgcatgtacatatatacatagagagcaatatgtgtgtgtatgtgtgtgtgtgtgcatatatatatattatagatatatattatatatatatattatagatatacagagagaaagacacttattcttacctcttgttgccaacttggacatgtagctttctctg

SEQ ID NO: 104099 - DNA, 601 bp, Human
aaaaaaaaaaaaaaaagatgagattaggacacagacatgtacagagggaagatgccgtgaagatgatgtaaagacacagggagagatggccacctacaagccaaggagtggcgcctcacgagtggtcatgtggtggccatccttactaggagaaaatgtcacgcactgtgctgggcagtgagggtggaggtgacagacacagatgtagcctcccagccgagcagagaggtgggcaaggaaacaaatcatcccacgagagaggggcacagggtgctaaggaaacatgagggagggacgatgyctgcagtcacgctctgggagtaaacaatgacaggcaagtgatctcctttggtgagcaggttgcatgtttcagttccctccgctcattccaccaagagccccccaaggccagtggacaagtctctcaggttagcagacaacacttgctatatgccaggcacatagagtgtaagatacacacacacacttgcatacatatgtgtatatacacacacataaatagaacaatacaaacatatatgtatgcatgtacatatatacatagagagcaatatgtgtgtgtatgtgtgtgtgtgtgcat

SEQ ID NO: 104100 - DNA, 601 bp, Human
aaacaaaacaaaacaaaacaaaaaccatctctaataaaatacaaaaaattagctgggcatggtggtacaccatgaggcttcaggaggctgaggcaggagaatcccttgaacccgggaggcggaggctgcagtgagccgagattgtgccactgcactccagcctgggcgagggagcaagactctatcaaaaaaaaaaaaaaaaaagatgagattaggacacagacatgtacagagggaagatgccgtgaagatgatgtaaagacacagggagagatggccacctacaagccaaggagtggcrcctcacgagtggtcatgtggtggccatccttactaggagaaaatgtcacgcactgtgctgggcagtgagggtggaggtgacagacacagatgtagcctcccagccgagcagagaggtgggcaaggaaacaaatcatcccacgagagaggggcacagggtgctaaggaaacatgagggagggacgatgcctgcagtcacgctctgggagtaaacaatgacaggcaagtgatctcctttggtgagcaggttgcatgtttcagttccctccgctcattccaccaagagccccccaaggccagt

SEQ ID NO: 104101 - DNA, 601 bp, Human
tggtgacagagcaagcatctgtctcaaaaaaaaaaaaaaagaaaagaaaagaaaagacagtctcagtgctagccaaggaaatgaaagtatgaagtgacaaagagatgtctcctgtttttcacaggtggtcagagcgggcttcagctgtgcagatctgtcggggaagggcactccgggcagaggagcagaggtggaaaggctgtgtggtggacctgtgcccagtgtctctgaactgcaagcaggggtaggtagcatgaatgaggggaagttctaggagactaggaaagagggcgacaagcgkgtggggttgttaggtagaacttccttggccagtggcttttactctgaatgagatggggaacagctgcagggttttctcttttgacaaggacacattatgtttttatttaaaatatggtaataacatttcaaagaaaaaattaaagccaactggaacaaggcaaggttcacagttgccttgggcccctgggctaactggagatgccccggcaagccccaggacaggcttcaaatcagccctaaaatccaggctatactgccagcctccattacctgtctgcattcagccaaacatagtcat

SEQ ID NO: 104102 - DNA, 601 bp, Human
aaattagtcaggcatggtggcatgtgcctgtagtcccagctactcgggaggctgagggaggagaatcgcttgaacccaggaggcacaggttgcagtgagctgagatcgagccactgcaatcccacctggtgacagagcaagcatctgtctcaaaaaaaaaaaaaaagaaaagaaaagaaaagacagtctcagtgctagccaaggaaatgaaagtatgaagtgacaaagagatgtctcctgtttttcacaggtggtcagagcgggcttcagctgtgcagatctgtcggggaagggcactccrggcagaggagcagaggtggaaaggctgtgtggtggacctgtgcccagtgtctctgaactgcaagcaggggtaggtagcatgaatgaggggaagttctaggagactaggaaagagggcgacaagcgggtggggttgttaggtagaacttccttggccagtggcttttactctgaatgagatggggaacagctgcagggttttctcttttgacaaggacacattatgtttttatttaaaatatggtaataacatttcaaagaaaaaattaaagccaactggaacaaggcaaggttcacagtt

SEQ ID NO: 104103 - DNA, 601 bp, Human
gccaatcccagcactttggaaggccgaggcaggcagatcactaggtcaggagctcgagaccagtctagccaatatggtaaaaccccatctctactaaaaatacaaaaattagtcaggcatggtggcatgtgcctgtagtcccagctactcgggaggctgagggaggagaatcgcttgaacccaggaggcacaggttgcagtgagctgagatcgagccactgcaatcccacctggtgacagagcaagcatctgtctcaaaaaaaaaaaaaaagaaaagaaaagaaaagacagtctcagtgcyagccaaggaaatgaaagtatgaagtgacaaagagatgtctcctgtttttcacaggtggtcagagcgggcttcagctgtgcagatctgtcggggaagggcactccgggcagaggagcagaggtggaaaggctgtgtggtggacctgtgcccagtgtctctgaactgcaagcaggggtaggtagcatgaatgaggggaagttctaggagactaggaaagagggcgacaagcgggtggggttgttaggtagaacttccttggccagtggcttttactctgaatgagatggggaacagctgcag

SEQ ID NO: 104104 - DNA, 601 bp, Human
ctactcaggaggctgaggtgcgaggatcacttgagcccaggaggtcaaaactgcagtgagccctgaccgtgtcactgcactccagcctggttgacagagtgagaccctgtctcaaaaaaaaataagtgaataaataataatactttgaaaaatgaaagctaagactaatagtccaagagataaatcagcaaaagatataaataggcaattcgcagagacagaaaaacagattacttacaaacatataaaaagacatactgggagcagtggctcatgccaatcccagcactttggaaggccraggcaggcagatcactaggtcaggagctcgagaccagtctagccaatatggtaaaaccccatctctactaaaaatacaaaaattagtcaggcatggtggcatgtgcctgtagtcccagctactcgggaggctgagggaggagaatcgcttgaacccaggaggcacaggttgcagtgagctgagatcgagccactgcaatcccacctggtgacagagcaagcatctgtctcaaaaaaaaaaaaaaagaaaagaaaagaaaagacagtctcagtgctagccaaggaaatgaaagtatgaagt

SEQ ID NO: 104105 - DNA, 601 bp, Human
aaaaaaaaaaaatttcctgaagaattgtttttttcatttagtattatgttataatctaagacttcatgttatttcatatattcatatttcatgttactttgtcattttactattaataaatatcctttttaaaggttgcctaataagctttccactatctacataaccattccccattggtgctcatttgtttccaatttttcaccattataaataattctaagatgaacagcttcattcctaaagctttttacaggattggaattccatcaataatagcttgaaaaatgggccaggtgcrgtggctcaggcctgtaatcccaacacttggcgaggccaagctagcaggactgcttgagcccaggagttagagaccagcctgggcaacatggcaagaccctccctctacaaaaaataaaaaattagctgggcatgatggtgcatgccttagtcacagctactcaggaggctgaggtgcgaggatcacttgagcccaggaggtcaaaactgcagtgagccctgaccgtgtcactgcactccagcctggttgacagagtgagaccctgtctcaaaaaaaaataagtgaataaataataatact

SEQ ID NO: 104106 - DNA, 601 bp, Human
atcccagctacttgggaggctgaggcaggagaatcacttgaacttgggacgtggaggctgcagtgagccaagattgcgtcattgcatgtcagcctgggtgacaaagtgagactctgtctcaaaaaaaaaaaaatttcctgaagaattgtttttttcatttagtattatgttataatctaagacttcatgttatttcatatattcatatttcatgttactttgtcattttactattaataaatatcctttttaaaggttgcctaataagctttccactatctacataaccattccccattgrtgctcatttgtttccaatttttcaccattataaataattctaagatgaacagcttcattcctaaagctttttacaggattggaattccatcaataatagcttgaaaaatgggccaggtgcggtggctcaggcctgtaatcccaacacttggcgaggccaagctagcaggactgcttgagcccaggagttagagaccagcctgggcaacatggcaagaccctccctctacaaaaaataaaaaattagctgggcatgatggtgcatgccttagtcacagctactcaggaggctgaggtgcga

SEQ ID NO: 104107 - DNA, 601 bp, Human
aggccgaggtgggcagatcgcctgaggtcaggagtttgagaccagcctggccaacatggtgaaaccctctctctactaaaagtatgaaaattagccgggcatggtggcacgtgcctataatcccagctacttgggaggctgaggcaggagaatcacttgaacttgggacgtggaggctgcagtgagccaagattgcgtcattgcatgtcagcctgggtgacaaagtgagactctgtctcaaaaaaaaaaaaatttcctgaagaattgtttttttcatttagtattatgttataatctaagacttcatgttatttcatatattcatatttcatgttactttgtcattttactattaataaatatcctttttaaaggttgcctaataagctttccactatctacataaccattccccattggtgctcatttgtttccaatttttcaccattataaataattctaagatgaacagcttcattcctaaagctttttacaggattggaattccatcaataatagcttgaaaaatgggccaggtgcggtggctcaggcctgtaatcccaacacttggcgaggccaagctagcaggactgcttgagcc

SEQ ID NO: 104108 - DNA, 601 bp, Human
tcaagcgattctcctgcctcagcctcccaggcagccatgattacaggcacctgccaccacacctggctaattttttgtatttttagcagagacggggtttcaccatgttggccaggctgttctcaaactcctgacctcaggtaatccacccgcctcagcctcccaaagtgctgggattacaggtgtgagccaccgagcccagcctttgtgatcatttttcttttcattttcaagtaaatcaacttaatataaaagtgcagaaaagtaggaaaaaatcagaattgcccataataccactttyaaacacagccattattaatatgatggcagatggctgaccaaagtctttgttatttataaactgtaatcattttacataacaactttccacgggcaggtgcagtggctcacgcctgtaatcccagtacgttgggaggccgaggtgggcagatcgcctgaggtcaggagtttgagaccagcctggccaacatggtgaaaccctctctctactaaaagtatgaaaattagccgggcatggtggcacgtgcctataatcccagctacttgggaggctgaggcaggagaatcacttgaacttggg

SEQ ID NO: 104109 - DNA, 601 bp, Human
aaagacttgctgatcctcagaggtggtgagaggggtcctcaccaggctgtggagtcccttctcccaggatcgaaccattatagcaggtcatattcttgactctacaattagctttctttcattgagggctgagaggccggcctggggggttgacagatacagaaggcctgctaccaaatgtgaggccaggactcacactgcccagtgcttatagcaatgacccactggagatacctcaatcaccctgaactgcagaacgactccagctaatttactggcaacatataatgttttactactytctttaatttgctaccagcctggccaacagggtgaaaccacatctctactaaaaatacaaaaaattagctaggtgtggtggcgggcgcctgtaataccagctactcaagacgctgaggcaaaagaatcgcttgaacccaggaggtggaggttgcagtgagttgagatagcaccactgcactccagcctgggccatagagtgagactctgtctaaaaaaataaataaacaaaaatttttttaaaaagtaccacagcctccttaattctctcctcagtgtcagatttcaaatattcatgttt

SEQ ID NO: 104110 - DNA, 601 bp, Human
cactcttcaggggtgtttgaagataaaaacagataatgggggccaggcgcggtggctcacgcctataatcccagcactttgggaggccgaggcgggcggatcatgaggtcaggagatcgagaccatcctggctaacatggtgaaaccccgtctctactaaaaaatacaaaaaaattagccgggcgtggtggcaggcacctgtggtcccagctgctcaggaggctgaggcaggagaatggtgtgaacccaggaggtggagcttgcagtaagcggagattacgccactacactccagcctggrcaacagagtgggactccgtctcaaaaaaaataaaaagagataatgggtgtgtacaaagtgcctggcacacagtgggagctcagtagtgtgtagactttctgagaactcctcacttcacaaaatgataatgatgtaacacatgcatgaagcatacagtttagagagctctttgcacttgcatgatctggcttaatcctcagaacaaccttgcacaatacgggcagaattattaccaattctattttgcagataatgacgttgcggctccaataggtcacatggctagagattttctgagtg

SEQ ID NO: 104111 - DNA, 601 bp, Human
tatagtttcatttgcacctttccctcctcacccgcacatcacaggcttagagaagagcaaagaacataataagtctttgagtcagaaagactctaagactcaaatgtggaatctgccccattattggcttgttttggaacagttttcttaacctctctgagcgtcaattctcctatctgcagaagggctttgacaagaccgatttcacgggtgcagagaaatgaggtaaagtttgtggggtgccctgcacagtggcgcatgctaagaggctctgcaggtacaaggagtgacagcaggggayggccctctgacctcccaccccatcatgccacggttggggacagaacctggccaggtttcccagcccaggatggggatacccactcttcaggggtgtttgaagataaaaacagataatgggggccaggcgcggtggctcacgcctataatcccagcactttgggaggccgaggcgggcggatcatgaggtcaggagatcgagaccatcctggctaacatggtgaaaccccgtctctactaaaaaatacaaaaaaattagccgggcgtggtggcaggcacctgtggtcccagctgctcagga

SEQ ID NO: 104112 - DNA, 601 bp, Human
cccccaccactggctctggcaagcacagatggtgccttatagtttcatttgcacctttccctcctcacccgcacatcacaggcttagagaagagcaaagaacataataagtctttgagtcagaaagactctaagactcaaatgtggaatctgccccattattggcttgttttggaacagttttcttaacctctctgagcgtcaattctcctatctgcagaagggctttgacaagaccgatttcacgggtgcagagaaatgaggtaaagtttgtggggtgccctgcacagtggcgcatgctragaggctctgcaggtacaaggagtgacagcaggggatggccctctgacctcccaccccatcatgccacggttggggacagaacctggccaggtttcccagcccaggatggggatacccactcttcaggggtgtttgaagataaaaacagataatgggggccaggcgcggtggctcacgcctataatcccagcactttgggaggccgaggcgggcggatcatgaggtcaggagatcgagaccatcctggctaacatggtgaaaccccgtctctactaaaaaatacaaaaaaattagccggg

SEQ ID NO: 104113 - DNA, 601 bp, Human
tttctactttaagcccatgcacgataagttggaaccttcctgccctgtagcaagatcccaggaataggccatgtgagatgctcagaggaggctgggggcagccaaagatgatcacagagtatctaggcatacgggtcattgtatctaagtgttgtgagtctaattagtgacagtgagcctcgccatccctttgtagccttttgtcatcttcattaaaaaaaagccctgaattcaggaagtctcatggtactgaccactaacaggaagattctggagccccagagtgcaccctgggggagaygcacctatccttacagaatctggtttctctgggtgagatttacttgaattgcgttgtttgtctgtctgtctctgagccagactatgaacttctgctaacagggatcaggccttaatcaacctggtcctgccataccctgaggctgaaaatacacgctggtgccctttcccctgcagtcaacctccttctccagcaaatcctgtttcggagctgggcatctgcgggacttactcacatccaactaataaggattcttctcatttgaactctaatttctacttttaaagtgacttcctgtgt

SEQ ID NO: 104114 - DNA, 601 bp, Human
ccaggagaacctcagcatctgaaaggagccccagagactaatagagcattctcacacagactctcaatccaccgccctctcccctgaggctctgacttaagtggcctggagtggaacctgggcatggggacttcactgcatggccatgaatggattgagattcagacctgcatcattacaggggccacagcatgtgagagggaagccctgccttctgtagagatgcagccataccctacaacaaatgtaaatttctgtcaaacagatgcaataaaattaaagctttggtccttcttatacrctgtacttctgaactgtgtattatggaacttctctaagccttcgttttctcatctgtaaaatggggataacaacactacctgtctcattagatggtggtgagggttaaatacgatacttttttttttttttaagtggagtctcactctgttgcccaggctggagtgcaatggcatgacctcagctcactgcaacctctgcctcccaggttcaagtgattctcctgcctcagcctcccaagtggctgggattacaggtgcacaccacgatgccctgctaatttttgtaattttagtagaga

SEQ ID NO: 104115 - DNA, 601 bp, Human
ggacgatctaaaggcctctgggggacaagccagcccccatgaaggccaccaaagctggggtgactttttgctgtgaggactgcagaggagataaccgtggcgatttatgggactggttgagactcagaagaaaatccaggagaaaatcactcagctgcttgtcacagaaaatgagaacagaaaaattactggacagtaaatttagcacaaataagaaatatttctttgtgttgtgcagactcagcacaacacaaaggggcagggggattgggcatgtccctgagataaataatatgaacawgtttccttcctttcttccttccctccttccttcttcctttctttctgcatagttttatgactgatgacaagtgtgctgtgtgtggttgggtggaggagaggatattaaccccaacataattccctgtgtaggaccctcctctcctcggtcccactatgcctgtgctgggagagatgggcctgaggaagacagtcatggcccagaaagctccatgcagggatgcaggacctgattcagttacgcaattaattaaatattcattgggcatctgctctgtgccgggaactattgaaatggaat

SEQ ID NO: 104116 - DNA, 601 bp, Human
gagcacacggtcacaggcagcccaggactgatccctagcagttctcgcccccttcctgcccctgggccagccctgcctacccctccatgccagcaacgttttggcctccctgacgaactatggaagcagatgattcaaaggcagccgccagtgtccccacccccaccaccctgaatccctctgtcccctggcttttgactccaaccctaattcaggacccctcttgcccccaggcagctgatctctacaaacctcccacagaccctgcccagagaccattgatgacccagccactcggacragagtccaagctctttgtccagccatgttagggctctgccataaccagtccaggcctgaaaagaccacagctttgtgccaccctgtccctctgctcttgtcttttccccccattcttccttgaacacccatatttttctaccccctggcctgctgagctagatctttttctaggcttgcgttctacccctccactcaacacctgttgaaatcagactgtcccaccacctgagcccctgaggaaaaagtgagaggatgtcggttcaagagcctatatcccccaaagcgctctacaaaccca

SEQ ID NO: 104117 - DNA, 601 bp, Human
atggtcaaatgagatcatttcaatatctgacagttaactaggacagagagaatctgggttaactctcccccaactccctgcctcctcagtgccaagcactctcccgcctaggacagtgggatctggtgctcggcttcccttccctgttccctgaagggtttcatggccaacagacagaggtacctttggtgcccctccccacctaggcccagcatctccctgtcccctagtcccagctccatggcctcagccttctctgtctcccctcctcccactacacacaccccattcccaggacacrccttgctcttccagactatttgccctgtgccttgcactctctgttccctcttcatgttccctccatttctctccctgaaaccctactatttggtaacatttgatgcatcctacaaaatgcagctcaaagatcccttctgtgttagcttctcccactgcaaatttcccaggggcccctaactcctagtgccatattaacctttgtcaagctgtagttaatgcacgtttagttggcactgccattggagtacaatgggctgaagaatgcagatacactaaatactctggttaaataaaagtt

SEQ ID NO: 104118 - DNA, 601 bp, Human; identical to SEQ ID NO: 20109

SEQ ID NO: 104119 - DNA, 601 bp, Human; identical to SEQ ID NO: 20110

SEQ ID NO: 104120 - DNA, 601 bp, Human; identical to SEQ ID NO: 20111

SEQ ID NO: 104121 - DNA, 601 bp, Human; identical to SEQ ID NO: 20112

SEQ ID NO: 104122 - DNA, 601 bp, Human; identical to SEQ ID NO: 20113

SEQ ID NO: 104123 - DNA, 601 bp, Human; identical to SEQ ID NO: 20114

SEQ ID NO: 104124 - DNA, 601 bp, Human; identical to SEQ ID NO: 20115

SEQ ID NO: 104125 - DNA, 601 bp, Human; identical to SEQ ID NO: 20116

SEQ ID NO: 104126 - DNA, 601 bp, Human; identical to SEQ ID NO: 20117

SEQ ID NO: 104127 - DNA, 601 bp, Human; identical to SEQ ID NO: 20118

SEQ ID NO: 104128 - DNA, 601 bp, Human; identical to SEQ ID NO: 20119

SEQ ID NO: 104129 - DNA, 601 bp, Human; identical to SEQ ID NO: 20120

SEQ ID NO: 104130 - DNA, 601 bp, Human; identical to SEQ ID NO: 20121

SEQ ID NO: 104131 - DNA, 601 bp, Human; identical to SEQ ID NO: 20122

SEQ ID NO: 104132 - DNA, 601 bp, Human; identical to SEQ ID NO: 20123

SEQ ID NO: 104133 - DNA, 601 bp, Human; identical to SEQ ID NO: 20124

SEQ ID NO: 104134 - DNA, 601 bp, Human; identical to SEQ ID NO: 20125

SEQ ID NO: 104135 - DNA, 601 bp, Human; identical to SEQ ID NO: 20126

SEQ ID NO: 104136 - DNA, 601 bp, Human; identical to SEQ ID NO: 20127

SEQ ID NO: 104137 - DNA, 601 bp, Human; identical to SEQ ID NO: 20128

SEQ ID NO: 104138 - DNA, 601 bp, Human; identical to SEQ ID NO: 20129

SEQ ID NO: 104139 - DNA, 601 bp, Human; identical to SEQ ID NO: 20130

SEQ ID NO: 104140 - DNA, 601 bp, Human; identical to SEQ ID NO: 20131

SEQ ID NO: 104141 - DNA, 601 bp, Human; identical to SEQ ID NO: 20132

SEQ ID NO: 104142 - DNA, 601 bp, Human; identical to SEQ ID NO: 20133

SEQ ID NO: 104143 - DNA, 601 bp, Human; identical to SEQ ID NO: 20134

SEQ ID NO: 104144 - DNA, 601 bp, Human; identical to SEQ ID NO: 20135

SEQ ID NO: 104145 - DNA, 601 bp, Human
gcttgatggagatacctcttactgggcctctctgaattcgcttcatcagatgcgtgacgtaactacaaagcacacacagccaaagagaacagtgagaagacaaatcaactcccacctggtactgagcacatgtggatatataaatacccgctttagttcttttccacagtgagaaggaagaggactcactatcctgggacctcctacacatagaacctccactggcctgagcattccttccccttggtttctcactctctattcaaactctccttcatgatgatcaagcgccccacccccmactcgccccgccccgccccgcagtttcacgacccttcacagccttcattttcttccaatttcaaattcacataacttggcaattaatacgttgactttggcactattcttccaggccatatgcctataaatctctcgaacagtaactgcaactgtgaagtaagcattagaagttgacatccagccgggcgaggtggctcacgcctgtaatcccagcaatttgggaggccgaggcgggcggatcgcttgaggtcaggtgttcgagaccagcctggtcaacattgtgaaaccctgttgtcta

SEQ ID NO: 104146 - DNA, 601 bp, Human
agctggttatggaatgtatggattaaaggtctcagattcagctgaggtccctttggaagccaagaacccatagctttatcatttgaggattagccagaagcccaaatatccagaaagtttacctcaggaacataattgtctctcctttctctctcctcctcctgcagcttgatggagatacctcttactgggcctctctgaattcgcttcatcagatgcgtgacgtaactacaaagcacacacagccaaagagaacagtgagaagacaaatcaactcccacctggtactgagcacatgtgsatatataaatacccgctttagttcttttccacagtgagaaggaagaggactcactatcctgggacctcctacacatagaacctccactggcctgagcattccttccccttggtttctcactctctattcaaactctccttcatgatgatcaagcgccccaccccccactcgccccgccccgccccgcagtttcacgacccttcacagccttcattttcttccaatttcaaattcacataacttggcaattaatacgttgactttggcactattcttccaggccatatgcctataaatctc

SEQ ID NO: 104147 - DNA, 601 bp, Human
gaatggaggctaagaaactggtagggggcctatgggcacccacagctggttatggaatgtatggattaaaggtctcagattcagctgaggtccctttggaagccaagaacccatagctttatcatttgaggattagccagaagcccaaatatccagaaagtttacctcaggaacataattgtctctcctttctctctcctcctcctgcagcttgatggagatacctcttactgggcctctctgaattcgcttcatcagatgcgtgacgtaactacaaagcacacacagccaaagagaacartgagaagacaaatcaactcccacctggtactgagcacatgtggatatataaatacccgctttagttcttttccacagtgagaaggaagaggactcactatcctgggacctcctacacatagaacctccactggcctgagcattccttccccttggtttctcactctctattcaaactctccttcatgatgatcaagcgccccaccccccactcgccccgccccgccccgcagtttcacgacccttcacagccttcattttcttccaatttcaaattcacataacttggcaattaatacgt

SEQ ID NO: 104148 - DNA, 601 bp, Human
tatggaatagacttaactggttccagaagagcagaatggaggctaagaaactggtagggggcctatgggcacccacagctggttatggaatgtatggattaaaggtctcagattcagctgaggtccctttggaagccaagaacccatagctttatcatttgaggattagccagaagcccaaatatccagaaagtttacctcaggaacataattgtctctcctttctctctcctcctcctgcagcttgatggagatacctcttactgggcctctctgaattcgcttcatcagatgcgtgacrtaactacaaagcacacacagccaaagagaacagtgagaagacaaatcaactcccacctggtactgagcacatgtggatatataaatacccgctttagttcttttccacagtgagaaggaagaggactcactatcctgggacctcctacacatagaacctccactggcctgagcattccttccccttggtttctcactctctattcaaactctccttcatgatgatcaagcgccccaccccccactcgccccgccccgccccgcagtttcacgacccttcacagccttcattttcttccaa

SEQ ID NO: 104149 - DNA, 601 bp, Human
ctgggaaagtacatgtgagttcattttgctactacctttttgagtgtcttaaacatttaatgaccataaaaataggaaaaatgaagttgttcaaaatcaccaaccgcccatgaagcccatgctttcacccaagtatgcaaaaggactaagataagccatagaaaaaacatcaaagtgcaatgaagatactcgtgaactacctaagtagtgccttgtatgtacctggaaatggaccaaagctcatttctgagtggttagcatggagacaccaaaggaatgccttcacagaagaaaagcaggsagattcagccagggctgacacaaagggggcaacgtaagccagctataaaaccaagaacagaagcagccaagagagaaaaggtgtcctggaagccactagatttgggaatcatgatcttgtggcgaactaactcaatgcacacaacttccgctacaccccttatgaaagcagtccagtttagtggctacaagtttagatgggattcccaactctgccacttactagctgggtgaccttggataataagacctactgatggtttttgaccaggaaaataccactttaggaatccagcaaaca

SEQ ID NO: 104150 - DNA, 601 bp, Human
gtccagaggcgacctgaaggaccctttaagagccaacagggttctcaatgcctcccacttttccagagtgatcttccttcaacacacacctgaccatgtggtatccccatttacaactctatgacttttacccaatgtaccatgccatttgtatctgttttcacaaccccttcctatcaatcactctaaaacaccgtttctcaatcttggcaacgtagacatcctgggctggacattctttgttataggcagctgtactgtgtattgcagaaagtttagcaacatccttggcctctacccmttagaagttagcaggtatcccctggctatgagaacgaaaaatgtgtctggacattgccaaatgtcctctaaagcaaaactctgtccctttgagaatacacagtgccacttgctttccaggaccagccctgggtaagagctattactaatctaatcaacatttgtgaagggcccaagtacacaaggcatcaagcagaagggagggaggcaagagcagaccctgccctcaaacaagttcaggctggtaggcagggcaagaagccaagggcccaacttatacctggaactccatgtcctattt

SEQ ID NO: 104151 - DNA, 601 bp, Human
gcggtggaaggcgctggagactccttagtgagtcattccccgaagttgtggcttctgctgatactttccttgagagtcacgagtttacaagctacataatagcgtcgggggcaagtaagtgtggaagacgaggtaaaggaaaagcagatactaggatgggtagaaggagaggcaggggttagaactttaattccttccctggggacaggagatgccctggaggggaaggcgcttccggctctgcaggtatgtgctgttgggcctaggtgtggtcctgcggaattgctgcagattttagatygctggtgggtaggagctgcagcgcttctcttgggaaatctgtagatcacctggagccagcagttctgggaggcaccccaggttattggtcagagttacaggctatattttatttcagtgaattcagagagcacattgagtcagatcaagaatgtttattctcataggagatgaatttaaggagttaaaactaacatataaaatagaaacaaatactttcatccctgggaagactttccgttaagcttccctcctgacacaatgttacggaaatagaaaactttgtcaagtgatttttttt

SEQ ID NO: 104152 - DNA, 601 bp, Human
caaatcaatctgtcaaaagcaattcagtgcctactgcacatctatctgtatttaaacatattgtgccctatgtttatacttaaatcttctgaatctatatttagaacaccattaccgaccacaattgaccatgaaccatctagcattttaaagcaatatttgtttcgaagaatatactgctacggtttttgcagctcaatttattaatgctactgtaagcttaccatcttcctgaacaaaaaatttagcagttagcagcaagtagattatcgctatgtaaaataaaattcctgagtttctstcactcgctcttacagtacctacctgcctacctgcctctgaggagaaacgctgtaattaggcaacaggaaaattgtactatctttcaaatgcatttgcaaatgcctttaaggattttatcctttagaatcatagatcttgctgttaccttctgagttatttctagagttgatctgttcattaactggaacttgcgttctacgatttagttgccttatttccacccttcatttttttttatttttttaaagcaaaaattaatttttttatttttttattccaccctttaaaaataagtaag

SEQ ID NO: 104153 - DNA, 601 bp, Human
gcacatctatctgtatttaaacatattgtgccctatgtttatacttaaatcttctgaatctatatttagaacaccattaccgaccacaattgaccatgaaccatctagcattttaaagcaatatttgtttcgaagaatatactgctacggtttttgcagctcaatttattaatgctactgtaagcttaccatcttcctgaacaaaaaatttagcagttagcagcaagtagattatcgctatgtaaaataaaattcctgagtttctgtcactcgctcttacagtacctacctgcctacctgyctctgaggagaaacgctgtaattaggcaacaggaaaattgtactatctttcaaatgcatttgcaaatgcctttaaggattttatcctttagaatcatagatcttgctgttaccttctgagttatttctagagttgatctgttcattaactggaacttgcgttctacgatttagttgccttatttccacccttcatttttttttatttttttaaagcaaaaattaatttttttatttttttattccaccctttaaaaataagtaagtgatattttattttataaataaatgagcaagcaat

SEQ ID NO: 104154 - DNA, 601 bp, Human
gcatttcttgtaatagaaaattaccaagtggtgtcaatgtgactcattcgagatttttttttttccttctggaagtcatagcttagtttctcaatgactcttggttcctatgtaatgccagttaagggacagctatatgacatgatatataaatgaagtgccagtttctgtgttactttgctccttgcaaacctatatgcctgaaagattggaggaagttttttccttctcgtaatctctacttcttttgtcatactgcagtgctgacactcattaaaaagaaaacattccttgtttggamctttcccaaagttttttttttttttttttctccttccaatttgaaacatctcaggctttagtcagtggcaaaattgaagttaattgtttgctctctcttcttgttaatgtattttgtactcaggagagggtctggggacatagaaatgtttcaaaagatgtcaggtgtggtcaaacttgcttttcaacctcattgagagacaatatagcaaaaggctgagagcacaaactggagccagactgcttgggggtgtggggatctggctgtgctctgtgatcgctgtgtgaccttgggcaggtc

SEQ ID NO: 104155 - DNA, 601 bp, Human
aggagagggtctggggacatagaaatgtttcaaaagatgtcaggtgtggtcaaacttgcttttcaacctcattgagagacaatatagcaaaaggctgagagcacaaactggagccagactgcttgggggtgtggggatctggctgtgctctgtgatcgctgtgtgaccttgggcaggtcacttaacctttctggtactgcgtttcttcatctgcaaaatgggagtaatatcatagggatgctgtgaggatctaaatgagttaatactgatgaactaactgcttagaacaaggtttgccccktactaaatactgtgcacggtggtaataagtaataataattgatttctcctacttttcttcctctagtctatatcactacccttcagacacactggactcttttctctccttcatacaagtcaagcctttttctgtctccaagtctctgctcttgctgttttctttacctgtgttctctctcacatatcactttatgctcttcagatcctttgtcgcaatgttacccttatgttttatggtatggtcctgctgtgtttttgtcttccctgactgcatgctcactcgtgctctctctcaatc

SEQ ID NO: 104156 - DNA, 601 bp, Human
tactaaatactgtgcacggtggtaataagtaataataattgatttctcctacttttcttcctctagtctatatcactacccttcagacacactggactcttttctctccttcatacaagtcaagcctttttctgtctccaagtctctgctcttgctgttttctttacctgtgttctctctcacatatcactttatgctcttcagatcctttgtcgcaatgttacccttatgttttatggtatggtcctgctgtgtttttgtcttccctgactgcatgctcactcgtgctctctctcaatcrtgcgctctctctctctctccctccctccctctctctccctccctctccctccctccctcccccccactctcaactgtgtattctagagagtcaggaccttccttctcattcttgatcattctcatagtagccctgccccttgagtggaacatggcatttagtaaaggatgaataagggaaggaatcattctgagaaaatactgaagatgatagctatggacttgaggcaagcatcccatttaggtaaaatgctttgtccgacattgaatttatcatatcagcttcatttaatgcattatg

SEQ ID NO: 104157 - DNA, 601 bp, Human
ctttaacagagtttcaacagagttcgtgtgagtgcaagcttgtgctctataaccaagaaccattcactggaacttgagcatcctgctgatcttccctcccccactcccagccagtgcagccatgtattaagcaattgttttcagtaccaacagtttaccaaagtgttggaataaaaacgacatctaaaacttgaatattttatatggccaaactatggctatttaactatacagttgaatatatttggattataacatatttatctcttaaagggacagatcttccatcctcctaacatayagttagcttccactctccaaatattccaccagcaacattgatgaatattgaagactatggactgtgaggtactgtgaaagacccactctaggacctgcttgctgctatttgccttacttgaaccagtaatcaagtgctggataaataatatgatttctattcaactttttgtttttagcccttagggaacaatctactgaatatgcaatgcaattgtcgggggatagttacttttcattacctaggtttctgttccttcttttaagtgtaatttaaatctggctgtcatgaaggtttggc

SEQ ID NO: 104158 - DNA, 601 bp, Human
aaatattccaccagcaacattgatgaatattgaagactatggactgtgaggtactgtgaaagacccactctaggacctgcttgctgctatttgccttacttgaaccagtaatcaagtgctggataaataatatgatttctattcaactttttgtttttagcccttagggaacaatctactgaatatgcaatgcaattgtcgggggatagttacttttcattacctaggtttctgttccttcttttaagtgtaatttaaatctggctgtcatgaaggtttggcgctcaaacagattttagcrtctgtttaatgtagaagtggactggaactagcattctgaaaatgtagtctgaacccaaagaaatcccatgactctccttttctgtcctatcatagaaacagataattacatttttaaagtttttgtgtgtgggtgtgtgtgttgtcattttgaggtggggtttcaccatgttgcccaggctagactcaaactcctaggctgaagcagtcctcccacctcagcctcccaagtagcagggattacaggtgtgcactactgcacccagcttaagttttactttgtttctaatagatatataat

SEQ ID NO: 104159 - DNA, 601 bp, Human
actatccaggggagctttaagtgagccaagtggaccctcagcaccacctcagagtgttctaagctaccgtctggtgtttgggactcagggaagtccttttggtatgatcagactagccctttatgtgactatccttgtgtgttactctcattaaaatattgatttttgccatgtaaggaagattggaatagcacaggcagccgaataaggattttaatgaaacattggagaatggcttcaagttaatctgtgaatgctttgtcattgtcccatccctggacacattaaaaagaaaaaaaaacagttgagaaattgcagtacaatttgaggagagcaatatcatacacagaagtagggactacttttgtcaaagctggattttatttatttgggagcaaagagagagagctgaaagacataatcttctctcccttaagaatctcattgtcatttagtaaaataaaaggtagtgtcacttcatggctcagaagtggtaaattatttgaggcaggtacccaaatccataaagcctgccttttgctttgtttgtggaatgctgattgtgtgctggggaatttctgatgggcagccaagaggaatt

SEQ ID NO: 104160 - DNA, 601 bp, Human
aaaaacccagccaggtacggtggctcacacctgtaatcccagcactttcggaggccaaggagggtggatcacttgaggtcaggagttcaagaccagcctggccaacatggcgaaaccctgtctctactaaaatacaacaattagctgggcatggtggtgcatgtctgtaatctcagctacttaggaggctgaggcaggagaatcacttgaacccaggaggtggaggttgcagtgagccaagatcgtgccactgcactctgccactcactctagcctgtgggacagagagagactccgtctyaaaaaaaaaaaaaaacccacattctagaaataattaggtttctaaagtattcttaaaaggggcatctgtggaaaccagccactaataacatatttaaaggagagagactgaatgcttccccctaagatgaggaaagaggcaaggatgtcggcacttgccactggtattcaacattgcattgcccctaaccaggacaatcagtcaagaaaaaaaaataaataaaagacatccacattggaaaggaagaagtaaaactgtctctctttgcagatggtatgatcctctatgtaaagtattcca

SEQ ID NO: 104161 - DNA, 601 bp, Human
aaaacccagccaggtacggtggctcacacctgtaatcccagcactttcggaggccaaggagggtggatcacttgaggtcaggagttcaagaccagcctggccaacatggcgaaaccctgtctctactaaaatacaacaattagctgggcatggtggtgcatgtctgtaatctcagctacttaggaggctgaggcaggagaatcacttgaacccaggaggtggaggttgcagtgagccaagatcgtgccactgcactctgccactcactctagcctgtgggacagagagagactccgtcttaaaaaaaaaaaaaaacccacattctagaaataattaggtttctaaagtattcttaaaaggggcatctgtggaaaccagccactaataacatatttaaaggagagagactgaatgcttccccctaagatgaggaaagaggcaaggatgtcggcacttgccactggtattcaacattgcattgcccctaaccaggacaatcagtcaagaaaaaaaaataaataaaagacatccacattggaaaggaagaagtaaaactgtctctctttgcagatggtatgatcctctatgtaaagtattccaa

SEQ ID NO: 104162 - DNA, 601 bp, Human
gaggtggaggttgcagtgagccaagatcgtgccactgcactctgccactcactctagcctgtgggacagagagagactccgtcttaaaaaaaaaaaaaaacccacattctagaaataattaggtttctaaagtattcttaaaaggggcatctgtggaaaccagccactaataacatatttaaaggagagagactgaatgcttccccctaagatgaggaaagaggcaaggatgtcggcacttgccactggtattcaacattgcattgcccctaaccaggacaatcagtcaagaaaaaaaaawaaataaaagacatccacattggaaaggaagaagtaaaactgtctctctttgcagatggtatgatcctctatgtaaagtattccaacgatcgtggatctgtctctccctcccctatgctcttgggccctggctctgtttctctcctggagtagaagcctgtggtgcagcaggattcaattgccttcaattgaacgttgcagaggactttcccctcggtgcttcccgtactgggggaagaggtgatttaacttctgagtaagggacaaacccagtagtgtgttagtagcaaaaagcatggac

SEQ ID NO: 104163 - DNA, 601 bp, Human
cctacactccagccttggtgacagagcaagaccctgtctcaaaacaaaacaaaacaaaagaagcactctatgggaccaggtcttatagttaggtattatatatgtagtagtgatattttcagttttgctgtttctgccagatgggatgaaaaattccatgagaagttggctggaagtcctactgattcattaaataggcctttcatttgaagtcatgtttctaatcattcagaagttgaggtatgcctgatccatggtattagaagggatgatcccagagaggtcattctgtagcataatragcattacttttgaaggatggagaacctagaactctgactcatttgactatgggaaaatctgatctggtgagtgaccatgaccatgaagtgagatctggtaacccaatggtggtcacaggatagagactctgaagatactgagctggcttacacacttgctttgttgtctcgaacctctgttaaagctgaaagaagaagtcagtcttctgctgggcacactgttagtgtgtaattgtgaagagcttagctggagcttgctcttcacaacagtctctgatctcatcagccccattctgttt

SEQ ID NO: 104164 - DNA, 601 bp, Human
tttccccagaagagttcccattcttggccaggtgcctgtaatcctagcactctgggaggctgaggcaggtggatcacctgaggtcaggagttcgagaccagcctggcctacgtggtgaaaccccgtctctactaaaaatacaaaaatgagcctggtgtgatggtgggcacctataatccctgctactcgggaggctgaggaaggagaatcacttgaacccagggggcggaggttgcagtgagcctagatcgtgccacttcactctagcctggggggaagagcaaaactttgtctcaaaacaaaaaaaagagttcccactccctgaagctgttttttgtttgcatgtttgttgtcagtctcctgtcatcattcgaaggtcagggccttgagggcaggaccctttcttgttcactgctgcatccccacccctcagcagttcctggcatagacagcaagtgctttatatattctggttgaataaatgaattaagtgttctttgattcattatgctgtctacggtaggaaactctattttgcaatctaattagaccagccttttgccaaatttgaattattttaaacaaaatcagaactattgtg

SEQ ID NO: 104165 - DNA, 601 bp, Human
ttccggatgtccatagtcagtgctaaaatcctgcttccttctggctgcttctgcctttcacatgatagcatatattttaacatggctggctgctgagagttcagaaaaggaagaggatatatgtggttctaaactttgctattttaaaatggcagttataaattctaaaatgtatattcattatcatttagccaaacatccccgttgagtcaggtcaaggacagttaaccaaacattagcatatgtaacgtaacataatatataacatttactgagtccttcctatgtgtcaggcatcatratgaatgtttatagacagtatgtccatctaatcctctcaacaaccttccaaggttatattagtatctccatttaacaagtgaggaaactgaggtgctgaaaggtgttaagtaatattcccaaggacactcaactaggaaatatgagaaccaggttctgaatgcagacaatttgattccaaaactgcattcaactgcaaagctgtctcgtgaactgcacttagcagataagtggtggtactcaagccagaagtcaggtctgatctttcggttccatcattccatactgcctgttcctctgt

SEQ ID NO: 104166 - DNA, 601 bp, Human
caggtgctgtggctcatgcttgtattcccagcattttgggaggctgagatgggaggatcactagagcccaggagttcgagaccagcctaagaaacataggaagatcctatctcttaaaaaaaaaaaaaagaaaaaatatacataggctgggcgtgatggctaacacctgtaatcccagtactttgagaggctgaggcagccgtatcagttgaggccaggagtttgagaccagcctggccaacatggcaaaacccccatctctactaaaaaataaaaaaattagccgggtgttgtggcgggygcctgtgatcccagctatttgggaggatgaggcatgagaattgattgaatctgggaggcagaggttgcagttagctgagattgtgccactgcagtccagcctgggcgacagagcgagactgtctcaaaataaataaaataaaataaaaaaattttaaaaatacagaaattagctgggcatgtcaatgtgtgcctgcagccccagctacttgggaggctgagttgggaggatcacctgagcccagaaggtcaaggctgcagtgagctgtgatagcaccaccatactccagccttggcaaca

SEQ ID NO: 104167 - DNA, 601 bp, Human
tgctgggtctcccagcctggagtgcagtggtgcaatctcggctcactgcaacctccacctcccggattcaagcagttctcctgcctcagcctcccgagcagctgggattacaggcactcatcacctcgcccagctaatttttttatatttttagtagaaacagggtttcaccatgttggccaggctggttttgaactcctgacctcaagtgatctgcttgccctggcgtcccaaagtgctgggattacaggtgtgagccaccatgcccggccaaaaattgtttcttcatatccttattctwtaagatttttttttctatgttttaaatactttttttatttttaaagaagcaacaccattcagttcagaacacccatactgactttgagctgatggcctttgtaggtttctaactggaagtgaaattttttctatttttaaaactttctttttatttcatagttactttttaagctttttttgttaaaaattaagacacaaacacacaccttatcctaggcctatacagggtcaggatcatcagtatccgtcttctgcctccacatcttgccccagtggaaggtcacatggacacacctgc

SEQ ID NO: 104168 - DNA, 601 bp, Human
ctgacctcaagtgatctgcttgccctggcgtcccaaagtgctgggattacaggtgtgagccaccatgcccggccaaaaattgtttcttcatatccttattctataagatttttttttctatgttttaaatactttttttatttttaaagaagcaacaccattcagttcagaacacccatactgactttgagctgatggcctttgtaggtttctaactggaagtgaaattttttctatttttaaaactttctttttatttcatagttactttttaagctttttttgttaaaaattaagacamaaacacacaccttatcctaggcctatacagggtcaggatcatcagtatccgtcttctgcctccacatcttgccccagtggaaggtcacatggacacacctgccatgtgtggagctgtcctctcctatggtaacaaggccttctggaatacctcagggaggacctgcttgcacctgttttacagttaacatttttttttaataagtagaaggaatacactataatgctaaaaagtatagtatagtaactacataaaccagtaactgtcacttatgatcattatcaagtgttatgtgctgta

SEQ ID NO: 104169 - DNA, 601 bp, Human
aattttttctatttttaaaactttctttttatttcatagttactttttaagctttttttgttaaaaattaagacacaaacacacaccttatcctaggcctatacagggtcaggatcatcagtatccgtcttctgcctccacatcttgccccagtggaaggtcacatggacacacctgccatgtgtggagctgtcctctcctatggtaacaaggccttctggaatacctcagggaggacctgcttgcacctgttttacagttaacatttttttttaataagtagaaggaatacactataatrctaaaaagtatagtatagtaactacataaaccagtaactgtcacttatgatcattatcaagtgttatgtgctgtacataattatacatgctatacttttatatgactggcagcgcagtaggtttgtttacaccagcatcaccacaaacatgtggatgatacagtgtactacgatgttacaatggcacagtggctatgatgtcactaagcaataggaatgtttcagctccattacagtcttatggggccattgttaaatatgcagtccatcactgaaacgcatggctgcatgtggtagaag

SEQ ID NO: 104170 - DNA, 601 bp, Human
ctgagtatgcatcctctgcaaaccactgctgtagcatcagactctgggtacccttactgtgaattcactgcctttccaaggtcctaactgttgctggctctgcttgtcatcatccagattcataacgccatacataccttaacaaagtgtgaggagagtaactttcactagggtgcaaatgcccatcaagtttaacctcacagattgcatttatactttaaaagaggagctcagtagtaaatattaatttgtaattatagattctaactgtggattgtagagcagttgctttgctgtgacgggcatctatgcaagaggcacttctcttatcttgccatctacctaccctagcctcttaaaattaagaaaaatagaagtcagtgactaagccaccaaatttgaatgtgttacctgggctagctggagtgttttgggggagaattctaaaacctgctctggtcttagctctgccctcatttactgagcctctatttccttttctataaagtggagctaataggagttttgtgaagagtaaaagtgagctgaaaagtgctgggctgacacaaggtagccctgcacatagccagggagcccagca

SEQ ID NO: 104171 - DNA, 601 bp, Human
cagactctgggtacccttactgtgaattcactgcctttccaaggtcctaactgttgctggctctgcttgtcatcatccagattcataacgccatacataccttaacaaagtgtgaggagagtaactttcactagggtgcaaatgcccatcaagtttaacctcacagattgcatttatactttaaaagaggagctcagtagtaaatattaatttgtaattatagattctaactgtggattgtagagcagttgctttgctgtgacaggcatctatgcaagaggcacttctcttatcttgccayctacctaccctagcctcttaaaattaagaaaaatagaagtcagtgactaagccaccaaatttgaatgtgttacctgggctagctggagtgttttgggggagaattctaaaacctgctctggtcttagctctgccctcatttactgagcctctatttccttttctataaagtggagctaataggagttttgtgaagagtaaaagtgagctgaaaagtgctgggctgacacaaggtagccctgcacatagccagggagcccagcatcctgtccaaagattagagtctgaaagctcactctac

SEQ ID NO: 104172 - DNA, 601 bp, Human
tgcaatcatagctcactacagcctcagcctcctgggctcaggtgatcctcccacttcagcctcctgagtagacatgagagtctccctgtgtggcccaggctgcctggcctcaagtgttccttccaccttggcctcccaaattgttgggactgtaggtgtgagccaccatgcttaggtggcagctttattttaaatgacctgtttgccccagatgtgttgaatttaaggataggctggaggttcagtcatttttatttattttcaaagaggtgttcagaattcacactctgtttttcttttrataactactgtggcttcctcctcatgctgactttctacacttgggaagagaatgtgggcaaggaagcttggagggaagccagagactccttgctctctgcagctgcacagacaggccaggatctgctgacctgtggaaccagcccgctgcagtgtgtgccccccagcccccggaggggcagcgggcatgcctcagagagcagctcagagtgaagacggtagaaggggaaaactgatgagaattattgtgaatcatggtggggaggaggggttttaagaagttaggcctgttaggctgggt

SEQ ID NO: 104173 - DNA, 601 bp, Human
atcatctgagctcaggagttcaagaatagcctggccaacatggcaaaacctcgtttctactaaaaatacaaaaattagctgggtgtggtggtgcgcatctgtaatcccagctacttgggaggctgaggcaggagaatcacttgaacccgggagatggaggttgcagtgagccgagatcgtgccactgcactccagcccgggcgacaagagtgaaactccatctcaaaaaaaaaaaagcagttaggcctattttgctgtgctaagagaaacttacttttaatgaactgagctgcatgcctaycccaaattctgttttaaggaagatgctctgaccacagtgtcagtttggctctaaagtttcaagggatactgaaagggaatattggaaccaaatgaatctgaatgggaatcccaggtctgtcactgtctgttttagaccttggaaacattacttaacctcttttgaaaataaggatttaccatcttgttggttggtttgttaggatgattagatacattccagatcagggtaactctcctaggttaaaagcagggactgaagccaggcaattaccagggatggaaattttaaagctgacgg

SEQ ID NO: 104174 - DNA, 601 bp, Human
gctctaaagtttcaagggatactgaaagggaatattggaaccaaatgaatctgaatgggaatcccaggtctgtcactgtctgttttagaccttggaaacattacttaacctcttttgaaaataaggatttaccatcttgttggttggtttgttaggatgattagatacattccagatcagggtaactctcctaggttaaaagcagggactgaagccaggcaattaccagggatggaaattttaaagctgacggcagaacacacaccagagctgctggctcgtggaagcctttgaagtgatkatttgatgggcaatctgagttcctcaggagctgcccaaagcctcataggctcaggagccatgctctgctttcagagtactcaacctgggccttcccctacctgtgtgagatgtctgctgctgcacccgcacgtgccccaggatcgaagggaggcctcagagtcctgccctcacagtgtcccccatgtctgaaggcaaaaaacttggaatcactgtgcatatactattttggatgctcgctttcttgctttctcactttcttgctttctctctctctctctctccctctcctccctcccca

SEQ ID NO: 104175 - DNA, 601 bp, Human
ctacctgtgtgagatgtctgctgctgcacccgcacgtgccccaggatcgaagggaggcctcagagtcctgccctcacagtgtcccccatgtctgaaggcaaaaaacttggaatcactgtgcatatactattttggatgctcgctttcttgctttctcactttcttgctttctctctctctctctctccctctcctccctccccactccctctctctccctctccatccctctccccaccatgtcctgctcctctcactccctccctccccctccctatgtaatgtatactttagcattttrccatgttaaatattttttcaataatgtgatttttgttggctatattattctacagcaacgactactgcagtggtgtagataaatctcataatgttgatcagaatctcccaggcacaaaagagaaaaaaagatacatgactgtatacttttctgtgtatagactgcatagttgagtaatttttaaattattttatatggtactgtctttgatgacttctcagaaacatcagattgattcatacctttttttggtctctatttactcatttgccagtaataaagcatcttgctccctaaggc

SEQ ID NO: 104176 - DNA, 601 bp, Human
tcagaggctgcccagagtttaaattacaccatagtttttctttctttctgcaaatcattctttctgatttgcagttttttccaaacagagccatattagtggaacaaaagtttgatgttcatgcccaacaagctctgatattttatggatacatttgtataaagcaagacttcttgctctgaaccctgggtgaccacaaataaattgaggggccatgattattggatgctgagagaaagtagcatacttaaacccacagtacagataatcaggaggcaagcaaaaacaaagctataacttrgcagtggtattcacccaccacttattccaaaaacatattttgcttattaaataagggaaatatggtccagttttgcaatgttaatagctgccagtctctcatattttttataaatatcatttcctgactagcaatgagctaggaaactggcctcaaattctgaccaaatctctcagtattagttaaaaataatacaaaacaaaacagaacaaaaaaccagccaacaggggttaaaagttgcacaattaaacttgaatgtaaattatactatatacagattggtataaacatcactgaaat

SEQ ID NO: 104177 - DNA, 601 bp, Human
ctgcctgatagaactttcagtaccttcagtgcccaaagggcgcgacgactagcccttaaaagaggctggagcccctgaggaagcgggtctttaggcaaaaccaccgcacggcagagcagccacaggacagatcaatgtcttcctgcgggagtgaggccttcggtctttttttgagacggagtctcactctgtcacccaggctggagtgcagtggcgcgatcttggctcactgcaacctccaactccccggttcaagcgattctcctgcctcagcctcccaagtagctgggactacaggcaygcgcaaccacggccagctaatttttgggttttttttgagacggagcctcactctgtcaccaggctggagtgcagtggtacgatctcagctcactgcaacttccacctcccgggtccaagcaattctcctacctcagcctcccaagtagctgggattacaggcgtgtgccaccacacctggctaattttttttcatatttttagtagagatggggtttcaccatgtttgccaggctggtctcgaactcctgacctcaggtgatctgcctgccttggcctcccacagtgctgggattacaga

SEQ ID NO: 104178 - DNA, 601 bp, Human
agacaggctcccagattgtccaccctccacagggagaagtcagggaggtgggcaggggacggggtcagccaccggctcagcctgtgcacgcccatccctcccagcagcacccctctccggcccacctggctggcctgagtctgtggactggcactgcctgatagaactttcagtaccttcagtgcccaaagggcgcgacgactagcccttaaaagaggctggagcccctgaggaagcgggtctttaggcaaaaccaccgcacggcagagcagccacaggacagatcaatgtcttcctgcgtgagtgaggccttcggtctttttttgagacggagtctcactctgtcacccaggctggagtgcagtggcgcgatcttggctcactgcaacctccaactccccggttcaagcgattctcctgcctcagcctcccaagtagctgggactacaggcacgcgcaaccacggccagctaatttttgggttttttttgagacggagcctcactctgtcaccaggctggagtgcagtggtacgatctcagctcactgcaacttccacctcccgggtccaagcaattctcctacctcagcctcccaagta

SEQ ID NO: 104179 - DNA, 601 bp, Human
ggcagggccctgaggaaggtgaggacatcctggagagctgtggccaccaaggtgctgcacggcctggaggtctccacacatctgggcaaacggaagctttctgggaggagctggctcccaggccctgctctccacgccaccccatcacagtcgcacacacagacaggctcccagattgtccaccctccacagggagaagtcagggaggtgggcaggggacggggtcagccaccggctcagcctgtgcacgcccatccctcccagcagcacccctctccggcccacctggctggcctgagtmtgtggactggcactgcctgatagaactttcagtaccttcagtgcccaaagggcgcgacgactagcccttaaaagaggctggagcccctgaggaagcgggtctttaggcaaaaccaccgcacggcagagcagccacaggacagatcaatgtcttcctgcgggagtgaggccttcggtctttttttgagacggagtctcactctgtcacccaggctggagtgcagtggcgcgatcttggctcactgcaacctccaactccccggttcaagcgattctcctgcctcagcctcccaagtagctg

SEQ ID NO: 104180 - DNA, 601 bp, Human
gcgcagacgacaggcacgtgcaagcctctcctctccagcaggagagcccggagcaggacacagcgactctttcaactgcgtcccgacaaacggtcagccccttcgctcctgcagtttatccaagctcaggaggagctttctaaagagaacacagggagacagctggctgccagagaagcagtcttggaaacgccagagccaggccccagggggaagtggcccaagtgtccctactctgctcctggaagcaggccaggctcaccaccaaggctcttccctgaggggtagacagtgtctgccragcacctgagcctctggcagctgcccagagtttgagagtgccctggggtcctggctctggaaggctccacccagctaacagggcctgtgacacaggtggcagccagcaagacccactgcagcggcatggccctcacagcctcccctgtccctgtcctgggagcagccccggcaaagactcctacccagaacactccaggtcaggagggcagggccctgaggaaggtgaggacatcctggagagctgtggccaccaaggtgctgcacggcctggaggtctccacacatctgggcaaacgga

SEQ ID NO: 104181 - DNA, 601 bp, Human
tgcagcgagggctgggggttccccagtcaaatgaaggggaatggggcatgaggacaggcgagtacttactttgctttggcctcctaggacagcatgaaggaaaagcagcaaggttagaggcagccagaaagactaaccgggtcagacacagcagcaggtcagcccggggcggccgggggcctttccagaagctgcttggcgaggtggtgtggaggtgacactggtggagatggaagctgagcgccagacagacccgccgccaccacaatcccaggtggcagctgagtccacacaggtgacrtcactccgtcatcccctgaaaggggagctcttgggattactgtcagttggagcctaggcaggccctgggggacaagcagggaccactatctgagccaacctttcccaaatccacccaccctgtcgtcacctgagcaaggtagcctgagacaagataagccagcgcccacaagcatcccctggagctgccaaggagctcccccaagcccctcacctgcactgcccctgtgtccggtctgctgaaggaggcccggaagatgacaaggaccctcaagggggaggcagcccagggctcacatta

SEQ ID NO: 104182 - DNA, 601 bp, Human
ccactgccacacccagagcaccctcaaagttcttacaaaagaaggagcctcggccaggcacggtggctcacacctgtaatcccaacactttgggaggccgaggcgggcggatcacagggtctggagactgagaccatcctggctaacacgttgaaaccctgtctctactaaaaataaaaataaaaattagccgggcgtggtggcaggcgcctgtagtcccagctcctagggaggctgaggcaggagaatggcgtgaagccgggaggcggagcttgcagtgaaccgagatggcgccactgcmctccagcctggacaacagagcaggggaaaagaaaaaaaaagagggagcttctttgtgggcctgactgtcctccccaggagggggccaggtggccgggcagagggtggagtgcccactcatgaaggagacgccagggaggatgctggtgaccactgtgtagaaaggaggggccaagcgcctggagcactgagacggctctaggctctctatcagctgcccccgcctcccagctggagtccatacctttgggtccatccaagctaaaggggaatcatggggctctcacagtcccaggacatc

SEQ ID NO: 104183 - DNA, 601 bp, Human; identical to SEQ ID NO: 62188

SEQ ID NO: 104184 - DNA, 601 bp, Human; identical to SEQ ID NO: 62189

SEQ ID NO: 104185 - DNA, 601 bp, Human; identical to SEQ ID NO: 62190

SEQ ID NO: 104186 - DNA, 601 bp, Human; identical to SEQ ID NO: 62191

SEQ ID NO: 104187 - DNA, 601 bp, Human; identical to SEQ ID NO: 62192

SEQ ID NO: 104188 - DNA, 601 bp, Human; identical to SEQ ID NO: 62193

SEQ ID NO: 104189 - DNA, 601 bp, Human; identical to SEQ ID NO: 62194

SEQ ID NO: 104190 - DNA, 601 bp, Human; identical to SEQ ID NO: 62195

SEQ ID NO: 104191 - DNA, 601 bp, Human; identical to SEQ ID NO: 62196

SEQ ID NO: 104192 - DNA, 601 bp, Human; identical to SEQ ID NO: 62197

SEQ ID NO: 104193 - DNA, 601 bp, Human; identical to SEQ ID NO: 62198

SEQ ID NO: 104194 - DNA, 601 bp, Human; identical to SEQ ID NO: 62199

SEQ ID NO: 104195 - DNA, 601 bp, Human; identical to SEQ ID NO: 62200

SEQ ID NO: 104196 - DNA, 601 bp, Human; identical to SEQ ID NO: 62201

SEQ ID NO: 104197 - DNA, 601 bp, Human; identical to SEQ ID NO: 62202

SEQ ID NO: 104198 - DNA, 601 bp, Human; identical to SEQ ID NO: 62203

SEQ ID NO: 104199 - DNA, 601 bp, Human; identical to SEQ ID NO: 62204

SEQ ID NO: 104200 - DNA, 601 bp, Human; identical to SEQ ID NO: 62205

SEQ ID NO: 104201 - DNA, 601 bp, Human; identical to SEQ ID NO: 62206

SEQ ID NO: 104202 - DNA, 601 bp, Human; identical to SEQ ID NO: 62207

SEQ ID NO: 104203 - DNA, 601 bp, Human; identical to SEQ ID NO: 62208

SEQ ID NO: 104204 - DNA, 601 bp, Human; identical to SEQ ID NO: 62209

SEQ ID NO: 104205 - DNA, 601 bp, Human; identical to SEQ ID NO: 62210

SEQ ID NO: 104206 - DNA, 601 bp, Human; identical to SEQ ID NO: 62211

SEQ ID NO: 104207 - DNA, 601 bp, Human; identical to SEQ ID NO: 62212

SEQ ID NO: 104208 - DNA, 601 bp, Human; identical to SEQ ID NO: 62213

SEQ ID NO: 104209 - DNA, 601 bp, Human; identical to SEQ ID NO: 62214

SEQ ID NO: 104210 - DNA, 601 bp, Human; identical to SEQ ID NO: 62215

SEQ ID NO: 104211 - DNA, 601 bp, Human; identical to SEQ ID NO: 62216

SEQ ID NO: 104212 - DNA, 601 bp, Human; identical to SEQ ID NO: 62217

SEQ ID NO: 104213 - DNA, 601 bp, Human; identical to SEQ ID NO: 62218

SEQ ID NO: 104214 - DNA, 601 bp, Human; identical to SEQ ID NO: 62219

SEQ ID NO: 104215 - DNA, 601 bp, Human; identical to SEQ ID NO: 62220

SEQ ID NO: 104216 - DNA, 601 bp, Human; identical to SEQ ID NO: 62221

SEQ ID NO: 104217 - DNA, 601 bp, Human; identical to SEQ ID NO: 62222

SEQ ID NO: 104218 - DNA, 601 bp, Human; identical to SEQ ID NO: 62223

SEQ ID NO: 104219 - DNA, 601 bp, Human; identical to SEQ ID NO: 62224

SEQ ID NO: 104220 - DNA, 601 bp, Human; identical to SEQ ID NO: 62225

SEQ ID NO: 104221 - DNA, 601 bp, Human; identical to SEQ ID NO: 18568

SEQ ID NO: 104222 - DNA, 601 bp, Human; identical to SEQ ID NO: 18569

SEQ ID NO: 104223 - DNA, 601 bp, Human; identical to SEQ ID NO: 18570

SEQ ID NO: 104224 - DNA, 601 bp, Human; identical to SEQ ID NO: 18571

SEQ ID NO: 104225 - DNA, 601 bp, Human; identical to SEQ ID NO: 18572

SEQ ID NO: 104226 - DNA, 601 bp, Human; identical to SEQ ID NO: 18573

SEQ ID NO: 104227 - DNA, 601 bp, Human; identical to SEQ ID NO: 18574

SEQ ID NO: 104228 - DNA, 601 bp, Human; identical to SEQ ID NO: 18575

SEQ ID NO: 104229 - DNA, 601 bp, Human; identical to SEQ ID NO: 18576

SEQ ID NO: 104230 - DNA, 601 bp, Human; identical to SEQ ID NO: 18577

SEQ ID NO: 104231 - DNA, 601 bp, Human; identical to SEQ ID NO: 18578

SEQ ID NO: 104232 - DNA, 601 bp, Human; identical to SEQ ID NO: 18579

SEQ ID NO: 104233 - DNA, 601 bp, Human; identical to SEQ ID NO: 18580

SEQ ID NO: 104234 - DNA, 601 bp, Human; identical to SEQ ID NO: 18581

SEQ ID NO: 104235 - DNA, 601 bp, Human; identical to SEQ ID NO: 18582

SEQ ID NO: 104236 - DNA, 601 bp, Human; identical to SEQ ID NO: 18583

SEQ ID NO: 104237 - DNA, 601 bp, Human; identical to SEQ ID NO: 18584

SEQ ID NO: 104238 - DNA, 601 bp, Human; identical to SEQ ID NO: 18585

SEQ ID NO: 104239 - DNA, 601 bp, Human; identical to SEQ ID NO: 18586

SEQ ID NO: 104240 - DNA, 601 bp, Human; identical to SEQ ID NO: 18587

SEQ ID NO: 104241 - DNA, 601 bp, Human; identical to SEQ ID NO: 18588

SEQ ID NO: 104242 - DNA, 601 bp, Human; identical to SEQ ID NO: 18589

SEQ ID NO: 104243 - DNA, 601 bp, Human; identical to SEQ ID NO: 18590

SEQ ID NO: 104244 - DNA, 601 bp, Human; identical to SEQ ID NO: 18591

SEQ ID NO: 104245 - DNA, 601 bp, Human; identical to SEQ ID NO: 18592

SEQ ID NO: 104246 - DNA, 601 bp, Human; identical to SEQ ID NO: 18593

SEQ ID NO: 104247 - DNA, 601 bp, Human; identical to SEQ ID NO: 18594

SEQ ID NO: 104248 - DNA, 601 bp, Human; identical to SEQ ID NO: 18595

SEQ ID NO: 104249 - DNA, 601 bp, Human; identical to SEQ ID NO: 18596

SEQ ID NO: 104250 - DNA, 601 bp, Human; identical to SEQ ID NO: 18597

SEQ ID NO: 104251 - DNA, 601 bp, Human; identical to SEQ ID NO: 18598

SEQ ID NO: 104252 - DNA, 601 bp, Human; identical to SEQ ID NO: 18599

SEQ ID NO: 104253 - DNA, 601 bp, Human; identical to SEQ ID NO: 18600

SEQ ID NO: 104254 - DNA, 601 bp, Human; identical to SEQ ID NO: 62188

SEQ ID NO: 104255 - DNA, 601 bp, Human; identical to SEQ ID NO: 62189

SEQ ID NO: 104256 - DNA, 601 bp, Human; identical to SEQ ID NO: 62190

SEQ ID NO: 104257 - DNA, 601 bp, Human; identical to SEQ ID NO: 62191

SEQ ID NO: 104258 - DNA, 601 bp, Human; identical to SEQ ID NO: 62192

SEQ ID NO: 104259 - DNA, 601 bp, Human; identical to SEQ ID NO: 62193

SEQ ID NO: 104260 - DNA, 601 bp, Human; identical to SEQ ID NO: 62194

SEQ ID NO: 104261 - DNA, 601 bp, Human; identical to SEQ ID NO: 62195

SEQ ID NO: 104262 - DNA, 601 bp, Human; identical to SEQ ID NO: 62196

SEQ ID NO: 104263 - DNA, 601 bp, Human; identical to SEQ ID NO: 62197

SEQ ID NO: 104264 - DNA, 601 bp, Human; identical to SEQ ID NO: 62198

SEQ ID NO: 104265 - DNA, 601 bp, Human; identical to SEQ ID NO: 62199

SEQ ID NO: 104266 - DNA, 601 bp, Human; identical to SEQ ID NO: 62200

SEQ ID NO: 104267 - DNA, 601 bp, Human; identical to SEQ ID NO: 62201

SEQ ID NO: 104268 - DNA, 601 bp, Human; identical to SEQ ID NO: 62202

SEQ ID NO: 104269 - DNA, 601 bp, Human; identical to SEQ ID NO: 62203

SEQ ID NO: 104270 - DNA, 601 bp, Human; identical to SEQ ID NO: 62204

SEQ ID NO: 104271 - DNA, 601 bp, Human; identical to SEQ ID NO: 62205

SEQ ID NO: 104272 - DNA, 601 bp, Human; identical to SEQ ID NO: 62206

SEQ ID NO: 104273 - DNA, 601 bp, Human; identical to SEQ ID NO: 62207

SEQ ID NO: 104274 - DNA, 601 bp, Human; identical to SEQ ID NO: 62208

SEQ ID NO: 104275 - DNA, 601 bp, Human; identical to SEQ ID NO: 62209

SEQ ID NO: 104276 - DNA, 601 bp, Human; identical to SEQ ID NO: 62210

SEQ ID NO: 104277 - DNA, 601 bp, Human; identical to SEQ ID NO: 62211

SEQ ID NO: 104278 - DNA, 601 bp, Human; identical to SEQ ID NO: 62212

SEQ ID NO: 104279 - DNA, 601 bp, Human; identical to SEQ ID NO: 62213

SEQ ID NO: 104280 - DNA, 601 bp, Human; identical to SEQ ID NO: 62214

SEQ ID NO: 104281 - DNA, 601 bp, Human; identical to SEQ ID NO: 62215

SEQ ID NO: 104282 - DNA, 601 bp, Human; identical to SEQ ID NO: 62216

SEQ ID NO: 104283 - DNA, 601 bp, Human; identical to SEQ ID NO: 62217

SEQ ID NO: 104284 - DNA, 601 bp, Human; identical to SEQ ID NO: 62218

SEQ ID NO: 104285 - DNA, 601 bp, Human; identical to SEQ ID NO: 62219

SEQ ID NO: 104286 - DNA, 601 bp, Human; identical to SEQ ID NO: 62220

SEQ ID NO: 104287 - DNA, 601 bp, Human; identical to SEQ ID NO: 62221

SEQ ID NO: 104288 - DNA, 601 bp, Human; identical to SEQ ID NO: 62222

SEQ ID NO: 104289 - DNA, 601 bp, Human; identical to SEQ ID NO: 62223

SEQ ID NO: 104290 - DNA, 601 bp, Human; identical to SEQ ID NO: 62224

SEQ ID NO: 104291 - DNA, 601 bp, Human; identical to SEQ ID NO: 62225

SEQ ID NO: 104292 - DNA, 601 bp, Human; identical to SEQ ID NO: 18568

SEQ ID NO: 104293 - DNA, 601 bp, Human; identical to SEQ ID NO: 18569

SEQ ID NO: 104294 - DNA, 601 bp, Human; identical to SEQ ID NO: 18570

SEQ ID NO: 104295 - DNA, 601 bp, Human; identical to SEQ ID NO: 18571

SEQ ID NO: 104296 - DNA, 601 bp, Human; identical to SEQ ID NO: 18572

SEQ ID NO: 104297 - DNA, 601 bp, Human; identical to SEQ ID NO: 18573

SEQ ID NO: 104298 - DNA, 601 bp, Human; identical to SEQ ID NO: 18574

SEQ ID NO: 104299 - DNA, 601 bp, Human; identical to SEQ ID NO: 18575

SEQ ID NO: 104300 - DNA, 601 bp, Human; identical to SEQ ID NO: 18576

SEQ ID NO: 104301 - DNA, 601 bp, Human; identical to SEQ ID NO: 18577

SEQ ID NO: 104302 - DNA, 601 bp, Human; identical to SEQ ID NO: 18578

SEQ ID NO: 104303 - DNA, 601 bp, Human; identical to SEQ ID NO: 18579

SEQ ID NO: 104304 - DNA, 601 bp, Human; identical to SEQ ID NO: 18580

SEQ ID NO: 104305 - DNA, 601 bp, Human; identical to SEQ ID NO: 18581

SEQ ID NO: 104306 - DNA, 601 bp, Human; identical to SEQ ID NO: 18582

SEQ ID NO: 104307 - DNA, 601 bp, Human; identical to SEQ ID NO: 18583

SEQ ID NO: 104308 - DNA, 601 bp, Human; identical to SEQ ID NO: 18584

SEQ ID NO: 104309 - DNA, 601 bp, Human; identical to SEQ ID NO: 18585

SEQ ID NO: 104310 - DNA, 601 bp, Human; identical to SEQ ID NO: 18586

SEQ ID NO: 104311 - DNA, 601 bp, Human; identical to SEQ ID NO: 18587

SEQ ID NO: 104312 - DNA, 601 bp, Human; identical to SEQ ID NO: 18588

SEQ ID NO: 104313 - DNA, 601 bp, Human; identical to SEQ ID NO: 18589

SEQ ID NO: 104314 - DNA, 601 bp, Human; identical to SEQ ID NO: 18590

SEQ ID NO: 104315 - DNA, 601 bp, Human; identical to SEQ ID NO: 18591

SEQ ID NO: 104316 - DNA, 601 bp, Human; identical to SEQ ID NO: 18592

SEQ ID NO: 104317 - DNA, 601 bp, Human; identical to SEQ ID NO: 18593

SEQ ID NO: 104318 - DNA, 601 bp, Human; identical to SEQ ID NO: 18594

SEQ ID NO: 104319 - DNA, 601 bp, Human; identical to SEQ ID NO: 18595

SEQ ID NO: 104320 - DNA, 601 bp, Human; identical to SEQ ID NO: 18596

SEQ ID NO: 104321 - DNA, 601 bp, Human; identical to SEQ ID NO: 18597

SEQ ID NO: 104322 - DNA, 601 bp, Human; identical to SEQ ID NO: 18598

SEQ ID NO: 104323 - DNA, 601 bp, Human; identical to SEQ ID NO: 18599

SEQ ID NO: 104324 - DNA, 601 bp, Human; identical to SEQ ID NO: 18600

SEQ ID NO: 104325 - DNA, 601 bp, Human; identical to SEQ ID NO: 62188

SEQ ID NO: 104326 - DNA, 601 bp, Human; identical to SEQ ID NO: 62189

SEQ ID NO: 104327 - DNA, 601 bp, Human; identical to SEQ ID NO: 62190

SEQ ID NO: 104328 - DNA, 601 bp, Human; identical to SEQ ID NO: 62191

SEQ ID NO: 104329 - DNA, 601 bp, Human; identical to SEQ ID NO: 62192

SEQ ID NO: 104330 - DNA, 601 bp, Human; identical to SEQ ID NO: 62193

SEQ ID NO: 104331 - DNA, 601 bp, Human; identical to SEQ ID NO: 62194

SEQ ID NO: 104332 - DNA, 601 bp, Human; identical to SEQ ID NO: 62195

SEQ ID NO: 104333 - DNA, 601 bp, Human; identical to SEQ ID NO: 62196

SEQ ID NO: 104334 - DNA, 601 bp, Human; identical to SEQ ID NO: 62197

SEQ ID NO: 104335 - DNA, 601 bp, Human; identical to SEQ ID NO: 62198

SEQ ID NO: 104336 - DNA, 601 bp, Human; identical to SEQ ID NO: 62199

SEQ ID NO: 104337 - DNA, 601 bp, Human; identical to SEQ ID NO: 62200

SEQ ID NO: 104338 - DNA, 601 bp, Human; identical to SEQ ID NO: 62201

SEQ ID NO: 104339 - DNA, 601 bp, Human; identical to SEQ ID NO: 62202

SEQ ID NO: 104340 - DNA, 601 bp, Human; identical to SEQ ID NO: 62203

SEQ ID NO: 104341 - DNA, 601 bp, Human; identical to SEQ ID NO: 62204

SEQ ID NO: 104342 - DNA, 601 bp, Human; identical to SEQ ID NO: 62205

SEQ ID NO: 104343 - DNA, 601 bp, Human; identical to SEQ ID NO: 62206

SEQ ID NO: 104344 - DNA, 601 bp, Human; identical to SEQ ID NO: 62207

SEQ ID NO: 104345 - DNA, 601 bp, Human; identical to SEQ ID NO: 62208

SEQ ID NO: 104346 - DNA, 601 bp, Human; identical to SEQ ID NO: 62209

SEQ ID NO: 104347 - DNA, 601 bp, Human; identical to SEQ ID NO: 62210

SEQ ID NO: 104348 - DNA, 601 bp, Human; identical to SEQ ID NO: 62211

SEQ ID NO: 104349 - DNA, 601 bp, Human; identical to SEQ ID NO: 62212

SEQ ID NO: 104350 - DNA, 601 bp, Human; identical to SEQ ID NO: 62213

SEQ ID NO: 104351 - DNA, 601 bp, Human; identical to SEQ ID NO: 62214

SEQ ID NO: 104352 - DNA, 601 bp, Human; identical to SEQ ID NO: 62215

SEQ ID NO: 104353 - DNA, 601 bp, Human; identical to SEQ ID NO: 62216

SEQ ID NO: 104354 - DNA, 601 bp, Human; identical to SEQ ID NO: 62217

SEQ ID NO: 104355 - DNA, 601 bp, Human; identical to SEQ ID NO: 62218

SEQ ID NO: 104356 - DNA, 601 bp, Human; identical to SEQ ID NO: 62219

SEQ ID NO: 104357 - DNA, 601 bp, Human; identical to SEQ ID NO: 62220

SEQ ID NO: 104358 - DNA, 601 bp, Human; identical to SEQ ID NO: 62221

SEQ ID NO: 104359 - DNA, 601 bp, Human; identical to SEQ ID NO: 62222

SEQ ID NO: 104360 - DNA, 601 bp, Human; identical to SEQ ID NO: 62223

SEQ ID NO: 104361 - DNA, 601 bp, Human; identical to SEQ ID NO: 62224

SEQ ID NO: 104362 - DNA, 601 bp, Human; identical to SEQ ID NO: 62225

SEQ ID NO: 104363 - DNA, 601 bp, Human; identical to SEQ ID NO: 18568

SEQ ID NO: 104364 - DNA, 601 bp, Human; identical to SEQ ID NO: 18569

SEQ ID NO: 104365 - DNA, 601 bp, Human; identical to SEQ ID NO: 18570

SEQ ID NO: 104366 - DNA, 601 bp, Human; identical to SEQ ID NO: 18571

SEQ ID NO: 104367 - DNA, 601 bp, Human; identical to SEQ ID NO: 18572

SEQ ID NO: 104368 - DNA, 601 bp, Human; identical to SEQ ID NO: 18573

SEQ ID NO: 104369 - DNA, 601 bp, Human; identical to SEQ ID NO: 18574

SEQ ID NO: 104370 - DNA, 601 bp, Human; identical to SEQ ID NO: 18575

SEQ ID NO: 104371 - DNA, 601 bp, Human; identical to SEQ ID NO: 18576

SEQ ID NO: 104372 - DNA, 601 bp, Human; identical to SEQ ID NO: 18577

SEQ ID NO: 104373 - DNA, 601 bp, Human; identical to SEQ ID NO: 18578

SEQ ID NO: 104374 - DNA, 601 bp, Human; identical to SEQ ID NO: 18579

SEQ ID NO: 104375 - DNA, 601 bp, Human; identical to SEQ ID NO: 18580

SEQ ID NO: 104376 - DNA, 601 bp, Human; identical to SEQ ID NO: 18581

SEQ ID NO: 104377 - DNA, 601 bp, Human; identical to SEQ ID NO: 18582

SEQ ID NO: 104378 - DNA, 601 bp, Human; identical to SEQ ID NO: 18583

SEQ ID NO: 104379 - DNA, 601 bp, Human; identical to SEQ ID NO: 18584

SEQ ID NO: 104380 - DNA, 601 bp, Human; identical to SEQ ID NO: 18585

SEQ ID NO: 104381 - DNA, 601 bp, Human; identical to SEQ ID NO: 18586

SEQ ID NO: 104382 - DNA, 601 bp, Human; identical to SEQ ID NO: 18587

SEQ ID NO: 104383 - DNA, 601 bp, Human; identical to SEQ ID NO: 18588

SEQ ID NO: 104384 - DNA, 601 bp, Human; identical to SEQ ID NO: 18589

SEQ ID NO: 104385 - DNA, 601 bp, Human; identical to SEQ ID NO: 18590

SEQ ID NO: 104386 - DNA, 601 bp, Human; identical to SEQ ID NO: 18591

SEQ ID NO: 104387 - DNA, 601 bp, Human; identical to SEQ ID NO: 18592

SEQ ID NO: 104388 - DNA, 601 bp, Human; identical to SEQ ID NO: 18593

SEQ ID NO: 104389 - DNA, 601 bp, Human; identical to SEQ ID NO: 18594

SEQ ID NO: 104390 - DNA, 601 bp, Human; identical to SEQ ID NO: 18595

SEQ ID NO: 104391 - DNA, 601 bp, Human; identical to SEQ ID NO: 18596

SEQ ID NO: 104392 - DNA, 601 bp, Human; identical to SEQ ID NO: 18597

SEQ ID NO: 104393 - DNA, 601 bp, Human; identical to SEQ ID NO: 18598

SEQ ID NO: 104394 - DNA, 601 bp, Human; identical to SEQ ID NO: 18599

SEQ ID NO: 104395 - DNA, 601 bp, Human; identical to SEQ ID NO: 18600

SEQ ID NO: 104396 - DNA, 601 bp, Human; identical to SEQ ID NO: 62188

SEQ ID NO: 104397 - DNA, 601 bp, Human; identical to SEQ ID NO: 62189

SEQ ID NO: 104398 - DNA, 601 bp, Human; identical to SEQ ID NO: 62190

SEQ ID NO: 104399 - DNA, 601 bp, Human; identical to SEQ ID NO: 62191

SEQ ID NO: 104400 - DNA, 601 bp, Human; identical to SEQ ID NO: 62192

SEQ ID NO: 104401 - DNA, 601 bp, Human; identical to SEQ ID NO: 62193

SEQ ID NO: 104402 - DNA, 601 bp, Human; identical to SEQ ID NO: 62194

SEQ ID NO: 104403 - DNA, 601 bp, Human; identical to SEQ ID NO: 62195

SEQ ID NO: 104404 - DNA, 601 bp, Human; identical to SEQ ID NO: 62196

SEQ ID NO: 104405 - DNA, 601 bp, Human; identical to SEQ ID NO: 62197

SEQ ID NO: 104406 - DNA, 601 bp, Human; identical to SEQ ID NO: 62198

SEQ ID NO: 104407 - DNA, 601 bp, Human; identical to SEQ ID NO: 62199

SEQ ID NO: 104408 - DNA, 601 bp, Human; identical to SEQ ID NO: 62200

SEQ ID NO: 104409 - DNA, 601 bp, Human; identical to SEQ ID NO: 62201

SEQ ID NO: 104410 - DNA, 601 bp, Human; identical to SEQ ID NO: 62202

SEQ ID NO: 104411 - DNA, 601 bp, Human; identical to SEQ ID NO: 62203

SEQ ID NO: 104412 - DNA, 601 bp, Human; identical to SEQ ID NO: 62204

SEQ ID NO: 104413 - DNA, 601 bp, Human; identical to SEQ ID NO: 62205

SEQ ID NO: 104414 - DNA, 601 bp, Human; identical to SEQ ID NO: 62206

SEQ ID NO: 104415 - DNA, 601 bp, Human; identical to SEQ ID NO: 62207

SEQ ID NO: 104416 - DNA, 601 bp, Human; identical to SEQ ID NO: 62208

SEQ ID NO: 104417 - DNA, 601 bp, Human; identical to SEQ ID NO: 62209

SEQ ID NO: 104418 - DNA, 601 bp, Human; identical to SEQ ID NO: 62210

SEQ ID NO: 104419 - DNA, 601 bp, Human; identical to SEQ ID NO: 62211

SEQ ID NO: 104420 - DNA, 601 bp, Human; identical to SEQ ID NO: 62212

SEQ ID NO: 104421 - DNA, 601 bp, Human; identical to SEQ ID NO: 62213

SEQ ID NO: 104422 - DNA, 601 bp, Human; identical to SEQ ID NO: 62214

SEQ ID NO: 104423 - DNA, 601 bp, Human; identical to SEQ ID NO: 62215

SEQ ID NO: 104424 - DNA, 601 bp, Human; identical to SEQ ID NO: 62216

SEQ ID NO: 104425 - DNA, 601 bp, Human; identical to SEQ ID NO: 62217

SEQ ID NO: 104426 - DNA, 601 bp, Human; identical to SEQ ID NO: 62218

SEQ ID NO: 104427 - DNA, 601 bp, Human; identical to SEQ ID NO: 62219

SEQ ID NO: 104428 - DNA, 601 bp, Human; identical to SEQ ID NO: 62220

SEQ ID NO: 104429 - DNA, 601 bp, Human; identical to SEQ ID NO: 62221

SEQ ID NO: 104430 - DNA, 601 bp, Human; identical to SEQ ID NO: 62222

SEQ ID NO: 104431 - DNA, 601 bp, Human; identical to SEQ ID NO: 62223

SEQ ID NO: 104432 - DNA, 601 bp, Human; identical to SEQ ID NO: 62224

SEQ ID NO: 104433 - DNA, 601 bp, Human; identical to SEQ ID NO: 62225

SEQ ID NO: 104434 - DNA, 601 bp, Human; identical to SEQ ID NO: 18568

SEQ ID NO: 104435 - DNA, 601 bp, Human; identical to SEQ ID NO: 18569

SEQ ID NO: 104436 - DNA, 601 bp, Human; identical to SEQ ID NO: 18570

SEQ ID NO: 104437 - DNA, 601 bp, Human; identical to SEQ ID NO: 18571

SEQ ID NO: 104438 - DNA, 601 bp, Human; identical to SEQ ID NO: 18572

SEQ ID NO: 104439 - DNA, 601 bp, Human; identical to SEQ ID NO: 18573

SEQ ID NO: 104440 - DNA, 601 bp, Human; identical to SEQ ID NO: 18574

SEQ ID NO: 104441 - DNA, 601 bp, Human; identical to SEQ ID NO: 18575

SEQ ID NO: 104442 - DNA, 601 bp, Human; identical to SEQ ID NO: 18576

SEQ ID NO: 104443 - DNA, 601 bp, Human; identical to SEQ ID NO: 18577

SEQ ID NO: 104444 - DNA, 601 bp, Human; identical to SEQ ID NO: 18578

SEQ ID NO: 104445 - DNA, 601 bp, Human; identical to SEQ ID NO: 18579

SEQ ID NO: 104446 - DNA, 601 bp, Human; identical to SEQ ID NO: 18580

SEQ ID NO: 104447 - DNA, 601 bp, Human; identical to SEQ ID NO: 18581

SEQ ID NO: 104448 - DNA, 601 bp, Human; identical to SEQ ID NO: 18582

SEQ ID NO: 104449 - DNA, 601 bp, Human; identical to SEQ ID NO: 18583

SEQ ID NO: 104450 - DNA, 601 bp, Human; identical to SEQ ID NO: 18584

SEQ ID NO: 104451 - DNA, 601 bp, Human; identical to SEQ ID NO: 18585

SEQ ID NO: 104452 - DNA, 601 bp, Human; identical to SEQ ID NO: 18586

SEQ ID NO: 104453 - DNA, 601 bp, Human; identical to SEQ ID NO: 18587

SEQ ID NO: 104454 - DNA, 601 bp, Human; identical to SEQ ID NO: 18588

SEQ ID NO: 104455 - DNA, 601 bp, Human; identical to SEQ ID NO: 18589

SEQ ID NO: 104456 - DNA, 601 bp, Human; identical to SEQ ID NO: 18590

SEQ ID NO: 104457 - DNA, 601 bp, Human; identical to SEQ ID NO: 18591

SEQ ID NO: 104458 - DNA, 601 bp, Human; identical to SEQ ID NO: 18592

SEQ ID NO: 104459 - DNA, 601 bp, Human; identical to SEQ ID NO: 18593

SEQ ID NO: 104460 - DNA, 601 bp, Human; identical to SEQ ID NO: 18594

SEQ ID NO: 104461 - DNA, 601 bp, Human; identical to SEQ ID NO: 18595

SEQ ID NO: 104462 - DNA, 601 bp, Human; identical to SEQ ID NO: 18596

SEQ ID NO: 104463 - DNA, 601 bp, Human; identical to SEQ ID NO: 18597

SEQ ID NO: 104464 - DNA, 601 bp, Human; identical to SEQ ID NO: 18598

SEQ ID NO: 104465 - DNA, 601 bp, Human; identical to SEQ ID NO: 18599

SEQ ID NO: 104466 - DNA, 601 bp, Human; identical to SEQ ID NO: 18600

SEQ ID NO: 104467 - DNA, 601 bp, Human; identical to SEQ ID NO: 62188

SEQ ID NO: 104468 - DNA, 601 bp, Human; identical to SEQ ID NO: 62189

SEQ ID NO: 104469 - DNA, 601 bp, Human; identical to SEQ ID NO: 62190

SEQ ID NO: 104470 - DNA, 601 bp, Human; identical to SEQ ID NO: 62191

SEQ ID NO: 104471 - DNA, 601 bp, Human; identical to SEQ ID NO: 62192

SEQ ID NO: 104472 - DNA, 601 bp, Human; identical to SEQ ID NO: 62193

SEQ ID NO: 104473 - DNA, 601 bp, Human; identical to SEQ ID NO: 62194

SEQ ID NO: 104474 - DNA, 601 bp, Human; identical to SEQ ID NO: 62195

SEQ ID NO: 104475 - DNA, 601 bp, Human; identical to SEQ ID NO: 62196

SEQ ID NO: 104476 - DNA, 601 bp, Human; identical to SEQ ID NO: 62197

SEQ ID NO: 104477 - DNA, 601 bp, Human; identical to SEQ ID NO: 62198

SEQ ID NO: 104478 - DNA, 601 bp, Human; identical to SEQ ID NO: 62199

SEQ ID NO: 104479 - DNA, 601 bp, Human; identical to SEQ ID NO: 62200

SEQ ID NO: 104480 - DNA, 601 bp, Human; identical to SEQ ID NO: 62201

SEQ ID NO: 104481 - DNA, 601 bp, Human; identical to SEQ ID NO: 62202

SEQ ID NO: 104482 - DNA, 601 bp, Human; identical to SEQ ID NO: 62203

SEQ ID NO: 104483 - DNA, 601 bp, Human; identical to SEQ ID NO: 62204

SEQ ID NO: 104484 - DNA, 601 bp, Human; identical to SEQ ID NO: 62205

SEQ ID NO: 104485 - DNA, 601 bp, Human; identical to SEQ ID NO: 62206

SEQ ID NO: 104486 - DNA, 601 bp, Human; identical to SEQ ID NO: 62207

SEQ ID NO: 104487 - DNA, 601 bp, Human; identical to SEQ ID NO: 62208

SEQ ID NO: 104488 - DNA, 601 bp, Human; identical to SEQ ID NO: 62209

SEQ ID NO: 104489 - DNA, 601 bp, Human; identical to SEQ ID NO: 62210

SEQ ID NO: 104490 - DNA, 601 bp, Human; identical to SEQ ID NO: 62211

SEQ ID NO: 104491 - DNA, 601 bp, Human; identical to SEQ ID NO: 62212

SEQ ID NO: 104492 - DNA, 601 bp, Human; identical to SEQ ID NO: 62213

SEQ ID NO: 104493 - DNA, 601 bp, Human; identical to SEQ ID NO: 62214

SEQ ID NO: 104494 - DNA, 601 bp, Human; identical to SEQ ID NO: 62215

SEQ ID NO: 104495 - DNA, 601 bp, Human; identical to SEQ ID NO: 62216

SEQ ID NO: 104496 - DNA, 601 bp, Human; identical to SEQ ID NO: 62217

SEQ ID NO: 104497 - DNA, 601 bp, Human; identical to SEQ ID NO: 62218

SEQ ID NO: 104498 - DNA, 601 bp, Human; identical to SEQ ID NO: 62219

SEQ ID NO: 104499 - DNA, 601 bp, Human; identical to SEQ ID NO: 62220

SEQ ID NO: 104500 - DNA, 601 bp, Human; identical to SEQ ID NO: 62221

SEQ ID NO: 104501 - DNA, 601 bp, Human; identical to SEQ ID NO: 62222

SEQ ID NO: 104502 - DNA, 601 bp, Human; identical to SEQ ID NO: 62223

SEQ ID NO: 104503 - DNA, 601 bp, Human; identical to SEQ ID NO: 62224

SEQ ID NO: 104504 - DNA, 601 bp, Human; identical to SEQ ID NO: 62225

SEQ ID NO: 104505 - DNA, 601 bp, Human; identical to SEQ ID NO: 18568

SEQ ID NO: 104506 - DNA, 601 bp, Human; identical to SEQ ID NO: 18569

SEQ ID NO: 104507 - DNA, 601 bp, Human; identical to SEQ ID NO: 18570

SEQ ID NO: 104508 - DNA, 601 bp, Human; identical to SEQ ID NO: 18571

SEQ ID NO: 104509 - DNA, 601 bp, Human; identical to SEQ ID NO: 18572

SEQ ID NO: 104510 - DNA, 601 bp, Human; identical to SEQ ID NO: 18573

SEQ ID NO: 104511 - DNA, 601 bp, Human; identical to SEQ ID NO: 18574

SEQ ID NO: 104512 - DNA, 601 bp, Human; identical to SEQ ID NO: 18575

SEQ ID NO: 104513 - DNA, 601 bp, Human; identical to SEQ ID NO: 18576

SEQ ID NO: 104514 - DNA, 601 bp, Human; identical to SEQ ID NO: 18577

SEQ ID NO: 104515 - DNA, 601 bp, Human; identical to SEQ ID NO: 18578

SEQ ID NO: 104516 - DNA, 601 bp, Human; identical to SEQ ID NO: 18579

SEQ ID NO: 104517 - DNA, 601 bp, Human; identical to SEQ ID NO: 18580

SEQ ID NO: 104518 - DNA, 601 bp, Human; identical to SEQ ID NO: 18581

SEQ ID NO: 104519 - DNA, 601 bp, Human; identical to SEQ ID NO: 18582

SEQ ID NO: 104520 - DNA, 601 bp, Human; identical to SEQ ID NO: 18583

SEQ ID NO: 104521 - DNA, 601 bp, Human; identical to SEQ ID NO: 18584

SEQ ID NO: 104522 - DNA, 601 bp, Human; identical to SEQ ID NO: 18585

SEQ ID NO: 104523 - DNA, 601 bp, Human; identical to SEQ ID NO: 18586

SEQ ID NO: 104524 - DNA, 601 bp, Human; identical to SEQ ID NO: 18587

SEQ ID NO: 104525 - DNA, 601 bp, Human; identical to SEQ ID NO: 18588

SEQ ID NO: 104526 - DNA, 601 bp, Human; identical to SEQ ID NO: 18589

SEQ ID NO: 104527 - DNA, 601 bp, Human; identical to SEQ ID NO: 18590

SEQ ID NO: 104528 - DNA, 601 bp, Human; identical to SEQ ID NO: 18591

SEQ ID NO: 104529 - DNA, 601 bp, Human; identical to SEQ ID NO: 18592

SEQ ID NO: 104530 - DNA, 601 bp, Human; identical to SEQ ID NO: 18593

SEQ ID NO: 104531 - DNA, 601 bp, Human; identical to SEQ ID NO: 18594

SEQ ID NO: 104532 - DNA, 601 bp, Human; identical to SEQ ID NO: 18595

SEQ ID NO: 104533 - DNA, 601 bp, Human; identical to SEQ ID NO: 18596

SEQ ID NO: 104534 - DNA, 601 bp, Human; identical to SEQ ID NO: 18597

SEQ ID NO: 104535 - DNA, 601 bp, Human; identical to SEQ ID NO: 18598

SEQ ID NO: 104536 - DNA, 601 bp, Human; identical to SEQ ID NO: 18599

SEQ ID NO: 104537 - DNA, 601 bp, Human; identical to SEQ ID NO: 18600

SEQ ID NO: 104538 - DNA, 601 bp, Human; identical to SEQ ID NO: 62188

SEQ ID NO: 104539 - DNA, 601 bp, Human; identical to SEQ ID NO: 62189

SEQ ID NO: 104540 - DNA, 601 bp, Human; identical to SEQ ID NO: 62190

SEQ ID NO: 104541 - DNA, 601 bp, Human; identical to SEQ ID NO: 62191

SEQ ID NO: 104542 - DNA, 601 bp, Human; identical to SEQ ID NO: 62192

SEQ ID NO: 104543 - DNA, 601 bp, Human; identical to SEQ ID NO: 62193

SEQ ID NO: 104544 - DNA, 601 bp, Human; identical to SEQ ID NO: 62194

SEQ ID NO: 104545 - DNA, 601 bp, Human; identical to SEQ ID NO: 62195

SEQ ID NO: 104546 - DNA, 601 bp, Human; identical to SEQ ID NO: 62196

SEQ ID NO: 104547 - DNA, 601 bp, Human; identical to SEQ ID NO: 62197

SEQ ID NO: 104548 - DNA, 601 bp, Human; identical to SEQ ID NO: 62198

SEQ ID NO: 104549 - DNA, 601 bp, Human; identical to SEQ ID NO: 62199

SEQ ID NO: 104550 - DNA, 601 bp, Human; identical to SEQ ID NO: 62200

SEQ ID NO: 104551 - DNA, 601 bp, Human; identical to SEQ ID NO: 62201

SEQ ID NO: 104552 - DNA, 601 bp, Human; identical to SEQ ID NO: 62202

SEQ ID NO: 104553 - DNA, 601 bp, Human; identical to SEQ ID NO: 62203

SEQ ID NO: 104554 - DNA, 601 bp, Human; identical to SEQ ID NO: 62204

SEQ ID NO: 104555 - DNA, 601 bp, Human; identical to SEQ ID NO: 62205

SEQ ID NO: 104556 - DNA, 601 bp, Human; identical to SEQ ID NO: 62206

SEQ ID NO: 104557 - DNA, 601 bp, Human; identical to SEQ ID NO: 62207

SEQ ID NO: 104558 - DNA, 601 bp, Human; identical to SEQ ID NO: 62208

SEQ ID NO: 104559 - DNA, 601 bp, Human; identical to SEQ ID NO: 62209

SEQ ID NO: 104560 - DNA, 601 bp, Human; identical to SEQ ID NO: 62210

SEQ ID NO: 104561 - DNA, 601 bp, Human; identical to SEQ ID NO: 62211

SEQ ID NO: 104562 - DNA, 601 bp, Human; identical to SEQ ID NO: 62212

SEQ ID NO: 104563 - DNA, 601 bp, Human; identical to SEQ ID NO: 62213

SEQ ID NO: 104564 - DNA, 601 bp, Human; identical to SEQ ID NO: 62214

SEQ ID NO: 104565 - DNA, 601 bp, Human; identical to SEQ ID NO: 62215

SEQ ID NO: 104566 - DNA, 601 bp, Human; identical to SEQ ID NO: 62216

SEQ ID NO: 104567 - DNA, 601 bp, Human; identical to SEQ ID NO: 62217

SEQ ID NO: 104568 - DNA, 601 bp, Human; identical to SEQ ID NO: 62218

SEQ ID NO: 104569 - DNA, 601 bp, Human; identical to SEQ ID NO: 62219

SEQ ID NO: 104570 - DNA, 601 bp, Human; identical to SEQ ID NO: 62220

SEQ ID NO: 104571 - DNA, 601 bp, Human; identical to SEQ ID NO: 62221

SEQ ID NO: 104572 - DNA, 601 bp, Human; identical to SEQ ID NO: 62222

SEQ ID NO: 104573 - DNA, 601 bp, Human; identical to SEQ ID NO: 62223

SEQ ID NO: 104574 - DNA, 601 bp, Human; identical to SEQ ID NO: 62224

SEQ ID NO: 104575 - DNA, 601 bp, Human; identical to SEQ ID NO: 62225

SEQ ID NO: 104576 - DNA, 601 bp, Human; identical to SEQ ID NO: 18568

SEQ ID NO: 104577 - DNA, 601 bp, Human; identical to SEQ ID NO: 18569

SEQ ID NO: 104578 - DNA, 601 bp, Human; identical to SEQ ID NO: 18570

SEQ ID NO: 104579 - DNA, 601 bp, Human; identical to SEQ ID NO: 18571

SEQ ID NO: 104580 - DNA, 601 bp, Human; identical to SEQ ID NO: 18572

SEQ ID NO: 104581 - DNA, 601 bp, Human; identical to SEQ ID NO: 18573

SEQ ID NO: 104582 - DNA, 601 bp, Human; identical to SEQ ID NO: 18574

SEQ ID NO: 104583 - DNA, 601 bp, Human; identical to SEQ ID NO: 18575

SEQ ID NO: 104584 - DNA, 601 bp, Human; identical to SEQ ID NO: 18576

SEQ ID NO: 104585 - DNA, 601 bp, Human; identical to SEQ ID NO: 18577

SEQ ID NO: 104586 - DNA, 601 bp, Human; identical to SEQ ID NO: 18578

SEQ ID NO: 104587 - DNA, 601 bp, Human; identical to SEQ ID NO: 18579

SEQ ID NO: 104588 - DNA, 601 bp, Human; identical to SEQ ID NO: 18580

SEQ ID NO: 104589 - DNA, 601 bp, Human; identical to SEQ ID NO: 18581

SEQ ID NO: 104590 - DNA, 601 bp, Human; identical to SEQ ID NO: 18582

SEQ ID NO: 104591 - DNA, 601 bp, Human; identical to SEQ ID NO: 18583

SEQ ID NO: 104592 - DNA, 601 bp, Human; identical to SEQ ID NO: 18584

SEQ ID NO: 104593 - DNA, 601 bp, Human; identical to SEQ ID NO: 18585

SEQ ID NO: 104594 - DNA, 601 bp, Human; identical to SEQ ID NO: 18586

SEQ ID NO: 104595 - DNA, 601 bp, Human; identical to SEQ ID NO: 18587

SEQ ID NO: 104596 - DNA, 601 bp, Human; identical to SEQ ID NO: 18588

SEQ ID NO: 104597 - DNA, 601 bp, Human; identical to SEQ ID NO: 18589

SEQ ID NO: 104598 - DNA, 601 bp, Human; identical to SEQ ID NO: 18590

SEQ ID NO: 104599 - DNA, 601 bp, Human; identical to SEQ ID NO: 18591

SEQ ID NO: 104600 - DNA, 601 bp, Human; identical to SEQ ID NO: 18592

SEQ ID NO: 104601 - DNA, 601 bp, Human; identical to SEQ ID NO: 18593

SEQ ID NO: 104602 - DNA, 601 bp, Human; identical to SEQ ID NO: 18594

SEQ ID NO: 104603 - DNA, 601 bp, Human; identical to SEQ ID NO: 18595

SEQ ID NO: 104604 - DNA, 601 bp, Human; identical to SEQ ID NO: 18596

SEQ ID NO: 104605 - DNA, 601 bp, Human; identical to SEQ ID NO: 18597

SEQ ID NO: 104606 - DNA, 601 bp, Human; identical to SEQ ID NO: 18598

SEQ ID NO: 104607 - DNA, 601 bp, Human; identical to SEQ ID NO: 18599

SEQ ID NO: 104608 - DNA, 601 bp, Human; identical to SEQ ID NO: 18600

SEQ ID NO: 104609 - DNA, 601 bp, Human; identical to SEQ ID NO: 62188

SEQ ID NO: 104610 - DNA, 601 bp, Human; identical to SEQ ID NO: 62189

SEQ ID NO: 104611 - DNA, 601 bp, Human; identical to SEQ ID NO: 62190

SEQ ID NO: 104612 - DNA, 601 bp, Human; identical to SEQ ID NO: 62191

SEQ ID NO: 104613 - DNA, 601 bp, Human; identical to SEQ ID NO: 62192

SEQ ID NO: 104614 - DNA, 601 bp, Human; identical to SEQ ID NO: 62193

SEQ ID NO: 104615 - DNA, 601 bp, Human; identical to SEQ ID NO: 62194

SEQ ID NO: 104616 - DNA, 601 bp, Human; identical to SEQ ID NO: 62195

SEQ ID NO: 104617 - DNA, 601 bp, Human; identical to SEQ ID NO: 62196

SEQ ID NO: 104618 - DNA, 601 bp, Human; identical to SEQ ID NO: 62197

SEQ ID NO: 104619 - DNA, 601 bp, Human; identical to SEQ ID NO: 62198

SEQ ID NO: 104620 - DNA, 601 bp, Human; identical to SEQ ID NO: 62199

SEQ ID NO: 104621 - DNA, 601 bp, Human; identical to SEQ ID NO: 62200

SEQ ID NO: 104622 - DNA, 601 bp, Human; identical to SEQ ID NO: 62201

SEQ ID NO: 104623 - DNA, 601 bp, Human; identical to SEQ ID NO: 62202

SEQ ID NO: 104624 - DNA, 601 bp, Human; identical to SEQ ID NO: 62203

SEQ ID NO: 104625 - DNA, 601 bp, Human; identical to SEQ ID NO: 62204

SEQ ID NO: 104626 - DNA, 601 bp, Human; identical to SEQ ID NO: 62205

SEQ ID NO: 104627 - DNA, 601 bp, Human; identical to SEQ ID NO: 62206

SEQ ID NO: 104628 - DNA, 601 bp, Human; identical to SEQ ID NO: 62207

SEQ ID NO: 104629 - DNA, 601 bp, Human; identical to SEQ ID NO: 62208

SEQ ID NO: 104630 - DNA, 601 bp, Human; identical to SEQ ID NO: 62209

SEQ ID NO: 104631 - DNA, 601 bp, Human; identical to SEQ ID NO: 62210

SEQ ID NO: 104632 - DNA, 601 bp, Human; identical to SEQ ID NO: 62211

SEQ ID NO: 104633 - DNA, 601 bp, Human; identical to SEQ ID NO: 62212

SEQ ID NO: 104634 - DNA, 601 bp, Human; identical to SEQ ID NO: 62213

SEQ ID NO: 104635 - DNA, 601 bp, Human; identical to SEQ ID NO: 62214

SEQ ID NO: 104636 - DNA, 601 bp, Human; identical to SEQ ID NO: 62215

SEQ ID NO: 104637 - DNA, 601 bp, Human; identical to SEQ ID NO: 62216

SEQ ID NO: 104638 - DNA, 601 bp, Human; identical to SEQ ID NO: 62217

SEQ ID NO: 104639 - DNA, 601 bp, Human; identical to SEQ ID NO: 62218

SEQ ID NO: 104640 - DNA, 601 bp, Human; identical to SEQ ID NO: 62219

SEQ ID NO: 104641 - DNA, 601 bp, Human; identical to SEQ ID NO: 62220

SEQ ID NO: 104642 - DNA, 601 bp, Human; identical to SEQ ID NO: 62221

SEQ ID NO: 104643 - DNA, 601 bp, Human; identical to SEQ ID NO: 62222

SEQ ID NO: 104644 - DNA, 601 bp, Human; identical to SEQ ID NO: 62223

SEQ ID NO: 104645 - DNA, 601 bp, Human; identical to SEQ ID NO: 62224

SEQ ID NO: 104646 - DNA, 601 bp, Human; identical to SEQ ID NO: 62225

SEQ ID NO: 104647 - DNA, 601 bp, Human; identical to SEQ ID NO: 18568

SEQ ID NO: 104648 - DNA, 601 bp, Human; identical to SEQ ID NO: 18569

SEQ ID NO: 104649 - DNA, 601 bp, Human; identical to SEQ ID NO: 18570

SEQ ID NO: 104650 - DNA, 601 bp, Human; identical to SEQ ID NO: 18571

SEQ ID NO: 104651 - DNA, 601 bp, Human; identical to SEQ ID NO: 18572

SEQ ID NO: 104652 - DNA, 601 bp, Human; identical to SEQ ID NO: 18573

SEQ ID NO: 104653 - DNA, 601 bp, Human; identical to SEQ ID NO: 18574

SEQ ID NO: 104654 - DNA, 601 bp, Human; identical to SEQ ID NO: 18575

SEQ ID NO: 104655 - DNA, 601 bp, Human; identical to SEQ ID NO: 18576

SEQ ID NO: 104656 - DNA, 601 bp, Human; identical to SEQ ID NO: 18577

SEQ ID NO: 104657 - DNA, 601 bp, Human; identical to SEQ ID NO: 18578

SEQ ID NO: 104658 - DNA, 601 bp, Human; identical to SEQ ID NO: 18579

SEQ ID NO: 104659 - DNA, 601 bp, Human; identical to SEQ ID NO: 18580

SEQ ID NO: 104660 - DNA, 601 bp, Human; identical to SEQ ID NO: 18581

SEQ ID NO: 104661 - DNA, 601 bp, Human; identical to SEQ ID NO: 18582

SEQ ID NO: 104662 - DNA, 601 bp, Human; identical to SEQ ID NO: 18583

SEQ ID NO: 104663 - DNA, 601 bp, Human; identical to SEQ ID NO: 18584

SEQ ID NO: 104664 - DNA, 601 bp, Human; identical to SEQ ID NO: 18585

SEQ ID NO: 104665 - DNA, 601 bp, Human; identical to SEQ ID NO: 18586

SEQ ID NO: 104666 - DNA, 601 bp, Human; identical to SEQ ID NO: 18587

SEQ ID NO: 104667 - DNA, 601 bp, Human; identical to SEQ ID NO: 18588

SEQ ID NO: 104668 - DNA, 601 bp, Human; identical to SEQ ID NO: 18589

SEQ ID NO: 104669 - DNA, 601 bp, Human; identical to SEQ ID NO: 18590

SEQ ID NO: 104670 - DNA, 601 bp, Human; identical to SEQ ID NO: 18591

SEQ ID NO: 104671 - DNA, 601 bp, Human; identical to SEQ ID NO: 18592

SEQ ID NO: 104672 - DNA, 601 bp, Human; identical to SEQ ID NO: 18593

SEQ ID NO: 104673 - DNA, 601 bp, Human; identical to SEQ ID NO: 18594

SEQ ID NO: 104674 - DNA, 601 bp, Human; identical to SEQ ID NO: 18595

SEQ ID NO: 104675 - DNA, 601 bp, Human; identical to SEQ ID NO: 18596

SEQ ID NO: 104676 - DNA, 601 bp, Human; identical to SEQ ID NO: 18597

SEQ ID NO: 104677 - DNA, 601 bp, Human; identical to SEQ ID NO: 18598

SEQ ID NO: 104678 - DNA, 601 bp, Human; identical to SEQ ID NO: 18599

SEQ ID NO: 104679 - DNA, 601 bp, Human; identical to SEQ ID NO: 18600

SEQ ID NO: 104680 - DNA, 601 bp, Human; identical to SEQ ID NO: 62188

SEQ ID NO: 104681 - DNA, 601 bp, Human; identical to SEQ ID NO: 62189

SEQ ID NO: 104682 - DNA, 601 bp, Human; identical to SEQ ID NO: 62190

SEQ ID NO: 104683 - DNA, 601 bp, Human; identical to SEQ ID NO: 62191

SEQ ID NO: 104684 - DNA, 601 bp, Human; identical to SEQ ID NO: 62192

SEQ ID NO: 104685 - DNA, 601 bp, Human; identical to SEQ ID NO: 62193

SEQ ID NO: 104686 - DNA, 601 bp, Human; identical to SEQ ID NO: 62194

SEQ ID NO: 104687 - DNA, 601 bp, Human; identical to SEQ ID NO: 62195

SEQ ID NO: 104688 - DNA, 601 bp, Human; identical to SEQ ID NO: 62196

SEQ ID NO: 104689 - DNA, 601 bp, Human; identical to SEQ ID NO: 62197

SEQ ID NO: 104690 - DNA, 601 bp, Human; identical to SEQ ID NO: 62198

SEQ ID NO: 104691 - DNA, 601 bp, Human; identical to SEQ ID NO: 62199

SEQ ID NO: 104692 - DNA, 601 bp, Human; identical to SEQ ID NO: 62200

SEQ ID NO: 104693 - DNA, 601 bp, Human; identical to SEQ ID NO: 62201

SEQ ID NO: 104694 - DNA, 601 bp, Human; identical to SEQ ID NO: 62202

SEQ ID NO: 104695 - DNA, 601 bp, Human; identical to SEQ ID NO: 62203

SEQ ID NO: 104696 - DNA, 601 bp, Human; identical to SEQ ID NO: 62204

SEQ ID NO: 104697 - DNA, 601 bp, Human; identical to SEQ ID NO: 62205

SEQ ID NO: 104698 - DNA, 601 bp, Human; identical to SEQ ID NO: 62206

SEQ ID NO: 104699 - DNA, 601 bp, Human; identical to SEQ ID NO: 62207

SEQ ID NO: 104700 - DNA, 601 bp, Human; identical to SEQ ID NO: 62208

SEQ ID NO: 104701 - DNA, 601 bp, Human; identical to SEQ ID NO: 62209

SEQ ID NO: 104702 - DNA, 601 bp, Human; identical to SEQ ID NO: 62210

SEQ ID NO: 104703 - DNA, 601 bp, Human; identical to SEQ ID NO: 62211

SEQ ID NO: 104704 - DNA, 601 bp, Human; identical to SEQ ID NO: 62212

SEQ ID NO: 104705 - DNA, 601 bp, Human; identical to SEQ ID NO: 62213

SEQ ID NO: 104706 - DNA, 601 bp, Human; identical to SEQ ID NO: 62214

SEQ ID NO: 104707 - DNA, 601 bp, Human; identical to SEQ ID NO: 62215

SEQ ID NO: 104708 - DNA, 601 bp, Human; identical to SEQ ID NO: 62216

SEQ ID NO: 104709 - DNA, 601 bp, Human; identical to SEQ ID NO: 62217

SEQ ID NO: 104710 - DNA, 601 bp, Human; identical to SEQ ID NO: 62218

SEQ ID NO: 104711 - DNA, 601 bp, Human; identical to SEQ ID NO: 62219

SEQ ID NO: 104712 - DNA, 601 bp, Human; identical to SEQ ID NO: 62220

SEQ ID NO: 104713 - DNA, 601 bp, Human; identical to SEQ ID NO: 62221

SEQ ID NO: 104714 - DNA, 601 bp, Human; identical to SEQ ID NO: 62222

SEQ ID NO: 104715 - DNA, 601 bp, Human; identical to SEQ ID NO: 62223

SEQ ID NO: 104716 - DNA, 601 bp, Human; identical to SEQ ID NO: 62224

SEQ ID NO: 104717 - DNA, 601 bp, Human; identical to SEQ ID NO: 62225

SEQ ID NO: 104718 - DNA, 601 bp, Human; identical to SEQ ID NO: 18568

SEQ ID NO: 104719 - DNA, 601 bp, Human; identical to SEQ ID NO: 18569

SEQ ID NO: 104720 - DNA, 601 bp, Human; identical to SEQ ID NO: 18570

SEQ ID NO: 104721 - DNA, 601 bp, Human; identical to SEQ ID NO: 18571

SEQ ID NO: 104722 - DNA, 601 bp, Human; identical to SEQ ID NO: 18572

SEQ ID NO: 104723 - DNA, 601 bp, Human; identical to SEQ ID NO: 18573

SEQ ID NO: 104724 - DNA, 601 bp, Human; identical to SEQ ID NO: 18574

SEQ ID NO: 104725 - DNA, 601 bp, Human; identical to SEQ ID NO: 18575

SEQ ID NO: 104726 - DNA, 601 bp, Human; identical to SEQ ID NO: 18576

SEQ ID NO: 104727 - DNA, 601 bp, Human; identical to SEQ ID NO: 18577

SEQ ID NO: 104728 - DNA, 601 bp, Human; identical to SEQ ID NO: 18578

SEQ ID NO: 104729 - DNA, 601 bp, Human; identical to SEQ ID NO: 18579

SEQ ID NO: 104730 - DNA, 601 bp, Human; identical to SEQ ID NO: 18580

SEQ ID NO: 104731 - DNA, 601 bp, Human; identical to SEQ ID NO: 18581

SEQ ID NO: 104732 - DNA, 601 bp, Human; identical to SEQ ID NO: 18582

SEQ ID NO: 104733 - DNA, 601 bp, Human; identical to SEQ ID NO: 18583

SEQ ID NO: 104734 - DNA, 601 bp, Human; identical to SEQ ID NO: 18584

SEQ ID NO: 104735 - DNA, 601 bp, Human; identical to SEQ ID NO: 18585

SEQ ID NO: 104736 - DNA, 601 bp, Human; identical to SEQ ID NO: 18586

SEQ ID NO: 104737 - DNA, 601 bp, Human; identical to SEQ ID NO: 18587

SEQ ID NO: 104738 - DNA, 601 bp, Human; identical to SEQ ID NO: 18588

SEQ ID NO: 104739 - DNA, 601 bp, Human; identical to SEQ ID NO: 18589

SEQ ID NO: 104740 - DNA, 601 bp, Human; identical to SEQ ID NO: 18590

SEQ ID NO: 104741 - DNA, 601 bp, Human; identical to SEQ ID NO: 18591

SEQ ID NO: 104742 - DNA, 601 bp, Human; identical to SEQ ID NO: 18592

SEQ ID NO: 104743 - DNA, 601 bp, Human; identical to SEQ ID NO: 18593

SEQ ID NO: 104744 - DNA, 601 bp, Human; identical to SEQ ID NO: 18594

SEQ ID NO: 104745 - DNA, 601 bp, Human; identical to SEQ ID NO: 18595

SEQ ID NO: 104746 - DNA, 601 bp, Human; identical to SEQ ID NO: 18596

SEQ ID NO: 104747 - DNA, 601 bp, Human; identical to SEQ ID NO: 18597

SEQ ID NO: 104748 - DNA, 601 bp, Human; identical to SEQ ID NO: 18598

SEQ ID NO: 104749 - DNA, 601 bp, Human; identical to SEQ ID NO: 18599

SEQ ID NO: 104750 - DNA, 601 bp, Human; identical to SEQ ID NO: 18600

SEQ ID NO: 104751 - DNA, 601 bp, Human
cttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcratatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgt

SEQ ID NO: 104752 - DNA, 601 bp, Human
atccctttgactcttccccactccactaccaccaacctctgaagcagaaaggtcctgggtttcacacctgcactgacccacattgctctcctgcccatgcaatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcrgccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccat

SEQ ID NO: 104753 - DNA, 601 bp, Human
cagctactcatgaggctgaggcaggagaatcgcttgaacctgggggacagaagttgtagtgagccgagatggagccattgtacatcagcctgaaagacagagcaagactcagtcttaaaaaaaaaaaaaaaaattaaccaggagtagtgacacatgcctgtagcctgtagtcccagttatcgggaggctgaggcaggagaatcccttgaacccaggaggcaaagtttgcagtgagctgagattgcatcactgcactccagcttgggtgacaagagcaaaactccatctcaaaaaaaaaaaagctacagaatatgaatatatttctatctcttctatagcatctcttctaaggacaattatttgtttgaatttatgctgagtcctgaggaagctgtcacaactacaccaaagtgtacttccaaattggatagaaattatttgtgatttcatatgagtaaaggaaggctctctttttctctcagttctaggaagagttcatatcatcacctaagtaaccctaatctgatcacttctttctacctttctggtgtttgatatctttatcccaaatctctaaagccccaaccttcttgcccattag

SEQ ID NO: 104754 - DNA, 601 bp, Human
tcagacacagcggcctctatttggtggtcacaacttcagaaaacgtttctcccttcagcctcctagaactgctctccaggtgaggagggttgggctgggcacctggtagctaggaggggtctgagaggaggagaaaatacacgctccaagtgtttcctcaggttggccacccttctgggcgattactgtggctccctgggcgaggggaccatctcccgcaatgtggctctggtatacgaactcctggatgaagtgctggtgagaatcaacaatccccttctgtggcccctacccaattccyctgaagatacatctgctcttctactgtgggatgccgtggttaggaggccaagtctaccttttttttttttttttttttgcttttagagacagggtcttgctctgttgcccaggctggactgcagtggtgcagttatagctcactgcagcctggaactcctgggctcaagccgtcctcctgccccagcctcccctgtgcctagctaattgtttattttttgtagagactagagtctcgctgtgttgcccaggctggtcttgaactcatggcctcaagccattctcctacgtctcggccttc

SEQ ID NO: 104755 - DNA, 601 bp, Human
ttgattgctttggatgctttacagtttggggctgagacacaacagagcaaagtggcccccagcagtgcagccagccgccccgtcctgtccagtcgctctgaccaggtgagggaaggatccatggggtcagacgctctggttttgctctgggatccgggagtccaagatcttaggtcgggcacagcggctcacgcctgtagtcccagcactttgggaggccgaggtgggcagatcacctgatgccaggagtttcagagcagcctggccaacatggtgaaaacctgtctctactaaaaatgcaaaaaaaaaaaaaaaaaaagaaaaagatcttggcacatctcccacccccccagatgtgggtggaggtgggagatgatcccttccatcacccatgtcctcaccctagagctgtagctttgactgtcctgttctttctccctgtctgtccatttcagaacataggctattctgcttccaaccacccaaattctctctctttctcagagccaaaagaatgaagtttttttggatgtggtcgagagattgtctgtactgatagcatctaatgtaagtttgagctcccaaacctggagctgaggac

SEQ ID NO: 104756 - DNA, 601 bp, Human; identical to SEQ ID NO: 104754

SEQ ID NO: 104757 - DNA, 601 bp, Human; identical to SEQ ID NO: 104755

SEQ ID NO: 104758 - DNA, 601 bp, Human
aaggctcataaaacacgctacagtcacaggatctcctcagatcagtggaggcggcaggaaggcgtcccagggaagggttaacttaagcgagatcccagcagagaagcaggtcgaagatccccgggcagcgcgaaaggaggttcagagagcccaccccatctcctgcaacatctctccaatgcaggcacacacacggggtccccacgagcacagacacacaaccaaccgtcctctttccagtccccacaagggaccttcaaagggtctcctccggggtaccactcagacccgcccccgccasccgagcgcggggagcaggaaaactctagcggcagccgagacgctgctcacccggcgctcggcgccatcttggccccgccccctcgtgggagcaggtcctggcagagcctaagagcaagtcactgccccttccccgtaccagaataagtcctctaggctcgcagaatgaaattatattttaaaagtttgtttctacatctatatataaggagcactccctcttggtgtaattactgcaatttattccttcactacccggctgccaggaccttcaagaggcgccacaaaacggaggcaggga

SEQ ID NO: 104759 - DNA, 601 bp, Human
gttaaaagcaaactgggccggccgtggtggctcacgcctgtaatcccagcactttgggaggccgaggcgggcggatcactaggtcaggagattgagaccatcctggctaacaaggtgaaacctcgtctctactaaaaaatagaaaaaattagccaggcatggtggcaggcacctatagtccctgctactcgggaggctgctgaggcaggagaatggcgtgagcccgggaggcggagcttgcagtgagccgagatcgcaccactgcactccagcctgggcaacagagccagactctgtctcaaaaaaaaaaaaaaaaacaaaaaaagcaaagtggagccaggtgcagtggctcacgcctgtaatttgggaggccaaggcgggaagatcacctgaggttaggagttcgagaccaccctggccaacatggtgaaaccctgtctttttgtaaaaacacaaaaattaaccagacatggtggcgggcgcctgtagtcccagctatctgggaggctgaggtgggagaaccgcttgaaccaggaagcggaggttgcagtgaaccgagatcgtgccactgcactccagcctgggcgatagagagagactc

SEQ ID NO: 104760 - DNA, 601 bp, Human
ttgtgaggctcctcacacctacacacatctgtcctcctttccctcctccctgccaccctgctctcccctcccccaacctttgaggcagacgtccaggggcacccggggcagaggggtattgatgatgtcgctcagatcaacctccttctcctcatagaagtaaagctcccggcccccaccagaggcgaagcggaaaggaatgaactcctgggcgtggaagccatagagtggctgtggcaggagagaggggcatgggtaagaagggagccggaggagacctggctgaaggatggcgtctcacccccccccgcctgtctccccaaatcacctcgacattctttagcttcaaggcgtagtcaatgtcactggtggtgagcttctgccgcttccccatgtgcatgaacttcaaggcatcctggggtcggtgacagaacagacatcagcccaaaatcctaaggacggggccctgggtgacatggacccaatgtagagctggacagaagggccgggtcacctgtgcgatctctttgatgcggtagctgacctcatccgttagcagctggcaggtctcctcctgaatctgggcgatgcccatggattc

SEQ ID NO: 104761 - DNA, 601 bp, Human
acatgcctgtaatcccagctactcgggaggctgaggcaggagaatcattggaacccaggaggcggaggttgtggtaagccaagattgcaccattgcactccagcctgggcaagaagagcgaaactccatctcaaaaaaacaaaaacaaaaaaattagccagttgtggtggcaggtgcctgtaatcccaagtactcaagagtctgagggagaagaatcgcttgaacccaggaggcagagggtgcggtcagcagagattgcaccactgcactccagcctgggcaagagcgagactccatctcaaaaaaaaaaaaaaaaggtattacagacaagcctcaagacccttagacccccacaagttccagtccctcttccctctgcccccttgtttccagtgtgacttcccccaaccagaggtggccagtgatgaagcaaatgacgctcaagttttcctggctcaccttggtgaaggtcttggtgatccgggactggatgttgttagtggttgtgctaaaatgcttgcagatctgggccaccaggcgggcagcaaagtctcggagtgcccagtgattgtccacatctggtcgcaggcacaactgtctg

SEQ ID NO: 104762 - DNA, 601 bp, Human; identical to SEQ ID NO: 104758

SEQ ID NO: 104763 - DNA, 601 bp, Human; identical to SEQ ID NO: 104759

SEQ ID NO: 104764 - DNA, 601 bp, Human; identical to SEQ ID NO: 104760

SEQ ID NO: 104765 - DNA, 601 bp, Human; identical to SEQ ID NO: 104761

SEQ ID NO: 104766 - DNA, 601 bp, Human
cctgggataaaaatgggcaaacaacaaagcctgagccaagggaaagaactggcctgttcccaagtgaccagctgctctgttcatattatacgggcagcccagggcaagagtctcactggacagtcattggtaacaagagacccgcggggttcaggttcactgctgcgctggctgctgcacgcagtcactgtctgccctcatatgccaaaccccatttgtttaaagcgcgtcatctatgaattgacacgtgtactgtgaaacttcactacagtcaaagagtcacctccaaatgcatctttgkgcccccactgggtcccgccaccgacccccaggcaacctcaggtcctgccactgcagactcgggtgcactttctagcatcttagatagacggatcatccagcaagcactctttttgtctgacttctctcactcacttattttgagatttgcccctgtggtcgtgtgtttcttgtcttgttttttgagacagggtctcactctgttgcccaggctggagggcagtggtgcaatcatggcttgctgcaggcttgatctcccaagctcaagcaatctcctgcctcagcctccccaggagctggg

SEQ ID NO: 104767 - DNA, 601 bp, Human
tgtatacttttggggccagtacagcgattttactcttcttgcagtctcagagtccagggagcaaatcccacccacctcgctgtagtcctgcacatcctccttcagcagctccagctcctccttctccttggtgagtgacttcttctgctcctgcagcttagagcaggcatcgctgaggatgtcgatttcctccttcgtgatctcttcctcctgggataaaaatgggcaaacaacaaagcctgagccaagggaaagaactggcctgttcccaagtgaccagctgctctgttcatattatacrggcagcccagggcaagagtctcactggacagtcattggtaacaagagacccgcggggttcaggttcactgctgcgctggctgctgcacgcagtcactgtctgccctcatatgccaaaccccatttgtttaaagcgcgtcatctatgaattgacacgtgtactgtgaaacttcactacagtcaaagagtcacctccaaatgcatctttgtgcccccactgggtcccgccaccgacccccaggcaacctcaggtcctgccactgcagactcgggtgcactttctagcatcttagatagacgg

SEQ ID NO: 104768 - DNA, 601 bp, Human
caggtgtagtggctcacgcctgtaatcccagtactttgcaaggccaaggcgggcggatcacctgaggttaggagttcgagaccagcctggccaatgtggtgaaaccccgcctctactaaaaatacaaaaattagctgggcatgatggcaggcacctgtaatccagttacttgggaggctgaggcaggagaatcgcttgaacccaggaggcagaggctgcagtgagccaagaccatgccaacgcactccagcctgggcaacagagcgagactctgtctccaaaaaaaaaaaaaaaaaaaaaagaatctggttgggcacagtgactcatgcctgtaatcccagaactttgggaggccaaggcaggaggatcacttgaggacaggagttcgaaaccagaccaggcaacatagcaagactttatctctaccaaaattcaaacaaaaaattagccaggcgtggtggtgcacacctgtagtgccagctacccaggagtctgagacaggaggatggcttgagcccaggaggtggaggctgcagtgagccaagatcacatcactgcacttcagcctgagtgacagagcgagaccctatctcaaacaaca

SEQ ID NO: 104769 - DNA, 601 bp, Human
ttacagtcttgtgataatgttaggtgtgtcaggccttgggggcaggcctctgacctctctaccctcctttcacctgccctaaggcaggtcactaatcttcccaacttcctgactatgggttttaagaccctccctaaagagggttccgtcctattccctgagggaaggaatgcccaagaggactgggttcaaggagcttccagaaagctgaacacggtagaggttcaccgggggttgcaccctgggaagcatggaagatccatgccccttccccgtacataccttgccttacggtctcttsacctgcatcctttgcactatgctttatagtaaactgataaatttaagtgtttctctaagttctgtgagccgctccagcaaattaatcaaacccaaaggggtgggggtgggtgtcacacctcatgtagcccataaatacgtatacctactatgtacccacaaaaacaaaacaatttaaaaacaaagagggggccaggcacagtggcccacgcctataatcccagcactttgcgaggccaaggcaggtggatcacttgaggccaggagttcgagagcagcctggccaacgcggtgaaacccc

SEQ ID NO: 104770 - DNA, 601 bp, Human
ccccgagagcctgggcactggtgagcgagcaggttctatcacagatggcagatgtggaaccttggggtcagaagcacggatcccaaaaataaaaacaactcacccagagggacacgcgcagcccctccagacagacgttgaagcagttaagacagaaagggcctgcacctgcagcagaggtgcacctgtgcagatgcagacccctcccaggaaacagcagtggagagccagggcaaggcatcaagagggtgaaggcatcgagagtgggtggagctgtgtgctgaaaactgctgctgggaargagttgaagcaggagcagacggtgttgcaattcaattcagtggcgaggtgcgcctttccataggtgtggttagttatgacaggtattggttcctggctctactgcccttgttacagtcttgtgataatgttaggtgtgtcaggccttgggggcaggcctctgacctctctaccctcctttcacctgccctaaggcaggtcactaatcttcccaacttcctgactatgggttttaagaccctccctaaagagggttccgtcctattccctgagggaaggaatgcccaagaggactgggttc

SEQ ID NO: 104771 - DNA, 601 bp, Human
tttgtatttttagtagagacagggtttcaccgtgttggccaggatggtctcgatctcttgacctcatgatcggcccgcctcggcctcccaaagttctgggattacaggtgtgagccactgcgcccggccaggattatctttaaaaaggaaggcctcccagcactttgggaggccgaggcagcaggactgcttgaggtcaggagtttgagaccaaccttggcaatatagtgagacccagtctctacgaaaaatttaaaaattagcctggcatgacagcgtgcgtctgtggtcccagctacaytggaggctgaggtaggaggatcccttatgcccgggagggctgaggctttggttagccatgaggttgcaactgcactccagcctgggtgggggagcgagaacctgtctcaaaaataaaaataagtaaataaatagtagagccacaaaaacgtaatataaaccccaagagctagaaaccatgaggtgttcttgggaggaaaggatggagcagacaggagatgaggctgcacctgggagagagtggactcgattcccacatagggctgcactctctgaggcccatggtgtcccatggctctca

SEQ ID NO: 104772 - DNA, 601 bp, Human
tttttgagatggagtctcactctgtctccaggatacagtgcagtgggcgcgatctcggctcactgcaacctctgcctcccgagttcaagtgattctcctgcctcagcctcctgagtagttgggattacacgcgcccgccaccacgaccggctaatttttgtatttttagtagagacagggtttcaccgtgttggccaggatggtctcgatctcttgacctcatgatcggcccgcctcggcctcccaaagttctgggattacaggtgtgagccactgcgcccggccaggattatctttaaaraggaaggcctcccagcactttgggaggccgaggcagcaggactgcttgaggtcaggagtttgagaccaaccttggcaatatagtgagacccagtctctacgaaaaatttaaaaattagcctggcatgacagcgtgcgtctgtggtcccagctacactggaggctgaggtaggaggatcccttatgcccgggagggctgaggctttggttagccatgaggttgcaactgcactccagcctgggtgggggagcgagaacctgtctcaaaaataaaaataagtaaataaatagtagagccaca

SEQ ID NO: 104773 - DNA, 601 bp, Human
actaaataattattgcacagcacaaggacaatatgaagatacataaagtctcaaaaatatctagcacctgaaaagtcacaaacaaggaagccatcacaatgaatttcagactcattctaaaacaagcagttgggatgctgcccttaccttgagtgactgagtctcaaatgtggatggcaacatgttggggaagagcttcacagcaacaggcagcagaaactccatgaacggcaccaccacgaacacaaggaacggcaccaggcggaagaggtcagcgcagatccggagaaactggaagggrcggaatccatcagaggggagcagagcacatgtgggaacaagggcaaggggtgtgagcatttctcctataatggtttataggcacaacctcaggcagcgactcacaggacccactgaggactctaagttccagaaccacttagcagaccattcccaaaacccacttctttctcagggtccaaagcaggtaccagcagcctccagaaaagcagggtatggtgctgacaccaagggccactgggtgctcccagcgatcgagtcctccgaggacaccggccagcactctgggctcgggggccag

SEQ ID NO: 104774 - DNA, 601 bp, Human
aataaagagaaacaaatccaaaacccagcatccactaaataattattgcacagcacaaggacaatatgaagatacataaagtctcaaaaatatctagcacctgaaaagtcacaaacaaggaagccatcacaatgaatttcagactcattctaaaacaagcagttgggatgctgcccttaccttgagtgactgagtctcaaatgtggatggcaacatgttggggaagagcttcacagcaacaggcagcagaaactccatgaacggcaccaccacgaacacaaggaacggcaccaggcggaakaggtcagcgcagatccggagaaactggaaggggcggaatccatcagaggggagcagagcacatgtgggaacaagggcaaggggtgtgagcatttctcctataatggtttataggcacaacctcaggcagcgactcacaggacccactgaggactctaagttccagaaccacttagcagaccattcccaaaacccacttctttctcagggtccaaagcaggtaccagcagcctccagaaaagcagggtatggtgctgacaccaagggccactgggtgctcccagcgatcgagtcctccgag

SEQ ID NO: 104775 - DNA, 601 bp, Human
aatcccagcactttgggaggccaaggtgggtggatcacctgaggtcaggagtttgagaccagcctggccaacacggtgaaaccccgtctctactaaaaacacaaaaattagccaggcatgcacacctgtaatcccagctacttgggaggctgaggcacaagaatcgcttgaacccaggaggtggaggctacagtgagctgagattgcaccactgcactctccagcctgggtgacagagcgaaactccgtctcaaaaaaaaaacaaaaacaaaacaaaaacaaacaaacaaacaaacaaaaacaaacaaactcgtgtgattccctaaagcaaggatcggcacactttccgtaatgggctagacaggaaggcgtctggccttcatggctgtgtggtctaaaacaaatgcttaactctgctggtgcctcacagacaagacacatgactgggcatcgcaggtccccacagggctctgctgagaacaggcagggtcctgatctggcctgtgggctgcagctggctgaccctgccctagaaggacctcatgactcccctatagcaccggtaggggagtgttcctggtctagaaaacctgtattttaa

SEQ ID NO: 104776 - DNA, 601 bp, Human
cctgtaatcccagcactttgggaggccaaggtgggtggatcacctgaggtcaggagtttgagaccagcctggccaacacggtgaaaccccgtctctactaaaaacacaaaaattagccaggcatgcacacctgtaatcccagctacttgggaggctgaggcacaagaatcgcttgaacccaggaggtggaggctacagtgagctgagattgcaccactgcactctccagcctgggtgacagagcgaaactccgtctcaaaaaaaaaacaaaaacaaaacaaaaacaaacaaacaaacaaamaaaaacaaacaaactcgtgtgattccctaaagcaaggatcggcacactttccgtaatgggctagacaggaaggcgtctggccttcatggctgtgtggtctaaaacaaatgcttaactctgctggtgcctcacagacaagacacatgactgggcatcgcaggtccccacagggctctgctgagaacaggcagggtcctgatctggcctgtgggctgcagctggctgaccctgccctagaaggacctcatgactcccctatagcaccggtaggggagtgttcctggtctagaaaacctgtat

SEQ ID NO: 104777 - DNA, 601 bp, Human
ctggggcaggaagaggtgcacctgtgtgcacctacatctcccacggatgactgcctgagccttgggggaggggtggccatctagctctttagggagagctagagtcccttagcgtggatcactcagggccctttgggtgatcctctgcagttcctaccacctgagggacaagccaccagctcagtctctgccaagagctgggctaggagggtacctagcagaggtgacagatgagggaggacgaggctgacttggtgcccaactcaaatcgtaacatgcaggatgccagctctgagacacratttcaggtgtgctcctgggggcggccctatgcagcacacccccgtgcaggtgactgcaagcacatccttcttggcagctgggcggcccaggaaaggttgggacgggcccctcctgctctgcaaggcacgatgtcctgggtgaggctcccaaagcatggctccccctaaaacatcttgctggaaccaccacccactccctggggggctcagcagccccatggctgtgtcgcctcctcccgagaggcttctccgtggttaggcctcagcctggcagtcttttctgtcaagggccagacagc

SEQ ID NO: 104778 - DNA, 601 bp, Human
actgtagatcgtgtctgggtgcacctctgggcccagtgtcagcatggccgccccagtgcccacgtcccacaccatgatcacgttgtcacaacctgcacgttccccacagtgtcagaagccatgagcctcctgccctcatccactgcaggccacgagccacccccaagcccctcctcccgcagcacctgcactgagcagcacgttctgggctgtggtgtgccaggccacaatgcccacacgcttggtgtggccctccagggtgacgacgggctcccgcaggggcagcatcaggcccccatcygggatctcccacacctgcagaggaggggccagtgagtcttcaggactccaaatgtcagatcccatcctagagcccctctcccagcccctgggtccccaccaccactcaccatgactgtgcagtcctcggagccactggcaatgacgttgtcattgtgcgggcaccaggcgatgtctagcacaggggctgtgtggccacagaccgtgggcgcattcttgtccacacgtccagtctaaaggcacagcagggccttggaggtgcttttgcctcccaaacccaatccaacctccccacacctcc

SEQ ID NO: 104779 - DNA, 601 bp, Human
tccaagggcctggctgatggtggataagaaggataaaggctgtagggtcaaaggtcagggtagatggcgactcacagctacgacagtgcctttgcggggctcgatgatgcgcacgcgcttgtcacggcaggaggtacaaatgaggcctccatctcggctccagtccacactgtagatcgtgtctgggtgcacctctgggcccagtgtcagcatggccgccccagtgcccacgtcccacaccatgatcacgttgtcacaacctgcacgttccccacagtgtcagaagccatgagcctcctgscctcatccactgcaggccacgagccacccccaagcccctcctcccgcagcacctgcactgagcagcacgttctgggctgtggtgtgccaggccacaatgcccacacgcttggtgtggccctccagggtgacgacgggctcccgcaggggcagcatcaggcccccatctgggatctcccacacctgcagaggaggggccagtgagtcttcaggactccaaatgtcagatcccatcctagagcccctctcccagcccctgggtccccaccaccactcaccatgactgtgcagtcctcggagc

SEQ ID NO: 104780 - DNA, 601 bp, Human
ccactggcctctggtgctgccctcctgcgcccggtgtccaggccccggttgaccctcagctcccggctctttgggggtacgtagccatccttgagggagatgaggaggggcccagcatcccgaccccccagccactcctcagccgtgagggcagggtcgggccctgcggtgggtgggtacaggtcctcctggaacaggtccgactgtgggcaaggccagggatagtgaggaaagcgcttatgccaggacaccccccacaagaccgcaaagtcagtgcccagcctggagcccagggtggggygggggagcatcacctttcgaggcactgtcatggcaatgggctcacacctccgctcgtgcagcttgtagaacctgtgggaaggggaaggtgagcggggcccacagtctggttgggtgggcttgggactgcccactgcccaaggagcatgctgcggtcagggccgggggtcagtcacctggcgatctcacacttgttcacctccaggccacgtttgggcatgtagcccatgccccgctgggactccttggaactgaacatggagagatagtgcaggaaaggggcctcggaagtgatctcaaa

SEQ ID NO: 104781 - DNA, 601 bp, Human; identical to SEQ ID NO: 30795

SEQ ID NO: 104782 - DNA, 601 bp, Human; identical to SEQ ID NO: 30796

SEQ ID NO: 104783 - DNA, 601 bp, Human; identical to SEQ ID NO: 30797

SEQ ID NO: 104784 - DNA, 601 bp, Human; identical to SEQ ID NO: 30798

SEQ ID NO: 104785 - DNA, 601 bp, Human
tcctaggaccaaaattctcctctcccaccccaagtcagtctggtctggaaccatacccactgtcctatgctgagtaccaactattctgtaggcaagagctagaactaagtccttccaggtagatgtcccggccccttcctctctctactccccacaaagtacccagaatcaagttactaacacagagccctggagatatgtgagcagaatcactcgccaaataggagtccttctgccctggccaagaatctccactaacaaatccaaagtcccttcccataacccctttcttttctttccctttttttttttttagacggagtctcactctgtcgcctagcctggagtgcggtggcgcgatctcggctcactgcaagctccgcctcctgggttcacgtcattctcctgcctcagcctcccgagtagctgggactacaggtgtccaccaccacacctggctaatttttttgtatttttagtagagatggggtttcaccatgttagccaggatggtctcgatctcctgacctcatgatccacctgcctcggcctcccaaagtgctgggattacaggcgtgagccgccgcgcccggcctgtttt

SEQ ID NO: 104786 - DNA, 601 bp, Human
cgtcgccacctacctgtggggaagtagaaagttttgccctgtcgtaaacagtcccctaccccctacctgtttctgtccagcggaggcccttcttccacaaccacccatctaacttggggccccttgcccccactccacgccccaaattaaggctcccaccctcaattacaggggtcttccagtcatccccccgttacatttcacagtgttggccacactcttactctgaacagctctttgaggtcatagaattgtccatggatgtcgccgcacacctggggaacaggaagagtggggttgsaactcaagcagtgggagttgccagggactaccctccaaacacccgctgctttagtgagctttatcactcttggctgcacttctacttcctaggaccaaaattctcctctcccaccccaagtcagtctggtctggaaccatacccactgtcctatgctgagtaccaactattctgtaggcaagagctagaactaagtccttccaggtagatgtcccggccccttcctctctctactccccacaaagtacccagaatcaagttactaacacagagccctggagatatgtgagcagaatcact

SEQ ID NO: 104787 - DNA, 601 bp, Human
accagacacagaccgggtccctagcaaggcacccaggccctttgtcatctggccccacactgcctctcccaccagtggcatcaatgacctgccacattcgcaacagtgagcctctgcccctcccagaatgctgccccgctggcctcaacccccatcaagtctctgaccacccccaaaagcagaatcggtccatcaccagtgacacagctccaaggtggggctggtcacgataggagatgagggcggaacggactaagacaggcccggcccgaggtcgcccaggttgggggtgcagaagccrgggactgccaccttaagtgccagcagcaggaggaacgtttcgacgctatagaagccacggtccacaaagtcccccatgaagaggtagttggtctcagggacgtcgccacctacctgtggggaagtagaaagttttgccctgtcgtaaacagtcccctaccccctacctgtttctgtccagcggaggcccttcttccacaaccacccatctaacttggggccccttgcccccactccacgccccaaattaaggctcccaccctcaattacaggggtcttccagtcatccccccgttacatt

SEQ ID NO: 104788 - DNA, 601 bp, Human
ggagaaagaacgcccaatgcctggggccccctcataatcacagtgatcatacaatccccgtccaaacagcacataagagtgaaaggggcactcccagagacagaagggcaccctgtgttgtcacagggaggtccggagtgactgtggagcagcggctgcatgtgtgtgtctgcatgtgtgtgtctgtatgtgtgtggctgtgatggagcagaggcctcgtgtgcgtgtgtgtggctgtgatggagcagaggctatgtgtatgtgtgtgtgtgtctgcgctggagcagaggctgcctgtgcrtgtgtgcctgtgacaacaggaactctggctggtcctcagaagacctgactttaaatctcagctctgctctacactagtggaaaacccacaaaatgaggggtctcagggggctaccattctggggttctgacctctgaagaagctgctgtcatgttctaaggccccttcacttcagggagccatgacttggttgtcctccacagccctctgggccatgccccaagccactgtgtgctcaaagcacctgccatgcagacctccctgctcctcctccagggttccagccatttggcaggtgga

SEQ ID NO: 104789 - DNA, 601 bp, Human
gtcaaggccctgacgtccaccccaggtcccaggccagcaaccctgtgcattcccaaccaagtctggcacaaacccaaaaaccatttttcttcttttattagaattttttcattttttttctcaaaatttttatctaaaaacaaacagaaaaaagaaggaaaaaaagaaaaaaaaattattggaaacttcatggttcaagtggggagagaggaggaggaacatggagctaggtctccaggcctctccagagaagtcctcaccctcgaagcaccctcttgggggacagcagagccaggacagccccccccacgcccagcctccgtctgaggaagatggcagagtcacagtggtgcgagggccagaagggttggagggggcaggggccgggcggggtcacaggaagtagtcggccacgggcttcttggaggggatgccccgtgtctcttggggagcagcctcaaagatgatgaaatctttctggagatgctcgtccagctccaagatggctgccacattcccacagctggaaggcggggcagcagggtcaggagcagctcggctcagatgcccgcccatcccagcccggcccagccggctcacc

SEQ ID NO: 104790 - DNA, 601 bp, Human
tgcagccgcttggcaatgctccctgggagtgtcacatgggaattaggggatcagcctgccactcccaaccctgcaccctccacccattctgtctcctgcccgcaccagtggactcatctgcagccaggatgcccttgccaggtgccacgatgcggtgagcgatgtcagacagctccttcttctgctccggggtcagtgctggatattggtagggcatggtgctggtagtagcaagttcctggatacaggaaacagaggggaaggactagttagctagggtttcccatcatctcccgatgascagggcccctctcctggaggtcagggaaatgttccctacctcccctgccccacacccagcaggccctggggcacttctggtccccagctctctcttacgcccaacttccctttgctaggcctgcccctgtacctttcctaactctgtctggtgctgggtgttgcccagctgagggtggagttgcccactggcaactgggggaaaggaaaaggccatagccatggacaggtgggtcatgttgaagctggacccttctggcttgcgccttgccatggggtcaccttgcctgaaaacaaaacc

SEQ ID NO: 104791 - DNA, 601 bp, Human
ttgccatggaaatccgtccaaatgggcatagggttgtgggtggagcttatctactgcatagagatcaagatgagtgtgggcctcaccagtgacagcggggggcactgtgcggcgcagcgctgtgacggtcgccatggcaatctcctcatgagaaaacttctgagtgcaagcatggcctggggtgaccatgttgggcttcagcaaggtgccttccaggtagatgtggtggtcactcagagccttgtagacagcagccagcacctggagcagagcaggcgcacggtgggtagtggggtggagragaggataggggttagccccagggtccccggccagccaccttgcactggtcaggcaggtagccatttaccttctcggtcacatactggcagcgcttcaagtcatggtccccatcagggaggatctcaggctccacgatgggcacaatgccattctgcagggcgagggacagggtcactgtgaggcctcctaacccagagtcccacctacatctctccacagccactggtcaagaccgtatcttgatgatgccagggactcaggcttcaaagccctcagattacaggagacaagagccgcc

SEQ ID NO: 104792 - DNA, 601 bp, Human; identical to SEQ ID NO: 81865

SEQ ID NO: 104793 - DNA, 601 bp, Human; identical to SEQ ID NO: 27908

SEQ ID NO: 104794 - DNA, 601 bp, Human; identical to SEQ ID NO: 27909

SEQ ID NO: 104795 - DNA, 601 bp, Human; identical to SEQ ID NO: 27910

SEQ ID NO: 104796 - DNA, 601 bp, Human; identical to SEQ ID NO: 27911

SEQ ID NO: 104797 - DNA, 601 bp, Human; identical to SEQ ID NO: 27912

SEQ ID NO: 104798 - DNA, 601 bp, Human
cagagcttcatgttctagaaccaggtcttactttgaccctttgttgctcctctcccaaccagcacggggcctcaccttctcctggtagatctctaggtaagacatggtgacagaaagggcccatggccggccctcggcaccctcctcccttgtgagctgcaggaggtccatgagagcccgcgggatcaccccaggttgctctgggctgcccagcattgtgtgcgtcttccctgggaagagagtggagaaaactgtgaggttttcctctccgtttccccagccctttctgacccatagctgkttcttttctggctccctcaccagctcctgtgggtccataggcaagcacactggcattctgcccttccagcaagtgccttaggatgggctgcactgaacctgcatagatgtcctgctgagtactcctctccccatagaaggcatcaaacctgcaggaagaaagaaagaaattagcgtgtgtgtgtgtgtgtgtgtgtgtgtgtgtaaggggtggagtggggtgggggtgggtaagggattctactctcatctggaccttggatttaagagaacgtctctatcccctttcttgtacaaagac

SEQ ID NO: 104799 - DNA, 601 bp, Human; identical to SEQ ID NO: 25432

SEQ ID NO: 104800 - DNA, 601 bp, Human; identical to SEQ ID NO: 25433

SEQ ID NO: 104801 - DNA, 601 bp, Human; identical to SEQ ID NO: 25434

SEQ ID NO: 104802 - DNA, 601 bp, Human; identical to SEQ ID NO: 25435

SEQ ID NO: 104803 - DNA, 601 bp, Human; identical to SEQ ID NO: 25436

SEQ ID NO: 104804 - DNA, 601 bp, Human; identical to SEQ ID NO: 25437

SEQ ID NO: 104805 - DNA, 601 bp, Human; identical to SEQ ID NO: 25438

SEQ ID NO: 104806 - DNA, 601 bp, Human; identical to SEQ ID NO: 25439

SEQ ID NO: 104807 - DNA, 601 bp, Human; identical to SEQ ID NO: 25440

SEQ ID NO: 104808 - DNA, 601 bp, Human; identical to SEQ ID NO: 25441

SEQ ID NO: 104809 - DNA, 601 bp, Human; identical to SEQ ID NO: 25442

SEQ ID NO: 104810 - DNA, 601 bp, Human
tcaaacattagaacttatttcttctatctaactgtatgtttgtaaccattaatcaacttctcttcattcccctcccaccaaccacccttcccagactctggtatctatcattctattctctatggccatgaggtcaagttttttagctcccacatatgagtaagaacatgcagcatttgtctttctgtgcctggctaatttcatttaacatagtgacttccagcaccatccttatggctgcaaatgagttgatttcattcttttttatgaccaataatattccattttgtatctataccargttttctctattcattcatccgttgatggacacttaggtttatatctttgctgtcatgagtcgtgctgtaatacacatctgaacgcaggcatccctttgatatactatttattttcctttagctagatacccagtaataggattcctggattatggtagttctatttttaggttttaataaatctccatattgttttccatagtggttgtactaatttacattcccaccatcagtgtataagagttccctgttctctgcgccctcatcagcctctgttatttttttcttctttataatag

SEQ ID NO: 104811 - DNA, 601 bp, Human
ataggattcctggattatggtagttctatttttaggttttaataaatctccatattgttttccatagtggttgtactaatttacattcccaccatcagtgtataagagttccctgttctctgcgccctcatcagcctctgttatttttttcttctttataatagccattctaactggggtaagacgatatctcattttggttttgttttgcacttccctaatgattcatgacattgagcattttttcatgtatccattggccatttgtcagtcttcatttgagaaatgtctattcatgccrgtttcccattttaatgggattattattattattattatttattgtttagttgtttgagttccttgtatattctggaattagtcacctgttgcatgagtagttagcaaatattttctcccattcaagaggttgtctctttactctgttgattgtttcttctgctacatagaagtttttccatttaatacagtcctatttgtctatttttcgttttgttgcctgtgcttttgaggtcttggccataaaatctttgcctagaccaatgccctgaagagtttttcttatgttttcttctagtag

SEQ ID NO: 104812 - DNA, 601 bp, Human
tgtcaacctagaattctaaacccagtgaaaatacctttcaaaaacaatggcgatagtcactttttaaaatgtgaaacaccgttcagaaaaatgaggatcgtgttatggtttcaatctgtatccccacccaaatctcatgtcgaattgtgatctccaatgttggaggtggagtctggtgggaggtgattggatcatgagcatggatccttcatgaatagtttagcacccttggtgctgttctcatgataatgagtaagttcttgagagatctggttgtttaaaagtgtgtagcaatcccccmcacacacacccagctctctctcttgctcctgctttggccatgtgatgtgcctgctaccccttcactttccaccataattgttaagtttcctgaggcctccccagaaagggagcagatgctagcatcatgcttcctgtacagccaacagaaccatgagacagttaaacctcttttcattataaattacccagtctcaggtacttctgtacagcaatacaagaatgaactaatacagattgctttccttgatgtgtgagagtcatcatctctcctcttggttcattattgggtgtgctataa

SEQ ID NO: 104813 - DNA, 601 bp, Human
gttaagcaaatagaagttcaaatgacatcaccaagatggtggatgagaaggtaatgcccatcccccactgagaaaaacaacgaataaacaactacataccaaccaaaatagctctgggagagctgcagagtacaatgaaaaacttgcagcaacccaaaggaccacacaaaccaagatagccatattaaaaaatacagaaagtatcctacctactccaccccatcccccagtccaagcacagctttgcaccaagaggcatctcctggacacaacccacaacctccacctgtgggagaaaagkagagcaggaggaccccagcatcctttgccaccaatgcaaacattgaccacttttaccactgaggacccctgcagtttccaccagtgatgatctcaactgacagagctttccagggtccatgctgctgtgtccccctggagaagaagctgctgtgtccccagtggccaagattaccaactcaccgtctcacaattgcatgtatgctctagaccccagagccaaggctgctacatgtatgatggacacttctgacactggcaccaccactgccatgggcacacctgtaccccagatcataga

SEQ ID NO: 104814 - DNA, 601 bp, Human
aaggagagcaggaggaccccagcatcctttgccaccaatgcaaacattgaccacttttaccactgaggacccctgcagtttccaccagtgatgatctcaactgacagagctttccagggtccatgctgctgtgtccccctggagaagaagctgctgtgtccccagtggccaagattaccaactcaccgtctcacaattgcatgtatgctctagaccccagagccaaggctgctacatgtatgatggacacttctgacactggcaccaccactgccatgggcacacctgtaccccagatcayagagccatggctgttctgtgtgcaaccaagcatcaaataccagcaccactaccaacatgagcacacctgcactgtggatctggcacaaaaagggatcccatcagctgtgaagttcccccaagcaggaataagagaacaggaaaatgccagcagcctttgctgttgcatttgggtggggtagtcaataataatttaccctatacatgtctttatatttagagtacccaagcaactttttctgctgctgtgtacacccacagccttggctgctgagggcctccagagccattggccatgctg

SEQ ID NO: 104815 - DNA, 601 bp, Human
acccaagcaactttttctgctgctgtgtacacccacagccttggctgctgagggcctccagagccattggccatgctgatctcagctgatggagctttatagagagtatgctgctgtacccaccatggagttggagctgatgctgtggcttcccagagctagaaccaccacacccaactcagacagcatcttcatgcccacttataaatggtctttccctattgaaatgagtccatacagtctggaagaggtggctattacttcaaacatgcagacatcactacaaggctaaagaaacataaaaaatcaaggaaatattacaccgccaaaggaacacaataatttttcagtaattaaccccaaagaaatagagatctatgaactacctaaagaataattcaaaataattgtttaaggaagcttggtggctacaagaagacactgggaattcagtgaaaccagaaaagcaatacaagaacagattaaaagttcaagaaagagatagaaatcattttaaaataaccaaacaaattatggagttgaagaatacaatgaatgaaattgaaaatacaatagagaatttcaacagcagacttgatca

SEQ ID NO: 104816 - DNA, 601 bp, Human
cttataaatggtctttccctattgaaatgagtccatacagtctggaagaggtggctattacttcaaacatgcagacatcactacaaggctaaagaaacataaaaaatcaaggaaatattacaccgccaaaggaacacaataatttttcagtaattaaccccaaagaaatagagatctatgaactacctaaagaataattcaaaataattgtttaaggaagcttggtggctacaagaagacactgggaattcagtgaaaccagaaaagcaatacaagaacagattaaaagttcaagaaagaratagaaatcattttaaaataaccaaacaaattatggagttgaagaatacaatgaatgaaattgaaaatacaatagagaatttcaacagcagacttgatcaagcaaaataattttaaaaaaaaatctgtgaacctgaagacacatcatttgaaattatctagtcagcagacaaaagagaaaaaagaatggaaaacagtaaagaaagcctatgggatttatggaataccatcactgaaatcaatatatgtatttgggagttccaaaaccagaagagtggctgagcactgtagctcatgcctg

SEQ ID NO: 104817 - DNA, 601 bp, Human
aaaataataaaggctaaaaacttcccaaatcttgagagagatatagacatccagattcatgataccaaatagcccccaaatagaatcaacccaaagaagactacatcaaggcatattataatcaaattaccaaaagttaaggacaaagagaattttgaaagcagtaagagaaaagtaactgatcacatataagggagactcgatgggactattggaagatttctcagaagaaaacttgctgaccaggagaaaatagggtgatataacccaagtactgaaagaaaaaaaaatgccatttaaraatactattcctagaaaaattttcctttaaaaatgaaggagaggctgggcatggtggctcacacctgtaaccccagcattttggaaggctgaggtggaaggatcacttaaacctaggagtttgagaccagcctgggcaacatggcaaaacctcatctccacaaaaaaaatttaaaaattagccaggtgtggtgacacactcctgtagtcccagataccagggaggctgaggcaggaggcttgcttgagcagaggtgtttgaagttgcagtgaggcatgatcacaccacagcactctagct

SEQ ID NO: 104818 - DNA, 601 bp, Human
aataaataaaaataaaactacaaataagattaaacaaaacataagacaaaaatttgcaggggctgggcgtgggggctcatgcctataatctcagcattttgagaggccgagacgggctgatcacctgaggtcaggagtttgagaccagcctggccaacatggtgaaaccccgtctctactaaaaatacaaaaattagccggttgtggtggcaggcacctgtaatcccagctacttgggaggctgaggcaggagaatcgctggaacctgggagacagaagttgcagtgagccaagatcacaycactgcactccagcctgggagacagagtgagactccattttaaaaaaaattttttttctaatggatatacagtataaaaacaagccagcagccaacaagatcacaaagtgtgcaggggtgcagggatggagagtaaaagtctagtgtttttgtaagcaattgaagttaagtttttttgttgttgttgttttatttttgagacggggtctcgctctgtctcccaggctggagcgcagtgtcgcatctctgctcactgcaagctctgcctcctgggttcacaccattctcctgcctcagcct

SEQ ID NO: 104819 - DNA, 601 bp, Human
acagtacaaccgataccacagaaacaaaaagatgtataaaggactattatgaacaattacatgccaacaaacaggaacaaacaggatcacctagaagaaatggataaatttctagaaacatacaacctaccaaaactgaagcaaaaaatagaaagcctgaacagaccaataaaaaataaggcaactgaatcagtactcaaaaaatctcccaaaaaagaaagcccagaaccagatggcttcataggtgaattctaccaagcattttaaaaagaatgaacacctaatctttcttaaactcttstgaaaaatagaagaaaagggaacacttcagaagttattctgcaaggccaaaattaccctgataccaaaaccagacaaagatactccgagaaaagaaaacctcaggccaatatacctgattaacttagatgtaaaaaccctcaatgaaatactagcaaaactaattcaacagcacattataaaaattatacaccataggccgggcatggtggctcacacctgtaatcccagcactttgggaggccgaggtggatggatcacctgaggtcgggagatcaagatcagcctgaccaacatggag

SEQ ID NO: 104820 - DNA, 601 bp, Human
attagctgggcatgttggcaggtgcctgtaatccgagctactcaggaggctgaggcaggagaattgcttgaacctgggaggcaaaggttgcagtgagccgagatcgcgccactgcactccagcctgggcaacaagagcaaaatttcgtctcaaaaaaaaaaaaaaattatacaccctgagcaagtgcaatttgcttatttatttgttcatttgttttattatccctggaatgcaagtatggttcaacgtatgaaaatcaatcaatgtgatacaacatattagctaaagaaaaaatgtgatyatctcaatagatgcagaaaaaacgtttggcaaagtacaatatctattcatgactctcaacaaaagaggtacagaagaaacttaccctaaaataataaaggccattatgaaaagtccacagctaatatcataaccaatggggaaaaactacaagctttccttctaagatctggtacaaggcaaggatgcccactttcaccttcttttcaacatagtactagaagtcctagccagagcaatgagacaagaaaaagccatccaaacaaaaaagaagtaaacttatccttctttgcagatggtg

SEQ ID NO: 104821 - DNA, 601 bp, Human
actcaggaggctgaggcaggagaattgcttgaacctgggaggcaaaggttgcagtgagccgagatcgcgccactgcactccagcctgggcaacaagagcaaaatttcgtctcaaaaaaaaaaaaaaattatacaccctgagcaagtgcaatttgcttatttatttgttcatttgttttattatccctggaatgcaagtatggttcaacgtatgaaaatcaatcaatgtgatacaacatattagctaaagaaaaaatgtgattatctcaatagatgcagaaaaaacgtttggcaaagtacartatctattcatgactctcaacaaaagaggtacagaagaaacttaccctaaaataataaaggccattatgaaaagtccacagctaatatcataaccaatggggaaaaactacaagctttccttctaagatctggtacaaggcaaggatgcccactttcaccttcttttcaacatagtactagaagtcctagccagagcaatgagacaagaaaaagccatccaaacaaaaaagaagtaaacttatccttctttgcagatggtgtgatcatgtacatagaaaacacagaagactcaatgaaaa

SEQ ID NO: 104822 - DNA, 601 bp, Human
ccttgctctgtcacccaggctgcagtgcagtgatgttatcatagctcactgtagtcttaaacttctggactcaagcaatcgtcctgcctcagcctactgataatctgggactacaggcacatgccaccagccccactaattttatctttttgtaaagacagggtcttgctatgttgcccaggctagtctcaaactcctggcctcaagcaatcctcctgcctcagcctccgaaagcactggaattacaggcatgagccaccatgcccagccctagtcacatttctagacacaaacagcaaastagtcagaaagaaaattaaggaaacaatcccattcccattagcaacaaaaagaataaaatattgaggaataaacttagccaaaaagacttgtacactaaaattataaaacattgaaggaaattaaataacattatagataaatgaaaaagatatcgcatgtccatagattgaaaaaatattggtaaaatgttcatactacccaaagtgatctacagatttaacgccatccctatcaaaatcccaatggtattctttacagaaatagacaatagaatcctaaaattcacatgggatgacaa

SEQ ID NO: 104823 - DNA, 601 bp, Human
atttctagacacaaacagcaaagtagtcagaaagaaaattaaggaaacaatcccattcccattagcaacaaaaagaataaaatattgaggaataaacttagccaaaaagacttgtacactaaaattataaaacattgaaggaaattaaataacattatagataaatgaaaaagatatcgcatgtccatagattgaaaaaatattggtaaaatgttcatactacccaaagtgatctacagatttaacgccatccctatcaaaatcccaatggtattctttacagaaatagacaatagaatcytaaaattcacatgggatgacaaaagacctagaatgtccaaagcaatcttgagcaagaacaaagctggattaatcacacttcccaattttgaaatgtattatagccagatacagggtagtcccagctacctgggagtggagtctgaggcaggaggatgcttcagcctaggagtttgaggctgcagtgtgctatgattgcacctgtgaatagccactgcactctagcctgggcaacatagatacacacacacacacacacacacacacacacacacatatacacacacacacacattatagt

SEQ ID NO: 104824 - DNA, 601 bp, Human
ccaataacacacaattggaaaaggatcatctccttgatagtgttggaaaaactggatatacaaatgcagaaggatgaaattggatccatgtctcacactatatacaaaaatcaactcaaaaaggattacagatctaagcttaaaagctaaaaccataaaactcctagaagaaaacataggggaacattttcttgatattggcctgggaaatgattttttttttgatgtgacacaaaaagcacaagcaacagaagcaaaaatagacaaatgagactgcatcaaactaaaaagcttctgcacrgcaaaggaaacaacagagaaaaaaggcagtctaaggaatgggagaaaatattttcaaactatgtatctgataagaggttaacatttaaaatatataaggaactcatacaactgaataacaaaaaaaaaaaaagaaagagagaataaatttaaaaaataaataaataaccctactttaaaatgagcaaaggacctgaatagacatttcccaaaagaaggcatacagatggccaataagtatatgaaatcatcggagaaatgcaaatcaaatgaaatgtcacctcacacctgttagaattag

SEQ ID NO: 104825 - DNA, 601 bp, Human
gcatcaaactaaaaagcttctgcacggcaaaggaaacaacagagaaaaaaggcagtctaaggaatgggagaaaatattttcaaactatgtatctgataagaggttaacatttaaaatatataaggaactcatacaactgaataacaaaaaaaaaaaaagaaagagagaataaatttaaaaaataaataaataaccctactttaaaatgagcaaaggacctgaatagacatttcccaaaagaaggcatacagatggccaataagtatatgaaatcatcggagaaatgcaaatcaaatgaaaygtcacctcacacctgttagaattagtattatcaaaaagacaaaagccaggtatggtggcttgcgcttataatttcagctattcaggagactgaggtgggaggatcacttgagccctggagttcaagacgaacctgagcaacatagtgagactttgtctccaaaaattatatatatataattttatataataattttaacaattttatataataatttatataataaattatatatatcatttttatatataattttgtctccaaaaattttatatatatatacacatatatatatacaca

SEQ ID NO: 104826 - DNA, 601 bp, Human
atacacaaaaactacaagtcattgctaagacaaattgaagttctaaataaatggagagatatactgtgtttataaatcagaagacaatatggctatgaattcagtgctctccaaataattcatatatagatttaatgcaatcccagtgaaaattccaacaggcttttttgtagaaattgacaagttaactctaaaatttgtatggaaatgcaaaggacctaacataaccaaaacaactttgaataataaaaacaaattagaaaatgtcactatctaacttcaaagctttttataaagttayagtcgtcaggccagggggcatgatggctcatgcctgtaatcccagcactttgggaggccaatgctggcagatcacctgaggtcaggagtttgagaccagcctgcccaacatgtcaaaaccccgtgtctactaaaaatacaaaaattaaccaggcatggtgacaggtgcctgtaatcccaggtacacaggaggctgaggcacgaggattgcttgaacccaggaggcagaggttgcagtgagccaagattgtgccactgcactccagcctgggcgacaaagtgagactctgtctcaaaaaaa

SEQ ID NO: 104827 - DNA, 601 bp, Human
aagacaaattgaagttctaaataaatggagagatatactgtgtttataaatcagaagacaatatggctatgaattcagtgctctccaaataattcatatatagatttaatgcaatcccagtgaaaattccaacaggcttttttgtagaaattgacaagttaactctaaaatttgtatggaaatgcaaaggacctaacataaccaaaacaactttgaataataaaaacaaattagaaaatgtcactatctaacttcaaagctttttataaagttatagtcgtcaggccagggggcatgatgrctcatgcctgtaatcccagcactttgggaggccaatgctggcagatcacctgaggtcaggagtttgagaccagcctgcccaacatgtcaaaaccccgtgtctactaaaaatacaaaaattaaccaggcatggtgacaggtgcctgtaatcccaggtacacaggaggctgaggcacgaggattgcttgaacccaggaggcagaggttgcagtgagccaagattgtgccactgcactccagcctgggcgacaaagtgagactctgtctcaaaaaaaaaaaaaaaggttatggtcatgaagac

SEQ ID NO: 104828 - DNA, 601 bp, Human
aagttatagtcgtcaggccagggggcatgatggctcatgcctgtaatcccagcactttgggaggccaatgctggcagatcacctgaggtcaggagtttgagaccagcctgcccaacatgtcaaaaccccgtgtctactaaaaatacaaaaattaaccaggcatggtgacaggtgcctgtaatcccaggtacacaggaggctgaggcacgaggattgcttgaacccaggaggcagaggttgcagtgagccaagattgtgccactgcactccagcctgggcgacaaagtgagactctgtctcaaaaaaaaaaaaaaaggttatggtcatgaagactacgttttattggaatagaaataaagaactatatcaccatatcaatcaaacagaatgaagagtccagaaacagtctctcaaatatgtgcttagtttattttttgacaaaggtgcaaatgcaattcaatggagaaagcgtaatcttttcaataaatggtactgaaacaactggatatctatatgcaaaaactaagctttgatccatacatcacaccatatacaaaaattaactgaagatatattttcgacctaaatgtaaaacctaaaa

SEQ ID NO: 104829 - DNA, 601 bp, Human
gtacacaggaggctgaggcacgaggattgcttgaacccaggaggcagaggttgcagtgagccaagattgtgccactgcactccagcctgggcgacaaagtgagactctgtctcaaaaaaaaaaaaaaaggttatggtcatgaagactacgttttattggaatagaaataaagaactatatcaccatatcaatcaaacagaatgaagagtccagaaacagtctctcaaatatgtgcttagtttattttttgacaaaggtgcaaatgcaattcaatggagaaagcgtaatcttttcaataaayggtactgaaacaactggatatctatatgcaaaaactaagctttgatccatacatcacaccatatacaaaaattaactgaagatatattttcgacctaaatgtaaaacctaaaaaaactgtaaaacttctagaagaaaatgtaacagaaaatctttgtaaccttgggttaggtaaagatttctcttaatataccaaaagcagccaggcccagtggcatgtgcctctaatcccagctactttttctgaattcattgacatgatcatatgggattttttgacttgttaatatggtgaaataca

SEQ ID NO: 104830 - DNA, 601 bp, Human
attatctttttatatattgttgggtttgatttgataaaacaccagctactggaaggctgggaggattgcttgagcccaggagttcaagaccagcctgggcaagataatgagtttttaacacacacacacacacacacacacacacacaccaggctgggtgctgtggctcatgcctgtaatcctagcactttgggaggccaaggcaggtggatcccttgagctcagcagtttgaggccagcctgggcaacatagcgagaccccatctctacaaaaaaatttttaattagttgggcatggtgktaagtgcctgtagtcccagttattcaggagtctgatgtgggaggttggcttgagcttcagaggcaatggttgcaatgagccaaggtcacaccactgcactccatcctgggcaacagagccagaccctgtctcaaaaacaaaacaaaacaaaagaacataccaaaagcactacccataaagaaccaattgataaattggactttatcaaaatttaaaacttctgctgttcaaaaacattattaaaagaatgaaaagacaagccattaactaggagaatatactttcaaatcacacatttaa

SEQ ID NO: 104831 - DNA, 601 bp, Human
ataagtaattcaaaatctaagctgggctgggtgtggtagctcacgcctgtaatcccaacactttgggaggctgaagcgggtggattgcttgaggtcaggagttcaagaccagcctggccaacatggtgaaaccctgtctctactaaaattacaaaaattagccaggcatggtggcacatgcctgtaaacccagctatgtcaggaggttgaggcacaagaattgcttgaaccaaggagacagaggttgcaatgagccgagattgcgccactgcactccagcctgggtgacacagagaggctytgactcaaaaaaaaaaaaaaaaaaaaaatctaagctgttggtagacgactcatataaaaaattttttaaaaacaaaatctggccaggcacagtagttcacgcccataatcccaccactttgagaggccaaggcgggcaaatcactggagctcagaagtttgaagagatcagcctggccaacatggtggaactccgtctctaccaaaaataaaaaaattagctgggcagggtggtgcacgcctagtaatcccagctatttgggaggctgaggctggagaattatttgaactagggaggtag

SEQ ID NO: 104832 - DNA, 601 bp, Human
ccactgcactccagcctgggcaacagagcaagactccgtctcaataaataaataaataagtcaacagatcagatagcatttcagaagaggctaagaacatgttgaactgttcaggaaagactacatggaatagggccttgaaagaagggcaggaatcagctaattagaagacaggaagagcatttcaggccaagggaaaatggtaaataaacacaaagagttagaaggattggagggagggccaggtgcggtggctcatacctgtaatcccagcactttgggaggccaaggcgggcagatyacttgagctcaggggttcaagaccaacctattcaacatagaccacatctctacagaaaatttttaaaataaaaaaattagctaggtatggaggcccacacctgtggtcctaactactcaggaggctaaagtgggaggatcacttgagcctgggaatttgaggctgcagtgagccatgattgtgccaccgtactcctgcctgggtgacagagcaagatcttgtctcaaaaaattttttccaataaaataattttatttatgttcataaatgtattagggaaaatttaggatatgagtttca

SEQ ID NO: 104833 - DNA, 601 bp, Human
cttgagcccaggagttcgagaccagcctgggcaacatagtgagaccctgcctttacaaaaaaatgtattttgaatcagccaggcatggtggtgcacgcttgtggtcccagctactcaagaggctgagatgagaggatcacttgagcctgggagactgaggctgcaatgagctgtgatcacacccttacactccagtctgggcaacggagcaagaccctatctcaaaaataaaacgaaaccaaaactgaaaagcaaagagaaaaaagactagaaagaagaaaaagaataaccaagaacggcrggacaactataaaaggtataacatgtataatgagaataccataaagagaaaaaatagagaaaggaacagaaatatttgaagcaatgactgtgaatttcccccaaattaatgttggccaccaaaccacaggtccaagaagttcagtgaacaccaagcagattaaatgacaaaaacgaaaccaacaacgacaaaaacactacacctaggcatatcatatttaaaactgcaaaaaatctaagacaaaaaaaaaaaaacgatattgaaagaagccagcgatgagaaaaaaacccttacttatag

SEQ ID NO: 104834 - DNA, 601 bp, Human
gtgagggccaggtgtcttgaatgctgaatcctccagagtggaggactgctggatcttcacatggcagaagggcaaaaaggataaactccctctgtgaagcccttatataagggcatctaatcccattcaggagggctccaccctcataacttaattacttcccgaagaccccacctttcaatagtgtcacattaatagtgccattaagtttcaacatgaattccatgggggatggatgggtgtttgtttttgtttcttagagacagggtccccctctgtcatccaggttagagtacagcgrtgtaatcatagctcaccgcaagcctcgacctcctgggctcaaggaatcatcctgctttagcctcccgagtagctaggactacaggcatttgccagcactcctggctaagtttcaacatgaattttagaaggtacacattcaaattttagaagggatgcattctgcctctggcccccacaaagtcatgtccttcccatgtgcaaaatactcattccatcccaacagcccccaaagtcttaactcattccagcatcaactcaaaagtctaaggtccacagtctcatctaaatcacatatgag

SEQ ID NO: 104835 - DNA, 601 bp, Human
tgaatgctgaatcctccagagtggaggactgctggatcttcacatggcagaagggcaaaaaggataaactccctctgtgaagcccttatataagggcatctaatcccattcaggagggctccaccctcataacttaattacttcccgaagaccccacctttcaatagtgtcacattaatagtgccattaagtttcaacatgaattccatgggggatggatgggtgtttgtttttgtttcttagagacagggtccccctctgtcatccaggttagagtacagcggtgtaatcatagctcacygcaagcctcgacctcctgggctcaaggaatcatcctgctttagcctcccgagtagctaggactacaggcatttgccagcactcctggctaagtttcaacatgaattttagaaggtacacattcaaattttagaagggatgcattctgcctctggcccccacaaagtcatgtccttcccatgtgcaaaatactcattccatcccaacagcccccaaagtcttaactcattccagcatcaactcaaaagtctaaggtccacagtctcatctaaatcacatatgagtgagactcagtgcatga

SEQ ID NO: 104836 - DNA, 601 bp, Human
acacattcaaattttagaagggatgcattctgcctctggcccccacaaagtcatgtccttcccatgtgcaaaatactcattccatcccaacagcccccaaagtcttaactcattccagcatcaactcaaaagtctaaggtccacagtctcatctaaatcacatatgagtgagactcagtgcatgattcatcctgaggcaaatttccctccagctatgagcccacgaaaccaaacaacttacatgcttccaaaatgtaatagtgggacaggtgtaggacagacgtttctttttcttttttgttttttttttttcgagacggagtttcactcttgttgcccaggctggagcgcaatggtatgatctcggctcaccacaacctcctcctcccgggttcaagtgattctcctgcctcagcctcctgagtagctgggattacaggcatgtaccactacgcccggctacttttgtatttttagtagagacagggtttctccatgttggtcaggctggtctcgaactcacgacctccggtgatctgcccgcctcagcctcccaaagtgctggattacaggcgtgagccactgtgcccagcccaggact

SEQ ID NO: 104837 - DNA, 601 bp, Human
tgtgcaaaatactcattccatcccaacagcccccaaagtcttaactcattccagcatcaactcaaaagtctaaggtccacagtctcatctaaatcacatatgagtgagactcagtgcatgattcatcctgaggcaaatttccctccagctatgagcccacgaaaccaaacaacttacatgcttccaaaatgtaatagtgggacaggtgtaggacagacgtttctttttcttttttgttttttttttttcgagacggagtttcactcttgttgcccaggctggagcgcaatggtatgatctyggctcaccacaacctcctcctcccgggttcaagtgattctcctgcctcagcctcctgagtagctgggattacaggcatgtaccactacgcccggctacttttgtatttttagtagagacagggtttctccatgttggtcaggctggtctcgaactcacgacctccggtgatctgcccgcctcagcctcccaaagtgctggattacaggcgtgagccactgtgcccagcccaggacttacatttctagtccaaactggagcaatcagaaagaaggagtaacaggtcccaagtaagtctaaa

SEQ ID NO: 104838 - DNA, 601 bp, Human
aggtccacagtctcatctaaatcacatatgagtgagactcagtgcatgattcatcctgaggcaaatttccctccagctatgagcccacgaaaccaaacaacttacatgcttccaaaatgtaatagtgggacaggtgtaggacagacgtttctttttcttttttgttttttttttttcgagacggagtttcactcttgttgcccaggctggagcgcaatggtatgatctcggctcaccacaacctcctcctcccgggttcaagtgattctcctgcctcagcctcctgagtagctgggattasaggcatgtaccactacgcccggctacttttgtatttttagtagagacagggtttctccatgttggtcaggctggtctcgaactcacgacctccggtgatctgcccgcctcagcctcccaaagtgctggattacaggcgtgagccactgtgcccagcccaggacttacatttctagtccaaactggagcaatcagaaagaaggagtaacaggtcccaagtaagtctaaaacccaaggcaaacaacgttaaatcctatgactggagaataatcttctttgactccatgtcctgccttccaga

SEQ ID NO: 104839 - DNA, 601 bp, Human
aggtctcacaggtgccctaggcactcccccaataacattctgcttctgaggccctaccactcaaagcctgtgatgggcacaacagccacaaagacctccaaaatgtctttgggtcattctcccattgtcttgatgaataccacctgacttccttctatccttattaatctccttaccaaacagtcacttggccacacctttggttttctctctaaacatgcttttttattctttacatgacgaggctgagaattttccaaatctctacattttgcttctcttttttattaagaaattccaycttaaaatcgtttctctgcttgcattttactataagcagttaagagaagccatgtagtaccccgagcactttgctgcttagctattccttccaccaaatatcctagttcatcactcttttttttttttaagttccgggatacatgtgcagaatgtgcaggtttgttatataggtatacatgtaccatggtggtttgctgcacctgtcaacccgtcgtcatctagattttaagccccgcatgcattagatatttgtcctaacgatctctgtcccctttcccccccaacccccgataggccc

SEQ ID NO: 104840 - DNA, 601 bp, Human
tcactcttttttttttttaagttccgggatacatgtgcagaatgtgcaggtttgttatataggtatacatgtaccatggtggtttgctgcacctgtcaacccgtcgtcatctagattttaagccccgcatgcattagatatttgtcctaacgatctctgtcccctttcccccccaacccccgataggccccggtgtgtgttgttcccctccttgtgtccaactcccacttatgagtgagaacatgcagtgtttgtttttctgttcctgtgttagtttgctgagaatggtggcttctagctscatccatgtccctgtaaaggacatgatctcattcctttttttttttagtttgttttgttttgaggcggagtctcactctgttgcccaggctggaatgcagtggtgccatcttggctcactgcaacctctacctcctgggttcaagtgactctcctgcctcagcctcccaagtagctgggattacaggctaatttttgtatttttagtagagacagggtttcaccatgttggccaggctggtctcaaacacctgacctcaggtgatccacccacctcggcctcccaaagtgctgggattac

SEQ ID NO: 104841 - DNA, 601 bp, Human
aactctcatcaactaggaatagaggtaaacttcctcaatttgattaaaaaacaggtacaaaaaccctatagctaacatatttaatgtcaaacttactaaatcagagtgttatcattgcatggtggaaactcaggttgctatgcaggggtgaaggtatttcatcagaaagaaaaataactcagactccagaattgtttctaatcatccaacaatcatatattgttcactattctaggagttgtaacacttctcagtatgttcaggagaaatgacaggagtaactgtctcattgctaaataatttgtgcacagtggggagtacagtgtcttgaccattaattccacaaagctgctatgagcagaggcacgatggtcatgttgacatgaaccagggagtcttaaaagggtagatggttgggaaaaaagcgagggtatgacgacaggcataatcagagaactcaaaagtgatgtcaaagttaggaactttgaactgaggatctcaaatcacagtaacggataagattgctaaggtagtgactctccaagaggttcatagtaatactaagctgttatttgttcatgtttccctcgttctgtcatga

SEQ ID NO: 104842 - DNA, 601 bp, Human
aggtaaacttcctcaatttgattaaaaaacaggtacaaaaaccctatagctaacatatttaatgtcaaacttactaaatcagagtgttatcattgcatggtggaaactcaggttgctatgcaggggtgaaggtatttcatcagaaagaaaaataactcagactccagaattgtttctaatcatccaacaatcatatattgttcactattctaggagttgtaacacttctcagtatgttcaggagaaatgacaggagtaactgtctcattgctaaataatttgtgcacagtggggagtacartgtcttgaccattaattccacaaagctgctatgagcagaggcacgatggtcatgttgacatgaaccagggagtcttaaaagggtagatggttgggaaaaaagcgagggtatgacgacaggcataatcagagaactcaaaagtgatgtcaaagttaggaactttgaactgaggatctcaaatcacagtaacggataagattgctaaggtagtgactctccaagaggttcatagtaatactaagctgttatttgttcatgtttccctcgttctgtcatgaatgtacaatggagctttccaga

SEQ ID NO: 104843 - DNA, 601 bp, Human
tcctcaatttgattaaaaaacaggtacaaaaaccctatagctaacatatttaatgtcaaacttactaaatcagagtgttatcattgcatggtggaaactcaggttgctatgcaggggtgaaggtatttcatcagaaagaaaaataactcagactccagaattgtttctaatcatccaacaatcatatattgttcactattctaggagttgtaacacttctcagtatgttcaggagaaatgacaggagtaactgtctcattgctaaataatttgtgcacagtggggagtacagtgtcttgaycattaattccacaaagctgctatgagcagaggcacgatggtcatgttgacatgaaccagggagtcttaaaagggtagatggttgggaaaaaagcgagggtatgacgacaggcataatcagagaactcaaaagtgatgtcaaagttaggaactttgaactgaggatctcaaatcacagtaacggataagattgctaaggtagtgactctccaagaggttcatagtaatactaagctgttatttgttcatgtttccctcgttctgtcatgaatgtacaatggagctttccagaggctacatt

SEQ ID NO: 104844 - DNA, 601 bp, Human
ctccctgtctgtacaatactcttggaaaaaggtcacgatgcatagcccacacttaagtagtagggagttgtatgtcacctccttcagggcagaatacccacatacattatttgggattctgtataggaaatttgtctcttctcctccatttatttattcattcaatcatttatttgtatcagcatggactcatgggtatttaattttatgctttgggttacaatcgaaaactgttttgttttgttgcccaaattgtccagctttggccactgggaacttttcagttggctcctgagtttatgttaatttttaatatggatagctattacccacataaacaaaagctctttggggtccttgataatttgtgagtgtaaagaggtcctgagaccaaaatgtttgagaaccaccgctctagggatcctctggctgacccgaatccccggtgtgtgtgcgcgcttcgtctgcaggtaggagttgtggtctggacagaagcaaagtaggccacactcgcctgcccttgggaacacccacttctccgtgccacgcccgctcctaaggttttcttcgggcagaaacgcggggatccccaagaagacga

SEQ ID NO: 104845 - DNA, 601 bp, Human
ggttacaatcgaaaactgttttgttttgttgcccaaattgtccagctttggccactgggaacttttcagttggctcctgagtttatgttaatttttaatatggatagctattacccacataaacaaaagctctttggggtccttgataatttgtgagtgtaaagaggtcctgagaccaaaatgtttgagaaccaccgctctagggatcctctggctgacccgaatccccggtgtgtgtgcgcgcttcgtctgcaggtaggagttgtggtctggacagaagcaaagtaggccacactcgcckgcccttgggaacacccacttctccgtgccacgcccgctcctaaggttttcttcgggcagaaacgcggggatccccaagaagacgaagctcaggctgccatgcctttcccgcgaacgccacggcgcggcgcccggttcacagggcgagtcgcccacccgcgagtcggaaagcgcccggaatcttggctaaagctcagcgttctcctccggggctggggccctggccaggcctggcctgagtggtctcccctcactctgcggctcgctctcccgggctactccggcgcgcaggtgctgcgcc

SEQ ID NO: 104846 - DNA, 601 bp, Human
agaaagagagagacgaagacagaagcaaacatacacaccaaggaaaatagaggtgcgcacacacccacatgcacagagagacggagaaagccacagagagtcagaaacaacatggagagacagatggagagagtgaagaaagagcaagacaaacggtcatacagattcatacagagagatacacacggagagacagggagtgacacaatctgacagggagacaggcaagagacagggattcagaaagagaaggacagagacattcagacagggagggggaggcaggccaacttagacacayagagagacaaatgaagacagggagataaacacaagagacagatgcaaatagacagagaatgacagaaacaagagccagagagagacccagggagatggagactcagagaagagacatggggagagtatgagaacaagaggcagcgtgaactgaggaaggcagagtgggagggaggcaggccatgccctctgcagatatttgtccattggaaacaactctcacttccagatcattctagggcccagaacaggtggtagggagagaaagagggcttagtgcttagcctgtgtgatacaggca

SEQ ID NO: 104847 - DNA, 601 bp, Human
agacagatgcaaatagacagagaatgacagaaacaagagccagagagagacccagggagatggagactcagagaagagacatggggagagtatgagaacaagaggcagcgtgaactgaggaaggcagagtgggagggaggcaggccatgccctctgcagatatttgtccattggaaacaactctcacttccagatcattctagggcccagaacaggtggtagggagagaaagagggcttagtgcttagcctgtgtgatacaggcagactgggaaccctcccttggggagaggctggtcagttgaccacccaggatcccagcagcacacccactggcctcacacagaacctgggccacccgcccggaatggccgtcagcccgcccactgcctggctccagtctgattacagccaaagtgccaaaaggctccagacacccccattccctgcccccatcgtctcacctccccacgcctcctctcctccttccccttctcctttacatccctctcttcctttcttcctagtcctcaggggagcagtttgtgcccctgtttagccactagctgggaggaaaggggttctcctccatcaagccccct

SEQ ID NO: 104848 - DNA, 601 bp, Human
attatctaggcatttgtcttcagccaccgttttgaggatgtcacttaggaaactttgcctccctcccttcttcctattctttcccatctcccatttctcccctccaagagccagagggctgcggagtcccaagatactaagagaccccctccccagatttcttgcaggccctagactccagacacttcacaagagggcagatgaggcaaaaaggcattacagatccactggatgtctcgtgtctgttctttttagaatcctccctgccccctactccttggatggcactcatcaccttccsgtaggagaaggagctgctttcccttcttccccaccatggggagagggcaaagcagggagagttgaacctagaaaagactcagtctttcctcttcaccccacaatcaaactggcctcttggactaggctattgcccctctccaccaggcagtgcctcccgtcctttccttactccgttcttcttcccgtgcaagcccccctccccgaaatgtggtctcttctctccttgcaccctgtggcttttctcctcttgacttggaatcttggctgaagggtgaggggtagctggccgaggggcccg

SEQ ID NO: 104849 - DNA, 601 bp, Human
cctccaagagccagagggctgcggagtcccaagatactaagagaccccctccccagatttcttgcaggccctagactccagacacttcacaagagggcagatgaggcaaaaaggcattacagatccactggatgtctcgtgtctgttctttttagaatcctccctgccccctactccttggatggcactcatcaccttcccgtaggagaaggagctgctttcccttcttccccaccatggggagagggcaaagcagggagagttgaacctagaaaagactcagtctttcctcttcaccccmcaatcaaactggcctcttggactaggctattgcccctctccaccaggcagtgcctcccgtcctttccttactccgttcttcttcccgtgcaagcccccctccccgaaatgtggtctcttctctccttgcaccctgtggcttttctcctcttgacttggaatcttggctgaagggtgaggggtagctggccgaggggcccgccagcttgggctgcagattcctatcatttcaagatgccgtctctccttatcccaacccccaccccctgttttcctgtttcagaaaaatctcttttgaatt

SEQ ID NO: 104850 - DNA, 601 bp, Human
aatcacaagaacaggattgtattcataggctcacaaagggagagaaacacaaagtggtatcatattgttagcactacttttaccaacagcagttgcttttaataagcccttactgagcttcaggcactatggccaaacaccttatgagcatgatctttgtcaatctgaaataatccagtgagatgggttctattatcatccttatttcacaaatgaaagtgagggatgctgtggcattaagagcagattcatggaggctaatagtgttatctctgtgttcaaagttctatatgtgctgggytgaatcatgtacactaggggctgtacacgaaaggaggaaagaaaaaaaaaaagcagatccctggcccgtttgtgtctttaacatacaaacataaaacatctgcagataggctggcaactgttgacaagtaaagctgtaatggaaatgggagttaatggctggctagagggagaagggagttggggataaatcagaacagttaggtgtttattcaacaaatagtgattgcatacctactatgtgccaggcactgttctcagtactggggatattgaattgaacaaaaccgacaaaaatccc

SEQ ID NO: 104851 - DNA, 601 bp, Human
gcccgtttgtgtctttaacatacaaacataaaacatctgcagataggctggcaactgttgacaagtaaagctgtaatggaaatgggagttaatggctggctagagggagaagggagttggggataaatcagaacagttaggtgtttattcaacaaatagtgattgcatacctactatgtgccaggcactgttctcagtactggggatattgaattgaacaaaaccgacaaaaatccctgcctttgtggagtggtgcatccaaaccatgtgaggatcatggtgaaatgcagattctgttacrgtaggccttgggtggggcctgaatgtctgcatttctaacgaatccccacatgatacagatactgctgttctggggaccacactttgagtagcaaggggctagagtagtgtatgcctcactttgtcaaatgaagggatgtgaattggccaaaagcaggtgaagagaagcattctggggcaggaagctgggaaggaagtgaagaacttccagaagggaaaaacaaagctagagtcagggcatctaacactctaccagaccgtgaggtgggagatgccttaaatatctttgtgtccctgacat

SEQ ID NO: 104852 - DNA, 601 bp, Human
attttgcaggcatgtgttgaactgagaggaagatgtggttagcctcaggctcagctttattggaggctccctacactaactacaaggggctgactactggagagcaagcaagcgccatgctctgtggagtcttgaagccattacttagtggagtaagggtggtaatagagacatttaattatcttcccatcttagatactgaacagatgttcccacactcagtgaggatgtaataaaaaggacctatgtgggctgcagcagaatggatttaagtcagaccacaagaaggacttgttgcccragtttggcctgccccactccagactgtctcacgagggctgggttattggtctctcattcccatccaaccctcctcacccaagccccattaaaaaaaaacaaaaaaacacacccattgcctagagcagtacttgggctgaactagggaagctgaacggtggtgagacagggacaagctccaactccaacggtcttgattctccaaacaaagcaccacagcagtgggtgtaactctgggctgtgcgtcaggcagcctttccggcctggccctgtctggggtgtttattttgtttgttcctgg

SEQ ID NO: 104853 - DNA, 601 bp, Human
aattgaccttcttttaattgttcatattggacagactggagactgcagtgtggggagagtcatcctcttacttatcttggcctttggcttcccactgcagacagcccttgcaggtccatccaggttggggaagatggttttaaaaggttcattagttaagaaaggccctggggcctggaaataaagggtttgaggaggagagtagagggtggggtcttcctccccggacctcacgattgggaatgaggattttttttagctacacgggtctgactagagctgtaaacgttactcagattgytcactatgtctcttcccacgagcccctccctgtcaccacccccctgctgtcaaaccatatcttcgtggaccagccatgcgggacatccctcttaatgggagcataagagtgttgtctcagacccttattttgttagtttatgtttccatgaagctcttaatgtttattaaataaacagacaatgagtttgtgtgacatgcccacagcttctgtgtatgtgacacatgcctagcctgtgttctgggagtgtatgtcactttggcctttggctggggaactggtgatggtgggaggccactc

SEQ ID NO: 104854 - DNA, 601 bp, Human; identical to SEQ ID NO: 29450

SEQ ID NO: 104855 - DNA, 601 bp, Human; identical to SEQ ID NO: 29451

SEQ ID NO: 104856 - DNA, 601 bp, Human; identical to SEQ ID NO: 29452

SEQ ID NO: 104857 - DNA, 601 bp, Human; identical to SEQ ID NO: 104810

SEQ ID NO: 104858 - DNA, 601 bp, Human; identical to SEQ ID NO: 104811

SEQ ID NO: 104859 - DNA, 601 bp, Human; identical to SEQ ID NO: 104812

SEQ ID NO: 104860 - DNA, 601 bp, Human; identical to SEQ ID NO: 104813

SEQ ID NO: 104861 - DNA, 601 bp, Human; identical to SEQ ID NO: 104814

SEQ ID NO: 104862 - DNA, 601 bp, Human; identical to SEQ ID NO: 104815

SEQ ID NO: 104863 - DNA, 601 bp, Human; identical to SEQ ID NO: 104816

SEQ ID NO: 104864 - DNA, 601 bp, Human; identical to SEQ ID NO: 104817

SEQ ID NO: 104865 - DNA, 601 bp, Human; identical to SEQ ID NO: 104818

SEQ ID NO: 104866 - DNA, 601 bp, Human; identical to SEQ ID NO: 104819

SEQ ID NO: 104867 - DNA, 601 bp, Human; identical to SEQ ID NO: 104820

SEQ ID NO: 104868 - DNA, 601 bp, Human; identical to SEQ ID NO: 104821

SEQ ID NO: 104869 - DNA, 601 bp, Human; identical to SEQ ID NO: 104822

SEQ ID NO: 104870 - DNA, 601 bp, Human; identical to SEQ ID NO: 104823

SEQ ID NO: 104871 - DNA, 601 bp, Human; identical to SEQ ID NO: 104824

SEQ ID NO: 104872 - DNA, 601 bp, Human; identical to SEQ ID NO: 104825

SEQ ID NO: 104873 - DNA, 601 bp, Human; identical to SEQ ID NO: 104826

SEQ ID NO: 104874 - DNA, 601 bp, Human; identical to SEQ ID NO: 104827

SEQ ID NO: 104875 - DNA, 601 bp, Human; identical to SEQ ID NO: 104828

SEQ ID NO: 104876 - DNA, 601 bp, Human; identical to SEQ ID NO: 104829

SEQ ID NO: 104877 - DNA, 601 bp, Human; identical to SEQ ID NO: 104830

SEQ ID NO: 104878 - DNA, 601 bp, Human; identical to SEQ ID NO: 104831

SEQ ID NO: 104879 - DNA, 601 bp, Human; identical to SEQ ID NO: 104832

SEQ ID NO: 104880 - DNA, 601 bp, Human; identical to SEQ ID NO: 104833

SEQ ID NO: 104881 - DNA, 601 bp, Human; identical to SEQ ID NO: 104834

SEQ ID NO: 104882 - DNA, 601 bp, Human; identical to SEQ ID NO: 104835

SEQ ID NO: 104883 - DNA, 601 bp, Human; identical to SEQ ID NO: 104836

SEQ ID NO: 104884 - DNA, 601 bp, Human; identical to SEQ ID NO: 104837

SEQ ID NO: 104885 - DNA, 601 bp, Human; identical to SEQ ID NO: 104838

SEQ ID NO: 104886 - DNA, 601 bp, Human; identical to SEQ ID NO: 104839

SEQ ID NO: 104887 - DNA, 601 bp, Human; identical to SEQ ID NO: 104840

SEQ ID NO: 104888 - DNA, 601 bp, Human; identical to SEQ ID NO: 104841

SEQ ID NO: 104889 - DNA, 601 bp, Human; identical to SEQ ID NO: 104842

SEQ ID NO: 104890 - DNA, 601 bp, Human; identical to SEQ ID NO: 104843

SEQ ID NO: 104891 - DNA, 601 bp, Human; identical to SEQ ID NO: 104844

SEQ ID NO: 104892 - DNA, 601 bp, Human; identical to SEQ ID NO: 104845

SEQ ID NO: 104893 - DNA, 601 bp, Human; identical to SEQ ID NO: 104846

SEQ ID NO: 104894 - DNA, 601 bp, Human; identical to SEQ ID NO: 104847

SEQ ID NO: 104895 - DNA, 601 bp, Human; identical to SEQ ID NO: 104848

SEQ ID NO: 104896 - DNA, 601 bp, Human; identical to SEQ ID NO: 104849

SEQ ID NO: 104897 - DNA, 601 bp, Human; identical to SEQ ID NO: 104850

SEQ ID NO: 104898 - DNA, 601 bp, Human; identical to SEQ ID NO: 104851

SEQ ID NO: 104899 - DNA, 601 bp, Human; identical to SEQ ID NO: 104852

SEQ ID NO: 104900 - DNA, 601 bp, Human; identical to SEQ ID NO: 104853

SEQ ID NO: 104901 - DNA, 601 bp, Human; identical to SEQ ID NO: 29450

SEQ ID NO: 104902 - DNA, 601 bp, Human; identical to SEQ ID NO: 29451

SEQ ID NO: 104903 - DNA, 601 bp, Human; identical to SEQ ID NO: 29452

SEQ ID NO: 104904 - DNA, 601 bp, Human
tgtgtctgagggtggtgacagctgttttctgcctcaggagaaactgaagccagaatacttggaggaacttcctacaatgatgcagcacttctcacagttcctggggaagaggccatggtttgttggagacaaggtaatgggggcatgtgatgaggacactagagatttgccatacatcctatgttacagagattccagcccacacattcttggccttctgcagatcacctttgtagatttcctcgcctatgatgtccttgacctccaccgtatatttgagcccaactgcttggacgccttyccaaatctgaaggacttcatctcccgctttgaggtgatgcccccatcctcctttctctttgatgccccttgttccgttacctcctttcagatgctttcccagtcctggatctgcataaagaataacttgcatttattgagtgctggcttcatgccaggaaccttgcccagcacattatacctatcgtgtggaatttgaaatttccaacattcctacagggtgacagaattatcttgcccatttagagataagaaaactttgaatgagagggtcagtcctttgttctgggtcccagagcca

SEQ ID NO: 104905 - DNA, 601 bp, Human
ggccatggtttgttggagacaaggtaatgggggcatgtgatgaggacactagagatttgccatacatcctatgttacagagattccagcccacacattcttggccttctgcagatcacctttgtagatttcctcgcctatgatgtccttgacctccaccgtatatttgagcccaactgcttggacgccttcccaaatctgaaggacttcatctcccgctttgaggtgatgcccccatcctcctttctctttgatgccccttgttccgttacctcctttcagatgctttcccagtcctggakctgcataaagaataacttgcatttattgagtgctggcttcatgccaggaaccttgcccagcacattatacctatcgtgtggaatttgaaatttccaacattcctacagggtgacagaattatcttgcccatttagagataagaaaactttgaatgagagggtcagtcctttgttctgggtcccagagccagtggaggctgtgctgggctccctgtgagcatctggatctatgggtggcagtcagggctctcccttttgtgacaaaagaaagaagcctcaggcctcatccagcctggattt

SEQ ID NO: 104906 - DNA, 601 bp, Human
catggtttgttggagacaaggtaatgggggcatgtgatgaggacactagagatttgccatacatcctatgttacagagattccagcccacacattcttggccttctgcagatcacctttgtagatttcctcgcctatgatgtccttgacctccaccgtatatttgagcccaactgcttggacgccttcccaaatctgaaggacttcatctcccgctttgaggtgatgcccccatcctcctttctctttgatgccccttgttccgttacctcctttcagatgctttcccagtcctggatctrcataaagaataacttgcatttattgagtgctggcttcatgccaggaaccttgcccagcacattatacctatcgtgtggaatttgaaatttccaacattcctacagggtgacagaattatcttgcccatttagagataagaaaactttgaatgagagggtcagtcctttgttctgggtcccagagccagtggaggctgtgctgggctccctgtgagcatctggatctatgggtggcagtcagggctctcccttttgtgacaaaagaaagaagcctcaggcctcatccagcctggatttcac

SEQ ID NO: 104907 - DNA, 601 bp, Human
ctggctgcccagactgtgtctgtcactgcctcttctgagggactggctggtgaccctggcagtagctgggttcatagagattatgatgggcttagtaaggtgtttccaactttgttttttttttgaaataaggtctcctgcttcccaaggtgaagggcagtggcggcatcgtagcttactgcaacatccagtcctgggctcaagaatcctcccacttcagcctcccaaatagctgagactataggtgtgccaccacacctggccacattaaaaaaatttttgtagagatgtgtctctttaygttgcccaggctggtctggaactcctgagctcaagcgatcctcttaccttggcatcccaaattgctgggattgcaggtgtgagccaccatgcctggccctgtttccaacttcttgatctcttttctgactgccttagagcaggaagccacataaagtgctctatagaaaggatgcctctttctgggcctagatcttcatttatttttatgtattcagtattattcagtgctttccatggttaggcagagctaggtctcagtgagtacgtcttagatgcccagaggtggtggaattcccat

SEQ ID NO: 104908 - DNA, 601 bp, Human
ggattgcaggtgtgagccaccatgcctggccctgtttccaacttcttgatctcttttctgactgccttagagcaggaagccacataaagtgctctatagaaaggatgcctctttctgggcctagatcttcatttatttttatgtattcagtattattcagtgctttccatggttaggcagagctaggtctcagtgagtacgtcttagatgcccagaggtggtggaattcccatcacagagaaccaggatccttctgtcttccacactgactgactccatcacagcttagatctctaggacscaagctctactgtgagctgcttcaccagaaggttctcccactcagcagttcccaagctgtgttatcacaaatagttgttgattttgtgggttaggaattcaggtgatgcccagcagggagaacttattacaaatcaacaaaggtcttttctccaaaaactatatatccagaaatacggcccattaaaaaatgagtcaaaacttgaacaggcatttccgaaaaatgaatatccaaattgccaacaagctcatgagaaggtgctcaacattattagaaagcagaaagttaaaaacccataag

SEQ ID NO: 104909 - DNA, 601 bp, Human
agggcaaaatcatttgttgtggggcactgtcctgagcattgcagggtgttcagcatcctacgcaaactctacccactagatgccatgggcgcttcccagtggtgacaattaacaaagtctccagacagacctacatgtcccctgaggggcaaagttacctccacttgaagaccagtggtgtgctggatggatactaatattaaaataataataataataataatagaaatcataatataactcatgtagttaaggtaagtcctttttgatggaacatttatttcagttaataatatttgtrtatgtctgtcctggtagttttttttttttaactttttattttgatttaacatgagagtttgagaaatttacaaaacgaatgaatacaaagacctctgattaccccagattctaacgtttccacatgggctttctcctccctccccaagtccaccagcccctgctccccacctttctgtctctcttcccacccagcaagctccctaggagcacagcaccacttatgacaaaaacatcattttcttttctctgaggcggtattcctgacgtttggatttaggctgataagtgacagtgagtt

SEQ ID NO: 104910 - DNA, 601 bp, Human
ttattactttattcagaatctctctgttttagagagagcctttctttcttgcctaacctagagtgcagcggcgcgatcatagctcagttcagtcttgaacccctggactcaaccagttctcccccgccctgggcttctgggcgtcctgatctctctcctgaaacccacggggctgggaggtgggaggagatcctactcctagccccatgagcgcgctccaggcctccagattggcccgtttcgggggcagggcgggccgtggggcggggtcgcagcaaggcttcccctctaccctctctgkgcctctcacaaacgctgagccccgccccgctgaggcctgtctgcagaatccacagcaaccagcaccatgcccatgacactggggtactggaacatccgcggggtgagcgagggtccgctgggcggtgggacgggggtgcgtgggggcggggaagtgtggagcagctgcaggacgggctctagggacggttcctcttcagggctgtccctgacagcggggtctgtgcttgccgctgtctgtgcgtgtggctgggcgtgcggggtgggggcgggtgaggcaggaacgagaggaggagatggg

SEQ ID NO: 104911 - DNA, 601 bp, Human
caaccagttctcccccgccctgggcttctgggcgtcctgatctctctcctgaaacccacggggctgggaggtgggaggagatcctactcctagccccatgagcgcgctccaggcctccagattggcccgtttcgggggcagggcgggccgtggggcggggtcgcagcaaggcttcccctctaccctctctgtgcctctcacaaacgctgagccccgccccgctgaggcctgtctgcagaatccacagcaaccagcaccatgcccatgacactggggtactggaacatccgcggggtgagcsagggtccgctgggcggtgggacgggggtgcgtgggggcggggaagtgtggagcagctgcaggacgggctctagggacggttcctcttcagggctgtccctgacagcggggtctgtgcttgccgctgtctgtgcgtgtggctgggcgtgcggggtgggggcgggtgaggcaggaacgagaggaggagatggggctccccttgtgcagagtcgtcacaaagtcagggaccctccatctctgacccgagctgtgggccatctctcccagctggcccattccatccgcctgctcctggaataca

SEQ ID NO: 104912 - DNA, 601 bp, Human
tcccagtctcccctttccctgcagagtttgtgtccaaaattgattccttctggtgagttcttggtcttgctgactctaagaatgaagccgcggtcctacacggtgagtgttacagttcttaaagatggtgtgtccggagtttgttccttcagatgttcagatgtgtccgcagtttcttccttccggtgggtttgtggtcttgctgacttcaggggtgaagccgcagaccttcgcagtgagtgctacagctcttaaaggtggcgcgtctggagttgtttattcctcttggtgggttcatggyctggctggcttcaggagtgaagctgcagaccttcatagtgaatgttatagctcataaaggtagttcaaacccaaagagtgagcaacagcaggatttatggtgacgagtgaaagaaaatacacttccacagcctggaagacaacctgagcaggttgctactgctgcttgggaagggcggaggtggggggggaaatcccttatttggccccacccacatgcagattggtccattttacagagagctgattggtccattttacagagtgctgattggtccgttttacagagtgctgattggtc

SEQ ID NO: 104913 - DNA, 601 bp, Human
tgtgcggtggctcacgcctgtaatctcagcgctttggaggctgagggaggcagatcacctgtggttaggagtttgatacctgcctgcccaacatggcaaaaccccatctttactaaaaaaaaatacaaaaattagctgggcgtggtggcgagcacctgtaatcccagctacttgggaggctgaggcaggagaatcacttgaacctgggaggtggaagttgcagtgagccaagatcgtgccactgcattccagcctgtatgacagagtgtgactccatctcaagaaaaaaaaaaaaaaaaamaaaggagccgggcatggtggctcacacttgtaatcccagcattttgggaggccgagttgggtggatcacctgaggtcgggagttcgagaccagcctgaccaacatggtgagacccctgtctctactaaaaatacaaaattagctgggcgtggtggcacatgcctataatcccagctactagggaggctgaggcaggagaatctcttgaacctgggaggcggaggttgcggtgagccaagatcgtgccattgcaccccagcctgggcaacaagagtgaaactccatctcaaaaaaaaaaaa

SEQ ID NO: 104914 - DNA, 601 bp, Human
aaaaaaaaaaaaggagccgggcatggtggctcacacttgtaatcccagcattttgggaggccgagttgggtggatcacctgaggtcgggagttcgagaccagcctgaccaacatggtgagacccctgtctctactaaaaatacaaaattagctgggcgtggtggcacatgcctataatcccagctactagggaggctgaggcaggagaatctcttgaacctgggaggcggaggttgcggtgagccaagatcgtgccattgcaccccagcctgggcaacaagagtgaaactccatctcaaamaaaaaaaagaagaaaagaataacttgcatttattgagtgctggcttcatgccacgaactgtacccagcacattatacctattgtgttgaatttgaaatttacaacattcctacagggtggtagaattatctcccccattttagagacaaagaaactgagaatgagagggtcagtcctttgctcagggtcccagagccagtggaggctgtgctgggctccctgcgagcctctggatctatggttggcagtcagggctctcccatttgtgacagaagaaaagcctcaggccttgtccagcct

SEQ ID NO: 104915 - DNA, 601 bp, Human
accccagcctgggcaacaagagtgaaactccatctcaaaaaaaaaaaagaagaaaagaataacttgcatttattgagtgctggcttcatgccacgaactgtacccagcacattatacctattgtgttgaatttgaaatttacaacattcctacagggtggtagaattatctcccccattttagagacaaagaaactgagaatgagagggtcagtcctttgctcagggtcccagagccagtggaggctgtgctgggctccctgcgagcctctggatctatggttggcagtcagggctctccsatttgtgacagaagaaaagcctcaggccttgtccagcctgggtttcatagcccaggacactttggaagaggcagagcacttcaggaccacggatgcagctggcaatagtaggactgacacacagtagcattgatgttcaatactgaacccacaggcagtattcacagctacacccagaaactttgtatgattgaacccccatgtggggaatcctgagagccagggctgtggctggagctggattaaggtacatatgtgggtgcccctgttgaaggagcttatgctgaaatgccctgtgct

SEQ ID NO: 104916 - DNA, 601 bp, Human
ccccagcctgggcaacaagagtgaaactccatctcaaaaaaaaaaaagaagaaaagaataacttgcatttattgagtgctggcttcatgccacgaactgtacccagcacattatacctattgtgttgaatttgaaatttacaacattcctacagggtggtagaattatctcccccattttagagacaaagaaactgagaatgagagggtcagtcctttgctcagggtcccagagccagtggaggctgtgctgggctccctgcgagcctctggatctatggttggcagtcagggctctcccwtttgtgacagaagaaaagcctcaggccttgtccagcctgggtttcatagcccaggacactttggaagaggcagagcacttcaggaccacggatgcagctggcaatagtaggactgacacacagtagcattgatgttcaatactgaacccacaggcagtattcacagctacacccagaaactttgtatgattgaacccccatgtggggaatcctgagagccagggctgtggctggagctggattaaggtacatatgtgggtgcccctgttgaaggagcttatgctgaaatgccctgtgctg

SEQ ID NO: 104917 - DNA, 601 bp, Human
ggcaacaagagtgaaactccatctcaaaaaaaaaaaagaagaaaagaataacttgcatttattgagtgctggcttcatgccacgaactgtacccagcacattatacctattgtgttgaatttgaaatttacaacattcctacagggtggtagaattatctcccccattttagagacaaagaaactgagaatgagagggtcagtcctttgctcagggtcccagagccagtggaggctgtgctgggctccctgcgagcctctggatctatggttggcagtcagggctctcccatttgtgacaraagaaaagcctcaggccttgtccagcctgggtttcatagcccaggacactttggaagaggcagagcacttcaggaccacggatgcagctggcaatagtaggactgacacacagtagcattgatgttcaatactgaacccacaggcagtattcacagctacacccagaaactttgtatgattgaacccccatgtggggaatcctgagagccagggctgtggctggagctggattaaggtacatatgtgggtgcccctgttgaaggagcttatgctgaaatgccctgtgctggagcactttc

SEQ ID NO: 104918 - DNA, 601 bp, Human; identical to SEQ ID NO: 104904

SEQ ID NO: 104919 - DNA, 601 bp, Human; identical to SEQ ID NO: 104905

SEQ ID NO: 104920 - DNA, 601 bp, Human; identical to SEQ ID NO: 104906

SEQ ID NO: 104921 - DNA, 601 bp, Human
ctgagctgttctgaaagaattcaaacttggcaactggcatcacttccttccaccagtctatagggatccctgggaaaggtgaatacacatccaacatcaggaagggaccttcatccagaggccccagagcaccccagggagctcctggaagcaagatgtcagagccagtgaggacacaggacctgacgaccaggactctccgacatctcacatacaaccaacaccggggagacagcacttggtgcaggaaggaggtttattgaccatttaatgcagggaacccagttacatttttggagaytctgaaacactggaatagaactaaaagtaccaagaagagacaccaggaaaaataattgctttcatggaagataattacaacattttagcaacaacaaaaaatacagcttagaggcataggcagggagccactccttggaagtatctgctaccggttgatttagggaaaatgcctcagtgagtctagtcttgaaggaagactgggcaaggtgagggcactcctgaccccagtgcaaccagcctcaatctcctaactcgggccttcagaatcatctccccatgctggctccatggccagagg

SEQ ID NO: 104922 - DNA, 601 bp, Human
ttatcaatgttcacaaccatcctggcattctctgccttggtacacagaatctgtaggccaaggcacatggagagggttagttcaggatgagacgaagcaagaagaacccaaatgaagagaagacagcagcaaaggtaggatccagcagccctgcagccatccctgcagaaggtcctcttccctggaactctgggagatatttagcgaattgctagtccttggagaacttgagatgtattttttaagaacctgaagcttcgtaaattcaaattccccattttggatgtgccaagcaatgtgraagggaagaatctcatgtctgaagtcactcatgtgacagttagaagggtctttgacatttactgaaaacttaccgtggaccaggggctgttccaagcacttgacctgcatcatctcatcaaatccttttgacaaccccattagataacgaccattattatccctgttttacagatgagaaaactgaggcctggggaagggatgggacccccaaagtcatgcaatgaggcaatggtagaactgagactagatcccagatctctccacatgaaagcctcaggctgagtgctcaaattataaa

SEQ ID NO: 104923 - DNA, 601 bp, Human
tcactttggcagaagccaagagcagcaccctggtttgtttgatgcatttgggctaaaatgggaaaccggtacccctagtattcccagtctccctccccacctgtgttcatcctgggaggagggtagcagaagcctggcttgactagttaaacgcccgagttagggcagctgcctcccaggcttggctgccaaagagggaaagttgtcactgagtctgccaggatgtgtgataacttctcattagtggcttcttggtgccgttcccagttctctgatttgagcaagatgagtcaggagcccragggtgctcggtgagtacgtggtgactgattgttactttacacttaagcctgaggaaacccagccaagattcagaggcacttgttcattcaaatcccaagtcaagaggttgagagtcaaccagggaggggggaaaaacaccatggctcaggtgggcttggcagcacacaggtgcccaaagcagagggcttcccctccaagaaacttcaggagataaggaaaaatcagaaagtaaagggcttcagcttgagcattttatatgcaaacagaagggaggacaaaataaggataggggcaaaaa

SEQ ID NO: 104924 - DNA, 601 bp, Human
gacatgaaaagatgcaacaaaagttgctaaagattgaaacattagatggcccctaaggactgcagtccactcagcagcatcccagtgctcttcaaactccagctgaatacccctgcgatgggaacctcactgcaacacaacacttcctatcactttggcagaagccaagagcagcaccctggtttgtttgatgcatttgggctaaaatgggaaaccggtacccctagtattcccagtctccctccccacctgtgttcatcctgggaggagggtagcagaagcctggcttgactagttaaasgcccgagttagggcagctgcctcccaggcttggctgccaaagagggaaagttgtcactgagtctgccaggatgtgtgataacttctcattagtggcttcttggtgccgttcccagttctctgatttgagcaagatgagtcaggagcccgagggtgctcggtgagtacgtggtgactgattgttactttacacttaagcctgaggaaacccagccaagattcagaggcacttgttcattcaaatcccaagtcaagaggttgagagtcaaccagggaggggggaaaaacaccatggctcagg

SEQ ID NO: 104925 - DNA, 601 bp, Human
cagggagacatgaaaagatgcaacaaaagttgctaaagattgaaacattagatggcccctaaggactgcagtccactcagcagcatcccagtgctcttcaaactccagctgaatacccctgcgatgggaacctcactgcaacacaacacttcctatcactttggcagaagccaagagcagcaccctggtttgtttgatgcatttgggctaaaatgggaaaccggtacccctagtattcccagtctccctccccacctgtgttcatcctgggaggagggtagcagaagcctggcttgactasttaaacgcccgagttagggcagctgcctcccaggcttggctgccaaagagggaaagttgtcactgagtctgccaggatgtgtgataacttctcattagtggcttcttggtgccgttcccagttctctgatttgagcaagatgagtcaggagcccgagggtgctcggtgagtacgtggtgactgattgttactttacacttaagcctgaggaaacccagccaagattcagaggcacttgttcattcaaatcccaagtcaagaggttgagagtcaaccagggaggggggaaaaacaccatgg

SEQ ID NO: 104926 - DNA, 601 bp, Human
tcctggctcacctccccagggagacatgaaaagatgcaacaaaagttgctaaagattgaaacattagatggcccctaaggactgcagtccactcagcagcatcccagtgctcttcaaactccagctgaatacccctgcgatgggaacctcactgcaacacaacacttcctatcactttggcagaagccaagagcagcaccctggtttgtttgatgcatttgggctaaaatgggaaaccggtacccctagtattcccagtctccctccccacctgtgttcatcctgggaggagggtagcagragcctggcttgactagttaaacgcccgagttagggcagctgcctcccaggcttggctgccaaagagggaaagttgtcactgagtctgccaggatgtgtgataacttctcattagtggcttcttggtgccgttcccagttctctgatttgagcaagatgagtcaggagcccgagggtgctcggtgagtacgtggtgactgattgttactttacacttaagcctgaggaaacccagccaagattcagaggcacttgttcattcaaatcccaagtcaagaggttgagagtcaaccagggaggg

SEQ ID NO: 104927 - DNA, 601 bp, Human
atggcttttaaacctgtcatgtttccagataactcagtaggttaggattatagagatcgagtcatgaataacataactgtctggaaagcagtaaaaaaactgacctgagtaataacaatcataaaaatgaataatgagagaaaatgcatttggggagttgtggcatgagaaagcccatcagaggtagagactcttggtagtcaaacagtaggcttttcccctgcaagaagtttgtgaattccgtccacacctagtcccccacaacactgtgtttcttggccttggaggctctgcccttcawggaggacccctcctcagcttccaagggctcaccttgtcccggagctcttcaatggtcttgtagtaggggctgtagtcccgctcagggctagctgggctctgcttcaggtgccagtcacggatcttcacctccaggtcagcgttggcctcctccagggcgcgcaccttctccaggtaggaagccaggcggtcgttgaggttctgcatggtgatcttctcattgccagtgaggaggccgccatcacaagcaccaaagtcaacaaagccaccagcaaaacccccaccaaagccacctccaagg

SEQ ID NO: 104928 - DNA, 601 bp, Human
tctgccatggcctcgtactgctccctcatctctgccagcacgcgggtcaggtcaatgcctggggtggcatccatctccacgttgacctggccgaccacctggttgctaaattccttcatctcctgtggggatgggaaaggaagatgtgtgaggctactcatcctccctctccttggctctgagtgctggcagagtgttctggagagtgtttccaggtcccacagtggaggactgtgtccagttgcaggggagggctcctccttctcactggaggttgttgagcccagggcagcctgcaatycccgctcacctcttcatggttcttcttcatgtaggctagctcttcattcaggctctcgatctgcatctccaggtcagtcttagacagagtgagctcatccagcacccggcgcaggccgttgatgtcggcctccacgctctggcgcagggccagctcattctcatacctaaaatagtaaaaaaatgaaatgttttttgaaaaagcaagacataaatgatatgagacattctccctacccctgcacgagactccagtacttccagaccttcactcctgggatgctccagtgtcattggtcag

SEQ ID NO: 104929 - DNA, 601 bp, Human
caggccagagggaaacctagaggtggtcgccaccgggcaggaggctgcaggcataccatgctcagctgggactgcagctcaatctccaggccttggagcgtgcgcctgagctccgtgatctctgtcttgctggtctgaatcatggcagtgttggtagacacctccttgttcagctctgcactctgaaatgcaagcaggaagaaggtggtggggaagctcagctcgagcagcctgaccaagaggctgtgtccgcccggcccccctggctatatgggatgggctatgtggggtgggagggccrggtaccttggcgtggaaccattcctcagcatcccggcggttcctctctgccatggcctcgtactgctccctcatctctgccagcacgcgggtcaggtcaatgcctggggtggcatccatctccacgttgacctggccgaccacctggttgctaaattccttcatctcctgtggggatgggaaaggaagatgtgtgaggctactcatcctccctctccttggctctgagtgctggcagagtgttctggagagtgtttccaggtcccacagtggaggactgtgtccagttgcaggggagggc

SEQ ID NO: 104930 - DNA, 601 bp, Human
gagggaggcgccgcaggtagtatcgacgaggctctgggagctggagggcagggcctctggactccgtgcgctcacctgctcggcaggtggggccagagtcgctgggaaaatgtgcgctcggcccccacagttgggcaagctgggcgcaaacaatagggccccacccaggcctgggggagtagggagggagggaaagcgaggatgacgcgtggggtggggtgagggtggccccaaagagaccagcggcagcaagtttcccaaacggtaaattcctgactgcagcgtgagccctgggacgcartcgaagcagagcaaagtctcccccgccagcccagggcgagagtcagggacgcggcgtcgggcgagctgcgcgggccccgggggaggcgcgaccccggaggcacctgtccggatccctccccgccttgctcagatctctggttcgcggagctccgaggcgcgctcggcccgaaccgcgcgacccccaagtcgccgcgcccaggaccccagcgcgccccctgccgccggtgcagggtggcgctcgatggcaccggccctcacctgcccagggacggctgggaccggccccgcggccgctcgc

SEQ ID NO: 104931 - DNA, 601 bp, Human
caggaaggaccccctaagcctaaaggaagttttgggcaaggagacgggaaaacccccagataaagctgctgtgaatacttcctcctgcaaagtttgttttgggtgattttttccaacaataagaggttagagaagacgggtcctgttcccctaccaacactctggcagccacagctactggaaactgggccaggtgaccctgaattcttcatccgtgcacagaccccaccccccagaccccagggcgagccacgggtgccagacaccagctggacactgagccgagccctgcaccccccactcactccatcccacctccgctgaagaagccagagccgggctcccaccggcgtggagggaggcgccgcaggtagtatcgacgaggctctgggagctggagggcagggcctctggactccgtgcgctcacctgctcggcaggtggggccagagtcgctgggaaaatgtgcgctcggcccccacagttgggcaagctgggcgcaaacaatagggccccacccaggcctgggggagtagggagggagggaaagcgaggatgacgcgtggggtggggtgagggtggccccaaagagaccagcggc

SEQ ID NO: 104932 - DNA, 601 bp, Human
gccctgtgctcagaactgccccactgtcccatctctccaaataaacagtccttctgtagactagtcaattgacccatctcactctaaggtggctccaggatgggaaaaaggttggcagccctagcccgacctttttcgttcctatgcactgcattctcaaagcctcggccctggcagcccaaacagaggctccagagggaatggggtggagccagggtgcaagggaggggtggagtgggggtgggagggctcaagtcacccaagctggggcttgatctagcaagaaatgactaactgggtyctaccttctcctcctcccccgcatcccccagtccagtcagtggccagttttcaccaagcacctcctagcagtacttcctcagtattatcttttcatcacagccacaaaccagattagctaaactaatcatgtagccaacataattacaatgccctcccctcctccaccttggcacagagaagagggaaagcaggttatttttgcccaaactccctgctcctgttgctccccagaggtgcagaatcccatcccccggcagaaaaggatctgagttcccacactgacttccccctagcacag

SEQ ID NO: 104933 - DNA, 601 bp, Human
ggccaggacaggtatcacccccacctacaaaacctgccctacattcaccactcacacatgccttcatgggcccttctgaattctcttctccccagtcaggcagaggctctcaaaagggggtgcagaaaaatcctttccgctcacacctgtaatcccagcactttgggaggctgaggcgggcggatctcctgaaggtcaggagttcgagaccatcctgaccaacatggtgaaaccccatctctactaaaaatacaaaaattagcctagtgtggtggtgcatgcctgtaatcccagctactcrggaggctgagacaggagaatcgcttgaacccaggaggtagacgttacagtgagccgagatcgcgccactgcactccagcctgggtggcagagcgtgactccatctcaaaaaaaaaaaaaaaatcctttccagagctgcatggggcaatacagcaggatgggttctgggcttggaatcagaggacccaaacgtcagtcttggtgctgcttgggtctcgctgtacaacattggggaaattacttaagttccttgagtttcaatttcctcctctgtagaatgcgaataatgatacgcgttttt

SEQ ID NO: 104934 - DNA, 601 bp, Human
aactgcaacctcatgccctctttgtagtagtcagtgggatggggttcattctgttttcttctctgtctcaagtcccattagccttctccacgatcaataatcccgttgcctggggtccccgcctgccctcagggaatccagaagcgcggtagtgacaggttcagtactccggctgcaccatcacataaagagaacccatttcccagaccccaaatccaggcccattctggtgtcagatgtccagttggcagagacaccagaaccaggcaggtctggagaacaatctgacaccagctcctcyctagagggccaaggctctggctgacaggcagcacacatgacccccacctccatcaccagaaaagccctcccagcagctgcctatctcaggtctcttgggcttcagagcagaggacagccagttccccatcaagagcagcctggcagcactgcctcgtcaactccagcaggacattagcccaggcctaaatcggactctcgtttctcgccaatccccacagggcagcacccctttatcttggcatagccccagcccccagcaaagcaggcaactcccacttcctacacatgaacaagccca

SEQ ID NO: 104935 - DNA, 601 bp, Human
gcctgggcgacagagtgagtgagactccgtctcaaaaaaaaaaaaaaaaaaaaattagctgggcgtactggcaggcgcttgtagtcccagctacgcgggaggctgagacaggagaatcacctgaacccgggagatggaggttgcagtgagccaagattgtgccactacactccagtctgggtgacagagtgagagactccatctcaaaaaaaaaaaaagaaagaaagaaagagaaaaagaaagctgagcttcctgctctgctggccccaaaggccaagatgccaggaggctgagcaaaggrgagtggtccatgagcttgcccttcaggcctggcagaggaagtcgcttcacaataagatattccatgtccccagactcaaccatgtcccaggagaggccgctcagtgtcacttgcaggaacacaagccctggtgacctgcccagccacactgcttgcttttcctcttcacaggggtcacaggaccagctcacagatgcctttccctctcactgccaggtcgctcttctcccaaaagatacaaatgaggagtctccccaaagggcagcaattcctgtctggcctccctgccgcacaggatgg

SEQ ID NO: 104936 - DNA, 601 bp, Human
cacctgaggtcaggagttcaagaccagcctgaccaatatggtgaaaccccgtctctactaaaaatacaaaaattaggccgggcacagtggctcacgcctgtaatcccagcactttgggaggccgaggcgggtggatcatgaggtcaggagatcgagaccatcctggcaaacacagtgaaaccccgtctctactaaaaacacaaaaaaattagccaggcgtggtggcgggcgcctgtagtcccagctactcgggaggctaaggcaggagaatggtgtgaacccagggggcggagcttgcagygagcggagatcgtgccactgcactccagcctgggcgacagagtgagtgagactccgtctcaaaaaaaaaaaaaaaaaaaaattagctgggcgtactggcaggcgcttgtagtcccagctacgcgggaggctgagacaggagaatcacctgaacccgggagatggaggttgcagtgagccaagattgtgccactacactccagtctgggtgacagagtgagagactccatctcaaaaaaaaaaaaagaaagaaagaaagagaaaaagaaagctgagcttcctgctctgctggccccaaagg

SEQ ID NO: 104937 - DNA, 601 bp, Human
agatcgagaccatactggctaatacggtgaaaccccatctctactaaaaatataaaaaattagccgggcgtgttagcgggtgcctgtagtcccagctactcgggaggctgaggcaggagaatggcatgaacccaggaggcggagcttgcagtgagccgagatcctgccactgcactccagcctgggtgacagagcgagactccgtctcaaaaaaaaagaaaaaaaggatgctaagaaaagaggaagagacttggctgggcgtggtggctcatgcctgtaatcccaggactttgggaggccraggcgggtggatcacaaggtctggagtttgaaaccagcctggccaacatggtgaaaccccgtctctactaaaaatacaaaaaactagccaggcatggtggcaggtgcctgtaatcccagctactcaggaggctgaggcaggagaatcgcttgaaaccagaaggcagaggttgcagtgagctgagattgtgccactgtactccagcctgggcaacaagagcaaaactccgtctcaaaaaaaaaaaaagaggaagagaccttaatgaaagttgctttttaggattatgggcgattttttttc

SEQ ID NO: 104938 - DNA, 601 bp, Human
gcagtgagctgagatctgcactccagcctgggcaacacagtgagaccccatctcaaaaaaaaaaaaaatgttactatatacaggggatgagctcatcaagatcaaggctaaagaacaaaaggatgttgccgagcgcggtggctcatgcctgtaatcccagcactttgggaggccgaggcgggcggatcacgaggtcaggagatcgagaccatactggctaatacggtgaaaccccatctctactaaaaatataaaaaattagccgggcgtgttagcgggtgcctgtagtcccagctactcrggaggctgaggcaggagaatggcatgaacccaggaggcggagcttgcagtgagccgagatcctgccactgcactccagcctgggtgacagagcgagactccgtctcaaaaaaaaagaaaaaaaggatgctaagaaaagaggaagagacttggctgggcgtggtggctcatgcctgtaatcccaggactttgggaggccgaggcgggtggatcacaaggtctggagtttgaaaccagcctggccaacatggtgaaaccccgtctctactaaaaatacaaaaaactagccaggcatggtggc

SEQ ID NO: 104939 - DNA, 601 bp, Human
tgcctgtagtcccagctacttgggaggctgaggtaggaggatcgcttgagcccaggaagaggaggttgcagtgagctgagatctgcactccagcctgggcaacacagtgagaccccatctcaaaaaaaaaaaaaatgttactatatacaggggatgagctcatcaagatcaaggctaaagaacaaaaggatgttgccgagcgcggtggctcatgcctgtaatcccagcactttgggaggccgaggcgggcggatcacgaggtcaggagatcgagaccatactggctaatacggtgaaaccycatctctactaaaaatataaaaaattagccgggcgtgttagcgggtgcctgtagtcccagctactcgggaggctgaggcaggagaatggcatgaacccaggaggcggagcttgcagtgagccgagatcctgccactgcactccagcctgggtgacagagcgagactccgtctcaaaaaaaaagaaaaaaaggatgctaagaaaagaggaagagacttggctgggcgtggtggctcatgcctgtaatcccaggactttgggaggccgaggcgggtggatcacaaggtctggagtttgaaac

SEQ ID NO: 104940 - DNA, 601 bp, Human
gaatccccttgagctcaggagctccagaccagtctgggcaacatggcgaaaccctgtctctacaaaaaaatgcaaaaattagccgggcgtggtggcatgtgcctgtagtcccagctacttgggaggctgaggtaggaggatcgcttgagcccaggaagaggaggttgcagtgagctgagatctgcactccagcctgggcaacacagtgagaccccatctcaaaaaaaaaaaaaatgttactatatacaggggatgagctcatcaagatcaaggctaaagaacaaaaggatgttgccgagcrcggtggctcatgcctgtaatcccagcactttgggaggccgaggcgggcggatcacgaggtcaggagatcgagaccatactggctaatacggtgaaaccccatctctactaaaaatataaaaaattagccgggcgtgttagcgggtgcctgtagtcccagctactcgggaggctgaggcaggagaatggcatgaacccaggaggcggagcttgcagtgagccgagatcctgccactgcactccagcctgggtgacagagcgagactccgtctcaaaaaaaaagaaaaaaaggatgctaaga

SEQ ID NO: 104941 - DNA, 601 bp, Human
ggaacctcctgcagactacaggttctctggcagacactgtggtctccatcagcaagctggtccattccaagagggcagaactgaagcaggagctgtcagacaagctggtcttaggcttccggaggaaaaccctcacttccagtctggagagcagcccaggctgtggcctgaggatgagctggggcctgggggaggctcaggcctgccgacccagctgctgtttattttcctccttctgggctccttcccaaagcaaacaaacccgggtaggaaaatgaaggggatttgtaggagagggaakttgccacggccaagtggctcgacccagggacctctatgctcccctggagagggctccagctggagctccgttccctgctggtgacccccgtgggcagattcccaaactggcagatgaccccaaaccgggactcctgggaatggaaaaacacttcaccccacaccaggaaacaacaacaaaaggttgacgtgtgttggtgacgcaaaatacacaagtactctcattccactgcctccaaccaccaccagtggggcttgggcagcctggggtccaggggcggcccacttctcaataacagca

SEQ ID NO: 104942 - DNA, 601 bp, Human
gggagtcccacaggtaggtgcccaagcagccacaccctggcaactgtcctgatgcccccagggagagggacgcagaggttccaccctctaattagtcgagaaggaggagacagctgcatggctttcccacctggatgctgtactttttgctaccaacacagtgcctggccctgccagccaaaaggccccctgctacccctaccagctgtcagggaggagactggcatgcgagggctgagctccatagagccccaccagccacagtctactcacactactcccagcacccacagcccacccsctggcatgttcagggccctggaggcacctgtggccaacagttctagggcctggctattcctctctcccagaggggcaggggaggcttgggctggcggggcatccccatcccggactaagccccagagctgagtcagtcactcatcccacagccttggcctatctgcaggtcagccgcagaggcctggtctccctccaaccccaacgaggggccctcaggcttgacacctacacccctctacccaaaggggaatccctgggggttcctgggggctacggccctggctctcccacaaacgtg

SEQ ID NO: 104943 - DNA, 601 bp, Human
gtcagggctgtgggttcagagagcaggagctgggtcctcagctgagacgtcaggttcctctctagcttccatcccctgggtgggtctgggagtcccacaggtaggtgcccaagcagccacaccctggcaactgtcctgatgcccccagggagagggacgcagaggttccaccctctaattagtcgagaaggaggagacagctgcatggctttcccacctggatgctgtactttttgctaccaacacagtgcctggccctgccagccaaaaggccccctgctacccctaccagctgtcaggraggagactggcatgcgagggctgagctccatagagccccaccagccacagtctactcacactactcccagcacccacagcccaccccctggcatgttcagggccctggaggcacctgtggccaacagttctagggcctggctattcctctctcccagaggggcaggggaggcttgggctggcggggcatccccatcccggactaagccccagagctgagtcagtcactcatcccacagccttggcctatctgcaggtcagccgcagaggcctggtctccctccaaccccaacgaggggcc

SEQ ID NO: 104944 - DNA, 601 bp, Human
gcctcccgcacccgtttggccctggctgttgtggacatctggtactccaggtcacctgggggccatggggacagggactgagtgcaggcagtgggctgggcagacactggggagcagggcaggccacagacagccccacctgggtcctctgggctacctcttgccctgcccaaacccccagcacatgactggccattctacctctcaccaggaaccttggggaagtcaccatcacctcagtaatctctgtaaaataggccccacatgttctgtccatcacgggaattttttttttttttttgcacacttattatgtgcctggcagtgaattcaatgccctgcttatattttctcacataacctgacaacgaccctgcaaggtaagtactatcactggctccactttacagatgggaaaactgggcacagaggggttataaggcagcctgactcaggggcccaaacccctactctattctcctcccttacccatcaggtctgttttcaaccctgaaatctcaggagtctaattacaccctcatcatccccaacggtagcaatcctcccactatacaggcaggcaaacagaggcccagagaac

SEQ ID NO: 104945 - DNA, 601 bp, Human
cctgacacaccagggcacatggcctcccgcacccgtttggccctggctgttgtggacatctggtactccaggtcacctgggggccatggggacagggactgagtgcaggcagtgggctgggcagacactggggagcagggcaggccacagacagccccacctgggtcctctgggctacctcttgccctgcccaaacccccagcacatgactggccattctacctctcaccaggaaccttggggaagtcaccatcacctcagtaatctctgtaaaataggccccacatgttctgtccatcamgggaattttttttttttttttgcacacttattatgtgcctggcagtgaattcaatgccctgcttatattttctcacataacctgacaacgaccctgcaaggtaagtactatcactggctccactttacagatgggaaaactgggcacagaggggttataaggcagcctgactcaggggcccaaacccctactctattctcctcccttacccatcaggtctgttttcaaccctgaaatctcaggagtctaattacaccctcatcatccccaacggtagcaatcctcccactatacaggcag

SEQ ID NO: 104946 - DNA, 601 bp, Human
aggaggaaaactccatctcaaaacaaaaaaaaaaatagctaggtatggtggcagatgcttgtaatcccagctactcaggagactgaggcaggagaatcattcgaacccaggaggtggaggctgcagtgagctgagatcacgccactgcactccagcttgggtgacagagcaaggcctcatctcaaaaaaaaaaaaagaaatgaggccaatccacattttgtagggggccaggaaacagaaagtttgcaagggactttgcatttgctgttccctctgcctgggacactcttcccttcctctrcactagccaaactccactcatctgtcaatcccctgccattaagcgattccacctttgagcaatctcaatgctcttctgccatagcctgtgtcgtatcctgatcattaacctgctgtttacatgcctgtgttccctgctgggctgtgagccaccgagcacccggatggggtgtgcttctgcctggcacatagtaggtgctcactggatatttatggaagctcagggaagggaggggagaggcccaagtgagagggggtcctgggctcatgcagtgagcagggttgggtacctgagcatgcg

SEQ ID NO: 104947 - DNA, 601 bp, Human
ctccttcccctcgcctaacagcagtaccttgaccagtggccactggttgggctggttgagcagcttcacgatggctgggatgccatagttgagacgcacagagttctgggccatctcggcctcagggtggcggctagtgaggtggcgcagagcgcagacggcaggctccgtgatgtcgtccttgtcaccagcacgcaggatggcatggatgagagcctccacaccgctgttctgtgtcaccagcgtcttgttcttgctgttgttgcatgtcaggttggagagtgtgcccgtggcacaggtraggacgttgacgtcatccacactcagctgattcaccagaatcttcagcacactctccaggccctcctggagggcaaggaagggacgggggagtcagggagcagccaactccagggagccttctcgaatatgtccaaggggagtgggatgacctaaaggggtcagccctgcctgtgtgtgcccgggaactttcatccctatgacccgccacaccctgtgagagggcgttactatcctgtggtgcaagtgaggcaatgaggctcagagaggttggggaacttgcccacagacacacagctag

SEQ ID NO: 104948 - DNA, 601 bp, Human
tgatccttccgcttccgcctctgcctgcacctcccaaagtgctggaactacagatgtgagccactgcacccagcctcctgtttttcttttcttttaagacacgggttcttgctctgtcacccaggctggagtgcactgatgcaatcatagctcactgtaacctccaactcctgtgctcaagcgatcctccaacctgagcctcccctccccagtagctgggactacaggcgtgcaccaccacacctggctaatttctgttgttgttattgttgtcgagacaggtcttgctatgttgtccagrctggtctcaaattcctggcctcaagcaatcctcctacctttgcctcccaaagtgttgggattacaggcatgagccaccgtgcctggccctggaacctgcaatttaatgaaaccacccagggtactcatgtgcattttgaactctgagctctgccctaggggctggtagagctacaagatagaaatcccaattctggaattttagagcagagccattgttgaggtctaaactattacacgagagagaaataaacttctgtcttattcgagccactgtatttagggcttctttgctacagcg

SEQ ID NO: 104949 - DNA, 601 bp, Human
tttttttttccaaattttttgtaagagatgggtgtctcactatgttacccatgatggtctcaaactcctggcctcaagtgatccttccgcttccgcctctgcctgcacctcccaaagtgctggaactacagatgtgagccactgcacccagcctcctgtttttcttttcttttaagacacgggttcttgctctgtcacccaggctggagtgcactgatgcaatcatagctcactgtaacctccaactcctgtgctcaagcgatcctccaacctgagcctcccctccccagtagctgggacyacaggcgtgcaccaccacacctggctaatttctgttgttgttattgttgtcgagacaggtcttgctatgttgtccagactggtctcaaattcctggcctcaagcaatcctcctacctttgcctcccaaagtgttgggattacaggcatgagccaccgtgcctggccctggaacctgcaatttaatgaaaccacccagggtactcatgtgcattttgaactctgagctctgccctaggggctggtagagctacaagatagaaatcccaattctggaattttagagcagagccattgttgag

SEQ ID NO: 104950 - DNA, 601 bp, Human
tgtgttttagattgtttatttgtttgggcttttttttttttccaaattttttgtaagagatgggtgtctcactatgttacccatgatggtctcaaactcctggcctcaagtgatccttccgcttccgcctctgcctgcacctcccaaagtgctggaactacagatgtgagccactgcacccagcctcctgtttttcttttcttttaagacacgggttcttgctctgtcacccaggctggagtgcactgatgcaatcatagctcactgtaacctccaactcctgtgctcaagcgatcctccracctgagcctcccctccccagtagctgggactacaggcgtgcaccaccacacctggctaatttctgttgttgttattgttgtcgagacaggtcttgctatgttgtccagactggtctcaaattcctggcctcaagcaatcctcctacctttgcctcccaaagtgttgggattacaggcatgagccaccgtgcctggccctggaacctgcaatttaatgaaaccacccagggtactcatgtgcattttgaactctgagctctgccctaggggctggtagagctacaagatagaaatcccaa

SEQ ID NO: 104951 - DNA, 601 bp, Human
caagatcagtctgagcaacatggcaaaatcccatctctactaaaaatacaaaaattatccagacatggtggcgtgcacctgtaatcccaactactcaggaggccaaggcaggagaatcacttgaacccgggaagcagaggttgcagtgagccaagaatgtaccactgcactccagcctgggcaatagacattgtctcaaaacaacaaaaaaaagacatacagaatggcaagccctctgcagcaggcctgcagagagacagagagagagagagagagagagagagagagagagagagagagwgagtgtgtgtgtgtgtgtgtgtgtgtgttttagattgtttatttgtttgggcttttttttttttccaaattttttgtaagagatgggtgtctcactatgttacccatgatggtctcaaactcctggcctcaagtgatccttccgcttccgcctctgcctgcacctcccaaagtgctggaactacagatgtgagccactgcacccagcctcctgtttttcttttcttttaagacacgggttcttgctctgtcacccaggctggagtgcactgatgcaatcatagctcactgtaacctccaa

SEQ ID NO: 104952 - DNA, 601 bp, Human
ggcagaggactcaagaatgggtacagggcactgccccaccctggaaaagaccgcccatagcctatccagcacctccacgcaaattacaaaaaggcacccccacctcaaacactgtatactcatttgggcaaaataaaaattggcattttgtggatatatgattcaacccactacttccatctgctaggaattgttataaatgatccaattacaaaataaaaatctatgaagttgacagtagtaggagacccccaaaagtgttgcccatgggcagtgcccaacttgcacaaccaactactgyggtccaacctaggatactcacagcctcccaggcagccgggtcatgcttgaagagggagttggtgagctccacggacacgcgcttccggtagtctgggttcttgtcctcggagatgcggaacaggacggcagcagcgtaggtggctgagcagagaggaaaggaaaagccaggttaaacgtcggccagcctccatcgtggctgggggagtgggacccagcctcctgccctcccccagctcaccagtgccctcgttgcgggagtgcagcaactccatgagtggggccgaggccccctctgcat

SEQ ID NO: 104953 - DNA, 601 bp, Human
cgtggctcacgcctgtaatcccagcactctgggagacagcaggcggatcacttgaggtcaggagttccagaccagcctggccaacatggtgaaaccctgtctctactaaaaatacaaaaaaaattagctgggcgtggtggtgcaggcctgtaatcccagctactcgggaggctgaggcaggagaattgcttgaatggggaggcagaggatgcagtgagccgagattacaccattgcactccagcctgggcgacaggagtgagactctgtctcgaaaaaaataaaaaataggctgggcgcastggctcacgcctgtaatcccagcactttgggaggccaaggcgggcggatcacaaggtcaggagacaatcgagatcatcctggccaacatggcgaaaccgcgtctctactaaaaatagaaaaattagccgggtgtggtagcgtgcacctgtagtcccagttactcagaaggctgaggcaggagaattgcttgaaaccgggaggcggaggttgcagtgagccaagatcacaccactgcactccagcctggcgacagagcaagactccatctcaaaaaatataaaaataaataaataaataaa

SEQ ID NO: 104954 - DNA, 601 bp, Human
gcacaccgtgcttggggaagctcagcagcaaaggatccccccaaaaaaggagcgcaggtttcagcggggagatgggagggcctccaacagaaggaggttctagagaggaggaaaagcctgcaaagagggggccgtactggggccaggccgcctaggccagcatgtggtctgcagtggggtacgggggcctgaggccgtcgctgtaggtgtcgatggggtagtctccatccatgtccatgtgcatctccagcgggtcaaggggcacatcgctggagtacatggggcggtaggtggcatccawgtctggggacaaaaagtggggctcggtcctagggtctgcaagctaccctgcagggagcagtctgcacagccttcagctgcctcctctacccatgcccacccctggtgggcctgaccccctccccagaccccacaccagggcatctagactggggtacatgtggatgccacacagcagttgccactggtcctctggccccggagacataatattgtcccctcacacacacccacacagccgcccaggatctccagggtcctgaagagcccggcacacacttaccatctccatagggctcat

SEQ ID NO: 104955 - DNA, 601 bp, Human; identical to SEQ ID NO: 104930

SEQ ID NO: 104956 - DNA, 601 bp, Human; identical to SEQ ID NO: 104931

SEQ ID NO: 104957 - DNA, 601 bp, Human; identical to SEQ ID NO: 104932

SEQ ID NO: 104958 - DNA, 601 bp, Human; identical to SEQ ID NO: 104933

SEQ ID NO: 104959 - DNA, 601 bp, Human; identical to SEQ ID NO: 104934

SEQ ID NO: 104960 - DNA, 601 bp, Human; identical to SEQ ID NO: 104935

SEQ ID NO: 104961 - DNA, 601 bp, Human; identical to SEQ ID NO: 104936

SEQ ID NO: 104962 - DNA, 601 bp, Human; identical to SEQ ID NO: 104937

SEQ ID NO: 104963 - DNA, 601 bp, Human; identical to SEQ ID NO: 104938

SEQ ID NO: 104964 - DNA, 601 bp, Human; identical to SEQ ID NO: 104939

SEQ ID NO: 104965 - DNA, 601 bp, Human; identical to SEQ ID NO: 104940

SEQ ID NO: 104966 - DNA, 601 bp, Human; identical to SEQ ID NO: 104941

SEQ ID NO: 104967 - DNA, 601 bp, Human; identical to SEQ ID NO: 104942

SEQ ID NO: 104968 - DNA, 601 bp, Human; identical to SEQ ID NO: 104943

SEQ ID NO: 104969 - DNA, 601 bp, Human; identical to SEQ ID NO: 104944

SEQ ID NO: 104970 - DNA, 601 bp, Human; identical to SEQ ID NO: 104945

SEQ ID NO: 104971 - DNA, 601 bp, Human; identical to SEQ ID NO: 104946

SEQ ID NO: 104972 - DNA, 601 bp, Human; identical to SEQ ID NO: 104947

SEQ ID NO: 104973 - DNA, 601 bp, Human; identical to SEQ ID NO: 104948

SEQ ID NO: 104974 - DNA, 601 bp, Human; identical to SEQ ID NO: 104949

SEQ ID NO: 104975 - DNA, 601 bp, Human; identical to SEQ ID NO: 104950

SEQ ID NO: 104976 - DNA, 601 bp, Human; identical to SEQ ID NO: 104951

SEQ ID NO: 104977 - DNA, 601 bp, Human; identical to SEQ ID NO: 104952

SEQ ID NO: 104978 - DNA, 601 bp, Human; identical to SEQ ID NO: 104953

SEQ ID NO: 104979 - DNA, 601 bp, Human; identical to SEQ ID NO: 104954

SEQ ID NO: 104980 - DNA, 601 bp, Human
cagttagggtgagtgaaaataaaattatgcttttctccccccttatccccatcccccaaccccatccaaatgaaaaggattcccctttaaaattttcaaaagtagagagaaaaaaggttttatgttacaaactgaaggagggaagttagataataagaaaggatggaaaagatgaccatgagatgtattagcatcctccttctgaaactgggctgggtgagatgcctctggtcttagacacaggtccaaggagcaaggcagacaggtgggggcaggggtgggggcagttgctctgctctckcaggagtccacacacaagagggagctggatctcagcttgatcatctcaaatcccaaggtatcattgtgccaggcattatctgtcacccccgccaaccttctctgcttccctgactccagcatcctcagttctcagcaagatctcctcttcccacccctaaaatagcgttgaagctaacagtgcattgacttctgttctgaagaccaggttctcagtaactggaaggcacagagcaacccatctctggggctcttcttgcccctcagtcccaagactttccacaaggatggaactggagct

SEQ ID NO: 104981 - DNA, 601 bp, Human
aaacctagtagttaaaaatcaactcataacttagaaaccgatgttattcatagattgcagacattttatagaagaacattgtgaaactccctgtcctattctgtttcactctgactaccagtgcatgaaacccctgttacgtatcccctagattgctctatcaatcacgaccctttcatgtgaaatctttagtgttgtgagcccttaaaagggacagaaattgggcactcgaggagctcggattttaaggcagtagcttgccgatgctcccagctgaataaagcccttccttctacaactyagtatctgagaagttttgtctgcagctcgtcctgttacatcactatgttgcacaagccggtctcaaactctgggcctcaagttctcctcccacctcggtctcctaaagtgctgggattacaagtgtgagccagtgtgtccagcccactttcttcctactagtcaagaagtccatatcctggctgggcatgatggctcatgactgtaattccagcactttgggaggctgaggtgggaggattgcttgagcccaggagtttgagaacagtctgggcaacacagggagaccctgtctctacaa

SEQ ID NO: 104982 - DNA, 601 bp, Human
ctggtcactcagcctgagcacccctcccaagaggccagttaggtgcctcttccttgatttccctaactcttactcgtctcaagacctggaagtttctcctaactgtacctcactctattctttctaacccaacttgctttccctttccacaattgagctgaagaaccacaaaataccccacgataacctctgttccactcccttagcccttccccaggacacagcccaccactctgccctctcaggagcatcccctgcccttcctggccttcctccaccttctttttttttttttttttttgagacagtattgtgctctgtcacccaggctgaatgcagtggtgtaatcacagctcactgcagctttgaactcacgggctcaagcgatcctccagcctcagccttccatacatcgcaatgcctgtctaattaaaaagaattgtttttgtagagacagggtctcgctgagggaagagagagaccctctcatattgttttatactcagtacctgttttaagaaaaaaacaaggaagtgaaatcaaagacaggcagcccagcgccaggcccgaaaccaggcctgggcctgcctggcctaaacct

SEQ ID NO: 104983 - DNA, 601 bp, Human
acttcctgccagcttcctggtcactcagcctgagcacccctcccaagaggccagttaggtgcctcttccttgatttccctaactcttactcgtctcaagacctggaagtttctcctaactgtacctcactctattctttctaacccaacttgctttccctttccacaattgagctgaagaaccacaaaataccccacgataacctctgttccactcccttagcccttccccaggacacagcccaccactctgccctctcaggagcatcccctgcccttcctggccttcctccaccttcttyttttttttttttttttgagacagtattgtgctctgtcacccaggctgaatgcagtggtgtaatcacagctcactgcagctttgaactcacgggctcaagcgatcctccagcctcagccttccatacatcgcaatgcctgtctaattaaaaagaattgtttttgtagagacagggtctcgctgagggaagagagagaccctctcatattgttttatactcagtacctgttttaagaaaaaaacaaggaagtgaaatcaaagacaggcagcccagcgccaggcccgaaaccaggcctgggcc

SEQ ID NO: 104984 - DNA, 601 bp, Human
cagatccatgctgtagacatgttctatatgttccctatacagaaacgagaaaaatcaattcctgagatttctttttttttttttttgagacggagtctcgctctgtcgcccaggctggagtgcagtggtgcgatctcagctcactgcaagctccacctcccgggttcacgcgattctcctgcctcagcctcccgaatagctgggactacaggtgcccgccaccacgcccagctaattttttgtatttttagtagagacggggtttcaccgtgttagccaggatggtcacgatctcctaacytcatgatctgcccgcctcagcttcccaaagtgctgggattacaggcgtgagccactgcgcccggcaattcctgagattcttgtagtgaactctcttgttaatgccaaaattcctcatcaagttcaaggaaaccttcataaaactggacaggcagttaacttgcagtgcaaaaaaatgtacaggaaacagtattcaaaggaaatatgtgatctgggaaaaaccagagagtgttatcatttctttttttttttttttttgagacagggtctcattctgttgcccaggctggagtacactgta

SEQ ID NO: 104985 - DNA, 601 bp, Human; identical to SEQ ID NO: 30275

SEQ ID NO: 104986 - DNA, 601 bp, Human; identical to SEQ ID NO: 30276

SEQ ID NO: 104987 - DNA, 601 bp, Human; identical to SEQ ID NO: 30277

SEQ ID NO: 104988 - DNA, 601 bp, Human; identical to SEQ ID NO: 30278

SEQ ID NO: 104989 - DNA, 601 bp, Human; identical to SEQ ID NO: 30276

SEQ ID NO: 104990 - DNA, 601 bp, Human; identical to SEQ ID NO: 30277

SEQ ID NO: 104991 - DNA, 601 bp, Human; identical to SEQ ID NO: 30278

SEQ ID NO: 104992 - DNA, 601 bp, Human
atgctctgtatcaccatcaggagatcaggaaccattctttcctgttcactgtgaaaccccagcatccgcaggatgcctggcacatagtaagtggacacaaaatatttttcaaatggccacaatccaaatatgccacgaccctgggcaagttatccaaccctggcctttcttctgataccagccagtggttgcaaggaaagtggacggggaagagagctggcaaaggtaaaaccacaagagttgtgatgcaggtggacctggaacgcaactcaactcggccttggaggtgctggagggaggygccacaaggggaggggtggggcttcagaatctataaagctccgttcaaaccccagcttcagcatttaccagctgctgaccttgggcaaggtacttatatctctgggaagcccagtttcccttacctgtagaatgggccgaagcattacatgaggaaatggatgttatgacattttacccagtacttggcatacagaaagtgttcaacaccagataactattaataatggtaaaaaagataagaaaaaggaggctgtctgctttcatcactgcactggtccctggcctttcagctggagcc

SEQ ID NO: 104993 - DNA, 601 bp, Human
tcttctcctagcgagggtgcaaaccccttcttctggccaaagtagggggtgtcaggctcagggtgggtctaaaggtgatgtgcagattgtaactggcacccgtggcattggctgggccttcctcggagggtagcaacttgataacttcaaaatgtctgggggccgctgggaaggccagagggcctgatctgggctggaggatgagagacggaaacggggtggggagtatcccgtctgacaatttggcaacacagacaacagtgatggagccagaactgggtgtctaggcagactgagcctrgcgggggggtgggggaagaggctggtgtgggaagacagggttctcagggcgaaggccaaccagcacccagagacaggaggggcaggctgcatgctcccctttcactcctcccacaaaacatcagcttccacctactctgtgccaggccctgggccaatcgctcactgtctgaagtgggtaagagaagaacagattcagttcctggacctcaagtagtggggagaggacttccagcctccaaggactgactatgtgaggagggaagggacactgcctaggccttgagaaatggggaacaga

SEQ ID NO: 104994 - DNA, 601 bp, Human
ctcttctcctagcgagggtgcaaaccccttcttctggccaaagtagggggtgtcaggctcagggtgggtctaaaggtgatgtgcagattgtaactggcacccgtggcattggctgggccttcctcggagggtagcaacttgataacttcaaaatgtctgggggccgctgggaaggccagagggcctgatctgggctggaggatgagagacggaaacggggtggggagtatcccgtctgacaatttggcaacacagacaacagtgatggagccagaactgggtgtctaggcagactgagccyggcgggggggtgggggaagaggctggtgtgggaagacagggttctcagggcgaaggccaaccagcacccagagacaggaggggcaggctgcatgctcccctttcactcctcccacaaaacatcagcttccacctactctgtgccaggccctgggccaatcgctcactgtctgaagtgggtaagagaagaacagattcagttcctggacctcaagtagtggggagaggacttccagcctccaaggactgactatgtgaggagggaagggacactgcctaggccttgagaaatggggaacag

SEQ ID NO: 104995 - DNA, 601 bp, Human
gtgtgtgtgtgtgtgtgtgtttgcctgcatgtgcgggtcagaaggatcgcttaccttcagatcagtagggaattcctccctcttcaccagtcctgtggctgctgcgatgttccctgccccagagaacacagctcctcccagatgtgaggcctgttccttggttttttcagccactggagcagggagggggttgaggaaggggtttgggagccagggggaaacaccgatgccctgccttgtagtatcccagggcctgccctccccacggagcattcccgcagaagccttgggagtctccccsgcccccgccctctggttcccggccagatcatccgcctaagtgagagaagggctggtgccagggctgggctagtacctgaagccacaccttgtaccacaccttctcgggtcttgcttcctgcagggagaaaaagcggcacatttaaggactctgcgctgagggaacagaaactccagcacagcatggtgattacagagtgggcatcctggccccgtcactgcctccttgggtccccacatcctacaacctgcacccccatgttaacccccgtcttatcactgcactgggccccacacctct

SEQ ID NO: 104996 - DNA, 601 bp, Human; identical to SEQ ID NO: 24048

SEQ ID NO: 104997 - DNA, 601 bp, Human; identical to SEQ ID NO: 24049

SEQ ID NO: 104998 - DNA, 601 bp, Human
acaatttgaatttcccctttgtaatctgaatcaatgactcctgtttgtacttgcacgccttttaaatttaaactagacctacctagaagtaatcctaccatccccgctggcatcatctgactggagacagcaaccttctttaacagtcccattacaaaaggagaacctgttccatatggattaatagcttgtttaaattctttgagtaatttaaaaggaaaaggctcaaatgtagctataatatttccctgttgatctacggggtatattctaacagggaactgctaagcctctatatcaycctctcttctaacttgctgaattcctggctgaatagaactgagagtggtcgctcgaggtgctgctcagtcactggggcgactactttttgcccagtgtcctctggaaaagaaagatctggaggatcaggctactctttttcttcgaaataatgagggggtgcagaagggtagggacaaacctctccctcctttgccactttagctttagctggcaaacaaacctgctctgtcacctcttctgttacttcattatactttccttcctcctcatctttagtgtgaaaaggttccaaggtgga

SEQ ID NO: 104999 - DNA, 601 bp, Human
taacagtcccattacaaaaggagaacctgttccatatggattaatagcttgtttaaattctttgagtaatttaaaaggaaaaggctcaaatgtagctataatatttccctgttgatctacggggtatattctaacagggaactgctaagcctctatatcatcctctcttctaacttgctgaattcctggctgaatagaactgagagtggtcgctcgaggtgctgctcagtcactggggcgactactttttgcccagtgtcctctggaaaagaaagatctggaggatcaggctactcttttkcttcgaaataatgagggggtgcagaagggtagggacaaacctctccctcctttgccactttagctttagctggcaaacaaacctgctctgtcacctcttctgttacttcattatactttccttcctcctcatctttagtgtgaaaaggttccaaggtggaatgagctagagcccacacttgcccattgttaccctgatgcttccgagctccccttcttactcaccatggggattgcttaagagtactcgggtatcctccagctttgttccacgttttccaaccattgctccagcgagcct

SEQ ID NO: 105000 - DNA, 601 bp, Human
cgagctccccttcttactcaccatggggattgcttaagagtactcgggtatcctccagctttgttccacgttttccaaccattgctccagcgagccttcatcctgggtttgagtccccacgttgggcgccacttgccgagaccagctcggtcgtggagaccctaacccagcagtgctagaggaattaaagacacacacacagaaacatagagtgtggagtgggaaatcaggggattcacagccttcagagctgagagccctgaacagagatttacccacgtatttattgacagcaagccgrtgataagcattatttctgtagattatagattaactaaaagtattccttacaggaaacaaagggatgggccaaaacaaagcgatgggctctggctagatatctgcagcaggaacacgtccttaaggcacagatcgctcatgctattgtttgtggcttaggaatgccttaagtggttttccatcttgggtggaccaggtgttccttgccctcattccagtaaacccacaaccttcagtgtgggcgtcatggccatcacaaacatgtcacagtgctgcagagattttgtttatggcaagatct

SEQ ID NO: 105001 - DNA, 601 bp, Human
agaagcactaatggactaagacaaaaagattccattatgaaagtgaaaaggcaaccgcagagtggcagaagcttttggagatgatgaatatgtttacttcctggattgcggtgatgataccatgagtgtatacatatgtgtgtatacataatgtatacaaattgtgttcattgattatgtacagtttctttgtataccaattataccttaataaagctaaggaaaaaaaaaagaaaatccagaataaatatgcatggtatgacccatttatttaaaaaaaaaaagagggaatgcgaagcartggttttggtgcgaacacaaaaattctggcttcaacagcatttaaattcccaaaccaagcatgtttatgttttaattctttgtggccataaattgtacagctcaggcctttatagtctctcagattctgtgaatgtggggaattagttttactcataaaaagttttgttcttggggataaattttttaaaaaaatttttgtatagttagcacactgagaaaatacagacaaaggcatacagatgcaagaaatgaggtagctgaatagaccaaagaatgatatagggcccagaaggtaggc

SEQ ID NO: 105002 - DNA, 601 bp, Human
atgttaagaaagtttgaagtgcagaaaaaggtgattgtaaatccatatggttaagcttagcccatttcttaaaaggcttgattgctcattcctccattcattgatttactcactcttccaatccatgttattgagtcttgctctgtaattccggatggttgtgcttttaagtactgcatagtggttgtatgtctgtgttagcattgctgaatgtatcagggaattcatttttttatccccattcattcgttccattcatctgtttctctctctctctctctttgtgtgtgtgtgtgtgtgggtgtgtgtgtgtgtgtgtgtgtgtgttatgcctagaaaacatttctcaagaattagaattacgatatgctgtcaaacacaatgacttatttgaacctcttttatttgtaggttgaagcactggacaatgccacatactttgtggatggtgtgggtcttgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgac

SEQ ID NO: 105003 - DNA, 601 bp, Human; identical to SEQ ID NO: 18364

SEQ ID NO: 105004 - DNA, 601 bp, Human
atgttgcccaggctggagtgcagtggctattcactggcacaatcatagcacactatagcctcaaattcctgggctcaagtgatcctcctgcttcagtctcctgaatagctgagactacaggcacacaccattatacctcactgcattcatctttaaaattaaaaaaccccctgaaggggaggaaagtaacaaagacagaaattaccacaactccaaagcccaactttcctaacactttttatactatcctgggggaagatagttaatatgaagacccagaggacaaaataggaaaggatgygtgtgtcatgggaaaaaaaccagaagcccaatcccagaaggcaggttttgttttttgttttgttttgatacagggtctcactctatcacccaggctggagtacagtggcacaattacagcttactgccacctccacgtcccgggctcaagcaaaccctcctgcctcagcttcccaagtagctgggactacaggcatgcgccaccacgcccggtttttctggtagagacaaagtctcactacactgccccagctagtctcaaattcctgggctcaagcaatcctcccaccttggcctccca

SEQ ID NO: 105005 - DNA, 601 bp, Human
ctaaaaactatcatgggaaagaaactgcaaatgaagtcaaggagcagtgaaaccacccaatggcacagatgccattacctcaaatagaggtgggagaggaaagaaaatgggagatgattctcaaagggagagcaaggaccaaacatctgggaaatgatgggaggcagtgactcaaggtcagaataactccatcagaggtgcttctaagaacatggggtggggggaggacaactgctccatttgattctcctacttcaactaagagaatctcgtgtgcattagcaaagtggatgtcttttawgatcagaatgctgcaatggacagtcaaaatgccacttaaggagaaacaaaaattactcaagatgagttacttgccgtcagaccacaacaggatagttttagatgagactggtctcttgactaagaattaaaccatctacaggtttacaggaaaggtatcagtaagtggtgttaaaataccaaattcagagcagcagatacgcttttaagggacaggatctcaccatgttgcccaggctggagtgcagtggctattcactggcacaatcatagcacactatagcctcaaattcctgggctc

SEQ ID NO: 105006 - DNA, 601 bp, Human; identical to SEQ ID NO: 30536

SEQ ID NO: 105007 - DNA, 601 bp, Human; identical to SEQ ID NO: 30537

SEQ ID NO: 105008 - DNA, 601 bp, Human
tagttgtccctcctctgggtttcgaaatcatcctctgcatattaccttcaaagaaggaatcacactgttctctgtttgtttataagacacatctcccctactagtttttgaactccttaaaggcaaggatcatctttatgacccagctcaaagcccaatgtctggtattagtagacatgctaaaatgtttgtgaagtgatgaatacatgtatgaatatattcagacttagaaacagcatcacagagatgggtcttcagaaaacatttaatatatcccgcttcacccaaaactccctaaatragtatttccaaagagttgtgttattattaaaacaagaaaataattttccatgttcaatataaaataaacatttttctaatgaaaataggattaaataagaatcttaccggcaaagttccaggtagagatgcatcaaaaaaagaaaccaaagaatttggaggtgctgaaaagcgaacttgagatccagagaagagtttagagttggaggaaatctgggcatgaatttccaaacctaccacagcagcccatttgtgttcactaagaagaaagagataatggttaagatgtattatatttgtc

SEQ ID NO: 105009 - DNA, 601 bp, Human
caaatagctcaggccaccacctcttcagtaacccttccttaacctaaagtacccctacttcaatttctcacaacagtcctttcttttactgaattagttgtccctcctctgggtttcgaaatcatcctctgcatattaccttcaaagaaggaatcacactgttctctgtttgtttataagacacatctcccctactagtttttgaactccttaaaggcaaggatcatctttatgacccagctcaaagcccaatgtctggtattagtagacatgctaaaatgtttgtgaagtgatgaatacrtgtatgaatatattcagacttagaaacagcatcacagagatgggtcttcagaaaacatttaatatatcccgcttcacccaaaactccctaaataagtatttccaaagagttgtgttattattaaaacaagaaaataattttccatgttcaatataaaataaacatttttctaatgaaaataggattaaataagaatcttaccggcaaagttccaggtagagatgcatcaaaaaaagaaaccaaagaatttggaggtgctgaaaagcgaacttgagatccagagaagagtttagagttgga

SEQ ID NO: 105010 - DNA, 601 bp, Human
agaaagacatgaccaataaatgttttctcttgattctatgtctcctttcacttgctgcattctgttgtccttcatagtaaaactttttgaaacagttgcccacactcacttcttcctccatgccatgacatttctcaatccactgccacctaccttctgtttccatcaccccactcaaactgttcttgcaaaggatacccttcttaataaatccaatgggcacttcctagtcctcactttacttgacctctcagtagcatccaatgttcttgtactccctccttctcaaaacactcacttccttggagtttctggccctgcactctccttacgtcttcttacctctttgcaaatgggatccacaccctttatcagggcttatatggtacaggctatgctttctgctctagcctcacctcttgcaatgcccatattcaaattctatgctacaacacatggaaaacgtttcagtttctagagcaagccacgttgtttttcttctggtctttgtacatcctattcactttctacttggccaatttcatcaattccttatatctgtgttgaatactcttcctatgtgctcctcaagcaccttgta

SEQ ID NO: 105011 - DNA, 601 bp, Human
acctcaccgccaaagaaaaacacaacaaaataaaacccatctactggcttaaggcctgaaaaggagaaagaggcctccaatcagtggccaaaaatgttcctacagcctatacttaggttacttttttcttgctttaccaatttagaacatgacttccaattatggtaggtaagaatttagttcttttcccaatatccaagttatatcacagtttttattaaatcagtagctggtgcttctattattatttacatgtttctctcctaagctaataaaacactatgattacatttcctttctkgaacattttgtttttcctagacttgctaagcccttcattgttttcatgtgcttcattttttatgtacctattgctcattcctctaaaggctagattatatggaaatcttttttccacacaaatcagatacctgctaattccctactctcattttttcctagaattctttattctggagccaccttcctcctcttccaacggtctcatggtagagctggcaacctgaaacttctctattattccagcaggttcctggggtaatgaaaggcaaactttttgagagtctgtctgaaaatacca

SEQ ID NO: 105012 - DNA, 601 bp, Human
ttgaaacagggtctcactctgtcactcagactggagtgccgtggtacacctcccaagctcaagtgatcctcccacctcaaccccacaagcagcggactacaggcatacaccaccatgcccgacttatttttgtattttttttttttgtagagacagggtttcaccatgttgcccaggctggtctccaactcctgggctcaagccatccaaccacctcagccttccaaagtgctgggattacaggcacgagccactgtgcctagctgctaaattatatttctatccaaaaataaaatatacscactccctaaaagccctgccatgagaagttgggtaacataaaagtccataaagtcagttagaaaaaaggatggtaggtcatgtctcccccagggaagcagacagagccattacatgcatgagcttgagtatggatggatctagaatgtggatgagtctatttctcctaaaatcagggtaagggtaagagttgtgagaacaggggtgtggtaggggactcattatttggactttgagaacaaaaaacaaaacaaaatgaaaagcacttcaccagcagaaggctgagaaaccagtacaggta

SEQ ID NO: 105013 - DNA, 601 bp, Human
aaaaatgataagttcatgtcctttgtagggacatggatgaagctggaaaccatcattctcagcaaactatcgcaaggacagaaaaccaaacaccacatgttctcactcataggtgagaactgaacaataagaacacttggacacaggaaggggaacatcacacaccagggcctgttgtggggtgggggtgggggagggatagcattaggagatgtacctaatgtaaatacaccaacatggcacatgtatacatatgtaacaaacctgcacgttgtgcacacgtaccctagaacttcaagtataattatatatatataataaaacaaaaagaaaaaagaaaaaaatcagagaggtgtttcctcaacctttgacaaccaaacctcaaaacttcctcacacctgggagcagagggacacatcttcccctcgggttacagtaggagagggctctttctccacagctctggagacattgtctgctttcttaggaaccttattctatcaacaattccctcccccttatatctttattcctttaaacctcagttttttgtgttttgtttttttttgagacagagtctggctctcatgccaggctggag

SEQ ID NO: 105014 - DNA, 601 bp, Human
aaaaaatgataagttcatgtcctttgtagggacatggatgaagctggaaaccatcattctcagcaaactatcgcaaggacagaaaaccaaacaccacatgttctcactcataggtgagaactgaacaataagaacacttggacacaggaaggggaacatcacacaccagggcctgttgtggggtgggggtgggggagggatagcattaggagatgtacctaatgtaaatacaccaacatggcacatgtatacatatgtaacaaacctgcacgttgtgcacacgtaccctagaacttcaagaataattatatatatataataaaacaaaaagaaaaaagaaaaaaatcagagaggtgtttcctcaacctttgacaaccaaacctcaaaacttcctcacacctgggagcagagggacacatcttcccctcgggttacagtaggagagggctctttctccacagctctggagacattgtctgctttcttaggaaccttattctatcaacaattccctcccccttatatctttattcctttaaacctcagttttttgtgttttgtttttttttgagacagagtctggctctcatgccaggctgga

SEQ ID NO: 105015 - DNA, 601 bp, Human
ccataaaaaatgataagttcatgtcctttgtagggacatggatgaagctggaaaccatcattctcagcaaactatcgcaaggacagaaaaccaaacaccacatgttctcactcataggtgagaactgaacaataagaacacttggacacaggaaggggaacatcacacaccagggcctgttgtggggtgggggtgggggagggatagcattaggagatgtacctaatgtaaatacaccaacatggcacatgtatacatatgtaacaaacctgcacgttgtgcacacgtaccctagaacttmaagtataattatatatatataataaaacaaaaagaaaaaagaaaaaaatcagagaggtgtttcctcaacctttgacaaccaaacctcaaaacttcctcacacctgggagcagagggacacatcttcccctcgggttacagtaggagagggctctttctccacagctctggagacattgtctgctttcttaggaaccttattctatcaacaattccctcccccttatatctttattcctttaaacctcagttttttgtgttttgtttttttttgagacagagtctggctctcatgccaggc

SEQ ID NO: 105016 - DNA, 601 bp, Human
tggaatactatgcagccataaaaaatgataagttcatgtcctttgtagggacatggatgaagctggaaaccatcattctcagcaaactatcgcaaggacagaaaaccaaacaccacatgttctcactcataggtgagaactgaacaataagaacacttggacacaggaaggggaacatcacacaccagggcctgttgtggggtgggggtgggggagggatagcattaggagatgtacctaatgtaaatacaccaacatggcacatgtatacatatgtaacaaacctgcacgttgtgcacaygtaccctagaacttcaagtataattatatatatataataaaacaaaaagaaaaaagaaaaaaatcagagaggtgtttcctcaacctttgacaaccaaacctcaaaacttcctcacacctgggagcagagggacacatcttcccctcgggttacagtaggagagggctctttctccacagctctggagacattgtctgctttcttaggaaccttattctatcaacaattccctcccccttatatctttattcctttaaacctcagttttttgtgttttgtttttttttgagacagagtctg

SEQ ID NO: 105017 - DNA, 601 bp, Human
tatatacccaaaggattataaatcatgctgctataaagacacatgcacacgtatgtttattgcggcactattcacaatagcaaagacttggaaccaacccaaatgcccaacagtgatagactggattaagaaaatgtggcacatatacaccatggaatactatgcagccataaaaaatgataagttcatgtcctttgtagggacatggatgaagctggaaaccatcattctcagcaaactatcgcaaggacagaaaaccaaacaccacatgttctcactcataggtgagaactgaacaatragaacacttggacacaggaaggggaacatcacacaccagggcctgttgtggggtgggggtgggggagggatagcattaggagatgtacctaatgtaaatacaccaacatggcacatgtatacatatgtaacaaacctgcacgttgtgcacacgtaccctagaacttcaagtataattatatatatataataaaacaaaaagaaaaaagaaaaaaatcagagaggtgtttcctcaacctttgacaaccaaacctcaaaacttcctcacacctgggagcagagggacacatcttcccctcgg

SEQ ID NO: 105018 - DNA, 601 bp, Human
agacagcaggtgtgctccagacatgctggggaacagggagatggaggcaggaggcagaaatgaagtattctatttatacacacatacatttatatatacatataaatttacaaatacacagatgtgtacatgcccagagccaagctcaaagcaagcaagaaaatcccctggggccgcagaagtaatggtagtttaaagccatgtgacaccaggggtaaccacaagagacaggacaacacattttctactcactttctaactgtgataaggacagcaactgcggcaggtagggttgttatgrggttagaataagtgaatacatataaagcacctagaacagtgcctgccacatggtaagcacttggtacatggtagttgattttactaccattattattgttaactgggctgatgagacatcagatgtcaatgctttaaagcaccttgggggcagaagtcaaggccatgagcccatgtgatagggagctgggatggcttcctgcataaagctgtgagccaaaaaattctagtccagttagaaaaccttttgccaccaactggaggggttgctgtggaggaggccagctacttcaggccatag

SEQ ID NO: 105019 - DNA, 601 bp, Human
ccactctcaccactcctcttcaatatagtactggacgccctagccagagcaatcagacaagagaaatagaaggcatccaaattggtgaagaggaagtcaaactgtccctgtctgctgacgatatgatcttttaccttgaaaaccctaaagacttctccagaaagctcctagaactgataaaagaattcagcaaagtttccagatacaattaacatacacaaatcagtagctcttctatatagcaacagtgaccaaatggagaaccaaatcaagaactcaaccccttttaaaatagctgccaaaaaaaaaaaaaaatacttaggaatacacctaacaaaagagttgaaggacctctacaaggaaaactacaaaacactgctgaaagaaatcacaaatgacacagacaaatagaaacacatcccatgttcacggatgggtagaatcaatattgtgaaaatgaccatagtgccaaaagcaatctaaaaagtcaacacaatccccatcaaaataccaccatcattcgtcacagagttagaaaaattcatatggaaccaaaaaagagcccgcataaccaaagcaagactaagcaaaaggaacaaat

SEQ ID NO: 105020 - DNA, 601 bp, Human
agacaactgtgcaaacctgaatatgaactatgttttaaataacagtattccatcaacagtagctttcctgagtgtgataatcatactgtgatcatagaagtgaacatttttattcttaggagatagctgctaagatatttagagaggaagtgccatgatgtctgcaacttactctcaaatggctcatccaaaggaggaaaaaaaaaatctaggtgcaggatggatttcattgtgctattctttcaacttttctgtaagttttaattttttcaaaacaaaaaatgttgaagagagtggaagkgttgggtaattcttctatctaggtgagatggtacaagcctcccacacaaaactcaaggaatctattaactatgaagagaagaaggagagtccctaaaggaggcaggagctattgaaactgatgctggtcggatcatggcagacgggaggcaggactagattgcagctccagacagagcagcatgcggaggcttgcattgtgaattttacctccagatcagctgcaagagcaggccagcaatcctgagaaaactgctcctacaggacccgggagacaccccaaatactctgggaagtggaa

SEQ ID NO: 105021 - DNA, 601 bp, Human
ttgccccatactgaaactgtcaagtcttttctgatgtgtcctaaaatttactcaagagactctacacctggagagatctgatgcaatgacaaactatttcacatcactgaaacctcaagaggaatcagtgatagtaacaagaaacattaatttcatgactgaaaagctctaataatcagaatgagatttactttcttctttatatataagattagtattaagttgaaagatttgactattgctaagaaacaaaacaactgtcttgaaccaaccaaactctaagtaagaaatgcagctaagyattcactattgatatgaatacaggatcaggtatgaacgaggcctatgaatatcagaaacaaattcctagagatacgtgccattttgtcaaaagtgcacctgctatatattcaccagcctcacaaatgtcctgagaagtgagtctctggaagagtctatcaggacagagacttttaggaagaaaaagctacctttaatttcacacatccaataggaatgcatatagcatcatcttagaggcttcttagtaagtcataaaatcatggaggttcgtaagagaaagaaagaaaaaactgcaaac

SEQ ID NO: 105022 - DNA, 601 bp, Human
tggagccaagaattatgaaatccaactaatttataaggaacatttgtgataactcatctggattgaactcaactgtaaatctacattaaataccaggaaagggtttgctaagcaaattaacagaataaagaagattatataacttacttaagtccataaaatattctctaggattttagtacttttatgtgaaattccactaattacaaataaatctattcacaaaagccagtctctaggatctatactgagaaatatcttgttatgtacttcaaaggaataacattgaatgtctttctaratagtcctcaattcacaccatttctctccccttcctactttgccctcaattggtgagcccatgatgctgtaacacccaaagttagtccaataagtatcagcacatccttaaaaaattgaggtgacatggcaagactagagtccttactgaaaatccagctggcaattcctctcaggcatcaaaacaaagagtagaaggtgatgttttccaaaaagcccacatggcaattactctgtgaaactgatgctatacatgacaaatctgataattaggatatagcatggtaaatgctttaattta

SEQ ID NO: 105023 - DNA, 601 bp, Human
tatcacagggtattggggccatcagaggatgctggaaacacactagaagctggagccatgggtaagacccatcctctatcagagatgttgctggaggcagagcaaaggcgaaataccctcttgctcctttcctcctacctctagtcttctatcagagcctcctgctggcctaacccagccagaagccagccgagctggggctctaggatctgtagcctgcaggagcagcctccctgccattcagagtggagcagcaaagtggtgtagcacagagctgagaacacacaggccatgactaccwcagcaaatacatacagttctatgttcatttctgtccttttttcttttgataaataaacagctattcaaaaaaacaatgccactctctagtctgtccaatcaacttaaaactgaacattttgtggacacccttttcacatgcgtggagccaagaattatgaaatccaactaatttataaggaacatttgtgataactcatctggattgaactcaactgtaaatctacattaaataccaggaaagggtttgctaagcaaattaacagaataaagaagattatataacttacttaagtccata

SEQ ID NO: 105024 - DNA, 601 bp, Human
cctctgctgtagttcctctgtgcaaaccgtgctgatcttctgattctccccattcttattcccttcaaaatcctagtgggacgtcaccacttctgtgaagccttccttgttgtcctttctgtgtacctcttctgaccttctacacactcccattggggcttccatcacagtggattgaatttgttcacatgtagttccacacaattgcacatttcatgaggacgggaattgtctgttcacccttgtatccctggagcctaatacagaacctgaaaaattgtggtatttgattaatgtgtgytgagctcaaaggaggagggaggggatgatatcaatggacgatttcagagaggcagtgatgccccagtctcctctaaggtgttacctgccacatgctggcctgcaaacttgtttctggaagtgccctgaagtgacaactgattgtgtgtgatacgatcaagatgtaatttaaaaactaaaaagactaacttggcttgaagaaagtatgttccagaatttctctgtaattaaatgactacaaaggatctcagggttagccatagcagctctcgtttggaaagaaggcagtaatttttggtac

SEQ ID NO: 105025 - DNA, 601 bp, Human
tctttgcccctgggaccaagctgcttcctcctgctaggcatgaagagaacccaggttattttgtttgtttattttcaagcacgcaccatagcctccctgtgggagaagagttgaggaccatcacagactctcactgtgtccgtgtgcacacaagcgcacgggcacttcataaaccaccactttccagagaagaaggcagtaaaacacacaaacattacagtgatactgagaatatgctttaatctttttttgatgatttagaagccatgaagtacttcaaggtcagaattataagcatcartcatcacacgttacagatgcacagagggcccagtaaacagagagtgtcagttagaagaatgccaagaaaaaaaggaatttcctaggatcttagtcaagctgcttgtgacagatggaagtccaggtcagcatgttctgaggataggatacagaatgggaaaattcaacttgggctgtcttcactctgaaaaaaaaaattcttaaatgtctataaagcactaaactttaggggtacatagataaataggactctgtctctgccctcaatgaatccgcagtggtgacatgaacctgccagcat

SEQ ID NO: 105026 - DNA, 601 bp, Human; identical to SEQ ID NO: 30538

SEQ ID NO: 105027 - DNA, 601 bp, Human; identical to SEQ ID NO: 30539

SEQ ID NO: 105028 - DNA, 601 bp, Human; identical to SEQ ID NO: 30540

SEQ ID NO: 105029 - DNA, 601 bp, Human; identical to SEQ ID NO: 30541

SEQ ID NO: 105030 - DNA, 601 bp, Human; identical to SEQ ID NO: 30542

SEQ ID NO: 105031 - DNA, 601 bp, Human; identical to SEQ ID NO: 30543

SEQ ID NO: 105032 - DNA, 601 bp, Human; identical to SEQ ID NO: 30544

SEQ ID NO: 105033 - DNA, 601 bp, Human; identical to SEQ ID NO: 30545

SEQ ID NO: 105034 - DNA, 601 bp, Human; identical to SEQ ID NO: 30546

SEQ ID NO: 105035 - DNA, 601 bp, Human; identical to SEQ ID NO: 30547

SEQ ID NO: 105036 - DNA, 601 bp, Human; identical to SEQ ID NO: 30548

SEQ ID NO: 105037 - DNA, 601 bp, Human; identical to SEQ ID NO: 30549

SEQ ID NO: 105038 - DNA, 601 bp, Human
cacacacacacaaattaatgttatatatagtcaatttctctatgaaatcacattttgagcaaggaaaccttggccatttcttggttcatcatacactacctcaaagggttggcttgggctcctgctgagtggagggaggtaacttaaatcttcgaggctgagtagccttggtcccttcctcccatctcctatgtaatttcacaaatagtaataaaaggtagggctagaattcagtgtttatttcaagtaggttggaaactcaagtggtcaagatggtggggaagatgtataagactaaaaygtagttttgttacgtcaacctaggaaaaatacatgaattgtaagaggctttgggttaagaggtgctctgtacggaatgctgactgactcagtcatagtcaaagtgtggcattaagcactgctgatgttgtgctcatctgtgctgagtagcacagaggatgaagcagtccttgccttcaagatgctgaacaacatacactaataagtacttaaaagacagtgatataattgccagagaggtaagaagaagatcaaacagcagcccacaggaggcagtgaccaactctgcttctccaagtag

SEQ ID NO: 105039 - DNA, 601 bp, Human
tcatacagtgccttgaacagaaacagctgtattcttgagattctgaaagtttctttcactctcttatggagacagctaatacacacacacacacacacaaattaatgttatatatagtcaatttctctatgaaatcacattttgagcaaggaaaccttggccatttcttggttcatcatacactacctcaaagggttggcttgggctcctgctgagtggagggaggtaacttaaatcttcgaggctgagtagccttggtcccttcctcccatctcctatgtaatttcacaaatagtaatamaaggtagggctagaattcagtgtttatttcaagtaggttggaaactcaagtggtcaagatggtggggaagatgtataagactaaaacgtagttttgttacgtcaacctaggaaaaatacatgaattgtaagaggctttgggttaagaggtgctctgtacggaatgctgactgactcagtcatagtcaaagtgtggcattaagcactgctgatgttgtgctcatctgtgctgagtagcacagaggatgaagcagtccttgccttcaagatgctgaacaacatacactaataagtacttaaa

SEQ ID NO: 105040 - DNA, 601 bp, Human
ctaataaaagtgctgaaccaggccgggtgtggtggctcacacctgtaatcccagcactttgggaggcagaggcaggcggatcacttgaggccaggagttcaaccagcctggccaacatggcaaaaccctgtctctactaaaaatacaaaaaattagccaggagtggtggcgcatgcctggaatcccagctactcgggaggctgaggtgggaggatgtcttgaatctgggaggcagaggttgcagtgagctgagatcgtgccactgcactccagcctgggcgagagttgagaccctgtctcaaaaaaaaaaaaaaaaaagtgctgaattaaataactgaaggtaggtttccctatacaggcctttaaactattaaaatatagactcactcatctgccagcccctagcaaacacctatttaaggcctactaggtttgggcaccatgcaggacccatgaataaagacaaggacacaaacacaaatacaaaaatgtccctgccctcatggagcttatgctcagtgaggtaaggcaggcactgtccccatcaccgctcatgaacggccgagagtgacaatcctatggaaatgccctctgaaggggg

SEQ ID NO: 105041 - DNA, 601 bp, Human
gctctttaaattgaaagatggttcattagatttgtgcatctgcccttctcagcaatctgttgtgtttctgatgaaggcaggaaaaaacacgaacatatcattttcgggtatgttatgagtaacgccgcttccaatgattacaaagtcataaagggctcaggctgcctaatttcaggaaaacaatttgtctgaatcattctctttccattcctatctcattctaatctcactcatcttggaaatttcaagtactagccctttaaaggaaaaatactaatcacccaatacattatctgcaagycataaaaataaggacgtttttaaggtatcaaaaaaagtcctttcaaaaatggccaaaaaattcacccttctttttttttttccaatcaagttaaccactacctcttgtgggccctgatcctacattatccatctatctagtgtaatctgtcctgtgggctggttattgtagtggggtgtgtgtgtgtgtgcatgtgtatgtataaattcttggaaggcaaaaaaaatctttaaaaaaatcttttgtttctgtctcagtacgtgctatacagaagatgctaataaaagtgctgaaccaggc

SEQ ID NO: 105042 - DNA, 601 bp, Human
gaaacaaaataaataaagctgcagaggacggcttatattacttttcttctaactttattttttcacttggaaaatagacatgatttctgcttttcattggcgttgactgattttcactaaatttagtggatggcactttatgtttatttatagggcagtctggcatcttaaaaatcaataggagtggtaaaaacttttaaatgaatctatgttctgtgattgtgctgtacaaaacgctagtggcatgaatgttaacaaaagtacaaactctgttttctccactaatgaaacacaagtgacyccaaacatcaattaactaaaaacactatttctgtttgacattatagcacattatatatgcaagcgggcagcagagcttaggaatgaagagcgtaggccttgaagtcagcatgatctgaatgtggctccaatacgggcttggggaagttattgaaccaaagaggttacatttccctacctgtaaatggggagagcagcagtccctgcctcagagggttgctgtaaggatagattaaaaagtcgtacaatgtgaattgcagagcatgctagaagcaggcagccttttctaggctgcttaggc

SEQ ID NO: 105043 - DNA, 601 bp, Human
cccacctcagcctcccgagtagctgggactacaggtgtgtgccaccatgcccggctaatttaaattttttttttttttttttttttgtagagataggggtctcactacactacgttgttgcccaaactggtctcgaaatcctggccaaaagtgatcctctcaccttggcctcccagagtgctgggattacaggtgtgagtcaccgtgcctggaacttcccaacgattcagacaggactcaagtgcttccagcagaaggtttaagaaacaaaataaataaagctgcagaggacggcttataktacttttcttctaactttattttttcacttggaaaatagacatgatttctgcttttcattggcgttgactgattttcactaaatttagtggatggcactttatgtttatttatagggcagtctggcatcttaaaaatcaataggagtggtaaaaacttttaaatgaatctatgttctgtgattgtgctgtacaaaacgctagtggcatgaatgttaacaaaagtacaaactctgttttctccactaatgaaacacaagtgactccaaacatcaattaactaaaaacactatttctgtttg

SEQ ID NO: 105044 - DNA, 601 bp, Human
gcaggtttactttctgcctttgccagtgtacacctaggccacgtggcattcagctgtggcatgacacacacctgttcccagaccaggaaggaagacagctgcacgcccactgcacaggccatactgggctccggggatggagggcggccagagctcctctgcccctctcctgccccctgccttgcctctgcatcccctccccacgctactgctgccccagaaaaggtcctgcgagcacacccagacctggacactgcacagtcctgaacaagacaaatcttgttatttctcataccaattragcatattgtattttatttattattgcattctaattcctctaatagggtaagtcctacctaattgagcaggtcatgcctgtgatgggagctgctgactatacaaaggctctacatctgcagacggaaccacaggggtttccactggacaaggctctcccacgtcacagtgtgtcattttgcagaggcgcacactggaattgcatccgtcccctttgcggcgggggtgctggggtgagcagctgctgagcatttgtgcagacgctggaggaggctcatcacctgcgtatcaacgcaggcac

SEQ ID NO: 105045 - DNA, 601 bp, Human
tgaggcaaagcagagggacctgctcaccaccactgcctgctcagggaaggaacctcagtctaccctgcactaggccctgggagcaacctgcctcgaagcggtcttctgcatcccaccttcagagatgatcaaatgcaaatgctggaagactctccagttggaataggatgaaggctgatttctcaactgcatttcttgttctaagtcacacaccctgtgaagctgacgataggccaggaacgaggtggactatatttatttacgagaaggaaacctgatagagccagctgcccagtggcaractcagagaaggaaaagcagcccagaagaatgcaagttgaggaacagctggttatgtgacagggagcgttctgacagctacaagggacccccagatgagccattctgggctagtcaaaggtgctcaagagtatctgctaaatatctgctagacacagagctcagaaccaggccctgtgggtggctgcgtgaggctactgctgctgctgaggacagtgataaccagagttacagcagcagcggtgatgggcgccaggcactgtctacgcactctctccacattacctcaattcatcccaac

SEQ ID NO: 105046 - DNA, 601 bp, Human
gcccagaaaagtgttgaggacccaactagtcaccttttttggctctgccctagtttcttttatcacattttggaagaactccagtaggccgacttcgttctgttaaaaaaaaaaaaagaaaattacataaagcctccccaaaaatgaaagatcagcattctgaaggcaaatctgaaactgtcccctctgcctcctctgagacagccactttttctttgctaaaccctgagatgtcaccagaacattctgatcactttcagctaatgacaactattctactactgtcactgtgcatttacayagcattttctcaaaaggataaacacattttagagagccctgactttgcagaccagagggatggtgaaattccacatcccccaaacccacttgctttctccgtgtctgctgtgtgtaacctgcactctccatccctgagctgtgaactgggcctaaaatgtttggcctgactttaatgcccctgttctttccaggcctgtcctctgctgaagtcccagtaattgctagaaaagagggtaaaaaacaaagcaaaatcaagaaagaacaaacagaatattctacctctgaaaaatcaaaagtg

SEQ ID NO: 105047 - DNA, 601 bp, Human
caaaaaaatggacctgccctatttccagcacttctggacagagctcatcacaaaggaagaaagaaatcccagacctcactcacctctcactgacagcgaggttctgttgctttaaatagcccagaaaagtgttgaggacccaactagtcaccttttttggctctgccctagtttcttttatcacattttggaagaactccagtaggccgacttcgttctgttaaaaaaaaaaaaagaaaattacataaagcctccccaaaaatgaaagatcagcattctgaaggcaaatctgaaactgtcacctctgcctcctctgagacagccactttttctttgctaaaccctgagatgtcaccagaacattctgatcactttcagctaatgacaactattctactactgtcactgtgcatttacatagcattttctcaaaaggataaacacattttagagagccctgactttgcagaccagagggatggtgaaattccacatcccccaaacccacttgctttctccgtgtctgctgtgtgtaacctgcactctccatccctgagctgtgaactgggcctaaaatgtttggcctgactttaatgcccct

SEQ ID NO: 105048 - DNA, 601 bp, Human; identical to SEQ ID NO: 30550

SEQ ID NO: 105049 - DNA, 601 bp, Human; identical to SEQ ID NO: 30551

SEQ ID NO: 105050 - DNA, 601 bp, Human; identical to SEQ ID NO: 30552

SEQ ID NO: 105051 - DNA, 601 bp, Human; identical to SEQ ID NO: 30553

SEQ ID NO: 105052 - DNA, 601 bp, Human; identical to SEQ ID NO: 30554

SEQ ID NO: 105053 - DNA, 601 bp, Human; identical to SEQ ID NO: 30555

SEQ ID NO: 105054 - DNA, 601 bp, Human; identical to SEQ ID NO: 30556

SEQ ID NO: 105055 - DNA, 601 bp, Human; identical to SEQ ID NO: 30557

SEQ ID NO: 105056 - DNA, 601 bp, Human; identical to SEQ ID NO: 30558

SEQ ID NO: 105057 - DNA, 601 bp, Human; identical to SEQ ID NO: 30559

SEQ ID NO: 105058 - DNA, 601 bp, Human; identical to SEQ ID NO: 30560

SEQ ID NO: 105059 - DNA, 601 bp, Human; identical to SEQ ID NO: 30561

SEQ ID NO: 105060 - DNA, 601 bp, Human; identical to SEQ ID NO: 30562

SEQ ID NO: 105061 - DNA, 601 bp, Human; identical to SEQ ID NO: 30563

SEQ ID NO: 105062 - DNA, 601 bp, Human; identical to SEQ ID NO: 30564

SEQ ID NO: 105063 - DNA, 601 bp, Human; identical to SEQ ID NO: 30565

SEQ ID NO: 105064 - DNA, 601 bp, Human; identical to SEQ ID NO: 30566

SEQ ID NO: 105065 - DNA, 601 bp, Human; identical to SEQ ID NO: 30567

SEQ ID NO: 105066 - DNA, 601 bp, Human; identical to SEQ ID NO: 30568

SEQ ID NO: 105067 - DNA, 601 bp, Human; identical to SEQ ID NO: 30569

SEQ ID NO: 105068 - DNA, 601 bp, Human; identical to SEQ ID NO: 30570

SEQ ID NO: 105069 - DNA, 601 bp, Human; identical to SEQ ID NO: 30571

SEQ ID NO: 105070 - DNA, 601 bp, Human; identical to SEQ ID NO: 30572

SEQ ID NO: 105071 - DNA, 601 bp, Human; identical to SEQ ID NO: 30573

SEQ ID NO: 105072 - DNA, 601 bp, Human; identical to SEQ ID NO: 30574

SEQ ID NO: 105073 - DNA, 601 bp, Human; identical to SEQ ID NO: 30575

SEQ ID NO: 105074 - DNA, 601 bp, Human; identical to SEQ ID NO: 30576

SEQ ID NO: 105075 - DNA, 601 bp, Human; identical to SEQ ID NO: 30577

SEQ ID NO: 105076 - DNA, 601 bp, Human; identical to SEQ ID NO: 30578

SEQ ID NO: 105077 - DNA, 601 bp, Human; identical to SEQ ID NO: 30579

SEQ ID NO: 105078 - DNA, 601 bp, Human; identical to SEQ ID NO: 30580

SEQ ID NO: 105079 - DNA, 601 bp, Human; identical to SEQ ID NO: 30581

SEQ ID NO: 105080 - DNA, 601 bp, Human; identical to SEQ ID NO: 30582

SEQ ID NO: 105081 - DNA, 601 bp, Human; identical to SEQ ID NO: 30583

SEQ ID NO: 105082 - DNA, 601 bp, Human; identical to SEQ ID NO: 30584

SEQ ID NO: 105083 - DNA, 601 bp, Human; identical to SEQ ID NO: 30585

SEQ ID NO: 105084 - DNA, 601 bp, Human; identical to SEQ ID NO: 30586

SEQ ID NO: 105085 - DNA, 601 bp, Human; identical to SEQ ID NO: 30587

SEQ ID NO: 105086 - DNA, 601 bp, Human; identical to SEQ ID NO: 30588

SEQ ID NO: 105087 - DNA, 601 bp, Human; identical to SEQ ID NO: 30589

SEQ ID NO: 105088 - DNA, 601 bp, Human; identical to SEQ ID NO: 30590

SEQ ID NO: 105089 - DNA, 601 bp, Human; identical to SEQ ID NO: 30591

SEQ ID NO: 105090 - DNA, 601 bp, Human; identical to SEQ ID NO: 30592

SEQ ID NO: 105091 - DNA, 601 bp, Human; identical to SEQ ID NO: 30593

SEQ ID NO: 105092 - DNA, 601 bp, Human; identical to SEQ ID NO: 30594

SEQ ID NO: 105093 - DNA, 601 bp, Human; identical to SEQ ID NO: 30595

SEQ ID NO: 105094 - DNA, 601 bp, Human; identical to SEQ ID NO: 30596

SEQ ID NO: 105095 - DNA, 601 bp, Human; identical to SEQ ID NO: 30597

SEQ ID NO: 105096 - DNA, 601 bp, Human; identical to SEQ ID NO: 30598

SEQ ID NO: 105097 - DNA, 601 bp, Human; identical to SEQ ID NO: 30599

SEQ ID NO: 105098 - DNA, 601 bp, Human; identical to SEQ ID NO: 30600

SEQ ID NO: 105099 - DNA, 601 bp, Human; identical to SEQ ID NO: 30601

SEQ ID NO: 105100 - DNA, 601 bp, Human; identical to SEQ ID NO: 30602

SEQ ID NO: 105101 - DNA, 601 bp, Human; identical to SEQ ID NO: 30603

SEQ ID NO: 105102 - DNA, 601 bp, Human; identical to SEQ ID NO: 30604

SEQ ID NO: 105103 - DNA, 601 bp, Human; identical to SEQ ID NO: 30605

SEQ ID NO: 105104 - DNA, 601 bp, Human; identical to SEQ ID NO: 30606

SEQ ID NO: 105105 - DNA, 601 bp, Human; identical to SEQ ID NO: 30607

SEQ ID NO: 105106 - DNA, 601 bp, Human; identical to SEQ ID NO: 30608

SEQ ID NO: 105107 - DNA, 601 bp, Human
tgaattggtgatggaggggtgtccacttttttctagttcctcagctgcttctggagcagtgttcacaacgggaatgtttttactgtccttggtaggctacaggttcacagcttcaaatcaaggcctccaaggattttattctcttacatcacagttttgacaagtatgcttttaaaaaacaacatttgcaaaactggtctttaagcgacgtgagtcagaggtaacaaaggcatatatataccgaacaaaggtgctccggtgcagtggagagaacagtattagtgtcgcaagcacaggagtrcagacagccccgccttcatcgtgatgcctgcagcacaccacgattatcatgagaggtcaagattttgatttactaatttataatcttatttccaagcaaaacaagtcaatttcatgttacaacttttttcttgtttctttttatcttgtttggcctgagggttgggggatttgggggagttgtcagctgcacaatctttgaagtgtaagttaatttttatgtgatatttcagtatatattttattgattaaatttattggaaaacttatttttttaattcatttattctcagactgtgcc

SEQ ID NO: 105108 - DNA, 601 bp, Human
aataattactaaaatgtacatggggtgggggagctcagctaaaatatccttactttggtgcaataatgatctaggttctttttcctaggcctaggcctccaccttgaaagacaggaacagaagttcactgtgatgtgtgaccctggacagagatcaaacagctcctttctagacccagatgacccagaacgcagaagcctagtagttggtatcaccagtgtctcttcaaaagggccccacaaaaggctgtccattaatttgtttcatacagtaagcgagcttttactgaatactccctctrttaggtagcatgcagagtgctagggctggcacattcctgccttcccaccagaaccctccaacctcctccccaggcaacagaacacagggtttgggcctgaccaggcagagctggttcaagccagcctggggcagagccagttttccagcacacttctaacttctagtcagagcctcagcattatacacccagcctacaggtgtgtggattcctgagacagatggcaatggcatcacctgtggtgccaactcatacattttaatgagatttctccctgaagggtgaaccagtagaccagac

SEQ ID NO: 105109 - DNA, 601 bp, Human
acttcgaggccatcttagtaattattttagcaataattactaaaatgtacatggggtgggggagctcagctaaaatatccttactttggtgcaataatgatctaggttctttttcctaggcctaggcctccaccttgaaagacaggaacagaagttcactgtgatgtgtgaccctggacagagatcaaacagctcctttctagacccagatgacccagaacgcagaagcctagtagttggtatcaccagtgtctcttcaaaagggccccacaaaaggctgtccattaatttgtttcatacrgtaagcgagcttttactgaatactccctctgttaggtagcatgcagagtgctagggctggcacattcctgccttcccaccagaaccctccaacctcctccccaggcaacagaacacagggtttgggcctgaccaggcagagctggttcaagccagcctggggcagagccagttttccagcacacttctaacttctagtcagagcctcagcattatacacccagcctacaggtgtgtggattcctgagacagatggcaatggcatcacctgtggtgccaactcatacattttaatgagatt

SEQ ID NO: 105110 - DNA, 601 bp, Human
gaaggctatggagggacaccatgatggttttctttctgctttcagatcccattcaggaggcttccaggacaggaagtggcaagaaccttttggatggacctccaagagtgcttcagcccttcctgacccacagaaccaaggtggctgaggcaccccccaacctgcccctgccggtgaggaaccccatgctggctgctgccctcttcccagagttcctgaaggagctggcggccttggcccaggaacactccattctgtgctacaagatcttgggtgactttgaggactcctgctgttagcttttttttttttttttaatagaggttcttgttttgtaaggttttagtgtcttgactgaatgttaaatgcaaagctgcttacaaagatttctactttaatgtttcctgacaatacttgatttgtggggaggggaattttctgtatctttcctctctctctctagccgggcctttccaccttatgttatatatagaatgtaagtctcataagctggttgctcccttggcagttttctttgctctgtttttcctccttatatttttttggttgtcattctcctatccctttgagttactcttct

SEQ ID NO: 105111 - DNA, 601 bp, Human; identical to SEQ ID NO: 22891

SEQ ID NO: 105112 - DNA, 601 bp, Human; identical to SEQ ID NO: 22892

SEQ ID NO: 105113 - DNA, 601 bp, Human; identical to SEQ ID NO: 22893

SEQ ID NO: 105114 - DNA, 601 bp, Human; identical to SEQ ID NO: 22894

SEQ ID NO: 105115 - DNA, 601 bp, Human; identical to SEQ ID NO: 22895

SEQ ID NO: 105116 - DNA, 601 bp, Human; identical to SEQ ID NO: 22896

SEQ ID NO: 105117 - DNA, 601 bp, Human; identical to SEQ ID NO: 22897

SEQ ID NO: 105118 - DNA, 601 bp, Human; identical to SEQ ID NO: 22898

SEQ ID NO: 105119 - DNA, 601 bp, Human; identical to SEQ ID NO: 22899

SEQ ID NO: 105120 - DNA, 601 bp, Human; identical to SEQ ID NO: 22900

SEQ ID NO: 105121 - DNA, 601 bp, Human; identical to SEQ ID NO: 22901

SEQ ID NO: 105122 - DNA, 601 bp, Human; identical to SEQ ID NO: 22902

SEQ ID NO: 105123 - DNA, 601 bp, Human; identical to SEQ ID NO: 22903

SEQ ID NO: 105124 - DNA, 601 bp, Human; identical to SEQ ID NO: 22904

SEQ ID NO: 105125 - DNA, 601 bp, Human; identical to SEQ ID NO: 22905

SEQ ID NO: 105126 - DNA, 601 bp, Human; identical to SEQ ID NO: 22906

SEQ ID NO: 105127 - DNA, 601 bp, Human; identical to SEQ ID NO: 22907

SEQ ID NO: 105128 - DNA, 601 bp, Human; identical to SEQ ID NO: 22908

SEQ ID NO: 105129 - DNA, 601 bp, Human; identical to SEQ ID NO: 22909

SEQ ID NO: 105130 - DNA, 601 bp, Human; identical to SEQ ID NO: 22910

SEQ ID NO: 105131 - DNA, 601 bp, Human; identical to SEQ ID NO: 22911

SEQ ID NO: 105132 - DNA, 601 bp, Human; identical to SEQ ID NO: 22912

SEQ ID NO: 105133 - DNA, 601 bp, Human; identical to SEQ ID NO: 22913

SEQ ID NO: 105134 - DNA, 601 bp, Human; identical to SEQ ID NO: 22914

SEQ ID NO: 105135 - DNA, 601 bp, Human; identical to SEQ ID NO: 22915

SEQ ID NO: 105136 - DNA, 601 bp, Human; identical to SEQ ID NO: 22916

SEQ ID NO: 105137 - DNA, 601 bp, Human; identical to SEQ ID NO: 22917

SEQ ID NO: 105138 - DNA, 601 bp, Human; identical to SEQ ID NO: 22918

SEQ ID NO: 105139 - DNA, 601 bp, Human; identical to SEQ ID NO: 22919

SEQ ID NO: 105140 - DNA, 601 bp, Human; identical to SEQ ID NO: 22920

SEQ ID NO: 105141 - DNA, 601 bp, Human; identical to SEQ ID NO: 22921

SEQ ID NO: 105142 - DNA, 601 bp, Human; identical to SEQ ID NO: 22922

SEQ ID NO: 105143 - DNA, 601 bp, Human; identical to SEQ ID NO: 22923

SEQ ID NO: 105144 - DNA, 601 bp, Human; identical to SEQ ID NO: 22924

SEQ ID NO: 105145 - DNA, 601 bp, Human; identical to SEQ ID NO: 22925

SEQ ID NO: 105146 - DNA, 601 bp, Human; identical to SEQ ID NO: 22926

SEQ ID NO: 105147 - DNA, 601 bp, Human; identical to SEQ ID NO: 22927

SEQ ID NO: 105148 - DNA, 601 bp, Human; identical to SEQ ID NO: 22928

SEQ ID NO: 105149 - DNA, 601 bp, Human; identical to SEQ ID NO: 22929

SEQ ID NO: 105150 - DNA, 601 bp, Human; identical to SEQ ID NO: 22930

SEQ ID NO: 105151 - DNA, 601 bp, Human; identical to SEQ ID NO: 22931

SEQ ID NO: 105152 - DNA, 601 bp, Human; identical to SEQ ID NO: 22932

SEQ ID NO: 105153 - DNA, 601 bp, Human; identical to SEQ ID NO: 22933

SEQ ID NO: 105154 - DNA, 601 bp, Human; identical to SEQ ID NO: 22934

SEQ ID NO: 105155 - DNA, 601 bp, Human; identical to SEQ ID NO: 22935

SEQ ID NO: 105156 - DNA, 601 bp, Human; identical to SEQ ID NO: 22936

SEQ ID NO: 105157 - DNA, 601 bp, Human; identical to SEQ ID NO: 22937

SEQ ID NO: 105158 - DNA, 601 bp, Human; identical to SEQ ID NO: 22938

SEQ ID NO: 105159 - DNA, 601 bp, Human; identical to SEQ ID NO: 22939

SEQ ID NO: 105160 - DNA, 601 bp, Human; identical to SEQ ID NO: 22940

SEQ ID NO: 105161 - DNA, 601 bp, Human; identical to SEQ ID NO: 22941

SEQ ID NO: 105162 - DNA, 601 bp, Human; identical to SEQ ID NO: 22942

SEQ ID NO: 105163 - DNA, 601 bp, Human
agtgggattactagtgctgttgtcttggggaaaaaataaccaccttttctcacctgtgatactgtagggtttcagaatggctttctgtttgggaaagcaagacttgctgttaaaaggctacagtatatattgtgactacaggaagacaatttggtttaaaatcacactgagtacatctcaatatacacatcataaggttcattcggatctaaatagtgcagagaaaaaggctattcttcttcaaaaataaaaataaaagcagcaagccatactgatcctcatccaatatgccaacagctcrgatgctgccattaataaggaaacaaacctgtaagttactaaataaaaaaaaaaatcaacacaataccatttataatatttcaacactacctcaatctctgtacagacagtgccaaagagaacctatttttgaaatgctcttagtaaactcaagcgagtttcattgagagaaaagtcttcgagcagtgctttgcagatcctggcatccttgggccggatggccgttagtgttgcaaacccaggaagccttctctcctcctctcccttcgtctacggagcatgttgttaaacccctcaggat

SEQ ID NO: 105164 - DNA, 601 bp, Human
agggttcaaatctcggctctactaccacttaagcagctgtgcaagaggctccacgtctccgaacctcaagtgtcctcatctgtaaagtgttgagaagaatagcaccttcttcacaaggctgttagcaggcggagattacgaacaatgctgagggctcggtatacagtagctcctctgctgttcctcgttttgttttcaattgttgaccgaaaagaaggaagggagactggcaggagacgcaggagcggcgcgccccgcaaagtcagggaggttcctcggcctcacctctggactcccctcrgaatggtccgcaaggacggggccagagccccccaaatctctaagcggtggaggggagctgaacggctccagcttgggatttgggactcaggacggccgaggaacccgtgaaggccgcgaccgtggccttcaccctgctaggcctcctcagtaccaacactcaccatgattgcggcggtggctgctccaggtctcggacgtggcagctcccggcggcgcctcggaacagctcacttccggcgccgggcccgacgggccgtggcgtaggagcctccgggcagcaacgcgctcggctcgcaca

SEQ ID NO: 105165 - DNA, 601 bp, Human
aaaagaatgcatgtactagatattccaggctcagcccagatacttccattctttagttctccttcagtcattcattcactcaaggagtaagtgtggagtgaatgtacactgcagatgccacagagacttaaaaaaccctgagcccctgccttcggagggtcgttcaggccatctttacgtttcccgaggtgcccatcctacctgggggccctaccccgagcaacagttcaatcatctctgctgggagctgcagtaggcggcagaaaggaatggttaggagggttcaaatctcggctctacyaccacttaagcagctgtgcaagaggctccacgtctccgaacctcaagtgtcctcatctgtaaagtgttgagaagaatagcaccttcttcacaaggctgttagcaggcggagattacgaacaatgctgagggctcggtatacagtagctcctctgctgttcctcgttttgttttcaattgttgaccgaaaagaaggaagggagactggcaggagacgcaggagcggcgcgccccgcaaagtcagggaggttcctcggcctcacctctggactcccctcggaatggtccgcaaggacggggc

SEQ ID NO: 105166 - DNA, 601 bp, Human
cagggagggtgatattaatacttacaatcatgtcctcatgggaggtatccacagtgttaattactgacacctagaaccaaagatatcactggtaaattaactcatggcagttagaatacaaccatctcaagttcttgactgcatttgtttgttcactcactcattcattcattcattcagtaagcattcattctaagtaccttctttctgccaagcactgtgctaggaactggatatacagacacaaataagaggaactttttgcccttgagaagctcgcgaataatgctagtgtcgcaarataaattatttaatggtggtttgtgtgtcctgtaggagcctgaggggctggggtggtagacacgaattgagccctagatgatgggtaggaatttgcaggtggcacaggggaaaataccagtccaagcagccaagcagagggaatacacgagtagagacaaagaggtctgagagagcctgatgtgtgtggggaaacggcaagcagtcctggctacccttaaggttgaggagagaccccaagggagctacagctggtgttcctttcctggatgacagagcctctgatgttccaggcagttta

SEQ ID NO: 105167 - DNA, 601 bp, Human
cctgccataccccgagattacaggctgataggcaaccactgcaaagccaccctggatccatgaatgatcaacagaaaggggtaatgaaaaccccaaattgcttccctcccacaaaaatgcccatgtccacacccctccagggagggtgatattaatacttacaatcatgtcctcatgggaggtatccacagtgttaattactgacacctagaaccaaagatatcactggtaaattaactcatggcagttagaatacaaccatctcaagttcttgactgcatttgtttgttcactcactcaytcattcattcattcagtaagcattcattctaagtaccttctttctgccaagcactgtgctaggaactggatatacagacacaaataagaggaactttttgcccttgagaagctcgcgaataatgctagtgtcgcaagataaattatttaatggtggtttgtgtgtcctgtaggagcctgaggggctggggtggtagacacgaattgagccctagatgatgggtaggaatttgcaggtggcacaggggaaaataccagtccaagcagccaagcagagggaatacacgagtagagacaaaga

SEQ ID NO: 105168 - DNA, 601 bp, Human
tcctgcagccctgtcctcttatactgagccttgtgtttacctctcaggaaatgccctgagtgtggacttctggttcaaagggccttgtctggcctattgtcttggtggtttgactgggctctgcctggggctttcactgtggctgccctctgcctttgtattgagtcatctttctacactctcttcttttcacccccctttccagtggggctaagaagtgacagcaggaggaagacaggtgggaagactattgtcaagcctccgtacccactcagccttcatccgagagcaggttattgtrttggctggaagactgacagcctagaactacaaattattcccaggttcctcccagcagagagtgattagactgccacagtcctgacaactcagagggcactgctagggagcctgccataccccgagattacaggctgataggcaaccactgcaaagccaccctggatccatgaatgatcaacagaaaggggtaatgaaaaccccaaattgcttccctcccacaaaaatgcccatgtccacacccctccagggagggtgatattaatacttacaatcatgtcctcatgggaggtatccacag

SEQ ID NO: 105169 - DNA, 601 bp, Human
atctccttagtttacctgctgtgcaaactttgaaaacacttcatctccttgagcttcagtttccttatctttattatttaccaacatcctatgggccttagttcccttatctttaaataaggctaaagatagcatctgtctcaacagttgttatgaaggttaaacaagatattgaatgaaaactcacgcctgtaatcccagcactttgggaagctgaggcgggcggatcacctgaggtcgggagttcgagactagcctgaccaacatggagaaaacttgcctctactaaaaatacaaaatyagctgggagtggtggcgcacgcctgtaatcccagctactcgggagtctggggcaggagaattacttgaacccgggaggcgtaggttgcggtgagctgagatcacgccactgcatgccagcctgggctacaagagcgaaactccatctcaaaaaaaaaaaaaaaaaaaaagaaaagtacttagcatggggcctgacactcagtgagcatgcaaatgtttgtcattactacttggcctcatctagttctcaaaccaaactcatacgagtaggtagcatatccattatttttcccgtaagtaa

SEQ ID NO: 105170 - DNA, 601 bp, Human
tgtatcaggccttggtttcttggagggcaggcagtagaggagtgtttctgaagcacttctcatgcttctcagtggaaggaggcaggacatagtacctttcagatctaaatcctatctccttagtttacctgctgtgcaaactttgaaaacacttcatctccttgagcttcagtttccttatctttattatttaccaacatcctatgggccttagttcccttatctttaaataaggctaaagatagcatctgtctcaacagttgttatgaaggttaaacaagatattgaatgaaaactcacrcctgtaatcccagcactttgggaagctgaggcgggcggatcacctgaggtcgggagttcgagactagcctgaccaacatggagaaaacttgcctctactaaaaatacaaaattagctgggagtggtggcgcacgcctgtaatcccagctactcgggagtctggggcaggagaattacttgaacccgggaggcgtaggttgcggtgagctgagatcacgccactgcatgccagcctgggctacaagagcgaaactccatctcaaaaaaaaaaaaaaaaaaaaagaaaagtacttagcatgg

SEQ ID NO: 105171 - DNA, 601 bp, Human
agccctggccctggatcctttgtggacctttgttttggggcttctgctcgaccttttccctagtagtgtgcccagagcttcccagactttccacccaaggaacacaatgccttaagtgtcgctgctctcaccacttgtgaaccgaattccttgatgctgactgagcatgcagaactaggcctggcccctacctgcagatccttgtccgcagggtgatggtctctgaggcaccatgcctcctgcaccactgaacaccctggtcccttctgcttgctggccctgcctattccaatggatgtcmctttccccagctgtcccaccctgggagtttcaggactatcagctgcactcccatggccaccaggggcaattatgcccattcaaaggcactcattctgtctggctcagatgggaattctcacctccctacgcaaggaacacatcctgatttttctttgggaactccctccactgtatcaggccttggtttcttggagggcaggcagtagaggagtgtttctgaagcacttctcatgcttctcagtggaaggaggcaggacatagtacctttcagatctaaatcctatctccttagtttacc

SEQ ID NO: 105172 - DNA, 601 bp, Human
acgtgccacgggcatataggcagaacaatgggatttataaaatgatagcattcttacattattcttacggtgatgcttttgtgacactttaggtcatactggctaaacttgaacgaaatggtactgtttaccacttttaaaagtagcagtagctgcctgcactaaagacttactgtgtcctgggccctgtgtcagggccttgcatacactagctggataggaggtagcattggcccaattttgaggatgagcagatgaaggctctgagagagaaactgagtcacttgcccaaggtcttctrgtgggtacacataaagtggcagagctgagattcacacctgtatccacctgtgcccttaacagcatcatccctggggacgtccgctgaggacagccaggctggctgggatcccagcgtcctctccgctaaatgtgctttggggttgctctgaatctgggctcccatgctttgctcccacgcttgaagcagggcctgagaacccacaccattcctggagcccttccctgggctcgccagcacttaccccctgaggtcggcgataaggatctgccctccattgcgcacatcaaagattttgac

SEQ ID NO: 105173 - DNA, 601 bp, Human
tttgtaaataatcactgaacacgtgccacgggcatataggcagaacaatgggatttataaaatgatagcattcttacattattcttacggtgatgcttttgtgacactttaggtcatactggctaaacttgaacgaaatggtactgtttaccacttttaaaagtagcagtagctgcctgcactaaagacttactgtgtcctgggccctgtgtcagggccttgcatacactagctggataggaggtagcattggcccaattttgaggatgagcagatgaaggctctgagagagaaactgagwcacttgcccaaggtcttctggtgggtacacataaagtggcagagctgagattcacacctgtatccacctgtgcccttaacagcatcatccctggggacgtccgctgaggacagccaggctggctgggatcccagcgtcctctccgctaaatgtgctttggggttgctctgaatctgggctcccatgctttgctcccacgcttgaagcagggcctgagaacccacaccattcctggagcccttccctgggctcgccagcacttaccccctgaggtcggcgataaggatctgccctccattg

SEQ ID NO: 105174 - DNA, 601 bp, Human
tctttgttaacacttcaagcaacaaaccctagcggcaggtctaataaccactgtaatttcaaagttgtgatgagcataagtggtattttgaggtagctaagtaaccgtgatgtgtgatgacaatatctgtgacttctactggtgacaaagtgacaggcactacaaatactactgaagtttctggcctacatccataattgaaggaaatgctaaatatcagagtcactgaaaatgcatttttttccccctgtcccaattcatcaacccctgaactctattcacagaacccttggagatccayggcacccaggcaaacccacaaatacgtgaaaggcagtgagctgagggaaagcagtagagatgtggccataaaaatgagccaggacttcctcaagaatctcagtagggagcagggcaggtcaaacatttgtaaataatcactgaacacgtgccacgggcatataggcagaacaatgggatttataaaatgatagcattcttacattattcttacggtgatgcttttgtgacactttaggtcatactggctaaacttgaacgaaatggtactgtttaccacttttaaaagtagcagtagctg

SEQ ID NO: 105175 - DNA, 601 bp, Human
gaattaaactcataaaatatccaataatcatacagatgcatgacagcaaacgatgtggcattagtcatatgagccccccacattggttattgttggtttttgaactgtgtggtggtaggaggtaggacattgatgttcgctttgcaaacatttattccttgattgaaccaccaacatcacgaccactgtcactcgctgattcaccaaaagttgggtaaagaatgaccttgtttatattaatctttcttaaatgtatgcatagctcacatactttttaaaagttttaataacaccactccawtctacagggtcccaatgactactgcagggcatgtcacctggaggcaaccatagctaaggtggcagtgagcaggctgctgctgcaccagccctcccctgcttgggagcacacaacaaggaagcagtgccaagccctgcctggtctggcttcagggcagagaggctcaaagctgctctagagcaatcatgtctggtcagctgaccactccccggcccactgtccagcggggaccctcccgtgccaccctctagggaggctgcagcagacacggggcaaggcaggcgctctcactgcacgaaa

SEQ ID NO: 105176 - DNA, 601 bp, Human
accctgaactggaatgagtagattagaaaaagaatagatacaaattattgtagaattaaactcataaaatatccaataatcatacagatgcatgacagcaaacgatgtggcattagtcatatgagccccccacattggttattgttggtttttgaactgtgtggtggtaggaggtaggacattgatgttcgctttgcaaacatttattccttgattgaaccaccaacatcacgaccactgtcactcgctgattcaccaaaagttgggtaaagaatgaccttgtttatattaatctttcttwaatgtatgcatagctcacatactttttaaaagttttaataacaccactccattctacagggtcccaatgactactgcagggcatgtcacctggaggcaaccatagctaaggtggcagtgagcaggctgctgctgcaccagccctcccctgcttgggagcacacaacaaggaagcagtgccaagccctgcctggtctggcttcagggcagagaggctcaaagctgctctagagcaatcatgtctggtcagctgaccactccccggcccactgtccagcggggaccctcccgtgccaccctc

SEQ ID NO: 105177 - DNA, 601 bp, Human
ttcaatggtacgtctgcattgtcccagtgtgagtgtgggggtgtgtgtgagtgctcctctggtggaatggtatcctgtccagggctggcttctgcctcatgccctaagctgccaggacaggctccaaccacctgtgaccctgaactggaatgagtagattagaaaaagaatagatacaaattattgtagaattaaactcataaaatatccaataatcatacagatgcatgacagcaaacgatgtggcattagtcatatgagccccccacattggttattgttggtttttgaactgtgtggkggtaggaggtaggacattgatgttcgctttgcaaacatttattccttgattgaaccaccaacatcacgaccactgtcactcgctgattcaccaaaagttgggtaaagaatgaccttgtttatattaatctttcttaaatgtatgcatagctcacatactttttaaaagttttaataacaccactccattctacagggtcccaatgactactgcagggcatgtcacctggaggcaaccatagctaaggtggcagtgagcaggctgctgctgcaccagccctcccctgcttgggagcacaca

SEQ ID NO: 105178 - DNA, 601 bp, Human
tacacgctatgatatggatgaaacttgaactcattatagtaagtaggagaagccagtcacaaaagaccacagattgtctcattctatgtacaactgatcctcaatttcatttcattataatgctgacaagattaaaaaaaaaaaaacaactcccagcgggggcccctgcctgtgtggagtctgtgtgttctccctgtgtctgcgtgggctctctcctggtactctggtttcctttcacacaataaagatgtgcatgttcacttcaatggtacgtctgcattgtcccagtgtgagtgtgggkgtgtgtgtgagtgctcctctggtggaatggtatcctgtccagggctggcttctgcctcatgccctaagctgccaggacaggctccaaccacctgtgaccctgaactggaatgagtagattagaaaaagaatagatacaaattattgtagaattaaactcataaaatatccaataatcatacagatgcatgacagcaaacgatgtggcattagtcatatgagccccccacattggttattgttggtttttgaactgtgtggtggtaggaggtaggacattgatgttcgctttgcaaacatt

SEQ ID NO: 105179 - DNA, 601 bp, Human
ttaaaaacatatgttcatgcaaaaacttatctgcaaatgttcatagcagcattattcataaggccgagaacatccatcatctgatgaatggataaacaaaatgtctatattcacaatggagtattatccagccataaaaaggaatggagtgctgatacacgctatgatatggatgaaacttgaactcattatagtaagtaggagaagccagtcacaaaagaccacagattgtctcattctatgtacaactgatcctcaatttcatttcattataatgctgacaagattaaaaaaaaaaaaacaactcccagcgggggcccctgcctgtgtggagtctgtgtgttctccctgtgtctgcgtgggctctctcctggtactctggtttcctttcacacaataaagatgtgcatgttcacttcaatggtacgtctgcattgtcccagtgtgagtgtgggggtgtgtgtgagtgctcctctggtggaatggtatcctgtccagggctggcttctgcctcatgccctaagctgccaggacaggctccaaccacctgtgaccctgaactggaatgagtagattagaaaaagaatagatacaaattatt

SEQ ID NO: 105180 - DNA, 601 bp, Human
cctctttatttattattaacaatttttttttttaaaaattgagacagggtctcactgtcacccaggctagagtgcaggctggtaagatcatggttcactgcagcctcaaacttcgtaggctcaagtgatcctcccacctcagactcccaaagtactgggattataggtgtgagccactgcctttttttttttttgagacagagtctggctctgttgcccaggatggagtgcagaggcgcgattttgactcactgcaacctccacctcccaggttcaagtgattctcctgcctcagcctccygtgtagctgggactgcaggtgtgtgccaccacgcctggctaatttttgtatttttagtagcgtcggggtgtgttagtccattttcacgctgctgataaagacatacctgagactgggcagtttacaaaaaaaagagaggtttaatggacttacagctccatgtagctggggaggcctcacaatcatggcagaaggcaagggaggagcaagtgacatctcacatggatggcagcaaaaagggagagagagcctgtgcaggtgaactccccttcataaaaccatcagatcttgtgagactta

SEQ ID NO: 105181 - DNA, 601 bp, Human
tgccagcagcgagaaaacagactaatacaaggtcaaaaaggaaaggctggataaacgcttgattctttctgaactggttctatcactttccaaagatgactgattctcctctttatttattattaacaatttttttttttaaaaattgagacagggtctcactgtcacccaggctagagtgcaggctggtaagatcatggttcactgcagcctcaaacttcgtaggctcaagtgatcctcccacctcagactcccaaagtactgggattataggtgtgagccactgcctttttttttttttgagacagagtctggctctgttgcccaggatggagtgcagaggcgcgattttgactcactgcaacctccacctcccaggttcaagtgattctcctgcctcagcctcccgtgtagctgggactgcaggtgtgtgccaccacgcctggctaatttttgtatttttagtagcgtcggggtgtgttagtccattttcacgctgctgataaagacatacctgagactgggcagtttacaaaaaaaagagaggtttaatggacttacagctccatgtagctggggaggcctcacaatcatggcagaa

SEQ ID NO: 105182 - DNA, 601 bp, Human
ttttctgcacaagctctctcttttgcctgctgccatccacgtaagctgtgacttgttcctccttgccttctgccatgactgtgaggtttccccagctacgtggaactgtgagttctccatcctctttcctttgtaaattgctcagtcttgggtatgtctttgccagcagcgagaaaacagactaatacaaggtcaaaaaggaaaggctggataaacgcttgattctttctgaactggttctatcactttccaaagatgactgattctcctctttatttattattaacaatttttttttttwaaaattgagacagggtctcactgtcacccaggctagagtgcaggctggtaagatcatggttcactgcagcctcaaacttcgtaggctcaagtgatcctcccacctcagactcccaaagtactgggattataggtgtgagccactgcctttttttttttttgagacagagtctggctctgttgcccaggatggagtgcagaggcgcgattttgactcactgcaacctccacctcccaggttcaagtgattctcctgcctcagcctcccgtgtagctgggactgcaggtgtgtgccaccacg

SEQ ID NO: 105183 - DNA, 601 bp, Human
tcccaacagtgtgtgcatttttctgcagtgtgcgctaaaagtagaaattaagaactcccacaagtttaagaaacaggacattttctaaacacatgaaagaatggtacattggagcttttttttaagaaaaatcttttattataaagtaatagatcaagaaacaaaaattctgccacctgcctgaaaagccctgtcattatgcccttcctaatcacagctccctcttccactataagtaaccactgccctaacttctaacccattttccccccattttatcacccaaatgtgcacccctagwtactatagtttagtcttgtccattaaacatttttttggatgttttttacatctcctactttgcagattcctcctctgatttttttccttacaatttttctgctgaagagagcctagtctctcggtctgggttttgctgcttcatatgcagttcaatatgttcctctgaattcctgaaaactgtcagctggagccaagactggacagactcaggtgtgatccctttggcaagactagagctggtgcgttctctcatcaggaggcacgttagattgtctcttatattaacagctgtcaataa

SEQ ID NO: 105184 - DNA, 601 bp, Human
cttgcaagagaacactgcttctgcagacccaagcctgctgtccctctcccctccgcttctcaggactggagtgtgtgtgaaggctgacatgaagcactcatcatggggtccactgctcagaattctccctcaaggatcccaacagtgtgtgcatttttctgcagtgtgcgctaaaagtagaaattaagaactcccacaagtttaagaaacaggacattttctaaacacatgaaagaatggtacattggagcttttttttaagaaaaatcttttattataaagtaatagatcaagaaacaaraattctgccacctgcctgaaaagccctgtcattatgcccttcctaatcacagctccctcttccactataagtaaccactgccctaacttctaacccattttccccccattttatcacccaaatgtgcacccctagatactatagtttagtcttgtccattaaacatttttttggatgttttttacatctcctactttgcagattcctcctctgatttttttccttacaatttttctgctgaagagagcctagtctctcggtctgggttttgctgcttcatatgcagttcaatatgttcct

SEQ ID NO: 105185 - DNA, 601 bp, Human
ctcatgcctgccaagtcacttccactggccgtctataccttctcaactgaatgggcagagctctccaaaaaccaagctccaagaatgagaaggcacaagtaaaaaagcacaaaaatcccaagtttagaaccaaaccaaacaggttcccatgatgtgaaaggcctagctggctccctctagggtggtggtgtataactgaaggctcacccttggccgtccttgctgtctgggaagggtggcttggtagctaagcgtataattcccatccaaccccatcgttgcttgggaacacttggaactrcacctgggcacctcggcgccctagtctcacatgggtcagaagggaaaattcatcccgaatccgcctccttcttggtgccggttctgttgtagctgtctcatctcagtggaggcaggccacttgtggcttctgaccaagacttccccacacaatgacctgactccctgtgctctgggccaaaggtgcctgttgctctccctttaccttcccagaggactttctgctaaggagactaagagctgatgggcctgactcgagactaaatgacaagggatactcatggccctgggctgacctggg

SEQ ID NO: 105186 - DNA, 601 bp, Human
cactggttaagagtctcccggattccttttctcatccgggtttcggaggtggactctgtctgcattgctaactcagattttctctggggttttcctcatgcctgccaagtcacttccactggccgtctataccttctcaactgaatgggcagagctctccaaaaaccaagctccaagaatgagaaggcacaagtaaaaaagcacaaaaatcccaagtttagaaccaaaccaaacaggttcccatgatgtgaaaggcctagctggctccctctagggtggtggtgtataactgaaggctcayccttggccgtccttgctgtctgggaagggtggcttggtagctaagcgtataattcccatccaaccccatcgttgcttgggaacacttggaactgcacctgggcacctcggcgccctagtctcacatgggtcagaagggaaaattcatcccgaatccgcctccttcttggtgccggttctgttgtagctgtctcatctcagtggaggcaggccacttgtggcttctgaccaagacttccccacacaatgacctgactccctgtgctctgggccaaaggtgcctgttgctctccctttacct

SEQ ID NO: 105187 - DNA, 601 bp, Human
gtcagatgggaatgtcaagtgccctctctagtgggcggggtgaagaccaacaggctgtgtccaccatgccacggggaatgggtatgtaccttattgtctccaccagagacagccaggatgttggctgtgatggaccagctcacatgccacaccacatcgttgaacttgtgcaacaatttaggggaccacgtattgcttgaggcatcatcacaggtccaaatgaacacacgaccatcctaggaagaaacaggatagagtcaggaggtggagtcaagactcctgcgtttgtgatgtgatgtcytcccagtctagagccacccggcacctctctgcaggaacagggtgggggattcaaaggggagccgaggacctctggggcgtccacagctttgtttctgtctcttcacactggttaagagtctcccggattccttttctcatccgggtttcggaggtggactctgtctgcattgctaactcagattttctctggggttttcctcatgcctgccaagtcacttccactggccgtctataccttctcaactgaatgggcagagctctccaaaaaccaagctccaagaatgagaaggcacaagta

SEQ ID NO: 105188 - DNA, 601 bp, Human
aactcttccagtgcacccactgtgtacctgcctcttaccagcataacaagtattcataaactctaaaggtttttaaaaagccttttcagtgttatggacaaaaaatatccccaatcttcttctgtttatgggttcttatacacttgcctttttggcacagctaactgaacatcaccatgaggtgaccaaatgcttagtagggtgatgggcctgactggctctgccacctcatagttttgggacccccatgcaagtcaaatcgcctctgtcagcttctttcctcatctgtgaaagggggacrtgttaatactacctcaggggctgtgacattaatgatgtaactaagaggcacactcaaaacgcagtcctggctaaggctcctgcccagcctgcagtcagatgggaatgtcaagtgccctctctagtgggcggggtgaagaccaacaggctgtgtccaccatgccacggggaatgggtatgtaccttattgtctccaccagagacagccaggatgttggctgtgatggaccagctcacatgccacaccacatcgttgaacttgtgcaacaatttaggggaccacgtattgcttgaggcatca

SEQ ID NO: 105189 - DNA, 601 bp, Human
cctgcagaggctctcaagatctgcacacccatgttcacagccacactattcgcaatagctaagaggtggcagcagcccaggtgccctttggtggaggaataagtgtagaaacagggtgtgggctgtctatacaatgcaacactacttagctttacaaaggaaggaattctgacacatgctacgtacagcatggaggaaccttaagggcatactgctagtgacatagtcgcaaaaggacaaatactgtatgattccacttagataggtcgctagagcagtcacattcacatagacagaaagragaagggtggctgccagggctggggaggggcaatggggaagggagttatttaatgggtacagagtttcaattttgcagctgaaaagagttctggagaccagctgcttctctgccttgcctgtgttggttgtgccgtgagccacacaaatgaaaggtaagacatggagccaaagtggccactgggaaacagtaaaagaccaacataggcaagggagagaagcagcaagggctggcaggatccagaccaactcgcacttcaggcgcagagcagatgtgcctgaaaacgcagcacagccactc

SEQ ID NO: 105190 - DNA, 601 bp, Human
gtcactgctcgttctgctggccctctgtcactgatgctgatacggagccctggcccttgttgacatcactgatgcacacccactgcccatcaactgactccttccacagggtcacctgcgagtcagtgcacaagcagattatcacgggtctgtgcccttccctctgctgtcccctaaatatgagcctcatcctcatcaagaaccactgcccagaggcttgtgggtgaacagagcatgtccctcctccactgaaatctcaccaaaatgagagtccaggaataaaaactcacagaaaaaaagragtaacaataacagcagctgtggatgatgatgtcaacacaggatactgttttcagcaaactgtgacagagctacagcgagaggatatggggtggcggggagcagggttcgcaaagtgtggtccccagaccagagcagagcatcggtcacctgggagcttgctacaactgcagattcttggggcctggaacaactgattaggaagctctgggggtggggctggcaatctgttttaacaggtttaacaacactgcagtttgaaaactactgtggtagaggaaggtaacagttcaatatgttg

SEQ ID NO: 105191 - DNA, 601 bp, Human
atcctgggatattagaaccggagagcaccccatctttgtacagaaaactaagcctcagactgatgaaggcactttctagttacacagctagtgaggaagtcattaacaggagagaccctcccgatctagtatcttaacagacactgccttaacaatcattctcttgtttcttttaaccccttctcttcccaggcactgccggaggtattctgaaacacgtccgtctgtgttcccacccatatcttctttcgctttcccatttcctctttcctaaagtcgataccaagatacttgctttcasgttgcacaatttccaaagaggagcttggctgaagaactaggcatgctcagtagccgggtggtcttcctcctcccccacccctccccccctttccttttcttttctcacccacatagaacttaggagctgagggaacctcagacaggtgagccctacaggtagcgaatgtgcccacggaaagttaatctgctacctcttcaggtgaacatttgcaggtctctaggtagacacgtaaatgctcgcaatccatgcccagagcagccccgggtgcataatcagctgcataactgtggggcatgt

SEQ ID NO: 105192 - DNA, 601 bp, Human
cagagaagaaaaaggactttataattcattaaatatgatagccaaatataatgaattagcatgcaagtagatttactatcaataactttctagaattatttccatttatcagtaaactgggatcaaaaactcttccctaaatacactgataaaccacagtttaaaaaagaaaaacttaacacctccctctggatcacccttttttttctgcacacactaaactttggactaatgcctttgtctcattcttccctcttcaactctgctgaaaaagcatagctgtattttctatgcttggcaytgccttcctcaatagcattctaccttcaccccttcaccccatcctgagctctacaaacagtataaatgtgtaccatttagcctgactcttgctcttaagtcatttcttgatttattgtacaagttcctgtttggacacgtgatactcccaaggccaagggaaagtacagaatctgactatttgctgatatgctgggctctattctatccaaagcctaattcactctttgtcagaaacagagattcttagcaagacaaatgagctctttcaaactattaggagatcatgtagaacactaga

SEQ ID NO: 105193 - DNA, 601 bp, Human
ccagtttttaacgggccacagaccaataccagcccatggcccaggggttggggacccctgctttaaagaactttcagtcaaatgtcagttcccaattttattttcaaatacctaaaaaatatcctgaattttctcatgtcccatatcatcaccctactcccgccatcactaccaagcagacctgtagtttatctttttccatcattagatgccagagttctacctatcaagtctctactctcaccttggagcatttcaagatcttgctaagaaccaaattccaaattcatgatcatcactycaaatcatatatcttctctttatgaatttactaattgtttgatgatacattcttcacgattttttatctggatcttttacgattaagatttattgtcttttcaaaatggactgtatattgtcctaagtgataaaccacagttgctttttttaaatccaaaatacacatgaagattgtgtgcatgtttttttctattgtaattctattaattttattgtaattccatacttatgattattatacattgcattgtctttctttgttctgagctgacacgaagcctagaaataacaagtttta

SEQ ID NO: 105194 - DNA, 601 bp, Human
attagattctcataagaagcatgcaacccagatccctcgcatgcacagttcacaatagggttcatgctcctatgagaatttaatgctgccgctgatctgacaggaggcggagcttaggtgggaatgtgagcaatggagagcagcatgtaaattcagatgaagtttcgctcacttgcctgctgctcacctcctgctgtgcagcccagtttttaacgggccacagaccaataccagcccatggcccaggggttggggacccctgctttaaagaactttcagtcaaatgtcagttcccaatttyattttcaaatacctaaaaaatatcctgaattttctcatgtcccatatcatcaccctactcccgccatcactaccaagcagacctgtagtttatctttttccatcattagatgccagagttctacctatcaagtctctactctcaccttggagcatttcaagatcttgctaagaaccaaattccaaattcatgatcatcactccaaatcatatatcttctctttatgaatttactaattgtttgatgatacattcttcacgattttttatctggatcttttacgattaagatttattgtct

SEQ ID NO: 105195 - DNA, 601 bp, Human
gcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagytgacaggtgggggcggcaatgtgacgctcactctgcccgtcaacaaccttgtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccagg

SEQ ID NO: 105196 - DNA, 601 bp, Human
gatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagctgacaggtgggggcggcaatgtgacgctcactctgcccgtcaacaacctygtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcag

SEQ ID NO: 105197 - DNA, 601 bp, Human; identical to SEQ ID NO: 26328

SEQ ID NO: 105198 - DNA, 601 bp, Human; identical to SEQ ID NO: 26329

SEQ ID NO: 105199 - DNA, 601 bp, Human; identical to SEQ ID NO: 26330

SEQ ID NO: 105200 - DNA, 601 bp, Human; identical to SEQ ID NO: 26331

SEQ ID NO: 105201 - DNA, 601 bp, Human; identical to SEQ ID NO: 26332

SEQ ID NO: 105202 - DNA, 601 bp, Human; identical to SEQ ID NO: 26333

SEQ ID NO: 105203 - DNA, 601 bp, Human; identical to SEQ ID NO: 26334

SEQ ID NO: 105204 - DNA, 601 bp, Human
gaggctgggggtggggggcgtgtggaaagatggtccggctctgcaggaccctgaatgctccatccagtgtgggcacctgagacgcagcatttgtcaggaactgcataggcacaggggctgggggctcaccttgcactcaggggttgtgatctgagttgggggttggcgctgggaggagagtaggattctgcagctggtgaggccttccctgctcaaagcctgggagtggtcaggagtgctgggtctggatggaaagtgaggttgtgaacaagtcaaggaatttgatgttttcgctagctcttttttttttttttttttttgagacagagtctcactctgtctcccaagctggagtgcagtgacgcgatcttggctcactgcaacctctgtctcctgggtttaagcaatcctctcgcctcagcctcccgagaagctaggattacaggcatgtgccaccatgcctggcaaatttttttgtatttttagtagagatggggtttcaccatgttgcccaggctgggctcgagctcctgacctcaacaatccacccgccttacaggcgtgagccaccgcgcccggcctagctaactcttttaagtag

SEQ ID NO: 105205 - DNA, 601 bp, Human
cctctcccctccctacctcggaacatcctgtcgtcacacacgattgtccagtgtcatgaaagtttgtaagtgggaaggcaggcagatgatgaattcatcaaacattacagggatgcttttgctgtaagacttcgggatgtagcccgtgtggggctgtttctggggtcccgttcgcctctccaagctcctcctgccattggtaaagatgcagggcatctgaactcgctcttgggctgtgcgggcacttggacctggtcagctccctgtgcagagaacgtggctgtggacgtcactgcccggyattcacgtgccttggttgtgaaagccgttctgtggtgcctgtttgtgtcctgtgagtttatggggaaatcctgaaattgagagctggggaccaagagaactgtgtgcgtcccaccatggaggcgtttgagtgatgctgtcacgaggctctgctaatgccaagaggggaccaatgagctcctctaagggtctaccaccaggtgtccttttacagacctggatggtgaagttcaggcctgaagaggtgaacctgatgcagcaacaaactgctgtttccttcagtgcttgaaggagtgagttc

SEQ ID NO: 105206 - DNA, 601 bp, Human
ggtgtcaggcgtgatgcgtgtgggtcctcagccctgcccaggtgacaggtgtggtgtgcgcgggtcctcagccctgcccaggtgacaggtgtgctgtgtgtgggtcctcagccctgcccaggtgacaggtgtgctgtgtgtgggtcctcaccctgcccaggtgacaggtgtgctgtgtgctgatcctcagccctgtccaggtgacaggtgtgctgtgcacgcgtcctcagctatacacaggtgtcaggcgtgatgcgtgtgggtcctcagccctgtccaggtgacaggtgtggtgtgcgcrggtcctcagccctgcccaggtgacaggtgtgctgtgtgtgggtcctcaccctgcccaggtgacaggtgtgtgtgcgggtcctcagccctgcccaggtgacaggtgtgctgtgtgctgatcctcagccctgtccaggtgacaggtgtggtgtgcgcgggtcctcagccgtgcccaggtgacaggtgtgctgtgtgtgggtcctcaccctgcccaggtgacaggtgtggtgtgtgcgggtcctcagccgtgcccaggtgacaggtgtgctgtgtgtgggtcctcaccctgcccaggtgacag

SEQ ID NO: 105207 - DNA, 601 bp, Human
atacacaggtgtcaggcgtgatgcgtgtgggtcctcagccctgtccaggtgacaggtgtggtgtgcgcaggtcctcagccctgcccaggtgacaggtgtgctgtgtgtgggtcctcaccctgcccaggtgacaggtgtgtgtgcgggtcctcagccctgcccaggtgacaggtgtgctgtgtgctgatcctcagccctgtccaggtgacaggtgtggtgtgcgcgggtcctcagccgtgcccaggtgacaggtgtgctgtgtgtgggtcctcaccctgcccaggtgacaggtgtggtgtgygcgggtcctcagccgtgcccaggtgacaggtgtgctgtgtgtgggtcctcaccctgcccaggtgacagttgtgctgtgtgcaggtcctcacccacccaggtgacaggtgtggtgtacacgggtcctcagctgtgcccaggtgacaggtgtggtgtacgtgggtcctcagccctgcccaggtgataggtgtggtgtgcgcgggtcctcagccgtgcccaggtgacaggtgtgctgtgcacgcgtcctcagctatacacaggtgtcaggcgtgatgcgtgtgggtcctcagccctgcccagg

SEQ ID NO: 105208 - DNA, 601 bp, Human
aacacttcattttacattcaaacaaatgtgcatctggtccccaaatctcttggctctggactgaacgccccttcttggagagtgggccaccccttcaagccacgcccaccatactgggttttgatttctgtagactgaatggagaacataaaagacatctcaggacacggagtgcagcctcctgggttgtttgcagttttcccaggatgctgctaacagtgccactggtatagaggggtgtctggaatgagcaaggctgagtctgagacatgtggatctgtccgagagagtcctgtcagcytggtgctttacaggaaaggcggtggagttaggagcgctcttcctgctgcatggatgtgtctcagtaattacccactcccctgtggttggggattctagtggtttccagttaaatcttcccaaatttgcacaaatccaggatgagtcttaggatgaattcctggaggtgaaattgcctgtgcgcgtgcatgtctgtgagtgcagatgctggtcttttcaggtcgctttcagcacagtgtgaggtatagccgtcaggctttttagctgctgtgtagtcatttacttcctctccttgaaagta

SEQ ID NO: 105209 - DNA, 601 bp, Human
taggctccgtgtctgggagctcttcaggccagcggtggagtcggctagccacgatgacttttgcccggacttaacctcttttttctctaacaaatggaaaagcagttcccattggagtggccagaccaaatcctattctggggtggaaggggatgaaggtggtcagcatcgaggttgatcttgatgccagtccccatcccaggctgtggttccagtggcatttatcacatgtggatgctgatcctggaagccctgcttcgtgtttttgggcatttgttccctggagccctgtttttgctcrctgttgagacagaaaggctgcgcgtcccctcgccccagcctgtcctgagcttgcctcactgtgcatccttgtgggtgggcgtcaaaccccgcacctgagtctgctgcggctctggtgcctgcccggcgccattgtcagggtgggtgtcctgggccctctggataccccctgtctggccggggttgccgctccgttctgaccccaggccaccctggaggagggtttctgagagtgccggtggctcactctgtccttggatgacttgatttttgttaaaatggaaatggaaattctttctaa

SEQ ID NO: 105210 - DNA, 601 bp, Human
ggatgctgatcctggaagccctgcttcgtgtttttgggcatttgttccctggagccctgtttttgctcactgttgagacagaaaggctgcgcgtcccctcgccccagcctgtcctgagcttgcctcactgtgcatccttgtgggtgggcgtcaaaccccgcacctgagtctgctgcggctctggtgcctgcccggcgccattgtcagggtgggtgtcctgggccctctggataccccctgtctggccggggttgccgctccgttctgaccccaggccaccctggaggagggtttctgagagtgccggtggctcactctgtccttggatgacttgatttttgttaaaatggaaatggaaattctttctaaaagggaaaagagtataatgtaaaaacttttccagaagagaaattagattaacatattgttatttttaaagttagctgctatgataaataaatagatgaatggagatggtctccacctcccacaggctggcggtatactcgggcgagggctatggggcggctcttccctgaggccccaggcctggaccccgtcgcgctgtctggcagcgtgtgctgcatttccctctggagga

SEQ ID NO: 105211 - DNA, 601 bp, Human
atgctgatcctggaagccctgcttcgtgtttttgggcatttgttccctggagccctgtttttgctcactgttgagacagaaaggctgcgcgtcccctcgccccagcctgtcctgagcttgcctcactgtgcatccttgtgggtgggcgtcaaaccccgcacctgagtctgctgcggctctggtgcctgcccggcgccattgtcagggtgggtgtcctgggccctctggataccccctgtctggccggggttgccgctccgttctgaccccaggccaccctggaggagggtttctgagagtgccggtggctcactctgtccttggatgacttgatttttgttaaaatggaaatggaaattctttctaaaagggaaaagagtataatgtaaaaacttttccagaagagaaattagattaacatattgttatttttaaagttagctgctatgataaataaatagatgaatggagatggtctccacctcccacaggctggcggtatactcgggcgagggctatggggcggctcttccctgaggccccaggcctggaccccgtcgcgctgtctggcagcgtgtgctgcatttccctctggaggatt

SEQ ID NO: 105212 - DNA, 601 bp, Human
caggccaccctggaggagggtttctgagagtgccggtggctcactctgtccttggatgacttgatttttgttaaaatggaaatggaaattctttctaaaagggaaaagagtataatgtaaaaacttttccagaagagaaattagattaacatattgttatttttaaagttagctgctatgataaataaatagatgaatggagatggtctccacctcccacaggctggcggtatactcgggcgagggctatggggcggctcttccctgaggccccaggcctggaccccgtcgcgctgtctgrcagcgtgtgctgcatttccctctggaggattttcccaccggaacctgtgtgatgtgttgtggaggaagctgtgtgaggcaggggtcccggggcctgaacggctggaccttgctagccctgcgacctcaggtggggactcctggcctctgtgtgctcgcctgtcccacgtgggcggccagctgccctccctacagggcagtgagggagaaaggagggcgtcagctgcttgccacgtcctggctgaacttggatggattcaaaagagtgaacataaggctttgacgaaattaggagcacctc

SEQ ID NO: 105213 - DNA, 601 bp, Human
tctgtgtgctcgcctgtcccacgtgggcggccagctgccctccctacagggcagtgagggagaaaggagggcgtcagctgcttgccacgtcctggctgaacttggatggattcaaaagagtgaacataaggctttgacgaaattaggagcacctcacaggcctgggcgctgtgtaagacctcctcccagccacgaggggctgatctgatcagagctggagggacggccattgccgtgtgtccaatgtgagggctctgagctcaggagccagcatccagacacgctggggactctgcggccyctgtctttgccccagtgttgcacagaggggccctggctttccctgggcactgtttagaatgattgagggggtggcaggtggccagaaacgggagaggtggagtctccgaggcagcaggcctcccctgcaggctgctgcttccaggagggctgcaggcacgaggtgttcaaatgcagcagtgacttcataagaaaagggagtggagccgccgacatttcaggtgagttgtcatcaagagtgcagaatccaactgtgttgggagccacttgctggtgcctggccaagttcccgtctggtccc

SEQ ID NO: 105214 - DNA, 601 bp, Human
gtaagacctcctcccagccacgaggggctgatctgatcagagctggagggacggccattgccgtgtgtccaatgtgagggctctgagctcaggagccagcatccagacacgctggggactctgcggcccctgtctttgccccagtgttgcacagaggggccctggctttccctgggcactgtttagaatgattgagggggtggcaggtggccagaaacgggagaggtggagtctccgaggcagcaggcctcccctgcaggctgctgcttccaggagggctgcaggcacgaggtgttcaaaygcagcagtgacttcataagaaaagggagtggagccgccgacatttcaggtgagttgtcatcaagagtgcagaatccaactgtgttgggagccacttgctggtgcctggccaagttcccgtctggtccctctactccccaccaccccagccctggaaaaccgtgcctgccaggttcataccacacaacccggtgcagcccaccccaaagacagcgggaggcaggatgcaagcacctttttaacggctgtggaactgatgtatgggttttccaggcagttttgcatttgtgcctgttgtaga

SEQ ID NO: 105215 - DNA, 601 bp, Human
gaaacgggagaggtggagtctccgaggcagcaggcctcccctgcaggctgctgcttccaggagggctgcaggcacgaggtgttcaaatgcagcagtgacttcataagaaaagggagtggagccgccgacatttcaggtgagttgtcatcaagagtgcagaatccaactgtgttgggagccacttgctggtgcctggccaagttcccgtctggtccctctactccccaccaccccagccctggaaaaccgtgcctgccaggttcataccacacaacccggtgcagcccaccccaaagacagygggaggcaggatgcaagcacctttttaacggctgtggaactgatgtatgggttttccaggcagttttgcatttgtgcctgttgtagactagagcatcatttggtgtttttctgctggaaaagcaggctttagagtggtggctgaaagtctcattatagattatatagattagagcagcctctcctgggagagggatgctgggtgcctgccttccaagtgtctgctcatgagtggatgggccccaccctctgtgcctgctggggcttcagaatccactggtttcctgaaggttctggtgcc

SEQ ID NO: 105216 - DNA, 601 bp, Human
agcaggcctcccctgcaggctgctgcttccaggagggctgcaggcacgaggtgttcaaatgcagcagtgacttcataagaaaagggagtggagccgccgacatttcaggtgagttgtcatcaagagtgcagaatccaactgtgttgggagccacttgctggtgcctggccaagttcccgtctggtccctctactccccaccaccccagccctggaaaaccgtgcctgccaggttcataccacacaacccggtgcagcccaccccaaagacagcgggaggcaggatgcaagcacctttttarcggctgtggaactgatgtatgggttttccaggcagttttgcatttgtgcctgttgtagactagagcatcatttggtgtttttctgctggaaaagcaggctttagagtggtggctgaaagtctcattatagattatatagattagagcagcctctcctgggagagggatgctgggtgcctgccttccaagtgtctgctcatgagtggatgggccccaccctctgtgcctgctggggcttcagaatccactggtttcctgaaggttctggtgcccccgaagcacagccccacctccctaacc

SEQ ID NO: 105217 - DNA, 601 bp, Human
agtttgtttgcattggagcctcgccccctccaggctgctggagtctggtctcgctgatgcgccctcacgtactccaccctgttgatgggctgccctggctgaatgttcatccttcgaaaccctcaaaggtgttgggtgttggggcctttgggagtgactagaattgagtgagggcacgcgggtgtagtcccccctgccctgttggatcagtgtcctgatagccagtccccacggcgagcctgcccttttcccaccttgcgaggcccaaggaggaggtagtaggtgcagcctggaagctggytctgccctgacctcccgcttccacatccaggaccgtgagagagaatccttgcacttagggctccaggactacgagagagaacccaggaccgtgagagagaacccaggaccatgagaaagaacccaggaccgtgaaagagaacccttgtgcttagggcttcaggactgccagagagaatccttgtatgtagggctccagaaccgtgagagagaacccaggactgtgataaagaatccttgcacgtagggctccaggaccatgagagagagcccaggaccgtgagagagaatccttgtatgt

SEQ ID NO: 105218 - DNA, 601 bp, Human
cgtagggcagctcgctggtggcttcctcagggtgagccagcaaggtcagagtcggtctcttgaggccaccctcaccctcaccaggctctggtgcttggtgggagcagggcagggcagcccacttgggggcccctgcagggccagggcactggaagggatggctagggccaccggaggtcgtccctgagctctggggttgtgtttgttcccaggtgtgctctccagggtccaggaggactcgtgggagctcgaggctggggtcccaggcccggccccagaggaagggcctgtggccaggtgsgcggaaggtgctggctatttgtggtgggcaacccaacagccaaaagggaggagcagagagagttctccgcaggagttgatgggggagcagacagagttacccgcaggagttgagggaggagcggatggagttacctgcaggagtcgagggaggagcggagagagctactccctctgtagctctgagaggaggacagagctactccctctgtagctctgagaggaggacagagctactccctctgtagccctgtagcggacagaggagggacggagctacccgcaggagtcgagggaggag

SEQ ID NO: 105219 - DNA, 601 bp, Human
ccaggctctggtgcttggtgggagcagggcagggcagcccacttgggggcccctgcagggccagggcactggaagggatggctagggccaccggaggtcgtccctgagctctggggttgtgtttgttcccaggtgtgctctccagggtccaggaggactcgtgggagctcgaggctggggtcccaggcccggccccagaggaagggcctgtggccaggtgcgcggaaggtgctggctatttgtggtgggcaacccaacagccaaaagggaggagcagagagagttctccgcaggagttgakgggggagcagacagagttacccgcaggagttgagggaggagcggatggagttacctgcaggagtcgagggaggagcggagagagctactccctctgtagctctgagaggaggacagagctactccctctgtagctctgagaggaggacagagctactccctctgtagccctgtagcggacagaggagggacggagctacccgcaggagtcgagggaggagcggacagagttacctgaaggagttcagggaggagtggatggagttacccacagcagtcgagggagaagcggatggagtta

SEQ ID NO: 105220 - DNA, 601 bp, Human
tgtgttgggctgcatgcagaggtgtcctggaccacatgcagcctgcaggacacaggtcggataagcctggtttatactctagtggggagctgttagcaatggaaatggtcagttgttcagtagattagaaagtgcagagaagagcagggcagagaagggtgagacagcgtggggtccaggtgtatgccccacctggctgctgtgtgttgcttgctgaccccctcatgggccttcgagtgtaagggagagtcctcttcatgccctcgcaccctcctgggtctctagggcttgtgtgtccccrggggaggagccccctggacacaccctggcgggtgctggctggcaaagagggaggcgttgagggcccgggcagcgcctccatcctggccaggcaagtgcagcttcaggttgtgagaaccgtggtcacctgtgtgttttaaagatgacggcagtgataggtccccttttgggcctggcatggaaattagtcacattcgtagaccctgtcacagagtgggcactggtgatgtcatcttttatagttcttattttcaattgattcagctttttctagcagcatggcgtgttttacgaacgtgtg

SEQ ID NO: 105221 - DNA, 601 bp, Human
aatagaaattaaggttagttttagccaaggagcacctttgctgttggcttatatgttaatgtgtttagcaccttgaggtgtccttactggcaggtagggttgcatcttgagtgtaaagatttaacaggaaaataagtccagtgcacatgtcttaaaattaatagcaatttcagcaatatgttaaaaacacgaagctaggccaggcgtggtagcttacacctgcttgagcccaggagttcgagaccagcctgggcagcgtaatgagacctcgtctctactacaaataaaaaaaaattagccrggcatggggtgcatgcctgtcccagctactttggaggctgaggtgaaaggatggcttgaaccgggaaggtcaaggctgcagtgagctgagatcttaccactgcaccctagcatgggtgacagagtaacagcctgtctcaaaaaaaaaaaaaaaaaaaggcaaattaaactatttgtgttttggtggtgcttgttactgagttcctgtgggtcacagcccacaagaaatgcaaggaggacccacatgagggtctttcctacagctccttacatgctcaagctggtaattgtggtctagtag

SEQ ID NO: 105222 - DNA, 601 bp, Human
agtgcacatgtcttaaaattaatagcaatttcagcaatatgttaaaaacacgaagctaggccaggcgtggtagcttacacctgcttgagcccaggagttcgagaccagcctgggcagcgtaatgagacctcgtctctactacaaataaaaaaaaattagccaggcatggggtgcatgcctgtcccagctactttggaggctgaggtgaaaggatggcttgaaccgggaaggtcaaggctgcagtgagctgagatcttaccactgcaccctagcatgggtgacagagtaacagcctgtctcaaaaaaaaaaaaaaaaaaaggcaaattaaactatttgtgttttggtggtgcttgttactgagttcctgtgggtcacagcccacaagaaatgcaaggaggacccacatgagggtctttcctacagctccttacatgctcaagctggtaattgtggtctagtagtagctactgaatatcaacccataagaatgacttcatattaaaaaaccacagaggctataattgggtctgtcttagtaagttctaaagtgtcagtagagacccagactcacacccacactcctaagggcaggacacaggg

SEQ ID NO: 105223 - DNA, 601 bp, Human
gagtcatgaactgcaagctcttggtaggttttggacgggacgtggctggctgagcttcctcttggctgtgtggagcctcagcagggcgttgtgtttgacggcaaatgggaattaaatcatggcatcgtcactgtcttttttagggacgatgctgcacttagttcttgcgactcttcctgttgtcagttggggcgggggggcgtcataacattctttcctgtccttgggggtcaccttccaggaaaggggtgggtgtcagagagtgagtgtggctttgaaaggctggtgttgagtgggatcycgtttttcaggtgatggtgccagtgatctttccgtgcggaactaagtttatgcagggttcaagatccattcaaagataaattcagtgacgacctggttgatgaaaagaaccactttttttttaatgttctagagaaaactctttaactgctgtattacttatctattgctgtgaaacagacaaatgtagtggcttaaaacaacaataagctgtcttctcccacacagcggctgtgggtcaggagtttgggagtggctcgattgggtgctgctgtcctggattctcatgcagttgcagttg

SEQ ID NO: 105224 - DNA, 601 bp, Human
aatcatggcatcgtcactgtcttttttagggacgatgctgcacttagttcttgcgactcttcctgttgtcagttggggcgggggggcgtcataacattctttcctgtccttgggggtcaccttccaggaaaggggtgggtgtcagagagtgagtgtggctttgaaaggctggtgttgagtgggatctcgtttttcaggtgatggtgccagtgatctttccgtgcggaactaagtttatgcagggttcaagatccattcaaagataaattcagtgacgacctggttgatgaaaagaaccactttttttttaatgttctagagaaaactctttaactgctgtattacttatctattgctgtgaaacagacaaatgtagtggcttaaaacaacaataagctgtcttctcccacacagcggctgtgggtcaggagtttgggagtggctcgattgggtgctgctgtcctggattctcatgcagttgcagttgagatgttgcccagctctgcaggcctcaaggccagggtctgggagtctgcttccaagatgtctcaccctcgcagcagtagcaggaggagccctcagcaccaggaccacctcaggg

SEQ ID NO: 105225 - DNA, 601 bp, Human
agagtgagtgtggctttgaaaggctggtgttgagtgggatctcgtttttcaggtgatggtgccagtgatctttccgtgcggaactaagtttatgcagggttcaagatccattcaaagataaattcagtgacgacctggttgatgaaaagaaccactttttttttaatgttctagagaaaactctttaactgctgtattacttatctattgctgtgaaacagacaaatgtagtggcttaaaacaacaataagctgtcttctcccacacagcggctgtgggtcaggagtttgggagtggctcrattgggtgctgctgtcctggattctcatgcagttgcagttgagatgttgcccagctctgcaggcctcaaggccagggtctgggagtctgcttccaagatgtctcaccctcgcagcagtagcaggaggagccctcagcaccaggaccacctcagggccgcttgagtatcctcacaccgtggcaccagctttcgccagagggcagggagtgacctagcttcagaagttgccccttatttccatcctcctgggggtcacagaagtcagttcagggaggagaaggtggcacggtggtgagtgtc

SEQ ID NO: 105226 - DNA, 601 bp, Human
gtctcaccctcgcagcagtagcaggaggagccctcagcaccaggaccacctcagggccgcttgagtatcctcacaccgtggcaccagctttcgccagagggcagggagtgacctagcttcagaagttgccccttatttccatcctcctgggggtcacagaagtcagttcagggaggagaaggtggcacggtggtgagtgtctgcaggggatcctgtgggaaagcagcgcagtggtgagtgtccgcaggggatcctgtgggaaggcggtgcggtgatgagtgtccaaggcggcgcggtgatragtgtccataggggatcctgtgggaaggcggcgcggtggtgagtgtccgcaggggatcctgtgggaaggcggcgtggtggtgagtgtccgcaggggatcctgtgggaaggcggcgcggtgatgagtgtccgcaggggatcctgtgggaaggcggtgcggtgatgagtgtccataggggatcctgtgggaaggcggcgtggtggtgagtgtctgcaggggatcctgtgggaaggcggcgcggtgatgagtgtccgcaggggatcctgtgggaaggcggtgcggtggttgagtgtccgcagg

SEQ ID NO: 105227 - DNA, 601 bp, Human
tgttgctgcggctgagacagcgcagggcgtcattcatccccctgcctcctgagcccagagcttctccaggagaaagctgaggaaaggggccagccgtgagctgcgggtgcttgccagggatctggtgacacctgggcatgtggctggtggaaccagcaggccaaggctgtggattttgaagtgctgtctgccatttccactttcagaagcatgagttgcataaggaaggggaatgaaagggtttttcctggagcaaaatgatgcttgtggcagacacagttggaaccacagacgatgccaygcttgtgtcagcagtgcgacactggcccacgtgtcgtccttgttctctcctcattgctgccgtcactgtgtgctgcgcatgccctgcagttaccccagagctttatgtcacaacattgaggctggcggagaaagaccggccccttcaccccaccttagacttcctggaagggccgcccgggtccacaacctggcccgttaactccctgggcagctgctggggaggaagaagcactgcccgcaaggaggggctgtgccagtgggtggcggtgacgggggccagtggtttcctggacctggg

SEQ ID NO: 105228 - DNA, 601 bp, Human
ataaagatagtttgttttctctccacccaaagataatgacgtttcagctgtggtgtgggctcttccagaggccggcctcacctgtgctgtttgaggaaagatgggcctaccatggtgcatgccttctgcgaagcaggcacttgccacctttaacgcttcgcgtgtgtattttactagctcttgaggaagagccgtttttcttgtcttggggaatccaggggaggaagtcagctggagaggttgaagccacctcttccagggtcccacggttggtagtttccattttacacctcggagtggygctgtggtttacgttcgtgaaggtgtgtgtgctcacctggttacttcctgggtaaactccttacctgtgctgggtcagggcacgccatttagaagctttgatgtgcgatgcttggcccctcgtgagaggctgtgctgtgtggatctgggattgcgtgcagggtagttcgttgtggtttgttgcgatattcctgggagacaagcttgtggaagagcttgctttgtcccaagacctgtctgcctgcagagcctagtgggtccactgagtgccctggtcgcaacatccacgtggtcgcatcag

SEQ ID NO: 105229 - DNA, 601 bp, Human
taaagatagtttgttttctctccacccaaagataatgacgtttcagctgtggtgtgggctcttccagaggccggcctcacctgtgctgtttgaggaaagatgggcctaccatggtgcatgccttctgcgaagcaggcacttgccacctttaacgcttcgcgtgtgtattttactagctcttgaggaagagccgtttttcttgtcttggggaatccaggggaggaagtcagctggagaggttgaagccacctcttccagggtcccacggttggtagtttccattttacacctcggagtggtrctgtggtttacgttcgtgaaggtgtgtgtgctcacctggttacttcctgggtaaactccttacctgtgctgggtcagggcacgccatttagaagctttgatgtgcgatgcttggcccctcgtgagaggctgtgctgtgtggatctgggattgcgtgcagggtagttcgttgtggtttgttgcgatattcctgggagacaagcttgtggaagagcttgctttgtcccaagacctgtctgcctgcagagcctagtgggtccactgagtgccctggtcgcaacatccacgtggtcgcatcagc

SEQ ID NO: 105230 - DNA, 601 bp, Human
caaatctgtgcttgaatctgtaacaagtttaattgagctgaagagttgaattgcagggattaggaaggaacatattctgcattcatgacatagctgaaaatgttctggttttgagccggcccagcagggccgtgcatttcccctcagctcgccccgcgtgccccggcccccagatccctcccacatgagccttgggacggtcagttctttccctggatcgccggcagcagctcctggacctcccctgccctcacctggtgttgattccaccgcacagacggtggtttttgttgttgttgtyttggagatggagtctcactctgtcgcccaggctggagtgcagtggcgccgtctcggctcactgcaacctctgcctcccggattcaagcgattctcctgcctcagcctccagagtagctgggattagaggtgcccaccaccatatccagctaattttgtatttttagtagagatggggtttcaccatgttggtcagactggtttcgaactcctgacatcatgatccgcccaccttggcctcccaaagtgctgggattacaggcgggagccactgcacccggccacacgtggttattttaaa

SEQ ID NO: 105231 - DNA, 601 bp, Human
tttcgaactcctgacatcatgatccgcccaccttggcctcccaaagtgctgggattacaggcgggagccactgcacccggccacacgtggttattttaaatttgcttttgaatcagtgacacgttcatgtttttaaattttgaagtatgaaaaggtgcagagaggtttccttttttcctcttctgtccatgcaggtgagcaccaatgttcacttccggtgttcgttccagagaattctgtttaacaaatagaatggtttgttggtgtttgcatgtgtctgtgtcaatatgtgtgcatgagygtgtgtgaggaatgtgtgtgtcactgagtgtgcatacgagtgtgtgtgtgcatgagtgtgtgtctgtgtgtatgcgtgaatgcgtgggtatgtgaggagtgtgtgtgtgcatgtgtgtctgcgtgaatgcgtgggtatgagtgtgtgtgtgcatgagtgtgtgtgtgtatgcgtgaatgcgtgggtatgtgaggagtgtgtgcatgagtgtgtctgtgtatgcgtgaatgcgtgggtgtgtgaggagtgcttatcagtgcattgtgcgtgtggagtgtctgtgcgtgtctgttcatgggt

SEQ ID NO: 105232 - DNA, 601 bp, Human
tgaatcagtgacacgttcatgtttttaaattttgaagtatgaaaaggtgcagagaggtttccttttttcctcttctgtccatgcaggtgagcaccaatgttcacttccggtgttcgttccagagaattctgtttaacaaatagaatggtttgttggtgtttgcatgtgtctgtgtcaatatgtgtgcatgagtgtgtgtgaggaatgtgtgtgtcactgagtgtgcatacgagtgtgtgtgtgcatgagtgtgtgtctgtgtgtatgcgtgaatgcgtgggtatgtgaggagtgtgtgtgygcatgtgtgtctgcgtgaatgcgtgggtatgagtgtgtgtgtgcatgagtgtgtgtgtgtatgcgtgaatgcgtgggtatgtgaggagtgtgtgcatgagtgtgtctgtgtatgcgtgaatgcgtgggtgtgtgaggagtgcttatcagtgcattgtgcgtgtggagtgtctgtgcgtgtctgttcatgggttgcatatgtgttgagtgtgcatgtgtgttgagtgtgcatgagttgtgtgagtggatgcgagtgtacctgtgagtttgcgtgtgtgtgcatgcgtgtgagttgtgtgcg

SEQ ID NO: 105233 - DNA, 601 bp, Human
aggctgggcatggtggctcaagcctgtatcccagcactttgggaggccgaggcaggtgtatcacctgaggtcaggagctcaagaccagcctagccaacatgatgaaaccacctctccactaaaaatataaaaattagtggggcgctgtggtacacgcctgtaatcccagctactcaggaggctgaggcaggagaatcacttgaaccctgtaggcggaggttgcagtgagctgagattgctccactgcactctagcctgggtgacagagtgagactctgtctccaaaaaaaaaaaaaaaaagagtaagtgtgtaagtgtacatttgagcgtgcactttcgcagctggtgcgtggagtgtctgtcctctccatgccgtgtggtggctcctgtctgtagtcactgggacccttccagtcacggtttcggtggctgcgttttgctaccttttgttatttgctgccgttttctcgtagagtgctcatgatttttaacatagtaaatccgtggagagcgctcaggtacagatcatggctgtgtgcagtgcaggctcaccgtctgcggcgccaggccgggtccctcgtttgctgctcatctgggagtg

SEQ ID NO: 105234 - DNA, 601 bp, Human
cagcactttgagaggccaaggcgggtggatcgcttgaactcaggagttcaagaccagtctgggtgatgtggcgaaactctgtctctacaaaaaatacaaaaattagccgggtatggttgtgcgagcctgtagtaccagctacttgggaggctgaggtgggaggatcccttgaaccgggaggtggaggttgcagtgagctgagattctacaactgcactccagcctgggtgacagagtgagaccctgtctcaaaaacaacaactactactactaattgaaataacattctatcctgaggtgracaaaaaaagtggtggggagcggcagcctggctgccactggtgcgtctggcctggaatgaccacttggggagctgggtggactctgggacagcggccgctgggacccgggcttccctggtggcaggtgtgccgaggaaaacacacagcatgtggttcagtaataacaaacagcattttcatatgacatctgtgttcatatgaccactttattataatggcatagcataacagcatttaaggaaatcagcctgacggctctatgtatgggtaaatctgaaacacaatgttggcagaattgc

SEQ ID NO: 105235 - DNA, 601 bp, Human
tggggagctgggtggactctgggacagcggccgctgggacccgggcttccctggtggcaggtgtgccgaggaaaacacacagcatgtggttcagtaataacaaacagcattttcatatgacatctgtgttcatatgaccactttattataatggcatagcataacagcatttaaggaaatcagcctgacggctctatgtatgggtaaatctgaaacacaatgttggcagaattgcagaatgcgagccatataatatttgtctgtgtttcagacgcacacaaaaacaatcatttatagcctwaggttcagcacatcctggaaaagtatgaaaaataaagtgagtacgtccctgcaggccctgggagttgcacacagggcagactcggggggaggctgaggatcctggggactgtaattttatttctgctctttatgtctctatgaaacttgaagcaagtatgatgataacagtgaattttaagtgtactggaataaaattgtcatgttattgtttgtatttgaaaagtttctcagtgaatagaaacaagaagcccggctgggcgtagtggctaacacctgtaatcccagcactttgggaggc

SEQ ID NO: 105236 - DNA, 601 bp, Human
acgcacacaaaaacaatcatttatagccttaggttcagcacatcctggaaaagtatgaaaaataaagtgagtacgtccctgcaggccctgggagttgcacacagggcagactcggggggaggctgaggatcctggggactgtaattttatttctgctctttatgtctctatgaaacttgaagcaagtatgatgataacagtgaattttaagtgtactggaataaaattgtcatgttattgtttgtatttgaaaagtttctcagtgaatagaaacaagaagcccggctgggcgtagtggctmacacctgtaatcccagcactttgggaggccgaggcaggcggatcaccagaggtcaggcgttcaagaccagcctggccaacatggtgaaacccttctctactaaaaatacaaaagttagccagtgtggtggcaggtgcctgtagtcccagctactcaggaggctgaggcaggggaatcgctggaacgcgggaggcggagcttgcagtgagccgagatcatgtcactgccctccagcctgggcgacacagtgagactccatctcaaaaaaaaaaaaaaaaaaaaaaaaaaaaaagaagaagc

SEQ ID NO: 105237 - DNA, 601 bp, Human
caagaagcccggctgggcgtagtggctaacacctgtaatcccagcactttgggaggccgaggcaggcggatcaccagaggtcaggcgttcaagaccagcctggccaacatggtgaaacccttctctactaaaaatacaaaagttagccagtgtggtggcaggtgcctgtagtcccagctactcaggaggctgaggcaggggaatcgctggaacgcgggaggcggagcttgcagtgagccgagatcatgtcactgccctccagcctgggcgacacagtgagactccatctcaaaaaaaaaamaaaaaaaaaaaaaaaaaaagaagaagcccacccacccaggtctggccccagaagccactgccactgccctttccagcctgtacgtctgggtgtgggtctgagatgtattcagggaggggccttgctgctcgctgtggtcgggtggctgtgcaagctcagcccctatctccaggcccttctgaagtgctgctcggggccggacagggggtattcaccctcagcctcaggatttctttcttctccctgttactgatgtacgtaccctgccctctgtcccgtagagactcagctggtgaccca

SEQ ID NO: 105238 - DNA, 601 bp, Human
agcccgtggccagtgctagattttccatagccctctgcagctgcccacgtgttgttgtgggagaggtgatggcgcccacagcactcctgtgtgccccagcccatgccatccttccagtaactggagggtggtgggtggggccgcggccccaaccagaggcagcttccttttagtgtcagagctcgaagctcttcatctaacaggggcttcttacgtgatgtggccgagcgttggctgtggccctcctggagacatcaggctgggaagccagagagggatagggccctggccgtggctgtgygtttgccccggggcagtgacagggcagatgctgctcccttggccacgcacaggagaggggaaggtgggcattgggaagtggcgcatcccccctccccaggctgatgctggccaactgatgctgcttctcataatgctgtttcctgtctcgtgtccgccctctgcgtccttgccggtggcagcctactggagacagggagcccacacagaatcctgacctcaccagaaatggggccccaggcacttggtgggcaggtttggctgtgactggagctggtggtgagggacatagccatcacaa

SEQ ID NO: 105239 - DNA, 601 bp, Human
aaaaagtgtgcacttagggcagaagggatgccttaaatcaggagtccccaacccctgggcctgttaggaagctggccgcacagccgcctgagccctgcctcctgtcagatcccagcattaggttctcaggagcgcaaaccccactgtgaacggcacatgcaggatctaggtggcactccgtatgagaatcgaatgcctgatgatctgaggtgggacagtttcttcccgaaactacccccgactccggtctgtggaaaaactgtcttccacaaaactggtccctgataccaaaaaggtgggrgatcgctgctttaaacaccaaggctcactgtgcagccagtgaggaggggagctcctgggggaggagggttggtctcgggcaaggtggacctccggcaggtcctctactgtgggatgcttccacctggagctgttttctaacgactgctggcgtggaagctgcaaaagctttagagtcgaaagactgtgtctgaagccgtgtaaagactgtctggagccgtgtaaagactgtgtctgaagctgtgtaaagactatgtctggagccgtgtaaagactgtgtctgaagccgtgtaaagactgt

SEQ ID NO: 105240 - DNA, 601 bp, Human
gggtgagggagtcgtgagggcggagcccatcctccagagaagccgctgttaaatctaaggggtgggtgtccctggcgcctttcagcccctgcctgcctcctgctcccagaggctcctggatctcctggaaagccctggttggagtgggacccacagcctcccagctttgggcagtacccctcattgtgctgtgaccacttctcccttccagggtctctgcccaccactccagctagcgtggccactgcttccaatacctcctttttttccctaggggcccagctctgaactatccttcccrgcactgtcccatccaccctttggcacctccttggttcctgttttccctgcgcttctgcccacacacgccctccagggcttcagtgtgttgccgtgcctcctctggctgttgagtgtggctcctggtgtagggaagtgaggccgggggcctgctccatgtctgttgaatgggagactggaaggcgtcctgtggcacaggcggccggcccgagttcaccggcttcctgtgcaccaggaaggaaacgcacacacctgtgccaggtccgggagcaaagcctctgtctcgttcctgggagggctg

SEQ ID NO: 105241 - DNA, 601 bp, Human
agtgaggccgggggcctgctccatgtctgttgaatgggagactggaaggcgtcctgtggcacaggcggccggcccgagttcaccggcttcctgtgcaccaggaaggaaacgcacacacctgtgccaggtccgggagcaaagcctctgtctcgttcctgggagggctggctccaggccgcccctgtgatgctgactcagctcacagggctggtgagcagcaggtgatgggtgaggagcagggacagtgctgcggagacacagtgaggggagctgccacgcagggcacgcagaggaaggtgcrggcacccttgcccagcactgcatgggccggatgccgcggggccttccgcagggagcagttaaagcaggagagtaaggagagcttcctgtaagacctggcctccgtaaacaacgcattcccagtgcactggtggctcgttctcagggtgcccctgggtgctgagtcctgtcttccaggaaaggttgttggtgagcaccattgagcacctggtgtgtacctgcctctggctttctcttcttcccaacttacagtgggtttgacctgtgattttgactttaagatggtccaaaagcaacatgc

SEQ ID NO: 105242 - DNA, 601 bp, Human
atgggagactggaaggcgtcctgtggcacaggcggccggcccgagttcaccggcttcctgtgcaccaggaaggaaacgcacacacctgtgccaggtccgggagcaaagcctctgtctcgttcctgggagggctggctccaggccgcccctgtgatgctgactcagctcacagggctggtgagcagcaggtgatgggtgaggagcagggacagtgctgcggagacacagtgaggggagctgccacgcagggcacgcagaggaaggtgcgggcacccttgcccagcactgcatgggccggatrccgcggggccttccgcagggagcagttaaagcaggagagtaaggagagcttcctgtaagacctggcctccgtaaacaacgcattcccagtgcactggtggctcgttctcagggtgcccctgggtgctgagtcctgtcttccaggaaaggttgttggtgagcaccattgagcacctggtgtgtacctgcctctggctttctcttcttcccaacttacagtgggtttgacctgtgattttgactttaagatggtccaaaagcaacatgcattcagtggaaactgcttccactgcccatacga

SEQ ID NO: 105243 - DNA, 601 bp, Human
ttgtaagttcctcgttgtaagtcagttcctcgttgtaagtccactctttgtgagtaggtttgctcctgcctggaggacagcggcacggtgacggcatctgttttggggccaagatccagtgccttgcgtggtcctgggattcctggggaagggagtggacccatgaggtgggttagaatcgtgtgtgggattctccagccccctgtacctgtgcgtgtggtatgcgcggagccagccagcactgcctggcgtggagctggcgggttctcagtctgacatcaactcccggagaatggcatcygctgaactcaacgcaggaagccgtgcggggccagcgcgctctcaggcagcctgagtggcagggtccttttgtcagctgtttggatctcccacgtggcccagtgccccagcagcacacacacacacacacacacacacacgcgtattgaacaaaacaagtttcacaggacatttatccacgcccaggagatttatcttttgtatggcttcattttgcagaaaattcacttgtttgatttcatggcctggtgatccacagaaggccgcactctgatgagtctctgatcatcggagagatgag

SEQ ID NO: 105244 - DNA, 601 bp, Human
ttgtaagtcagttcctcgttgtaagtccactctttgtgagtaggtttgctcctgcctggaggacagcggcacggtgacggcatctgttttggggccaagatccagtgccttgcgtggtcctgggattcctggggaagggagtggacccatgaggtgggttagaatcgtgtgtgggattctccagccccctgtacctgtgcgtgtggtatgcgcggagccagccagcactgcctggcgtggagctggcgggttctcagtctgacatcaactcccggagaatggcatctgctgaactcaacgyaggaagccgtgcggggccagcgcgctctcaggcagcctgagtggcagggtccttttgtcagctgtttggatctcccacgtggcccagtgccccagcagcacacacacacacacacacacacacacgcgtattgaacaaaacaagtttcacaggacatttatccacgcccaggagatttatcttttgtatggcttcattttgcagaaaattcacttgtttgatttcatggcctggtgatccacagaaggccgcactctgatgagtctctgatcatcggagagatgagtgtcaatgaaaaga

SEQ ID NO: 105245 - DNA, 601 bp, Human
atccagtgccttgcgtggtcctgggattcctggggaagggagtggacccatgaggtgggttagaatcgtgtgtgggattctccagccccctgtacctgtgcgtgtggtatgcgcggagccagccagcactgcctggcgtggagctggcgggttctcagtctgacatcaactcccggagaatggcatctgctgaactcaacgcaggaagccgtgcggggccagcgcgctctcaggcagcctgagtggcagggtccttttgtcagctgtttggatctcccacgtggcccagtgccccagcagaacacacacacacacacacacacacacgcgtattgaacaaaacaagtttcacaggacatttatccacgcccaggagatttatcttttgtatggcttcattttgcagaaaattcacttgtttgatttcatggcctggtgatccacagaaggccgcactctgatgagtctctgatcatcggagagatgagtgtcaatgaaaagatcagtccttgaaatgtttttcttctccggagctgacaggtgatctggcctagggataattggaaagtgtccccgtcagctgctcccagggccaccgcag

SEQ ID NO: 105246 - DNA, 601 bp, Human
attcctggggaagggagtggacccatgaggtgggttagaatcgtgtgtgggattctccagccccctgtacctgtgcgtgtggtatgcgcggagccagccagcactgcctggcgtggagctggcgggttctcagtctgacatcaactcccggagaatggcatctgctgaactcaacgcaggaagccgtgcggggccagcgcgctctcaggcagcctgagtggcagggtccttttgtcagctgtttggatctcccacgtggcccagtgccccagcagcacacacacacacacacacacacacrcgcgtattgaacaaaacaagtttcacaggacatttatccacgcccaggagatttatcttttgtatggcttcattttgcagaaaattcacttgtttgatttcatggcctggtgatccacagaaggccgcactctgatgagtctctgatcatcggagagatgagtgtcaatgaaaagatcagtccttgaaatgtttttcttctccggagctgacaggtgatctggcctagggataattggaaagtgtccccgtcagctgctcccagggccaccgcaggtgatgcatttatccccgtaagaag

SEQ ID NO: 105247 - DNA, 601 bp, Human
gcggtgtggtacgtttcgctcttttaatatcgggaacagttaaaaccatacagaaaatgccaagtacagcataaaagaatttttccgatccatttgctggcacgatgctttgtcaactccagtgagtgagcacgtgggctggctctgcacgtctagcggcccagaaatgcacaaatgcccacctcaccagctgggctcgacacccgagagcccccggctctccttctggaacacactcaggcttcgcacagccccgtcttgccctgcgtcatctgtggggtgggagcgctccctgagggcrtgttggggtggcggctccgtgagcggggtgcccctttgagccagtgcccatggtctacagtttaaggatccaccggcctttttggatcatttggaaactccactccctgtcatccccaggcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtgccccttcagccttccttcaaccttgatttccctt

SEQ ID NO: 105248 - DNA, 601 bp, Human
tggaaaaaaaactcacctatatcttgtagcacctgctatgtctagatttgtccatatcccttcgattacattctgggtaaacataggtaacactgtgaggatgtgaggatgtgggttttaaaaaacgctctgtggaacagttgtgatgattcttcacatgggtggtttgtttttgaaggtggaaagacagaggagacttgaaagaataaaacagaaacagtctcaacttcaagaacttattctacaggtaagagaatacgtatctgtggaggcagggtaatttttattttactaatttagytttataacggcaacatactgccttgggttacactcctgcatggcaaatcaaatgactgctctaagattctgagtgtgagttcatctcataggtgttgaacgtgggccttattcccagagcgaggttgtgcacgtgcgtgtgcatgcatgtgtgtgtgtgcgtgcatgcatgcatgtgtgcgtgtgtgcatgtgcctgtgtgcgtgcgtgcgtgtgcctgtgtgcgtgtgcatgtgtgtgcgtgcatgtgcctgtgtgcgtgtgtgtgtgtgcatgtgtgcatacatgtgtatgtgtgtat

SEQ ID NO: 105249 - DNA, 601 bp, Human
ctcactgcagagctggctgctgccctgaccaaggtgtgctcgagccctcccagaggggacggtgtggcagccgtggtgatggaggctcgtgggcaggagctcctcaggacccacagagtgtcaggagggacagtcctggttgccagtgccttaggacctgccaggtggggatagacccagggtggccgggagaggaagggaatctcctggctctacattaatagcaaagaaggtctctccaagtggaacacttggtttggggccctgaggccctggccctggattcagccttgcagggccyattcccccagaggagcacccctgcagcacatgggcccttctgcgttccactttccagggtgggcaaagtccacggcacggcaccccctccaaggccatcaccctgtaggtgccatggtggtaggtggtcttagaggggtgaaggacagcaaggaatcgacttccaaaattggtgttttgttgagcgccgttgccgtggaggacacttttatcagggcacggatggctgtgcgcccgctttcccttagttctcccctcaggatcccgtttcctgagcgcttttctccctgggctgcagagg

SEQ ID NO: 105250 - DNA, 601 bp, Human
tcggggagctgctctgccgaagaccttaaaatggccagaagtctggtccccaaggctctggagccatacgtgacaggtcagcaatgcccagacaacctggcgtggctgtgtgaggaatggcccccagcctccgacggtgccctcccctcccggctcgggatgtgtcttgctgagatcaggcccacgtgtgtagggccaggagcaaagacaaaggggctgtgagggggatgagggcaggggtgtggctggggtggggtccagccagtgccgtgacccactggatatgggggccttgagtccrcaggtggctcgtgtggatttcctatgtggtttgtgtgaggaggtgctaagtcaggattttaccctccaagtaggcccagaagtagaagttgagattctttgagaagtgcagttggattgctgatcccacccactgatggtagctgattggtcactagggcaaagtcaccaagaaaaagcatttcagagtcattggcgtcctgctccggagggccgggagcacaggagcttttgttgaaggagctttttttctgttctggtgaattctttccttgggggccgtagggtcccagccactgac

SEQ ID NO: 105251 - DNA, 601 bp, Human
tcattggcgtcctgctccggagggccgggagcacaggagcttttgttgaaggagctttttttctgttctggtgaattctttccttgggggccgtagggtcccagccactgacagcaggatggctttaaggtgagaaattgtgaaggtgtcatatctgctgatccttctcttgttagcctaaacttggggtgtagatttattccctgagagggtcagagattcctccctgagctcttagactgccccagatcttgtgaaaatctggctggtccatgttgtcaggtgacagtgggctctggcygcccacgtgggctgggccctgaccccggcctctgtcccgtgcttcatggagctgccaggatgggctgtgggaagagggtttcagcttgacactttgattcggttccgtttcacgatgggtatgatactgaggcagcagcacacgtgtgccgtttgtaagtcagtgtgtgcaggtatttattgcaaggctgttcttgcctttttagagaagacaggcttatgtgactgcacagcgggatgtcctgctccgtggcgcagtgtggaaaatactggacaagcgaaggatatccggaagcttcta

SEQ ID NO: 105252 - DNA, 601 bp, Human
ggcgtcatctgggcctcccccggggtccaggggccaaggcagggcagccgtctcaggtgtggccatcaggtctgtggctgctctgacgtggcttgtctgtccaggcagtggggccccgctggctttccctgtgtggagagctgcttttcttagttggtttctgctcactaaaaactgaaagtaatacatggtggtttttttttcatagtatcacctaataagtaaagtaggaatgaaaaccacccaaatcctcctgtccccggcagcccaagtaacagcaagtatttccaggttttttttsccatttttcagaacgcgtctgcggtcacagcgcacgtatttttcagaacgcgtctgcggtctgggcgcaagtagttttcagaacgtgtctgcgatcacagcacacatttttcagaacgcatctgcggtcatggtgcatgtgtttttcagaatgcatctatggtcatagcgcatgtatttttcagaacgtctgccatcacggcgcacgtgtttttcagaacgcgtctgcggtctcggcgcacgtgctgcgatcacagtgcatgtatttttgcgaacgcgtctgtgattatggtacacgtat

SEQ ID NO: 105253 - DNA, 601 bp, Human; identical to SEQ ID NO: 30883

SEQ ID NO: 105254 - DNA, 601 bp, Human; identical to SEQ ID NO: 30884

SEQ ID NO: 105255 - DNA, 601 bp, Human; identical to SEQ ID NO: 30885

SEQ ID NO: 105256 - DNA, 601 bp, Human; identical to SEQ ID NO: 30886

SEQ ID NO: 105257 - DNA, 601 bp, Human; identical to SEQ ID NO: 30887

SEQ ID NO: 105258 - DNA, 601 bp, Human; identical to SEQ ID NO: 30888

SEQ ID NO: 105259 - DNA, 601 bp, Human; identical to SEQ ID NO: 30889

SEQ ID NO: 105260 - DNA, 601 bp, Human; identical to SEQ ID NO: 30890

SEQ ID NO: 105261 - DNA, 601 bp, Human; identical to SEQ ID NO: 30891

SEQ ID NO: 105262 - DNA, 601 bp, Human; identical to SEQ ID NO: 30892

SEQ ID NO: 105263 - DNA, 601 bp, Human; identical to SEQ ID NO: 30893

SEQ ID NO: 105264 - DNA, 601 bp, Human; identical to SEQ ID NO: 30894

SEQ ID NO: 105265 - DNA, 601 bp, Human; identical to SEQ ID NO: 30895

SEQ ID NO: 105266 - DNA, 601 bp, Human; identical to SEQ ID NO: 30896

SEQ ID NO: 105267 - DNA, 601 bp, Human; identical to SEQ ID NO: 30897

SEQ ID NO: 105268 - DNA, 601 bp, Human; identical to SEQ ID NO: 30898

SEQ ID NO: 105269 - DNA, 601 bp, Human; identical to SEQ ID NO: 30899

SEQ ID NO: 105270 - DNA, 601 bp, Human; identical to SEQ ID NO: 30900

SEQ ID NO: 105271 - DNA, 601 bp, Human; identical to SEQ ID NO: 30901

SEQ ID NO: 105272 - DNA, 601 bp, Human; identical to SEQ ID NO: 30902

SEQ ID NO: 105273 - DNA, 601 bp, Human; identical to SEQ ID NO: 30903

SEQ ID NO: 105274 - DNA, 601 bp, Human; identical to SEQ ID NO: 30904

SEQ ID NO: 105275 - DNA, 601 bp, Human; identical to SEQ ID NO: 30905

SEQ ID NO: 105276 - DNA, 601 bp, Human; identical to SEQ ID NO: 30906

SEQ ID NO: 105277 - DNA, 601 bp, Human; identical to SEQ ID NO: 30907

SEQ ID NO: 105278 - DNA, 601 bp, Human; identical to SEQ ID NO: 30908

SEQ ID NO: 105279 - DNA, 601 bp, Human; identical to SEQ ID NO: 30909

SEQ ID NO: 105280 - DNA, 601 bp, Human; identical to SEQ ID NO: 30910

SEQ ID NO: 105281 - DNA, 601 bp, Human; identical to SEQ ID NO: 30911

SEQ ID NO: 105282 - DNA, 601 bp, Human; identical to SEQ ID NO: 30912

SEQ ID NO: 105283 - DNA, 601 bp, Human; identical to SEQ ID NO: 30913

SEQ ID NO: 105284 - DNA, 601 bp, Human; identical to SEQ ID NO: 30914

SEQ ID NO: 105285 - DNA, 601 bp, Human; identical to SEQ ID NO: 30915

SEQ ID NO: 105286 - DNA, 601 bp, Human
ttattacatagaattatattaatatattacatagaattataataatattagataactgtttaagactattaaaataacagggcagttaccacctttttttttttttggtatgcagcaacagtatcaaagtgctctattttgggcagataaagtagcttcactctctcgtggtaagtgacaaaatgctaactggttttctgattaatcttaaaattcgttttctatttcaccttgtacctctgaccacttatgtgaatttttccctccagaagaaccccaggacatctattggttggctcartgtctttacctgacagcacaatatcacagagccgcccatgcacttcggtcacgaaaactggacaaagtaagtgatggtatgaactttaaagctcttcagagctttaaaaaaaatgtcattagtggccgggcgcggtggcttacacctgtaatcccagcgctttggaaagccaaggcaggtggatcatgaggtcaggagctcaagaccaagatggtgaaaccccatctccgctaaaaatacaaaaattagccggacgtggtggcaggcgcctgtaatcccagctactcgggaggctgaggc

SEQ ID NO: 105287 - DNA, 601 bp, Human
tttctaaacagctctggaatcatggatattcctcttcctccccactcgtacgtgtcaggcctttgatttttttgtctgttctgttacagcctctcttcttgtctcttttccccagtaacagtttctctcttcttatcttccctgtcacaagttcatcttgtgaactattacaggagtgagtagtctttaaaacacggatgtggttatattcccacaaagtcattcagtgacttcccattagctgcaggataaagtcagatgcatcagtaggtctgtgaggccctccttgttttctctccastctgcgtctaatccaccaccatcaatacctggagcacgtgctccagtcacgtggtgctgctgtgagctccttggacacccagcagttattcacactcagggcctgaagtggagctgctgcgatctccttggacgcccagcagttattcacactcagtgcctgaagtggagctgctgtgagctcctcggacgcccagcagttattcacactgagggcctgaagtggagctgctgcgatctcctcggacgcccagcagttattcacactcagtgcctgaagtggagctgctgtgagctcctc

SEQ ID NO: 105288 - DNA, 601 bp, Human
gttattcacactgagggcctgaagtggagctgctgcgatctcctcggacgcccagcagttattcacactcagtgcctgaagtggagctgctgtgagctcctcggacgcccagcagttattcacactcagggcctgaagtggagctgctgcgatctcctcggatgcccagcagttattcacactcagtgcctgaagtggagctgctgcgagctcctcggacgcccagcagttattcacactcagggcctgaagtggagctgctgcgagctcctcggacgcccagcagttattcacactcagkgcctgaagtggagctgctgcgatctcctcggacgcccagcagttattcacactcagtgcctgaagtggagctgctgcgatctccttggacccccagcagttattcacactcagtgcttgaagagctacccagtgctccactcctctgcctgaccacttactcgctgcctcacttactcgctctcctgcagatgtttacttctccacctggttgatgctttctgttgccccgtttcgtcatgcttacctgttgtgcttagttcacatctcccctactgtaacctcctggggcagggcctta

SEQ ID NO: 105289 - DNA, 601 bp, Human
cataaaagaatattacacattctaggtttttgtttttgtttttttttctggccactcattaatgtatgtgttgggaagcagattcttctgttaagaaatgcatttatgaaagtgtgtggtacagtcattattttgggacctcttatccattaacttatttgctatgaaatgtgtgatttatttgcaacgcattattatttattttgtgaaattacatttttaaaaaacaactcctaggatattgcttagttcgaagactctcataattcattattttttctaaaattttactttatgaatmttcttcatatccttaatgatactagctgcctgttgctggatcatctttaaattcagttatgtgttcgaggtccagagtctagaatgtgcatcagatttccacatcttcgtgtttatggtagtcgtgagatggctgttgaacgccttactatgtgctagcaccacagagatggtagcatctctagccctcacagacttctataagttagatagtaaagagttctataagttagatagtgtttttatctttttacagatgaggataggaaatggaggccaagagaggttcaatcacttgtcc

SEQ ID NO: 105290 - DNA, 601 bp, Human
taattcattattttttctaaaattttactttatgaatcttcttcatatccttaatgatactagctgcctgttgctggatcatctttaaattcagttatgtgttcgaggtccagagtctagaatgtgcatcagatttccacatcttcgtgtttatggtagtcgtgagatggctgttgaacgccttactatgtgctagcaccacagagatggtagcatctctagccctcacagacttctataagttagatagtaaagagttctataagttagatagtgtttttatctttttacagatgaggawaggaaatggaggccaagagaggttcaatcacttgtccgaggttacaagtaattggcagagctggggtttgaactcaggtctgtgctgcctcagcaggccattgtgctgactgctgtgaccactctgctgcattgctgccagtttctgctcattaagatccttttgaggggtgtctgcctatcacactgtcaatcttggagttttatacacatgcacacacactctgccatctctaaatcattgcactgttttggacaaaacaggtaatgaacctagtagccgtgacatgtacttttgtta

SEQ ID NO: 105291 - DNA, 601 bp, Human
gaggataggaaatggaggccaagagaggttcaatcacttgtccgaggttacaagtaattggcagagctggggtttgaactcaggtctgtgctgcctcagcaggccattgtgctgactgctgtgaccactctgctgcattgctgccagtttctgctcattaagatccttttgaggggtgtctgcctatcacactgtcaatcttggagttttatacacatgcacacacactctgccatctctaaatcattgcactgttttggacaaaacaggtaatgaacctagtagccgtgacatgtacttytgttataaagatgtgttggaacagagcagttgaagcccagggaaggtgaattgaagaagctttgctgtgcattttttgtgtgtttttatttatgccttgacagttgtgattgactaaatccttttaaatgcaataaaaacttctcagcattcaaatacacaattctctatcaaaagttaagtttaagggccaggcatggttgctcatgcctgtaatctcagcacttcgggaggccaaagtgggaggatcacttgaggccaggagtttgagagcagcctaggcaacatagcaagattgtct

SEQ ID NO: 105292 - DNA, 601 bp, Human
tcacttgtccgaggttacaagtaattggcagagctggggtttgaactcaggtctgtgctgcctcagcaggccattgtgctgactgctgtgaccactctgctgcattgctgccagtttctgctcattaagatccttttgaggggtgtctgcctatcacactgtcaatcttggagttttatacacatgcacacacactctgccatctctaaatcattgcactgttttggacaaaacaggtaatgaacctagtagccgtgacatgtacttttgttataaagatgtgttggaacagagcagttgragcccagggaaggtgaattgaagaagctttgctgtgcattttttgtgtgtttttatttatgccttgacagttgtgattgactaaatccttttaaatgcaataaaaacttctcagcattcaaatacacaattctctatcaaaagttaagtttaagggccaggcatggttgctcatgcctgtaatctcagcacttcgggaggccaaagtgggaggatcacttgaggccaggagtttgagagcagcctaggcaacatagcaagattgtctgtacaaaaaatttaaaaaattaactgtttgtgg

SEQ ID NO: 105293 - DNA, 601 bp, Human
tgctgacagcacaagaaggtttggaaactcaggcttttttgttttatgtttagcaaaattaatattgtttggattttttgcctctgaaatcttctaagtcaacaacaggccacatacaggtttaaatagacctactcactttcttaatgtcttcaaatgtaaagcacgttgcagaatgcagtattgtacggtgccttgtgctgtccgaatctagggattgtgataggaagaggccatctttttgagaagtgattgagatagtataaaccaggatttcagtatctcatgcagtgattctcarccgtgttgctctttacatccttgggaagacagagaaacatccatgtccagttcccaactccagagcagatgctttaaagctcccaggtgatcctaatgtaccacaggcactgagaatcagtccaagtatgttggcagtggtgtgaggtgcgtcaacaagggaaacagaaaatagagtggttggattaatgggattctaacatattttagcctagtgcagtggttctcaaccaaccagagtgattttgccgccccctgccccgggaacagttggcaatgtctggagatgttgtttgtcaca

SEQ ID NO: 105294 - DNA, 601 bp, Human
gttcccaactccagagcagatgctttaaagctcccaggtgatcctaatgtaccacaggcactgagaatcagtccaagtatgttggcagtggtgtgaggtgcgtcaacaagggaaacagaaaatagagtggttggattaatgggattctaacatattttagcctagtgcagtggttctcaaccaaccagagtgattttgccgccccctgccccgggaacagttggcaatgtctggagatgttgtttgtcacagcttaggggcagggagggaggttgagaggttgctgctggtatctagtggytagtggccagaggtcctgcttagcacctgcagtacacaggctcccctgttcccagcagagcaagatccacgcagtcaggagtgcggaggctggtggttcttaggtgacaagagccacctggggacctgcctcagccctgaaagagtagcctccacccaccagatgattcccgtcttcaggcctggagccactgtgtcagcttctgttgcacattttgatcttatgttctcttttgagtttgatttacttagaccaagaactgtagaatcatatttttagttgttggctttttcccctcta

SEQ ID NO: 105295 - DNA, 601 bp, Human
aagacttttttttaaattaaagtaattcttagacataaaacaaatcttttctgtaacttgaaattttgtctctgaaattctggatagttgagattgcaggtaacaacataatggaaccctactataaaagtaacaactggggaggaaatgtttaggaaagtagcaaatggccaattttgttttcccatcagaacaattagttctttatcactgcttcctactaccttttctcaaatatcatttatgtttcaaggtttgttagctttaaattgttgggtgtcagttctgcctcccccccccytttttttttttgtaaattccactggaaatctgatatggtaagagttgataactacttagaaattggaaaggagcagattgtttgctcatgttttccgtatttttaacatttgacatttagttgtgtttggggatgcatttgtccttaaatttttctaaactgaatggtgagctctgtcaggaaggaaaaccctcaccgaatccctgctgctcagagtgtggttcgtggaccagcaacatcgcatttgtggaagctggttggaaatgcagcatctccagctgctctggtctactgaatcca

SEQ ID NO: 105296 - DNA, 601 bp, Human
tttcttccgtgcaaataaaacagaattggtctctaacggaaacagcataaactttggagtcaaatttgaattctaatccaagttctgtgacttaccaactgaaattccttgggaaagttaatttctcctgctctctctttctttaaaaatggggatgtcagccaggcgtggtggctcacgcctgtaatcccaacactttgggaggccgagacaggcagattaccttaggtcaggagttcgagaccagcctggccaacatggtgaaagtctgtctctactaaaaataaaaaaatcagctggrcatggtggcatgcacctgtaatccccgctacttgggaggctgagggaggagaattgtttgagtccaggaggtggaggttgtagtgagctgagattgcactactgcactccagcctcgccgacagagtgagactctgtctcaaaaaaaataaaagggagtgggggtgggggagatgtcatactcatatagcaggattgttaggaagactgatgccacgaaagtaccctgtactaggaagaaactagaatgttccctggttggttgtatgttcagcattttagaagaacttctacatagaaa

SEQ ID NO: 105297 - DNA, 601 bp, Human
taacggaaacagcataaactttggagtcaaatttgaattctaatccaagttctgtgacttaccaactgaaattccttgggaaagttaatttctcctgctctctctttctttaaaaatggggatgtcagccaggcgtggtggctcacgcctgtaatcccaacactttgggaggccgagacaggcagattaccttaggtcaggagttcgagaccagcctggccaacatggtgaaagtctgtctctactaaaaataaaaaaatcagctgggcatggtggcatgcacctgtaatccccgctactygggaggctgagggaggagaattgtttgagtccaggaggtggaggttgtagtgagctgagattgcactactgcactccagcctcgccgacagagtgagactctgtctcaaaaaaaataaaagggagtgggggtgggggagatgtcatactcatatagcaggattgttaggaagactgatgccacgaaagtaccctgtactaggaagaaactagaatgttccctggttggttgtatgttcagcattttagaagaacttctacatagaaagatgattagtattgtaaaagttattttgagcta

SEQ ID NO: 105298 - DNA, 601 bp, Human
atatagcaggattgttaggaagactgatgccacgaaagtaccctgtactaggaagaaactagaatgttccctggttggttgtatgttcagcattttagaagaacttctacatagaaagatgattagtattgtaaaagttattttgagctatgctgctttgatctagcgtgcaattcagtgatggactcttatcagtggtccccaacatttttggcaccagggaccattttgtagaagccccccctcccagggtggggggactggtttcttgatgattcaagcgcattacatttatcgtgtrcttttttctattattattacattgtagcatataatgaaataattatacaactcactataatgaagaatcagtgggagccctgagcttgttttcctgcaactagatggtcccatctgggagagatgggagacagcgacaggtcatcaggcattagattctcgtaaggagtgcgccacctagatccctcacatgtgcagttaacaatagggtttgcgcacttacgagaacctaatgcctctgatctgacaggaggcagagctcaggcggaaatgcaagtgaaggggagtggctgtaaataca

SEQ ID NO: 105299 - DNA, 601 bp, Human
gatatatatgagtccagtccctgtaaccagggtatatctgttgaccatcatctataggatatcgcctaatccctcaagccttggtatacctgtctttaaaatataaatgaatttatcttgcaagttattaggatgagaggatgtatctactaggttacaaaatggagctcctggattaagtaatatctgtaagttctatttagaatgctaatgggttttgctacagtgcataaaaagctgtggatctcctcaaatttcttaaaattttgctatactattaaacagttttagttcaaatgawtcaacacaaatgttacattagtgtttaatgtggtgacagcttgtttactaaatggatgttaatgtttttgaggccatctccttatataaaattaacaattcaagaataaatactagctgggcacagtggctcgtgcctgtaatctcagtgactcaagagcctgaggcagaaggattacttgagcccaggattttgaggctgcagtgagctatgatcataccactgcattccagcctccagcgacagagcaaaactctgtctctaaaaataaaaaataataaataggctgggcgcagtggc

SEQ ID NO: 105300 - DNA, 601 bp, Human
cgagatcgcaccactgcactccagcctgagcgacaaagtgagactttgtctcaaaaaaaaaaaaaaaagaataaatactatatgacttaaattaactcttttgttttagcaaagccacaacacttgagaaaacctatggacctgcatggatagcctatggacattcatttgcggtggagagtgagcacgaccaagcgatggctgcttacttcacagcagcacagctgatgaaagggtacggcagagcaaactcatcaaactccatgaagggatgtttttcctaatagaaatgaaatttctrttactattactgctatttggttgctaaactaaacacaaacattttacttgccttttaatctagttgcttgtgattgtaaaataactatgaaagtggaggggagagaagctggtgtatgcatttgcctagcagttgattccaaccagtgcaagaagcaaccaggaaattaggccagtggaggagaggagttctggaagcccttcctcacatgctcatgcaagaataaaaatattcacgagcaaaattattatatcttatctattaccaaaaggtatttgatgtggcttagtggtaggtgca

SEQ ID NO: 105301 - DNA, 601 bp, Human
tatgagcatatgctacagtctggtaatttttatttgatattttgggttctcagaaacagaatagttattagttagttcctagctgggaatcagaatcaatgataattaatgacacaataccttcagtgtttccaaatctaacaaactttgtcattaaattctcacattaagctaggtgtggtagctcacacctgtaatcccagcactttgggaggctgaggtgggaggattgcttgaggccaggagtttgatactagccctggcaacatagtgagaccttatctttacaaaaaaaaaattwaaaattagctgggtttgatggtgcctgcctgtaatcccagctatgcgggaaactgaggcaggatggtcactgtgccaccacaatccagcctgggtgaccagttgagatacatctcaaaaacctcatgatagctcatcaagataagcattatttttctttcaagtttacttatctgtcagagcagctctgcattttcttaacttgtctgtgtttggataaatgtttgaaattggatgaatatttttacgtgtcctttatgatttcttttttgagtcattggttatttaagaatatgttgac

SEQ ID NO: 105302 - DNA, 601 bp, Human
tttaaatttattgaggctggccgggcgcagtggctcacacctgtaatcccagcactttgggaggccagaggggtgtggatcacttgaggtcaggagttcaagaccagcctggccaatatggtgaaaccccatctctactaaaaatacaaaaattagccgggtgtggtggctcacgcctgtagtcccagctactcgggaggctgaggcaggagaagctcttgaacccagaggcagaggttccaatgagctgagatcgcaccactgcactccagcctgggcgacagagtgagactccatctcaaaaaaaaaaaaaagaaaaaaattattgaggcttttttatgagccattctatagattgttccagattatttgagaattctgctcttgttgggtgaagtgttccatagatacctgttacatctgattttatagtgttgttgaagtcttctctttcctcattgatcttctacttatttattctctgcattattgcaagtgaggtattaaagtctccagattttattgttgaattgtgtatttctccctccaattccggcacatttcacttcatatattctgagtctctgttgttaggtgtgta

SEQ ID NO: 105303 - DNA, 601 bp, Human
aaaaaaaaaaaagaaaaaaattattgaggcttttttatgagccattctatagattgttccagattatttgagaattctgctcttgttgggtgaagtgttccatagatacctgttacatctgattttatagtgttgttgaagtcttctctttcctcattgatcttctacttatttattctctgcattattgcaagtgaggtattaaagtctccagattttattgttgaattgtgtatttctccctccaattccggcacatttcacttcatatattctgagtctctgttgttaggtgtgtacrtgtttataattgttgtattttcttgatggattgagccttttatcattataaaatatcactaattatctctaataatacttttttttataaagtctgtttcatctgatgttactgtaggcacaccagctctcttttgttactgtttatatggtgtggtttttttcattcttttaatttcaacttgtgttttgaatctaaagcatgtctcttgttgacaacatacagttagatccatttatgtttaattactaacaagataggatttatgtctggcgttttgttctttattgtctatacatc

SEQ ID NO: 105304 - DNA, 601 bp, Human
acaagataggatttatgtctggcgttttgttctttattgtctatacatcacatcttttgttcctgtatttcttcttttgtgttgagtaaatattttataatgtcccattttaatcccctttttttattatactatatcttttgagttattttcttaggttggttatctttaggattataattagcaccttaatttaaaacgacctactttgaattaataccaatttaattttaatagtacgcccaaaccttactccgatatagctgtttcctcttgcctccttgtgctgttagtgtcatayagaatacatcttacacattataagtccatcagcacagatctgttattattatttattctgttgtcttttaaatcagatagaagagttaaaaacaagcacattttatactgtctcataattaccaatgtagctatttttatcagactctcatttcttcgtgttgtaaaccaaaaataaaatttgaagaccctccccaaccatctaaatgggcttcctcctctaggccagggccgtctaaatttaacctgaaagactggttcaggccatgatgggaagtgggggtccaacacgcctctttac

SEQ ID NO: 105305 - DNA, 601 bp, Human
agtgtcatatagaatacatcttacacattataagtccatcagcacagatctgttattattatttattctgttgtcttttaaatcagatagaagagttaaaaacaagcacattttatactgtctcataattaccaatgtagctatttttatcagactctcatttcttcgtgttgtaaaccaaaaataaaatttgaagaccctccccaaccatctaaatgggcttcctcctctaggccagggccgtctaaatttaacctgaaagactggttcaggccatgatgggaagtgggggtccaacackcctctttacgccctccagcattaacatcaaatggaccttcagtctgataagaagaaacacttaccatctatcctctctgaagcctgctacctggaggcttcatctgcatgataaaatttggtctctgcaacctcttatcataacccagacattgcttactattgataataactctttcaaccaatcagaaaaatcttaaatctacctgttacctggaagcctgcacttcgagttcttagagtttgactcttctgcaacaatgtggatttgaattcctatgtagtatccttctgttttagc

SEQ ID NO: 105306 - DNA, 601 bp, Human
agaatacatcttacacattataagtccatcagcacagatctgttattattatttattctgttgtcttttaaatcagatagaagagttaaaaacaagcacattttatactgtctcataattaccaatgtagctatttttatcagactctcatttcttcgtgttgtaaaccaaaaataaaatttgaagaccctccccaaccatctaaatgggcttcctcctctaggccagggccgtctaaatttaacctgaaagactggttcaggccatgatgggaagtgggggtccaacacgcctctttacrccctccagcattaacatcaaatggaccttcagtctgataagaagaaacacttaccatctatcctctctgaagcctgctacctggaggcttcatctgcatgataaaatttggtctctgcaacctcttatcataacccagacattgcttactattgataataactctttcaaccaatcagaaaaatcttaaatctacctgttacctggaagcctgcacttcgagttcttagagtttgactcttctgcaacaatgtggatttgaattcctatgtagtatccttctgttttagcataaaggact

SEQ ID NO: 105307 - DNA, 601 bp, Human
cccaaccatctaaatgggcttcctcctctaggccagggccgtctaaatttaacctgaaagactggttcaggccatgatgggaagtgggggtccaacacgcctctttacgccctccagcattaacatcaaatggaccttcagtctgataagaagaaacacttaccatctatcctctctgaagcctgctacctggaggcttcatctgcatgataaaatttggtctctgcaacctcttatcataacccagacattgcttactattgataataactctttcaaccaatcagaaaaatcttaaatmtacctgttacctggaagcctgcacttcgagttcttagagtttgactcttctgcaacaatgtggatttgaattcctatgtagtatccttctgttttagcataaaggactccctttagtatttcttactgggcagatgtactaatgacagattttctcaattatacattgttattatttatgtaattttgtttttcaaagaagctgtgaggaaagaaggtgtatatacttatatcatttgttatattaaccctgttatttaccattttcagttctctttgttcctgtgggttcaagttaaca

SEQ ID NO: 105308 - DNA, 601 bp, Human
ttactttcctactgtaatacagctttgctgtcacccgcttcctattacactgttactggtaaaccttacatttctgtatatgataggcccaacaatataattgcacattgagtatccctaatctgaaaatccaaagttcaaaatgttccagaagcccaaactttttgagcactgtcatgacactcaaaaagaattgctcactggagtattttggattttcagaatagggatgcataaattccaaaattaaaaaaaaaaaacctgaaatcccagacacttctggtctcaagcatttctgatraagaatactcaacctgtacatagagtctcactctcttgcccaggctggagtgcagtggcaccatcacagctcactgcattctcaaactcctgggctcaagggatccttccgcctcagcctctcaagtgtctgggactacaagcccataccaccacgcttggctaattttttattactttttagagatggggtctcactgtgtgtcataaactcctgggctcaagcattcctttcaccttagcctcccagagtactgggattacaggtatgagcccagggggctcttttaggagctaccag

SEQ ID NO: 105309 - DNA, 601 bp, Human
gcactgtggaatccttagttatctctgtgttgataaggagttgaatttacgtatttgagaagaatttgacatggtttttgaaacaaaagtgttttctatttagttactagtaagtcagaaaatttaattcctggtcagtgtaggctttactgtactctagaatatttgtagaataagtgatttggtgttatactcaaagagaaaaatgtatgtaatcctttgcatttcatgatatacaaattttaaaatggtaaattagtttcagttttttttggtttttgtttttgtttttttgagatgkagtctcgctgtgttgcccaggctagagtgcagtggcgcattttcagctcactgcattctctgcctcccaggttcaagcgattctcctgcctcagcctcctgagtagctgggattacagatgcccaccaccacgcccggctaatttttgtatttttagtagagacagggtttcaccatgttggtcaggctggtctcgaactcctgacctggtgatccgcctgcctcagcctcccaaagtgctgggattacaggtgtgagcctccacgctcggctgtaaattagtattaatactactacagt

SEQ ID NO: 105310 - DNA, 601 bp, Human
gctgggattacagatgcccaccaccacgcccggctaatttttgtatttttagtagagacagggtttcaccatgttggtcaggctggtctcgaactcctgacctggtgatccgcctgcctcagcctcccaaagtgctgggattacaggtgtgagcctccacgctcggctgtaaattagtattaatactactacagtgtcatttatggcatgtatgtgttctaaaaaatgggttatctaggtattttttaaaagtttgaagctttaaaataaatagtaatcttttaatataatacagtaatcrtcagtatttgcgaatttgcctactcattaaaatttatttgtaaccgccaaatcagttcctgaggtgctttctgagccattggcagacatgcccagggctgggagaaagctgggtctcctggcacacacacttccagctggagtctaagaaggcaacgctctgccttttttcccagttcaactataaaccagtgtacttcttgtggtctatttagtgccacagttttcacatttttgtgctttttgttgatgatttcactgttttgaaataatccccaagcttagtgaaatgctatctagt

SEQ ID NO: 105311 - DNA, 601 bp, Human
tttatagaacataaatactgtggttgggtgcggtggctcccgtctgtaatcccagcactttgggaggccgagatgggcatattgcttgaggccaggagtttgagaccagcatgtgcaacatggcgaaaccccatctctactaaaaatacagaaattagccagggatggtgttgtacacctgtaatcccagctgtgtcaggaggctgaggcacaagaatcacttaaacccgggaggcagaggctgcagtgagctgagatcgcaccactgcactccagcctaggtaacagagtgagactcttaaaaaaaaaaaaaaaaaaaaggaatataaatactgtatctcccaaaatcttgaaatcttgaactcttgatattaatgccgtaaaattaatcatttgtgacttaactttgaatttttataattatttccagcagtttaccccattgcattttagtactactagaaaggtaatcaaaaatttttttaaagtttatatttgctaatttcgaataatctgcaaccttttttcctttcattttagatggaaaacagccgaaaaatggtttcttgatgctttggaaaaaattaaagcaattgggaac

SEQ ID NO: 105312 - DNA, 601 bp, Human
ctctagctttgaaacgtgagaggcatcagaatagattgggtgattatttgaagctaggaatagtcattgggtcacggaaacaattgggcactgtagcgtcagatgtaatattcctctagaacttcagagagcttctttgactgaagggtaaataaagtatagcagcaggtcccacttctgaaaggatagggatgggataggtattactgaaattcacaccttttgttgctgttactgcatactgagtgtgtatttgggcctttccattttaaaatatttgactgcttctgttgtatgaacratcccgtgaattggtgcttatgagttaacctaacaattatcaaggatgtgtatatactgatattacttaaaagtagtaacagttttagataccataaacttgcatagtaagagatttgcatgatgctcttctgtttcattcgtgcctgttttgtttcattctattctgattttcacttctcagcttcctgctgttactgtttgtgcacacctgcccacagttttcttctcccttggctgttagctctctctgctgttacagacacagctttgcctccctgccaagcgatctgcctgtccc

SEQ ID NO: 105313 - DNA, 601 bp, Human
agggtcagagggggtgggggtgccattcactgactggaggggcactcagaagcagtgaggtcaggggctgggatggccagggagagatgggtgtggtgtgtggtgcactaaacttaaagtgcttgtaacatttacaagcagaagtatttagcaggcagatggatagagaggtctggtgtttgagggaaagctctgagttgcagatactcatttgaactccagcagggataggctcttggataaacttgtcctaatgataacagagtcctcaggaagtctcctagtaggaaagaaagggagmtagataaaacagcagttaccctggccttgtggtgtgctggcggcacacactgggagagagcccagcttgcaaggcgtgaaataattcagtgcaaacaaatcaggctgaacagtgacatatataactcgtgggcttgatgttgctatgttttaggtaacagttgacaaatgggaacctttgttgaacaacttggggcatgtctgcagaaaacttaagtaagtgaagtagagcattttcagaaatatactttgtgtctcaaagtttacttaattttgaatactttgtcatattcttatttca

SEQ ID NO: 105314 - DNA, 601 bp, Human
aacagcagttaccctggccttgtggtgtgctggcggcacacactgggagagagcccagcttgcaaggcgtgaaataattcagtgcaaacaaatcaggctgaacagtgacatatataactcgtgggcttgatgttgctatgttttaggtaacagttgacaaatgggaacctttgttgaacaacttggggcatgtctgcagaaaacttaagtaagtgaagtagagcattttcagaaatatactttgtgtctcaaagtttacttaattttgaatactttgtcatattcttatttcatgagatcraccagctttcttgtacttggctgctcagataaaatcagcatcaaatcagtttttattatttatctgtgttggtgtaattttattttagaaacacattgagaattttacttttttatatgaaaatttagtgttcaaaattaattcagaagaattaggacagtaggatataattaaaatcctatccatagtctgttttctgctagaggttttgtggtgtgataaacaggcgacagttgaaaaatgggttttttggttaaatatgtctgggcaattttaggttattcaagatttaacaagtat

SEQ ID NO: 105315 - DNA, 601 bp, Human
cacaaggaaagaacctttcattaatccatgtaccatattccatcaaatttaagacaccatgagtaagcaggatgaccacaaagaaaaaagtgctgccaattaaactttaacataattttttcccggcacttaatttttttgtacttagagaaaatattcttgaacatatttaggcagatttgtattactctagtacatacatagaaatgtacatataagtgaaataaatggttacaatattcagcccagagggccagtatctgtgttttctcaaaatagtgccctggtgctagcacacacrcccagttcctgactctgggtttcctcccagccacagacacctgctttccaactctctctctctctcgtccctctcagtctgctaaagtgtcaacagaaggtttttagaaaaccacaattcccgcatctgtttaagtgttcctcgcatggtttgtgatctagtctgtgctgccaacataaccaccaagttcacgcttctcaggcaggttacccatatcacagtggtggctggtggatggcaataataggaaaccacaggtaaaagggaagcaatgtttgaatttgagaaaatgtgggtctt

SEQ ID NO: 105316 - DNA, 601 bp, Human
ggtagatttccagcataagaaaatagaatagtgtgatgaacctccatgacccataaccaacttcaacaatctttggttcatggccagtcatgtagctatgtctggccacttcccccaccctggatgccctggaatattttgaaatgaatcagtgtggtaagagaaggaaatatgttttcttttaataaccatgctgaatcttttatggcaggcccttggtcttaggcgagatgatacattttctgttacaatgcttggtcattgcatcgaaatgtacattggtgattctgaagcttatatyggtaagataatcgttattcttattggtattgtactccattttttaggttgtcatatgtctctgtttatgtttctcatattctcgtctgaggttccaagttcatctttctaaccattcgtgctgcattaaaaacaagaaactccatttattttattagaacaatgctgtgggggagttagtgactcaccaagggtgcgttcagtttaaagctgaatacttgctaagtgcaaaataccactatagaatatgtgtaaagcactttgttatagaaggactcatctgtttctataatgggaaaag

SEQ ID NO: 105317 - DNA, 601 bp, Human
ctgtttctataatgggaaaagaaatcttagcaacatttttctgataaacaattgaagaggctctgtcattattttataatgcagggtataacaatataaatctttacatttcaatagaatgttgagatgccatacatttccataacagtgaataagtaatagtataagtttggatggaattgctgtacttgggcactcgtttagttataaacattatgtgataaggaggatgtggtgaggttattgagatctaggataggaaagttgcaagcttgctaactcccgttcctactaaagtaattttttttttttttgagatggagcttcgctcttgttgcccaggctggagtgcaatggcgcaacctctgcccaccgcaacccctgcctccctggttcaagctattctcctacctcagcctcctgagtagcttggattacaggcatgtgctaccacgcctagctaattatgtatttttagtagagactggtcttctccatgttcaggccagactggtcttgaactcctgacctcaggtgatctgcctgcctcggcctctcaaagtgctgggataacaggcatgagccactgcgcccagcccct

SEQ ID NO: 105318 - DNA, 601 bp, Human
ggtaatgtgatacaaaacagagcagagccttagattttgagagggatctgtctgcttatgtgtcttggggttccctgaggaaaacagaggtttctcctaaaacggggtctgtggcaccctctggttttcccaaggagcccgaggctgtcagaaattaccttgggtcctctcatgtggacatccagagtggcgagaagacagactggggaactaatctagccaactgagaagaaaaacaaaaaatgagtaatacccattgtaaagttggataaactgaggcacatcacagtttaaaaatgcwtgttcccataggctccacagctcactctcttaaccatcctgtaattgtgcctgctctatgcccagtcactgatgcacttgtgtggtagctcatggcacacctagcaaacagtttccctgcccccttagaacctgggtttcgtttcctgctctacggcagtataaacagtttttctctgcatgtgttgggttctaaccctatatatctcaaattttattaatattactgaatctttttttttttttgagacggagtctcgctctgtcgcccagggtggagtgcagtggcaggatctctgct

SEQ ID NO: 105319 - DNA, 601 bp, Human
aatgtcaaaattatatgccatatacatttctgtgggcttgaaaatgatacaatataggttgtttctttaaagcagtcactaaaatgtgtaaacttctagatagagtaatcactaaaaaggaaagttcataccaaaagtagtaatactaggaataaaagagggctcaacactgcctttgggagtcctcctcccatgaaacatggctggatttttctccttgtcctgtgtaacctcccttactttatcatagtttactgccttagttactctctcattcctccaaggagagcctcaagaaatktaggtaacaccagagtgtggccccagccagttgccctcagttaccaaggagcaattaggtaggaaatggccactgaaagactgaaaacaagaaaaaaactcaggtccctcacccaaactgggcagtggtggtcaggcttccacacggaaacctttcactgtcaccagagtgtccccagccagagacctgcagttgcctctgtgcttagatgctgtccaccaagggtcccgagttggaaaagggaaaggggggggagttcccctatgtagagcagagggatccccacatggagatagctcc

SEQ ID NO: 105320 - DNA, 601 bp, Human
acctcccttactttatcatagtttactgccttagttactctctcattcctccaaggagagcctcaagaaatttaggtaacaccagagtgtggccccagccagttgccctcagttaccaaggagcaattaggtaggaaatggccactgaaagactgaaaacaagaaaaaaactcaggtccctcacccaaactgggcagtggtggtcaggcttccacacggaaacctttcactgtcaccagagtgtccccagccagagacctgcagttgcctctgtgcttagatgctgtccaccaagggtccygagttggaaaagggaaaggggggggagttcccctatgtagagcagagggatccccacatggagatagctccagctcatgcctgcaaatgaaggctctctagagagggaaaagggaaaaagaaatgaaaaataaatcccaaaatttgggcttacctcccgactggctcaccaaaatatgttactggtgtggaaggtcttcactacaagttgtccaggttcttggcatggtgaacaaagattgaacaaaacaaagcaatggaacatgaaagcataggtgtattgaagtgaaagtatactcca

SEQ ID NO: 105321 - DNA, 601 bp, Human
cagcctcctgagtagctgggactacaggcacccgccaccatgcccggctaatttttttgtatttttttttttagtagagactgggtttcaccgtgttagccaggatggtctcgatctcctgaccttgtgatctgcccgcctcggcctcccaaagtgctgggattataggtgtgagccaccgcgcctggccacacagtgcagttcttacctgtaacagctgaggagaaagttgtccacaggcctcatacgtatttaggaggccttggaaatgggcaactgttgaaacactggagctgcaacygcatgtgcttctgaaagtcttctgacacttcctttgcaaatggtggaaaacaaatgaaaaagaagattggaatgttgttttccttctgctctcaacttgtgctcttaaaagtataatttgacttaaatgatagagatggtgtataatgatggaaatgataaatgatggagttttgtattttattctaaatagtataatctgacttaaatgataagagatggtgttatataacaatagaaatgataagtgatggaatttcttattttattctaattatagtatttctttttaggagcagac

SEQ ID NO: 105322 - DNA, 601 bp, Human
cgtatttaggaggccttggaaatgggcaactgttgaaacactggagctgcaactgcatgtgcttctgaaagtcttctgacacttcctttgcaaatggtggaaaacaaatgaaaaagaagattggaatgttgttttccttctgctctcaacttgtgctcttaaaagtataatttgacttaaatgatagagatggtgtataatgatggaaatgataaatgatggagttttgtattttattctaaatagtataatctgacttaaatgataagagatggtgttatataacaatagaaatgataartgatggaatttcttattttattctaattatagtatttctttttaggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagca

SEQ ID NO: 105323 - DNA, 601 bp, Human
aattatttaattttattatttaatccaaaaaaattccagaaattctgtgtaatagtgacagcctatttatgtattatcatcagagaatgaaggttttcatgagtgagtttgttgcatgagagaacttgatctttttaggttctaaagctaaactattttacctgataggaattttccaaaatgtacactgacttctatcttcctaaacagcatccttcatgactgtaccatttatgataatgtcaccaggaagtcactgctgttaaacagctttgcctgcggagacagcagtcttcaactytactctcaatagttcccttatcagtacttctagggttctgctttcatctttttccttctcttctcctgtcaggctgtctgctgttgtgttcctggctgtcaagtttgtatacctttcacagcaagttgttttctgccctcccctccccagccaccctcttccgactccacgtgttttgacactgatgagtgttttctttttctccaatgaggggtaaggactagaaagattgttaaaaaaataagcattagccaagctagttcctgtgactagaagcaaatgtgatgcttgaactgacct

SEQ ID NO: 105324 - DNA, 601 bp, Human
ccgggcacagtggctcacacctgtaatcccagcactttaggaggccaaggcgggtggatcacgaggtcaggagttcgagaccggcctgagcaacaacgtgaaaccctgtctctactaaaaatacaaaaattagccaggcatggtggcaggcgcctgtagtcccagctactcggaagactgagacaggagaattgcttgaacctgggaggcggaggttgcagtgagccgagatcatgccactgcatcccagccggggcgacggagcaaaaaaatatgtatgtgtatgtacgtgtatgtataggtgtgtgtgtgtgtaaaatatgtgtaacatggccaggtgtgatggctcactcctgtaatcccagcactttgggaggccgaggaatgtagatcagttgaggtcaggggttcgagaccagcctggccaagatggtgaaaccctgtctctactaaaaaaaaaaaaaaattagccaggcatcatgaggcatgcctgtaatctcagatacttgggagactgaggcatgagactcacttgaacccgggaggcagaggttgcagtgagccaagatcgtgttactacactgtagccttggtgacagag

SEQ ID NO: 105325 - DNA, 601 bp, Human
ttacgtgttcattttcggctcaaggcgtacacgtgcaggtgtgtcacatgggtaaatcaagtgtcactggggtttggtgtgcagataattttgttgcccaggtaatcagcacagtacctgatgtttttcagtcttcaccctcctcccattctccaccctctacattttcctttaaaaaaaagttttcctcccagcactttgggaggctgaggcgggcagatcacgaggtcaggagttcgagatcaccctgactaacatggtgaaaccctgtctctactaaaaatacaaaaattagccaggygtggtggcggacgccttaatcccagctactcaggaggctgaggcaggagaatcgcttgaacccagggagcagaggttgcagtgagccgagatcgcgccattgcactccagcctgggcgacagagcaagactccctctcaaaaaaaaaaaaaaaaaaaaaaaatttcctggccgggtggggtggctgacacctataatctcagcactttgggagaccgaggcaggcggattacttgagttcaggagtttgagaccagcttggccaatatggggaaaccccatctctactaaaaacacaaaa

SEQ ID NO: 105326 - DNA, 601 bp, Human
aaaagttttcctcccagcactttgggaggctgaggcgggcagatcacgaggtcaggagttcgagatcaccctgactaacatggtgaaaccctgtctctactaaaaatacaaaaattagccaggtgtggtggcggacgccttaatcccagctactcaggaggctgaggcaggagaatcgcttgaacccagggagcagaggttgcagtgagccgagatcgcgccattgcactccagcctgggcgacagagcaagactccctctcaaaaaaaaaaaaaaaaaaaaaaaatttcctggccgggtsgggtggctgacacctataatctcagcactttgggagaccgaggcaggcggattacttgagttcaggagtttgagaccagcttggccaatatggggaaaccccatctctactaaaaacacaaaaatgagccggacgtggtggcgtgtgcctggaatcccagctactcaggaggctgaggcaggagaatcacttgaacccaggaggcggaggttgcagcgagccgggatcgcgccactgcactccagcctgggcaacagagcaagactctgtcttaaaaaaaaaaaagtttccctgattaaa

SEQ ID NO: 105327 - DNA, 601 bp, Human
aattagctgggcgtggtggcgggagcctgtagtcccagctacttggaaggctgaggcaggagaatggcatgaacccgggaggcggagcttgcagtgagccaagattgcgccactgcactccagcctgggcgacagagcaagactccgtctcaaaaaaaaaaaaaaaaagaaaagaaatacggcacacagaacagctcagctgtttaatgttcctctgaggatgctaagcagtgagcttatgtgtggccacatgggtgaacacacacaggcgagggctgggagggagcacagctgcccatgygctccgcttggcctccggaagccttgcagggcgtggcagagctggcctgctccccagctcgtctccagcagctctggcctgctccccagctcgtctccagcggctctggcgtgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcggctctggcgtgctccccagctcgtctccagcggctctg

SEQ ID NO: 105328 - DNA, 601 bp, Human
aggctgaggcaggagaatggcatgaacccgggaggcggagcttgcagtgagccaagattgcgccactgcactccagcctgggcgacagagcaagactccgtctcaaaaaaaaaaaaaaaaagaaaagaaatacggcacacagaacagctcagctgtttaatgttcctctgaggatgctaagcagtgagcttatgtgtggccacatgggtgaacacacacaggcgagggctgggagggagcacagctgcccatgcgctccgcttggcctccggaagccttgcagggcgtggcagagctggcstgctccccagctcgtctccagcagctctggcctgctccccagctcgtctccagcggctctggcgtgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcagctctggcctgctccccagct

SEQ ID NO: 105329 - DNA, 601 bp, Human
tccgtctcaaaaaaaaaaaaaaaaagaaaagaaatacggcacacagaacagctcagctgtttaatgttcctctgaggatgctaagcagtgagcttatgtgtggccacatgggtgaacacacacaggcgagggctgggagggagcacagctgcccatgcgctccgcttggcctccggaagccttgcagggcgtggcagagctggcctgctccccagctcgtctccagcagctctggcctgctccccagctcgtctccagcggctctggcgtgctccccagctcgtctccagcggctctggcstgctccccagctcgtctccagcggctctggcctgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcagctctggcctgctccccagctcgtctccagcggctctggcgtgctccccagctcgtctccagcagctctggcctgctccccagctcgtctccagcggctctggcctgctggtttctc

SEQ ID NO: 105330 - DNA, 601 bp, Human
ggcagagctggcctgctccccagctcgtctccagcagctctggcctgctccccagctcgtctccagcggctctggcgtgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcagctctggcstgctccccagctcgtctccagcggctctggcgtgctccccagctcgtctccagcagctctggcctgctccccagctcgtctccagcggctctggcctgctggtttctcatgaatgcaccagcggattccacctcaggactccgcacgtttccctccacagggacttccccagatgtgcccgtggctccttcttggcatctggtcttagttcccgtcttggctctgcagagagccctcctgggccctcctcttcctgcgtctctgatgctttactctcccttcatgtctgttcgtagcttt

SEQ ID NO: 105331 - DNA, 601 bp, Human
ctcgtctccagcagctctggcctgctccccagctcgtctccagcggctctggcgtgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcagctctggcctgctccccagctcgtctccagcrgctctggcgtgctccccagctcgtctccagcagctctggcctgctccccagctcgtctccagcggctctggcctgctggtttctcatgaatgcaccagcggattccacctcaggactccgcacgtttccctccacagggacttccccagatgtgcccgtggctccttcttggcatctggtcttagttcccgtcttggctctgcagagagccctcctgggccctcctcttcctgcgtctctgatgctttactctcccttcatgtctgttcgtagcttttgatgctacctgaggttatctta

SEQ ID NO: 105332 - DNA, 601 bp, Human
ctcgtctccagcggctctggcgtgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcagctctggcctgctccccagctcgtctccagcggctctggcgtgctccccagctcgtctccagcrgctctggcctgctccccagctcgtctccagcggctctggcctgctggtttctcatgaatgcaccagcggattccacctcaggactccgcacgtttccctccacagggacttccccagatgtgcccgtggctccttcttggcatctggtcttagttcccgtcttggctctgcagagagccctcctgggccctcctcttcctgcgtctctgatgctttactctcccttcatgtctgttcgtagcttttgatgctacctgaggttatcttattcctttgtttcctttttcatatttttgccac

SEQ ID NO: 105333 - DNA, 601 bp, Human
agcggctctggcgtgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcggctctggcgtgctccccagctcgtctccagcggctctggcctgctccccagctcgtctccagcagctctggcctgctccccagctcgtctccagcggctctggcgtgctccccagctcgtctccagcagctctggcstgctccccagctcgtctccagcggctctggcctgctggtttctcatgaatgcaccagcggattccacctcaggactccgcacgtttccctccacagggacttccccagatgtgcccgtggctccttcttggcatctggtcttagttcccgtcttggctctgcagagagccctcctgggccctcctcttcctgcgtctctgatgctttactctcccttcatgtctgttcgtagcttttgatgctacctgaggttatcttattcctttgtttcctttttcatatttttgccactgttcacag

SEQ ID NO: 105334 - DNA, 601 bp, Human
cccagctcgtctccagcggctctggcctgctccccagctcgtctccagcagctctggcctgctccccagctcgtctccagcggctctggcgtgctccccagctcgtctccagcagctctggcctgctccccagctcgtctccagcggctctggcctgctggtttctcatgaatgcaccagcggattccacctcaggactccgcacgtttccctccacagggacttccccagatgtgcccgtggctccttcttggcatctggtcttagttcccgtcttggctctgcagagagccctcctggrccctcctcttcctgcgtctctgatgctttactctcccttcatgtctgttcgtagcttttgatgctacctgaggttatcttattcctttgtttcctttttcatatttttgccactgttcacagcattcccccttgaccaccgttgcctcaggtggtgcatcaggcgcaagttccttcgaggcaggggcacctcttgtctcattcacagccattccctagtgcctagcacagggtcttaggccctggttcctgcacacagctcctcagacctcgggaatctgcagtaatatgagtgtcttat

SEQ ID NO: 105335 - DNA, 601 bp, Human
tgggttctggtgctaactccaggtcgatgatctcagagttgagttgaatgtggagcacgcagctggtgtcggaggggtggtattgaaaaagacgtgcagtgtcagaaatgtaagaacagttcctaggcacacagaatatttgttgaatgggtggatggagatttgcacttcctatggttcacatttattacagacatgttactgttgcaatttttataaaagatgggcagttaccagaaaggaaatgtttaagttcccagattccacataggcagaataagaggatgttcacagctgacayggggcccacgcttgatgagaagcggcttccaatgctccaccttgcatgatgcgttgtgttcccaagtgaacacgtgtgattgaatgcatctgtgtatggtcttgctatgctgcaattatgagtgagaacagaattctcagatgtacaccttccatttctgttctacaaatgatctgtctgtggtgcttccgttttttttttttttctcccttttctcaagttagctgaggtgctttagtttcaaaaactatacagagagcagggagaaaggccaggggcatacagggcagatgaaatatg

SEQ ID NO: 105336 - DNA, 601 bp, Human
aaaaaatatttcattcactgaatgttccaccacgtattaaaccaaaaacctcatttttggacctttagctttaattctttgctgtgcaaacatttggcttcaatattggggtatatttgtaattatttatttaacagcttcttttaaaatatgctctcaaggtgatactttactaacattgtaatttctcagcttcttaagaaaccagaaaagggagaggaaccaaccacagagaaaccaaaagaaagaggagaggagattgatactggaggtggcaagcaggaatcctgtgcccccggtrcagtcgtaaaagccaggcccatggaaggctcgctggaggagccccaggagacgtgagcgtgctttcattgttatgaccacgtcagctcccagtcatggtgacgtaggctttgtcagtatgagtatgcctatttcacactgttcttggaatccaagactttccagggtgtgcgagtacacgttagccttcatttcccatcagcatggcaggaacgtagtgaactcgtcttgtctgcagtctcaagtctgtcttcagatcgggagtttcttcctgttgtttgctttgcttttgcctccatgt

SEQ ID NO: 105337 - DNA, 601 bp, Human
gacctttagctttaattctttgctgtgcaaacatttggcttcaatattggggtatatttgtaattatttatttaacagcttcttttaaaatatgctctcaaggtgatactttactaacattgtaatttctcagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtgagcrtgctttcattgttatgaccacgtcagctcccagtcatggtgacgtaggctttgtcagtatgagtatgcctatttcacactgttcttggaatccaagactttccagggtgtgcgagtacacgttagccttcatttcccatcagcatggcaggaacgtagtgaactcgtcttgtctgcagtctcaagtctgtcttcagatcgggagtttcttcctgttgtttgctttgcttttgcctccatgtcctccttttactcctgagccgcctcctggattcctgctgttgcatgtcaggtcttcagg

SEQ ID NO: 105338 - DNA, 601 bp, Human
taattatttatttaacagcttcttttaaaatatgctctcaaggtgatactttactaacattgtaatttctcagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtgagcgtgctttcattgttatgaccacgtcagctcccagtcatggtgacgtaggctttgtcagtaygagtatgcctatttcacactgttcttggaatccaagactttccagggtgtgcgagtacacgttagccttcatttcccatcagcatggcaggaacgtagtgaactcgtcttgtctgcagtctcaagtctgtcttcagatcgggagtttcttcctgttgtttgctttgcttttgcctccatgtcctccttttactcctgagccgcctcctggattcctgctgttgcatgtcaggtcttcaggatctgtcttcccagtctttctttttgttttttgttttttatttttctctgtgtttgtgat

SEQ ID NO: 105339 - DNA, 601 bp, Human
ttgatactggaggtggcaagcaggaatcctgtgcccccggtgcagtcgtaaaagccaggcccatggaaggctcgctggaggagccccaggagacgtgagcgtgctttcattgttatgaccacgtcagctcccagtcatggtgacgtaggctttgtcagtatgagtatgcctatttcacactgttcttggaatccaagactttccagggtgtgcgagtacacgttagccttcatttcccatcagcatggcaggaacgtagtgaactcgtcttgtctgcagtctcaagtctgtcttcagatcrggagtttcttcctgttgtttgctttgcttttgcctccatgtcctccttttactcctgagccgcctcctggattcctgctgttgcatgtcaggtcttcaggatctgtcttcccagtctttctttttgttttttgttttttatttttctctgtgtttgtgatatcttgccctttgctcttttatcccccttgcaatttatctacagaattgcatatttgggaaccccctcttttaggtctggcagatcttttgtgatagagaaacagaattttaagtgctgtgatcctttggttgaagctgt

SEQ ID NO: 105340 - DNA, 601 bp, Human
atactggaggtggcaagcaggaatcctgtgcccccggtgcagtcgtaaaagccaggcccatggaaggctcgctggaggagccccaggagacgtgagcgtgctttcattgttatgaccacgtcagctcccagtcatggtgacgtaggctttgtcagtatgagtatgcctatttcacactgttcttggaatccaagactttccagggtgtgcgagtacacgttagccttcatttcccatcagcatggcaggaacgtagtgaactcgtcttgtctgcagtctcaagtctgtcttcagatcgggrgtttcttcctgttgtttgctttgcttttgcctccatgtcctccttttactcctgagccgcctcctggattcctgctgttgcatgtcaggtcttcaggatctgtcttcccagtctttctttttgttttttgttttttatttttctctgtgtttgtgatatcttgccctttgctcttttatcccccttgcaatttatctacagaattgcatatttgggaaccccctcttttaggtctggcagatcttttgtgatagagaaacagaattttaagtgctgtgatcctttggttgaagctgtccc

SEQ ID NO: 105341 - DNA, 601 bp, Human
gttgcatgtcaggtcttcaggatctgtcttcccagtctttctttttgttttttgttttttatttttctctgtgtttgtgatatcttgccctttgctcttttatcccccttgcaatttatctacagaattgcatatttgggaaccccctcttttaggtctggcagatcttttgtgatagagaaacagaattttaagtgctgtgatcctttggttgaagctgtccctggctcctctggctgtggatcttgaccagcagctttggctgtgcactgtgggtcctccctttttcttttcctttgcygcatatgacagtgcagctctatggagggagctcatctgcgaaagggacagacacagcattatctgcccggtgggccagagagaccagccagatgccagtcaggagggatcctgtccctcttgctcctggcatccaccatcctcagggccccaggcacctgggcttaccttcccctccgggactcctgcccactcactgcctctcgccacccacagtctcctggtgcccagggccacttggcccacaggggatgatggacgtggattttaggtgggaagactaatgcgattaggctgccgg

SEQ ID NO: 105342 - DNA, 601 bp, Human
tcaaaagaaggtatttactttggagggttattgagaattagaaaatatgtataaaaagtaccttagcatggccaggcacggtggctcacacctgtaatcccagcactttgggaggccaagatgggcatatcataaggtcaggagatcgagaccatcctaactaacacagtgaaaccccgtctctactaaaaatacacaaaaaattagccgggcgtggtcgcgggcacctgtagtcccagctactcgggaggctgaggcaggaggatggtgtgaacccaggaggcggagctttcagtgagcygagatcccgccattttactccagcctgggcaacagagcgagactccatctcagaaaaaaaaaaaaaaagtaccttagtataaggcatattgcctatctgtcactcaactgaaatgacagatactattactatgatttattcctctttgtagtggtttttatcaacgcctgctgtgtgcccatcgcagtgcagcctcagcagtgcagcgctgagcacttcgcatgggtccctgttgtctgggaacctgtggtctagaaaggagggtgggcagccaaccggcggtttactgcagttgctgat

SEQ ID NO: 105343 - DNA, 601 bp, Human
ccgggcgtggtcgcgggcacctgtagtcccagctactcgggaggctgaggcaggaggatggtgtgaacccaggaggcggagctttcagtgagctgagatcccgccattttactccagcctgggcaacagagcgagactccatctcagaaaaaaaaaaaaaaagtaccttagtataaggcatattgcctatctgtcactcaactgaaatgacagatactattactatgatttattcctctttgtagtggtttttatcaacgcctgctgtgtgcccatcgcagtgcagcctcagcagtgcagygctgagcacttcgcatgggtccctgttgtctgggaacctgtggtctagaaaggagggtgggcagccaaccggcggtttactgcagttgctgatcatttgtgttgaatcataggtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaaga

SEQ ID NO: 105344 - DNA, 601 bp, Human
ctatctgtcactcaactgaaatgacagatactattactatgatttattcctctttgtagtggtttttatcaacgcctgctgtgtgcccatcgcagtgcagcctcagcagtgcagcgctgagcacttcgcatgggtccctgttgtctgggaacctgtggtctagaaaggagggtgggcagccaaccggcggtttactgcagttgctgatcatttgtgttgaatcataggtcacacagcggcagtgataaagagcacagggatgtggagagatctcaagaacaagaatctgaagcacaaagayaccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggtttttattaaacccaaaaagaaaaatgtgtctggctgtcttaaggtccaggctgcatgctgaccatgtcacccccact

SEQ ID NO: 105345 - DNA, 601 bp, Human
actgaaatgacagatactattactatgatttattcctctttgtagtggtttttatcaacgcctgctgtgtgcccatcgcagtgcagcctcagcagtgcagcgctgagcacttcgcatgggtccctgttgtctgggaacctgtggtctagaaaggagggtgggcagccaaccggcggtttactgcagttgctgatcatttgtgttgaatcataggtcacacagcggcagtgataaagagcacagggatgtggagagatctcaagaacaagaatctgaagcacaaagataccatgtggatgayggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggtttttattaaacccaaaaagaaaaatgtgtctggctgtcttaaggtccaggctgcatgctgaccatgtcacccccacttggccttgtgtctt

SEQ ID NO: 105346 - DNA, 601 bp, Human
tcctctttgtagtggtttttatcaacgcctgctgtgtgcccatcgcagtgcagcctcagcagtgcagcgctgagcacttcgcatgggtccctgttgtctgggaacctgtggtctagaaaggagggtgggcagccaaccggcggtttactgcagttgctgatcatttgtgttgaatcataggtcacacagcggcagtgataaagagcacagggatgtggagagatctcaagaacaagaatctgaagcacaaagataccatgtggatgacggcaggaggcacagagctcaccacgagcctgamcggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggtttttattaaacccaaaaagaaaaatgtgtctggctgtcttaaggtccaggctgcatgctgaccatgtcacccccacttggccttgtgtcttggggaacgcagtgctttgagcattttcaagagc

SEQ ID NO: 105347 - DNA, 601 bp, Human
ggtttttatcaacgcctgctgtgtgcccatcgcagtgcagcctcagcagtgcagcgctgagcacttcgcatgggtccctgttgtctgggaacctgtggtctagaaaggagggtgggcagccaaccggcggtttactgcagttgctgatcatttgtgttgaatcataggtcacacagcggcagtgataaagagcacagggatgtggagagatctcaagaacaagaatctgaagcacaaagataccatgtggatgacggcaggaggcacagagctcaccacgagcctgaacggctttccagarggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggtttttattaaacccaaaaagaaaaatgtgtctggctgtcttaaggtccaggctgcatgctgaccatgtcacccccacttggccttgtgtcttggggaacgcagtgctttgagcattttcaagagcagtttttcctgaa

SEQ ID NO: 105348 - DNA, 601 bp, Human
ccgaaacgcagccggcagcaggtactcgagatgagtagtgtgagctcccgagcacccgtaggtcggattatctggtaaggcaccggaagtgaccgcctcgcggctgcttcctctcctggagtccagagtcccgttgctccgccgcgatattcagtaaaccactgggagtccggcagcatggaggcagcgcgccctcccccgacggcagggaagttcgtggtggtcggcggcggcatcgcgggcgtcacttgtgcggagcaggtagggcggtgctcaggcggttccgcctctttccccgacmccaaaggggatagcactggaggccttcctcccaccccctccctttttcttcttccgggttccttttttgctgcgcccttttccgcacttattgctcccagattttagaaactgcttggtggtcctcagatgacctcactagctttctcttaggcgcagggaggagtgggaggcaaattatagccgagaaaccaaagctggctgatccgtgctcagatccttgtaatgtcagagcagacatgaggactttgtatttagacaaaaaattcagccccctttctttttctttttttttcttttt

SEQ ID NO: 105349 - DNA, 601 bp, Human
tacttcgaactcccaagatagaagaaactttatttctagtaaagttttgtaaaataatcagcgaaggattaaatgcatgtagggcttgctttcttgattatactgaatagccagaccatatatattcagatacatgtgtgtattccaaaaagttctacattattttgttgatataaagtaaacatgagcaatcactgaagtcataagaaatagtggaagaaactcaagtgtttccatcgttggatgcgtattttccgtttattcactaagtaaacatatatgatgcaggcaccgtattaasggctgagtgttcaactatgaacagcatggtatataccatgctggggactcacagcctgctggaagagacaatattacaatattgtatgtctatgcaagagatatcaacggttatcttagaggtgcctgtggagtatgtagggagtgaattagggaagaggaaatttttttaatcaaagaaggtatttttaaaatctcattatgaaagaatgagtgaaagtttaccaagtattcaagaaaagaatgtcatctccagtggaaaagcatggatcatcagggagcagtaaagcttaaagcatag

SEQ ID NO: 105350 - DNA, 601 bp, Human
gttttgtaaaataatcagcgaaggattaaatgcatgtagggcttgctttcttgattatactgaatagccagaccatatatattcagatacatgtgtgtattccaaaaagttctacattattttgttgatataaagtaaacatgagcaatcactgaagtcataagaaatagtggaagaaactcaagtgtttccatcgttggatgcgtattttccgtttattcactaagtaaacatatatgatgcaggcaccgtattaagggctgagtgttcaactatgaacagcatggtatataccatgctrgggactcacagcctgctggaagagacaatattacaatattgtatgtctatgcaagagatatcaacggttatcttagaggtgcctgtggagtatgtagggagtgaattagggaagaggaaatttttttaatcaaagaaggtatttttaaaatctcattatgaaagaatgagtgaaagtttaccaagtattcaagaaaagaatgtcatctccagtggaaaagcatggatcatcagggagcagtaaagcttaaagcatagatcataaggagtcttagcatgctgagaacttaacaagaattta

SEQ ID NO: 105351 - DNA, 601 bp, Human
gaaggattaaatgcatgtagggcttgctttcttgattatactgaatagccagaccatatatattcagatacatgtgtgtattccaaaaagttctacattattttgttgatataaagtaaacatgagcaatcactgaagtcataagaaatagtggaagaaactcaagtgtttccatcgttggatgcgtattttccgtttattcactaagtaaacatatatgatgcaggcaccgtattaagggctgagtgttcaactatgaacagcatggtatataccatgctggggactcacagcctgctgraagagacaatattacaatattgtatgtctatgcaagagatatcaacggttatcttagaggtgcctgtggagtatgtagggagtgaattagggaagaggaaatttttttaatcaaagaaggtatttttaaaatctcattatgaaagaatgagtgaaagtttaccaagtattcaagaaaagaatgtcatctccagtggaaaagcatggatcatcagggagcagtaaagcttaaagcatagatcataaggagtcttagcatgctgagaacttaacaagaatttacaagtagtcaaatgttttt

SEQ ID NO: 105352 - DNA, 601 bp, Human
tgtgtattccaaaaagttctacattattttgttgatataaagtaaacatgagcaatcactgaagtcataagaaatagtggaagaaactcaagtgtttccatcgttggatgcgtattttccgtttattcactaagtaaacatatatgatgcaggcaccgtattaagggctgagtgttcaactatgaacagcatggtatataccatgctggggactcacagcctgctggaagagacaatattacaatattgtatgtctatgcaagagatatcaacggttatcttagaggtgcctgtggagtakgtagggagtgaattagggaagaggaaatttttttaatcaaagaaggtatttttaaaatctcattatgaaagaatgagtgaaagtttaccaagtattcaagaaaagaatgtcatctccagtggaaaagcatggatcatcagggagcagtaaagcttaaagcatagatcataaggagtcttagcatgctgagaacttaacaagaatttacaagtagtcaaatgtttttgagcagtggagtaacttgatcatatgaaaaggcttgaaagatgattagttacaatgtatttgtggcagaggcag

SEQ ID NO: 105353 - DNA, 601 bp, Human
gttcaactatgaacagcatggtatataccatgctggggactcacagcctgctggaagagacaatattacaatattgtatgtctatgcaagagatatcaacggttatcttagaggtgcctgtggagtatgtagggagtgaattagggaagaggaaatttttttaatcaaagaaggtatttttaaaatctcattatgaaagaatgagtgaaagtttaccaagtattcaagaaaagaatgtcatctccagtggaaaagcatggatcatcagggagcagtaaagcttaaagcatagatcataagkagtcttagcatgctgagaacttaacaagaatttacaagtagtcaaatgtttttgagcagtggagtaacttgatcatatgaaaaggcttgaaagatgattagttacaatgtatttgtggcagaggcagctggtttatacgtgaaactggagagccaattcgaaggtgatttcagtagtataaagaagttttgaggacctcatctagcaatggaaacagcagagatataaattacagaatatacagaggaaagaaagatggagagagtaatgatattgtcaaatatagaaagttcaaataaa

SEQ ID NO: 105354 - DNA, 601 bp, Human
atcagggagcagtaaagcttaaagcatagatcataaggagtcttagcatgctgagaacttaacaagaatttacaagtagtcaaatgtttttgagcagtggagtaacttgatcatatgaaaaggcttgaaagatgattagttacaatgtatttgtggcagaggcagctggtttatacgtgaaactggagagccaattcgaaggtgatttcagtagtataaagaagttttgaggacctcatctagcaatggaaacagcagagatataaattacagaatatacagaggaaagaaagatggagaragtaatgatattgtcaaatatagaaagttcaaataaaatgagactgagaagaatcgcatgggtgttgggcacgatagctcacacttgtaatcttagaactttgggaggccaaggtgggaggattgcatgagtccaggagtttgaagccagactgggcaacatggcaagatcccatctccattaaaaaaaaaataaataatcccttggattttaaggattcatagatccctcaaacatgctgttttagtgatggagtaggaatagaagccagattattgagggtggtggtgtcgaggaacc

SEQ ID NO: 105355 - DNA, 601 bp, Human
gctgagaacttaacaagaatttacaagtagtcaaatgtttttgagcagtggagtaacttgatcatatgaaaaggcttgaaagatgattagttacaatgtatttgtggcagaggcagctggtttatacgtgaaactggagagccaattcgaaggtgatttcagtagtataaagaagttttgaggacctcatctagcaatggaaacagcagagatataaattacagaatatacagaggaaagaaagatggagagagtaatgatattgtcaaatatagaaagttcaaataaaatgagactgagwagaatcgcatgggtgttgggcacgatagctcacacttgtaatcttagaactttgggaggccaaggtgggaggattgcatgagtccaggagtttgaagccagactgggcaacatggcaagatcccatctccattaaaaaaaaaataaataatcccttggattttaaggattcatagatccctcaaacatgctgttttagtgatggagtaggaatagaagccagattattgagggtggtggtgtcgaggaaccagactttgagataagaaaatgctttcaggtacagagtgaagaagaccga

SEQ ID NO: 105356 - DNA, 601 bp, Human
gccaattcgaaggtgatttcagtagtataaagaagttttgaggacctcatctagcaatggaaacagcagagatataaattacagaatatacagaggaaagaaagatggagagagtaatgatattgtcaaatatagaaagttcaaataaaatgagactgagaagaatcgcatgggtgttgggcacgatagctcacacttgtaatcttagaactttgggaggccaaggtgggaggattgcatgagtccaggagtttgaagccagactgggcaacatggcaagatcccatctccattaaaaaawaaataaataatcccttggattttaaggattcatagatccctcaaacatgctgttttagtgatggagtaggaatagaagccagattattgagggtggtggtgtcgaggaaccagactttgagataagaaaatgctttcaggtacagagtgaagaagaccgaggttgtagctaaaggaaaataatgaaacattaacaagttatacctctaaattttgtggaagcaattattaaaatggctttatcgtcccacaatatgtactgactggaagaggcagaataggagtgccagagcacctgggg

SEQ ID NO: 105357 - DNA, 601 bp, Human
taacaagttatacctctaaattttgtggaagcaattattaaaatggctttatcgtcccacaatatgtactgactggaagaggcagaataggagtgccagagcacctggggaaagttagaccaatattctaagtgtttaatattgagggtttgctttaatttcatcccattgaagacaaatgaaatattattttaagataaatagaagttggtttaactggtaattaggaagatagtttattctcatcctctgcattataactctaaattggtataaaaaatagttgaagtaaataaaggayatttctttatatcacttttcttgttcaggagttctttgttagtgtttactgtaaatattattttctcagtatcagagtttaatattattcaccattgccccatcaagaccaaggataatggagacctttagatgaggaacagtgggtttttaattttctagattaattacattattaaaattgcattattctcaaccccaaaccatatataccagtacttaaagtaatttgtcctaattttttttctctctttttaaaaataagttggctactcactttccatcggaagatattctcttg

SEQ ID NO: 105358 - DNA, 601 bp, Human
gttggctactcactttccatcggaagatattctcttggtaacagcttctcctgttattaaagcagttacaaatttcaagcaggtaagaacctttgtataacttcttaatattaatttgaaaaaattgcaataacttgcatagcagttagggtaattgtgtatttttttctttcttaaaaattgacaagtacagttatatgctgtacaacatgatgttttgatacatgtatacattgtggaatggctaagtcaagctatttaaaatctttccaatttggatgccttttatttctttctgtcactaatttaattgctctagctaggactttagtactgtgttgaatagaagttgtgagagtgggcatccttgtgttgttcttgatcttggaaaagctttcagcttttctccattcaatatattattagctataggcttgtatatgaccatttttttgttgtggtacattccttccatacctaattgttgggtttttattatgaaaagacatttaattttgttgaatattttttctatatctgtagagatggtcatgatttttgtcctttgttctgttaatgtggtatatcacatttaccgatt

SEQ ID NO: 105359 - DNA, 601 bp, Human
tttgaaaaaattgcaataacttgcatagcagttagggtaattgtgtatttttttctttcttaaaaattgacaagtacagttatatgctgtacaacatgatgttttgatacatgtatacattgtggaatggctaagtcaagctatttaaaatctttccaatttggatgccttttatttctttctgtccctaatttaattgctctagctaggactttagtactgtgttgaatagaagttgtgagagtgggcatccttgtgttgttcttgatcttggaaaagctttcagcttttctccattcartatattattagctataggcttgtatatgaccatttttttgttgtggtacattccttccatacctaattgttgggtttttattatgaaaagacatttaattttgttgaatattttttctatatctgtagagatggtcatgatttttgtcctttgttctgttaatgtggtatatcacatttaccgatttgcatattttaagccatctttgcatccctgaataaatcccacttgattatggtgaattgattgcttttttttgagatggagtctcaccctgttgcccagactggagtgcagtgg

SEQ ID NO: 105360 - DNA, 601 bp, Human
acatgatgttttgatacatgtatacattgtggaatggctaagtcaagctatttaaaatctttccaatttggatgccttttatttctttctgtccctaatttaattgctctagctaggactttagtactgtgttgaatagaagttgtgagagtgggcatccttgtgttgttcttgatcttggaaaagctttcagcttttctccattcaatatattattagctataggcttgtatatgaccatttttttgttgtggtacattccttccatacctaattgttgggtttttattatgaaaagacrtttaattttgttgaatattttttctatatctgtagagatggtcatgatttttgtcctttgttctgttaatgtggtatatcacatttaccgatttgcatattttaagccatctttgcatccctgaataaatcccacttgattatggtgaattgattgcttttttttgagatggagtctcaccctgttgcccagactggagtgcagtggcacgatcttggctcactgcaagctccgcctcctgggttcacgccattctcctgcctcagcctcccaagtagctaggactacaggcgcccgcaa

SEQ ID NO: 105361 - DNA, 601 bp, Human
ctataggcttgtatatgaccatttttttgttgtggtacattccttccatacctaattgttgggtttttattatgaaaagacatttaattttgttgaatattttttctatatctgtagagatggtcatgatttttgtcctttgttctgttaatgtggtatatcacatttaccgatttgcatattttaagccatctttgcatccctgaataaatcccacttgattatggtgaattgattgcttttttttgagatggagtctcaccctgttgcccagactggagtgcagtggcacgatcttggytcactgcaagctccgcctcctgggttcacgccattctcctgcctcagcctcccaagtagctaggactacaggcgcccgcaaccatgcccagctaattttttgtattttttagtagagacggggtttcaccatattggccaggctggtctggaactcctgacctcgtgatccatccacctcggcctcccaaattgctgggattacaggtgtgagccaccgcgcccagcctggaaagttttctgttgttatttctttaaatacatgttctactcctttgtctttcttgtctccttctataac

SEQ ID NO: 105362 - DNA, 601 bp, Human
acatttaattttgttgaatattttttctatatctgtagagatggtcatgatttttgtcctttgttctgttaatgtggtatatcacatttaccgatttgcatattttaagccatctttgcatccctgaataaatcccacttgattatggtgaattgattgcttttttttgagatggagtctcaccctgttgcccagactggagtgcagtggcacgatcttggctcactgcaagctccgcctcctgggttcacgccattctcctgcctcagcctcccaagtagctaggactacaggcgcccgyaaccatgcccagctaattttttgtattttttagtagagacggggtttcaccatattggccaggctggtctggaactcctgacctcgtgatccatccacctcggcctcccaaattgctgggattacaggtgtgagccaccgcgcccagcctggaaagttttctgttgttatttctttaaatacatgttctactcctttgtctttcttgtctccttctataacgcctataattcaaagatttgctcatttgatgccatcctttaattccctacttctatgttctttttcattcttttttctt

SEQ ID NO: 105363 - DNA, 601 bp, Human
ttcatcgtcagaatttctgctttagtttttaaataactttttaaattttttgttttggttgcttattgtttttctgatttaattgaattgtttgtaacttcttgaagttccttcagcttctttaaacaattattttgaattcttaggcagttctgacatttgtgttcttttggtggcatatcttcttggtttatcatgtttcttactgccttatgttgatgtttgcacatttgatgacacacttgctgttttcagaagtatgggctagttttgctgtggaaagaccttcccctatggggakggctgcttgctagatgggatgtagcagttctggcaccagtgagggtgcccactttgtagtctgtgcagctccgtcagctgagttaattgttgttgaagattgcagggatcctcagcatccaactctggatgtctgcagtggtagtgagggttgttggggttttcaatgtcaatggctgctaatagcctcccaatcttttcttctcccacaaaggaagttgtggcttaggggatccctgttggcactgagtctgccttctgggttcagtggcagcagcgctggtgtctgataagtggtgcc

SEQ ID NO: 105364 - DNA, 601 bp, Human
ctttagtttttaaataactttttaaattttttgttttggttgcttattgtttttctgatttaattgaattgtttgtaacttcttgaagttccttcagcttctttaaacaattattttgaattcttaggcagttctgacatttgtgttcttttggtggcatatcttcttggtttatcatgtttcttactgccttatgttgatgtttgcacatttgatgacacacttgctgttttcagaagtatgggctagttttgctgtggaaagaccttcccctatggggagggctgcttgctagatgggwtgtagcagttctggcaccagtgagggtgcccactttgtagtctgtgcagctccgtcagctgagttaattgttgttgaagattgcagggatcctcagcatccaactctggatgtctgcagtggtagtgagggttgttggggttttcaatgtcaatggctgctaatagcctcccaatcttttcttctcccacaaaggaagttgtggcttaggggatccctgttggcactgagtctgccttctgggttcagtggcagcagcgctggtgtctgataagtggtgcctatggagcagatagagctg

SEQ ID NO: 105365 - DNA, 601 bp, Human
agttctgacatttgtgttcttttggtggcatatcttcttggtttatcatgtttcttactgccttatgttgatgtttgcacatttgatgacacacttgctgttttcagaagtatgggctagttttgctgtggaaagaccttcccctatggggagggctgcttgctagatgggatgtagcagttctggcaccagtgagggtgcccactttgtagtctgtgcagctccgtcagctgagttaattgttgttgaagattgcagggatcctcagcatccaactctggatgtctgcagtggtagtgarggttgttggggttttcaatgtcaatggctgctaatagcctcccaatcttttcttctcccacaaaggaagttgtggcttaggggatccctgttggcactgagtctgccttctgggttcagtggcagcagcgctggtgtctgataagtggtgcctatggagcagatagagctgaggcccaaaacacaggcatacacggaggaattaaagttctgggatctgggactgtaatgatattggtgcctagggtgcaggtacccgtactgctatattggtaatagaatatgaggtgaggatgcttgt

SEQ ID NO: 105366 - DNA, 601 bp, Human
tttgatgacacacttgctgttttcagaagtatgggctagttttgctgtggaaagaccttcccctatggggagggctgcttgctagatgggatgtagcagttctggcaccagtgagggtgcccactttgtagtctgtgcagctccgtcagctgagttaattgttgttgaagattgcagggatcctcagcatccaactctggatgtctgcagtggtagtgagggttgttggggttttcaatgtcaatggctgctaatagcctcccaatcttttcttctcccacaaaggaagttgtggcttagrggatccctgttggcactgagtctgccttctgggttcagtggcagcagcgctggtgtctgataagtggtgcctatggagcagatagagctgaggcccaaaacacaggcatacacggaggaattaaagttctgggatctgggactgtaatgatattggtgcctagggtgcaggtacccgtactgctatattggtaatagaatatgaggtgaggatgcttgtgaggcagccagggaaaccaagaatgggaacacatgtgtgctcagagttacagcagcttcagtgtcagggcagggcctagct

SEQ ID NO: 105367 - DNA, 601 bp, Human
cttctgggttcagtggcagcagcgctggtgtctgataagtggtgcctatggagcagatagagctgaggcccaaaacacaggcatacacggaggaattaaagttctgggatctgggactgtaatgatattggtgcctagggtgcaggtacccgtactgctatattggtaatagaatatgaggtgaggatgcttgtgaggcagccagggaaaccaagaatgggaacacatgtgtgctcagagttacagcagcttcagtgtcagggcagggcctagctttcaatggcagctgagccagtgcctrgattgcagacatgtgcagtgaggattggttgcaggccccaaagtgcaaactagcttactatggtgatggctctggtgtctgagatgtaggtgggcccagtatgggccgtagaacctgggtctgaggtgtaggcattctcagagtgaccatggccctggggttggaacactcacagggttgaggacaaagtgactcctttgccaaagcatcttgacattggccacttctttgtggagacaagatatgccgccatgtctcccactctagggttccctggcaggaatggttgttggtcccctc

SEQ ID NO: 105368 - DNA, 601 bp, Human
ctggtgtctgataagtggtgcctatggagcagatagagctgaggcccaaaacacaggcatacacggaggaattaaagttctgggatctgggactgtaatgatattggtgcctagggtgcaggtacccgtactgctatattggtaatagaatatgaggtgaggatgcttgtgaggcagccagggaaaccaagaatgggaacacatgtgtgctcagagttacagcagcttcagtgtcagggcagggcctagctttcaatggcagctgagccagtgcctagattgcagacatgtgcagtgaggmttggttgcaggccccaaagtgcaaactagcttactatggtgatggctctggtgtctgagatgtaggtgggcccagtatgggccgtagaacctgggtctgaggtgtaggcattctcagagtgaccatggccctggggttggaacactcacagggttgaggacaaagtgactcctttgccaaagcatcttgacattggccacttctttgtggagacaagatatgccgccatgtctcccactctagggttccctggcaggaatggttgttggtcccctcacagtagcaagggatgccagtttc

SEQ ID NO: 105369 - DNA, 601 bp, Human
tctgggatctgggactgtaatgatattggtgcctagggtgcaggtacccgtactgctatattggtaatagaatatgaggtgaggatgcttgtgaggcagccagggaaaccaagaatgggaacacatgtgtgctcagagttacagcagcttcagtgtcagggcagggcctagctttcaatggcagctgagccagtgcctagattgcagacatgtgcagtgaggattggttgcaggccccaaagtgcaaactagcttactatggtgatggctctggtgtctgagatgtaggtgggcccagtaygggccgtagaacctgggtctgaggtgtaggcattctcagagtgaccatggccctggggttggaacactcacagggttgaggacaaagtgactcctttgccaaagcatcttgacattggccacttctttgtggagacaagatatgccgccatgtctcccactctagggttccctggcaggaatggttgttggtcccctcacagtagcaagggatgccagtttcctctgcagtgcaggccaccatttaccacagtggtccccaccatgtggctgatactgatagcctctgcctttctttgct

SEQ ID NO: 105370 - DNA, 601 bp, Human
cagcagcttcagtgtcagggcagggcctagctttcaatggcagctgagccagtgcctagattgcagacatgtgcagtgaggattggttgcaggccccaaagtgcaaactagcttactatggtgatggctctggtgtctgagatgtaggtgggcccagtatgggccgtagaacctgggtctgaggtgtaggcattctcagagtgaccatggccctggggttggaacactcacagggttgaggacaaagtgactcctttgccaaagcatcttgacattggccacttctttgtggagacaagayatgccgccatgtctcccactctagggttccctggcaggaatggttgttggtcccctcacagtagcaagggatgccagtttcctctgcagtgcaggccaccatttaccacagtggtccccaccatgtggctgatactgatagcctctgcctttctttgctcctagctatctcctagtttctcaggtatgccagggtcattattgattcttttatgtggttattctccattttcatgctccactgtgttgctgcagattgtttaatgggccgttgagccctctttgggctattttggcttgt

SEQ ID NO: 105371 - DNA, 601 bp, Human
ggccccaaagtgcaaactagcttactatggtgatggctctggtgtctgagatgtaggtgggcccagtatgggccgtagaacctgggtctgaggtgtaggcattctcagagtgaccatggccctggggttggaacactcacagggttgaggacaaagtgactcctttgccaaagcatcttgacattggccacttctttgtggagacaagatatgccgccatgtctcccactctagggttccctggcaggaatggttgttggtcccctcacagtagcaagggatgccagtttcctctgcagtrcaggccaccatttaccacagtggtccccaccatgtggctgatactgatagcctctgcctttctttgctcctagctatctcctagtttctcaggtatgccagggtcattattgattcttttatgtggttattctccattttcatgctccactgtgttgctgcagattgtttaatgggccgttgagccctctttgggctattttggcttgtgaagatttgtctatatttgttttttttaatgggggaatgaaggctggtatctcctacttagccatcttgatgacaatacctccatgtattc

SEQ ID NO: 105372 - DNA, 601 bp, Human
tgcagtgcaggccaccatttaccacagtggtccccaccatgtggctgatactgatagcctctgcctttctttgctcctagctatctcctagtttctcaggtatgccagggtcattattgattcttttatgtggttattctccattttcatgctccactgtgttgctgcagattgtttaatgggccgttgagccctctttgggctattttggcttgtgaagatttgtctatatttgttttttttaatgggggaatgaaggctggtatctcctacttagccatcttgatgacaatacctccakgtattctggagtgttttaattgtttaaaattacaaatattcttttgagagttattttaaaaaagctcgagttgagaattattcagatagaataccagaagctcccagaatgatactaaatttttaatcttctattctttttctccattttccttccacttagaattacttttgagaaagtttccaataaaaaattttcaggaaagatgctctgcaaatctaaaatgggtacaaatatacatgatatttattatcaatatgggtaggggtgtgtgtgtgtgtttacacatcagaaaagtgc

SEQ ID NO: 105373 - DNA, 601 bp, Human
aggtatgccagggtcattattgattcttttatgtggttattctccattttcatgctccactgtgttgctgcagattgtttaatgggccgttgagccctctttgggctattttggcttgtgaagatttgtctatatttgttttttttaatgggggaatgaaggctggtatctcctacttagccatcttgatgacaatacctccatgtattctggagtgttttaattgtttaaaattacaaatattcttttgagagttattttaaaaaagctcgagttgagaattattcagatagaataccaraagctcccagaatgatactaaatttttaatcttctattctttttctccattttccttccacttagaattacttttgagaaagtttccaataaaaaattttcaggaaagatgctctgcaaatctaaaatgggtacaaatatacatgatatttattatcaatatgggtaggggtgtgtgtgtgtgtttacacatcagaaaagtgcttccaagccaagtttatacttatagataattagtgtctcagaatactttgtattccattaatttatattcacattatagtaggagtctaagaacagt

SEQ ID NO: 105374 - DNA, 601 bp, Human
ttaatcttctattctttttctccattttccttccacttagaattacttttgagaaagtttccaataaaaaattttcaggaaagatgctctgcaaatctaaaatgggtacaaatatacatgatatttattatcaatatgggtaggggtgtgtgtgtgtgtttacacatcagaaaagtgcttccaagccaagtttatacttatagataattagtgtctcagaatactttgtattccattaatttatattcacattatagtaggagtctaagaacagttgggtaatagtatcatagaaaagtcwtctccaaactttttttttcctgtagctcaactgttaaaaagttttgccctgacatcccaatatatgtatactaataagttatgtgtatgagctacagaactacaattataaatgttataaagcctatgcaaaataaaatttctaaaatgtcgaaaaacgtacattctgatctttcttcccacccttcagtgaagactactaccatagcccttcatttaatacgatgtctctggtaatatcctgataatggaatataattttctcatgttgtaaacccataagaccaagggtagtttagtg

SEQ ID NO: 105375 - DNA, 601 bp, Human
ctttccagaagacctaattcagtataataatccaagagttgtgagacttgaattcagtttttgccggttttgtaagttatatacaacagaaggaaaaagcttggtttctaggcctcttatttactggtcgggtagccttggaagatctctgtaagctgcttcacctgtagtattaggttaatactttccttgcttacttcacagggttgtgaacttaaatgtgccaataacaaatatacaaatatcagctattctgtgtacagcagtaggaaatggcattatctttatgatttattgagtrcctatattatatattaaccaatgtgctaggcacataagataaggagattaaaagtatagaacataacaccaaaaagtcactagtgcttatcctgagggattaaggatgagatatgaagagtgatagagactttaacatttactctgtattatgtattgtttgtttagtgttacaaagagcatgattcatgacttgtataatttttaaaggagaaaaaagattactgctaataattcacatttattaagtgcttaccatgcatcaagtagccttctaaaggtttcagatctattctatgat

SEQ ID NO: 105376 - DNA, 601 bp, Human
gtaagataattgttttcttaataacattttccattgttgaatcttgatgaagttttgcctgcctcttttcactccagctctactaccaccaccatttaagtttttaacatgtaaagtttagtgacattgatttccagtattattagaaaaaatacagtttttgtaagtttattggaattatataattagatttgggattttagtcttcacatttcaaattacattaatgtttataaagtgtccactgtgttctggatactgcattaggtgctgggatgcagtagggttaatacgaggtgtyggctcctaggaactgtcagtgtcaaagggaatatgaacatgcatactataattatattgacatataaaaaacacagtcactgaaatactatcaaagctctgatatcagggcttaaggaagactttacagagagagtaaaatgaggggggtattaacagatgagtgaaattaagagttccccaggtggaaagaggcattccaggaaggggagattgaatgttcaaagacccaaagaaaggaaaagaaatatgaagaatagagatgtcaaagggattagggtgtggttaagtaaaggagatt

SEQ ID NO: 105377 - DNA, 601 bp, Human
aattagatttgggattttagtcttcacatttcaaattacattaatgtttataaagtgtccactgtgttctggatactgcattaggtgctgggatgcagtagggttaatacgaggtgttggctcctaggaactgtcagtgtcaaagggaatatgaacatgcatactataattatattgacatataaaaaacacagtcactgaaatactatcaaagctctgatatcagggcttaaggaagactttacagagagagtaaaatgaggggggtattaacagatgagtgaaattaagagttccccargtggaaagaggcattccaggaaggggagattgaatgttcaaagacccaaagaaaggaaaagaaatatgaagaatagagatgtcaaagggattagggtgtggttaagtaaaggagattggcaatcaaggctagaagataagtaagtgagaacctgaagggtttttaatgtcacactataagaagttgagtttgggccggtgcgttggctcacgcctgtaatcccagcactttgggaggctgaggcaggcggatcatgaggtcaggagattgagaccatcctggctaacatggtgaaaccct

SEQ ID NO: 105378 - DNA, 601 bp, Human
cctaggaactgtcagtgtcaaagggaatatgaacatgcatactataattatattgacatataaaaaacacagtcactgaaatactatcaaagctctgatatcagggcttaaggaagactttacagagagagtaaaatgaggggggtattaacagatgagtgaaattaagagttccccaggtggaaagaggcattccaggaaggggagattgaatgttcaaagacccaaagaaaggaaaagaaatatgaagaatagagatgtcaaagggattagggtgtggttaagtaaaggagattggcartcaaggctagaagataagtaagtgagaacctgaagggtttttaatgtcacactataagaagttgagtttgggccggtgcgttggctcacgcctgtaatcccagcactttgggaggctgaggcaggcggatcatgaggtcaggagattgagaccatcctggctaacatggtgaaaccctgtctctactaaaaatacaaaaaattagccgggtgtggtggcgtgcacctgttagtcccagctactcgggagacttgaggcaggagaatggcgtgaacccgggaggcggagcttgcagggagc

SEQ ID NO: 105379 - DNA, 601 bp, Human
tagagatgtcaaagggattagggtgtggttaagtaaaggagattggcaatcaaggctagaagataagtaagtgagaacctgaagggtttttaatgtcacactataagaagttgagtttgggccggtgcgttggctcacgcctgtaatcccagcactttgggaggctgaggcaggcggatcatgaggtcaggagattgagaccatcctggctaacatggtgaaaccctgtctctactaaaaatacaaaaaattagccgggtgtggtggcgtgcacctgttagtcccagctactcgggagacttgaggcaggagaatggcgtgaacccgggaggcggagcttgcagggagcccagatcgcaccactgcactccagcctgggcgacagagcgagactccttctcaaaaaaaagagagaagttgagtttgttttatatttgggagaaattgtaaggtgattttaagagctggggcatcaatgataaaatagatttttttttttttttaaggaagatacatctgataggagtgttgagcatgaacaagtggctagtagccaaccaaactagaaggtggttatgatagtcaaaaattatgtgaagag

SEQ ID NO: 105380 - DNA, 601 bp, Human
ggcaatcaaggctagaagataagtaagtgagaacctgaagggtttttaatgtcacactataagaagttgagtttgggccggtgcgttggctcacgcctgtaatcccagcactttgggaggctgaggcaggcggatcatgaggtcaggagattgagaccatcctggctaacatggtgaaaccctgtctctactaaaaatacaaaaaattagccgggtgtggtggcgtgcacctgttagtcccagctactcgggagacttgaggcaggagaatggcgtgaacccgggaggcggagcttgcagkgagcccagatcgcaccactgcactccagcctgggcgacagagcgagactccttctcaaaaaaaagagagaagttgagtttgttttatatttgggagaaattgtaaggtgattttaagagctggggcatcaatgataaaatagatttttttttttttttaaggaagatacatctgataggagtgttgagcatgaacaagtggctagtagccaaccaaactagaaggtggttatgatagtcaaaaattatgtgaagagtcaggaaattatgtacaggctcatgcctataatccccagcactt

SEQ ID NO: 105381 - DNA, 601 bp, Human
tttgggccggtgcgttggctcacgcctgtaatcccagcactttgggaggctgaggcaggcggatcatgaggtcaggagattgagaccatcctggctaacatggtgaaaccctgtctctactaaaaatacaaaaaattagccgggtgtggtggcgtgcacctgttagtcccagctactcgggagacttgaggcaggagaatggcgtgaacccgggaggcggagcttgcagggagcccagatcgcaccactgcactccagcctgggcgacagagcgagactccttctcaaaaaaaagagagargttgagtttgttttatatttgggagaaattgtaaggtgattttaagagctggggcatcaatgataaaatagatttttttttttttttaaggaagatacatctgataggagtgttgagcatgaacaagtggctagtagccaaccaaactagaaggtggttatgatagtcaaaaattatgtgaagagtcaggaaattatgtacaggctcatgcctataatccccagcactttgtgaggccaaggcagacggatggctttagcctagaagttcgactctagcctgggcaacatagcaaaaccc

SEQ ID NO: 105382 - DNA, 601 bp, Human
gaacttcagtagtttcctagtgaggcgaggacgcagagtgtgtggctcacttccgtctggagaagtgtcctttacattttttagtgaattagagatagtatgttttactttcacgtctcttgccaaaaatttagcagtagctaatggaaagagtttttgtgtttgtttgtgctatttgtttttacagcagctaaatgcaaattatttttaaagttttgtcagtgcctataattaacttttgttcttgtcagttgaaattctaaccagattatttaaaagaagacttgtataaaatttctayatggattatgctatgctggattactggttttatgtatttgttatggaactgaagaattaatttgagttataaatgtctcattggatgttaagtgctatgatacagtttaacaaggtttgtaagtcaaacacttggcacagacattaacccctaaatcattcgaacaaagttgagcatctctcatagtagcatgcatttatgtttaaatgttttctaaaggctactatttatatgtggtttttcattcagtattaaagaacaaaagcaatatatctctgatatgtagttttagacccattt

SEQ ID NO: 105383 - DNA, 601 bp, Human
tttcctagtgaggcgaggacgcagagtgtgtggctcacttccgtctggagaagtgtcctttacattttttagtgaattagagatagtatgttttactttcacgtctcttgccaaaaatttagcagtagctaatggaaagagtttttgtgtttgtttgtgctatttgtttttacagcagctaaatgcaaattatttttaaagttttgtcagtgcctataattaacttttgttcttgtcagttgaaattctaaccagattatttaaaagaagacttgtataaaatttctacatggattatgcyatgctggattactggttttatgtatttgttatggaactgaagaattaatttgagttataaatgtctcattggatgttaagtgctatgatacagtttaacaaggtttgtaagtcaaacacttggcacagacattaacccctaaatcattcgaacaaagttgagcatctctcatagtagcatgcatttatgtttaaatgttttctaaaggctactatttatatgtggtttttcattcagtattaaagaacaaaagcaatatatctctgatatgtagttttagacccatttatgttattaatt

SEQ ID NO: 105384 - DNA, 601 bp, Human
ctaatggaaagagtttttgtgtttgtttgtgctatttgtttttacagcagctaaatgcaaattatttttaaagttttgtcagtgcctataattaacttttgttcttgtcagttgaaattctaaccagattatttaaaagaagacttgtataaaatttctacatggattatgctatgctggattactggttttatgtatttgttatggaactgaagaattaatttgagttataaatgtctcattggatgttaagtgctatgatacagtttaacaaggtttgtaagtcaaacacttggcacaracattaacccctaaatcattcgaacaaagttgagcatctctcatagtagcatgcatttatgtttaaatgttttctaaaggctactatttatatgtggtttttcattcagtattaaagaacaaaagcaatatatctctgatatgtagttttagacccatttatgttattaattaatataaatttaaagccaatacatgctaggattaaagattatcatattttttacttatactaaaatataccccaaaagcatttggtttgctcgtaaagtcattatttgtacttaagaatataagtact

SEQ ID NO: 105385 - DNA, 601 bp, Human
tttaaaagaagacttgtataaaatttctacatggattatgctatgctggattactggttttatgtatttgttatggaactgaagaattaatttgagttataaatgtctcattggatgttaagtgctatgatacagtttaacaaggtttgtaagtcaaacacttggcacagacattaacccctaaatcattcgaacaaagttgagcatctctcatagtagcatgcatttatgtttaaatgttttctaaaggctactatttatatgtggtttttcattcagtattaaagaacaaaagcaatakatctctgatatgtagttttagacccatttatgttattaattaatataaatttaaagccaatacatgctaggattaaagattatcatattttttacttatactaaaatataccccaaaagcatttggtttgctcgtaaagtcattatttgtacttaagaatataagtactattttttttaagcacttctagtctttttagattaagaagacataccataacctcttgttccactcactgcttttctgtactcataatagatatgaaggtaggatatggttagaattactaggtcttcttac

SEQ ID NO: 105386 - DNA, 601 bp, Human
acattaacccctaaatcattcgaacaaagttgagcatctctcatagtagcatgcatttatgtttaaatgttttctaaaggctactatttatatgtggtttttcattcagtattaaagaacaaaagcaatatatctctgatatgtagttttagacccatttatgttattaattaatataaatttaaagccaatacatgctaggattaaagattatcatattttttacttatactaaaatataccccaaaagcatttggtttgctcgtaaagtcattatttgtacttaagaatataagtactwttttttttaagcacttctagtctttttagattaagaagacataccataacctcttgttccactcactgcttttctgtactcataatagatatgaaggtaggatatggttagaattactaggtcttcttacagtaacttcccttgagatcagaaatcttcatcaaggcctgtcacaggtataatgagaatgcttaaatttaaaaatttcttgaagttttgtttttaacgtggggtcaacataccttttcaaccaacatgggattccctgaagtttaatacaaaactttgtgtgaatgtacc

SEQ ID NO: 105387 - DNA, 601 bp, Human
tgcttttctgtactcataatagatatgaaggtaggatatggttagaattactaggtcttcttacagtaacttcccttgagatcagaaatcttcatcaaggcctgtcacaggtataatgagaatgcttaaatttaaaaatttcttgaagttttgtttttaacgtggggtcaacataccttttcaaccaacatgggattccctgaagtttaatacaaaactttgtgtgaatgtacctttttatgccaggggagaaagactagttttcaggagatctcaaaatggttcatgagcttaaaatgatttaagaataactggattagtacatgtattctcatgcttagttttgtaattgctataacaaagaactgagtgccaccaagaggcaaccttaatatattatgttttgcttttgccttattgaatttttagtttaaagtgaagttgtatccatgttgattatgtgtctcccttttctttcattgtttgatgtatttacagtgcattgtaacagaagatggcaatcagcacgtatataagaaactctgtctgtgtgctggagctaaaccaaagttgatatgtgaaggaaatccttatgtattag

SEQ ID NO: 105388 - DNA, 601 bp, Human
cgcccacctaggcctcccagagtgctgggattacaggcgtgagccaccgtgcccagcctattcctgccaattttatatttttagttgacactatgtttttaagttcatgctgatgtgttatcagcgtgagataacccagatataatgactgtgctgaatattaacaacttatattacacacacattcattactctacttggggaatatgtgatttgcaacctaaataatataacaattttttccaaaaaggtgaagcgtattcaaaatgtactgatcttattctccagcaaaaaaaattcraaagatctttgtggtacaaaatcatgatagaatcatagaacagaaaaggtcacttggcttattgttctgccctagataaactatcccaataaggtgaaacatctgtttttggagcattatacaaattccttttggtaatttaatttaattcagggcttattaacccttattgccaagaagctcttcctggtttcacaatactatgtctaacctcaagttcgttgttctgtctcatgacatgatgattttgcattaatataatttatattctgaaaatttaataatgttttctttcagcct

SEQ ID NO: 105389 - DNA, 601 bp, Human
tgactgtgctgaatattaacaacttatattacacacacattcattactctacttggggaatatgtgatttgcaacctaaataatataacaattttttccaaaaaggtgaagcgtattcaaaatgtactgatcttattctccagcaaaaaaaattcaaaagatctttgtggtacaaaatcatgatagaatcatagaacagaaaaggtcacttggcttattgttctgccctagataaactatcccaataaggtgaaacatctgtttttggagcattatacaaattccttttggtaatttaatktaattcagggcttattaacccttattgccaagaagctcttcctggtttcacaatactatgtctaacctcaagttcgttgttctgtctcatgacatgatgattttgcattaatataatttatattctgaaaatttaataatgttttctttcagcctattctcttaataattaggaattgagagaaaattaaaggaacttgattatcttcttataaacaatttaagttcatattatcagagattgagctcataactgttttagctcggtcctctacatacatgaactcattgaatcctcatg

SEQ ID NO: 105390 - DNA, 601 bp, Human
tattactcccaatttacaaataggaaactgaggtcaagagattaagtatgtatctatactaatttagctgttaagtctatcagatacacaatttaaacttgtgcttttcacctctaggtccagtgctcttgcagatgtttcttaaattgcaatatcctcaatgaaggacaaactgaaataaacttcagttgtttttttcttggagaattttaaagatgtcagcttcagtgaatattataagtttggagataaatttaatataaatttagtaggagggccagatgtcattctgaagcagtgrgactattctatacttctgaaagtgcccaaagaattaccactggcttctctctcttttttttttttaatatatctatatttattatactttaagttctagggtacatgtgcaccaagtgcaggtttgttacatatgtatacatgtgccatgttggtgtgctgcaccctttaactgtcatttacatttaccactggcttctctaagctcattgtgatcttttttttctggggggtggaggcatcaatgtatctgtcttagaatgttaataacatttttttttttagtagaagtttgacatta

SEQ ID NO: 105391 - DNA, 601 bp, Human
agtctatcagatacacaatttaaacttgtgcttttcacctctaggtccagtgctcttgcagatgtttcttaaattgcaatatcctcaatgaaggacaaactgaaataaacttcagttgtttttttcttggagaattttaaagatgtcagcttcagtgaatattataagtttggagataaatttaatataaatttagtaggagggccagatgtcattctgaagcagtgggactattctatacttctgaaagtgcccaaagaattaccactggcttctctctcttttttttttttaatatatmtatatttattatactttaagttctagggtacatgtgcaccaagtgcaggtttgttacatatgtatacatgtgccatgttggtgtgctgcaccctttaactgtcatttacatttaccactggcttctctaagctcattgtgatcttttttttctggggggtggaggcatcaatgtatctgtcttagaatgttaataacatttttttttttagtagaagtttgacattattgggtgcgtgctactcctaccagctttgtctgtgtcatctcacataatccttacagaaacattaggatatat

SEQ ID NO: 105392 - DNA, 601 bp, Human
tttaaacttgtgcttttcacctctaggtccagtgctcttgcagatgtttcttaaattgcaatatcctcaatgaaggacaaactgaaataaacttcagttgtttttttcttggagaattttaaagatgtcagcttcagtgaatattataagtttggagataaatttaatataaatttagtaggagggccagatgtcattctgaagcagtgggactattctatacttctgaaagtgcccaaagaattaccactggcttctctctcttttttttttttaatatatctatatttattatactttmagttctagggtacatgtgcaccaagtgcaggtttgttacatatgtatacatgtgccatgttggtgtgctgcaccctttaactgtcatttacatttaccactggcttctctaagctcattgtgatcttttttttctggggggtggaggcatcaatgtatctgtcttagaatgttaataacatttttttttttagtagaagtttgacattattgggtgcgtgctactcctaccagctttgtctgtgtcatctcacataatccttacagaaacattaggatatatagtcccttatttccattt

SEQ ID NO: 105393 - DNA, 601 bp, Human
cttttcaaacagatactgtttttcataacttcacaaaaccgcaatatctcattgtctgcttctgtagagtcattttcaaaatgaaagcagtatttcccctctgtgtgatgataatcgtcaaactgtgcatcttgctgagaacatagttcaagtcaggaaaagaggattagaaggtgtcctaggaggtagagcaagtactgaagtttcttgtggttacttgtaataactttgtctgctagtcagtcatcagtatgctgaagtgcactgataggtgttatagtgtaatattactttaaatttwaaaatggtaatatagagaaattcccagtttttcaaaaagaaagcattacatgataactgtatgcctgtatgtaaattgaaatacaaactttattaccaaatttgtgtgtattccactttccgctggtcagtaatgctatatgaccagagtaacataaaatagaatgttcacccaataatcttctatgtttactgacatagaagagctggaaaaacgaagacttattaggtaaagcaaggagttccttatcaccatatgttgaaaagtatgaatatcaagtgacctggattcagatgtact

SEQ ID NO: 105394 - DNA, 601 bp, Human
tattagtatcgcaagtttagataaaatcctattatagttaggatggccatatatcttgtttgtctgggattgtctccatttccaccagttgtaccaaaaatgattattagtagcagatagtatcccaggttaggtgataaattatgtgatcaccttaattataatggacttcagggactttgtgaaaggaatattgttaggaaaaccacttcttagcatctaaacctagaataaaatatcacatgcccattaccttacattagtggtaaatagtaatagaaggtggcttatatataccatkttcattctttccttcctctaagatccttgatccttgatcttgatccttaagatttttagcttataactctgattctttccattttctatccctttccgtaatgtgctttgaagatataaaaagttgttaccaaataagtgactgattctcaatattatagctatgtgccatccatccattacttgattacactataaccagattttttaaaaagcactgcttacccctgggggccattcatataataagtgtattgtagaaattgaacattttctaatgatgtacattgtaatgaaattt

SEQ ID NO: 105395 - DNA, 601 bp, Human
ttagtatcgcaagtttagataaaatcctattatagttaggatggccatatatcttgtttgtctgggattgtctccatttccaccagttgtaccaaaaatgattattagtagcagatagtatcccaggttaggtgataaattatgtgatcaccttaattataatggacttcagggactttgtgaaaggaatattgttaggaaaaccacttcttagcatctaaacctagaataaaatatcacatgcccattaccttacattagtggtaaatagtaatagaaggtggcttatatataccatttycattctttccttcctctaagatccttgatccttgatcttgatccttaagatttttagcttataactctgattctttccattttctatccctttccgtaatgtgctttgaagatataaaaagttgttaccaaataagtgactgattctcaatattatagctatgtgccatccatccattacttgattacactataaccagattttttaaaaagcactgcttacccctgggggccattcatataataagtgtattgtagaaattgaacattttctaatgatgtacattgtaatgaaatttta

SEQ ID NO: 105396 - DNA, 601 bp, Human
acttcagggactttgtgaaaggaatattgttaggaaaaccacttcttagcatctaaacctagaataaaatatcacatgcccattaccttacattagtggtaaatagtaatagaaggtggcttatatataccattttcattctttccttcctctaagatccttgatccttgatcttgatccttaagatttttagcttataactctgattctttccattttctatccctttccgtaatgtgctttgaagatataaaaagttgttaccaaataagtgactgattctcaatattatagctatgtrccatccatccattacttgattacactataaccagattttttaaaaagcactgcttacccctgggggccattcatataataagtgtattgtagaaattgaacattttctaatgatgtacattgtaatgaaattttacttgatattcagtacatgtatttgtcacttaaaggttctttctgtaaactgcttcagattcttttactattcaatttttaattcttaatatctgtaaagaacgttaatattcctctttataatcaatctttcccagttagccttaaaaatgtattccctactttt

SEQ ID NO: 105397 - DNA, 601 bp, Human
gaaggtggcttatatataccattttcattctttccttcctctaagatccttgatccttgatcttgatccttaagatttttagcttataactctgattctttccattttctatccctttccgtaatgtgctttgaagatataaaaagttgttaccaaataagtgactgattctcaatattatagctatgtgccatccatccattacttgattacactataaccagattttttaaaaagcactgcttacccctgggggccattcatataataagtgtattgtagaaattgaacattttctaaygatgtacattgtaatgaaattttacttgatattcagtacatgtatttgtcacttaaaggttctttctgtaaactgcttcagattcttttactattcaatttttaattcttaatatctgtaaagaacgttaatattcctctttataatcaatctttcccagttagccttaaaaatgtattccctacttttgcttcaggagatcattatttgcaaatgcaaagattttttacttagacttttgaaatcactcttagtaactttaacattgtttttaggtatgaaattgaaggctgtgaagtg

SEQ ID NO: 105398 - DNA, 601 bp, Human
cagattttttaaaaagcactgcttacccctgggggccattcatataataagtgtattgtagaaattgaacattttctaatgatgtacattgtaatgaaattttacttgatattcagtacatgtatttgtcacttaaaggttctttctgtaaactgcttcagattcttttactattcaatttttaattcttaatatctgtaaagaacgttaatattcctctttataatcaatctttcccagttagccttaaaaatgtattccctacttttgcttcaggagatcattatttgcaaatgcaaakattttttacttagacttttgaaatcactcttagtaactttaacattgtttttaggtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggtaagtgtagcacctagctcattaattctcatacaaaacttttttaaaaccatatagaaaagggctacaagaaaatttaataaaa

SEQ ID NO: 105399 - DNA, 601 bp, Human
gggccattcatataataagtgtattgtagaaattgaacattttctaatgatgtacattgtaatgaaattttacttgatattcagtacatgtatttgtcacttaaaggttctttctgtaaactgcttcagattcttttactattcaatttttaattcttaatatctgtaaagaacgttaatattcctctttataatcaatctttcccagttagccttaaaaatgtattccctacttttgcttcaggagatcattatttgcaaatgcaaagattttttacttagacttttgaaatcactcttrgtaactttaacattgtttttaggtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggtaagtgtagcacctagctcattaattctcatacaaaacttttttaaaaccatatagaaaagggctacaagaaaatttaataaaataaattttggaaatagtaatatggatatttat

SEQ ID NO: 105400 - DNA, 601 bp, Human
tttgggccattaaagataaagctatagggaatactttcttcgatgcaggagcagctgaattcttgacttcaaagctcattgctgaaaaatcagaggctaaaattgcacataaaagaaccagatatacaactgaaggtaagtgtagcacctagctcattaattctcatacaaaacttttttaaaaccatatagaaaagggctacaagaaaatttaataaaataaattttggaaatagtaatatggatatttatatatctttacatgaagttttcagattttctattttatatatatgtatgyattttatatatatatatataattaaaacaagaaatttaaaataaattgaataactcagcccatctgcatctttgcaaacagatactacattttggcaatacctgaagaagttttgtaaaaaatgcagtgagttgaaaaactaatacaaacttcatatttttttaagtttgatagctttgaaaaacttttagattataaaattaaacaagagttttgtacattttggaggtgctaaaaatagataaaattataaaaatttgaaggctaattttcttacccttccagttaaccgtgtaacat

SEQ ID NO: 105401 - DNA, 601 bp, Human
aactgaaggtaagtgtagcacctagctcattaattctcatacaaaacttttttaaaaccatatagaaaagggctacaagaaaatttaataaaataaattttggaaatagtaatatggatatttatatatctttacatgaagttttcagattttctattttatatatatgtatgtattttatatatatatatataattaaaacaagaaatttaaaataaattgaataactcagcccatctgcatctttgcaaacagatactacattttggcaatacctgaagaagttttgtaaaaaatgcartgagttgaaaaactaatacaaacttcatatttttttaagtttgatagctttgaaaaacttttagattataaaattaaacaagagttttgtacattttggaggtgctaaaaatagataaaattataaaaatttgaaggctaattttcttacccttccagttaaccgtgtaacatccaaaacgtaagttgagtgtgtttatactcaacacacaactgaaagattatctgttttgtaactctacatcagaaaaatattaatgactaaaatgattaatatagataacataggttagtcatgctg

SEQ ID NO: 105402 - DNA, 601 bp, Human
aaagggctacaagaaaatttaataaaataaattttggaaatagtaatatggatatttatatatctttacatgaagttttcagattttctattttatatatatgtatgtattttatatatatatatataattaaaacaagaaatttaaaataaattgaataactcagcccatctgcatctttgcaaacagatactacattttggcaatacctgaagaagttttgtaaaaaatgcagtgagttgaaaaactaatacaaacttcatatttttttaagtttgatagctttgaaaaacttttagaytataaaattaaacaagagttttgtacattttggaggtgctaaaaatagataaaattataaaaatttgaaggctaattttcttacccttccagttaaccgtgtaacatccaaaacgtaagttgagtgtgtttatactcaacacacaactgaaagattatctgttttgtaactctacatcagaaaaatattaatgactaaaatgattaatatagataacataggttagtcatgctgtaatgtatgtatatatatgaatcattacattgcctaaataaaaaacttcagaacactaacatattt

SEQ ID NO: 105403 - DNA, 601 bp, Human
aataaattgaataactcagcccatctgcatctttgcaaacagatactacattttggcaatacctgaagaagttttgtaaaaaatgcagtgagttgaaaaactaatacaaacttcatatttttttaagtttgatagctttgaaaaacttttagattataaaattaaacaagagttttgtacattttggaggtgctaaaaatagataaaattataaaaatttgaaggctaattttcttacccttccagttaaccgtgtaacatccaaaacgtaagttgagtgtgtttatactcaacacacaaytgaaagattatctgttttgtaactctacatcagaaaaatattaatgactaaaatgattaatatagataacataggttagtcatgctgtaatgtatgtatatatatgaatcattacattgcctaaataaaaaacttcagaacactaacatatttctctatctggtaatttttatattatttaatttcatctctttaggaaggaaaaaggaagctagaagcaaatctaaagcagataatgtaggaagtgcattgggaccagattggcatgaaggcttgaatcttaaaggaacaaaagaggta

SEQ ID NO: 105404 - DNA, 601 bp, Human
aattaaacaagagttttgtacattttggaggtgctaaaaatagataaaattataaaaatttgaaggctaattttcttacccttccagttaaccgtgtaacatccaaaacgtaagttgagtgtgtttatactcaacacacaactgaaagattatctgttttgtaactctacatcagaaaaatattaatgactaaaatgattaatatagataacataggttagtcatgctgtaatgtatgtatatatatgaatcattacattgcctaaataaaaaacttcagaacactaacatatttctctayctggtaatttttatattatttaatttcatctctttaggaaggaaaaaggaagctagaagcaaatctaaagcagataatgtaggaagtgcattgggaccagattggcatgaaggcttgaatcttaaaggaacaaaagaggtatcttttcatatactaattggtcatgtctaaatgtaattttaaattcttgaaccatttattaaagactggtaataaatatatagtcaacgaactgctaggtcactttacttaaaatccatagtgttaggaaaagacctccaatgcagttggtccatttgg

SEQ ID NO: 105405 - DNA, 601 bp, Human
tctttaggaaggaaaaaggaagctagaagcaaatctaaagcagataatgtaggaagtgcattgggaccagattggcatgaaggcttgaatcttaaaggaacaaaagaggtatcttttcatatactaattggtcatgtctaaatgtaattttaaattcttgaaccatttattaaagactggtaataaatatatagtcaacgaactgctaggtcactttacttaaaatccatagtgttaggaaaagacctccaatgcagttggtccatttggccaccaaagaaaactgaatgtcaaagcatckaagactggatctcagcctacgttttaactcttgaggtgtgatactgtaatatatatacagtcataccttggagtattgcaggttcagtcccagaccatcacaggaaatgatataccacaataaagtgagccacacgaatttttcagtttcccagtgcctacaaaagttatgtttataacatactgcagtctattaaatgtgcattagcattgtgtctaaaaatacaatgcacataacgttaatttaaagatactttattgcttaatatgctaacaatcatctgagccttcagcaaatcat

SEQ ID NO: 105406 - DNA, 601 bp, Human
cattgggaccagattggcatgaaggcttgaatcttaaaggaacaaaagaggtatcttttcatatactaattggtcatgtctaaatgtaattttaaattcttgaaccatttattaaagactggtaataaatatatagtcaacgaactgctaggtcactttacttaaaatccatagtgttaggaaaagacctccaatgcagttggtccatttggccaccaaagaaaactgaatgtcaaagcatcgaagactggatctcagcctacgttttaactcttgaggtgtgatactgtaatatatatamagtcataccttggagtattgcaggttcagtcccagaccatcacaggaaatgatataccacaataaagtgagccacacgaatttttcagtttcccagtgcctacaaaagttatgtttataacatactgcagtctattaaatgtgcattagcattgtgtctaaaaatacaatgcacataacgttaatttaaagatactttattgcttaatatgctaacaatcatctgagccttcagcaaatcataatctttttttggtggaaagttttgcctcagtattggtggctgatgactcatcagggt

SEQ ID NO: 105407 - DNA, 601 bp, Human
ccagattggcatgaaggcttgaatcttaaaggaacaaaagaggtatcttttcatatactaattggtcatgtctaaatgtaattttaaattcttgaaccatttattaaagactggtaataaatatatagtcaacgaactgctaggtcactttacttaaaatccatagtgttaggaaaagacctccaatgcagttggtccatttggccaccaaagaaaactgaatgtcaaagcatcgaagactggatctcagcctacgttttaactcttgaggtgtgatactgtaatatatatacagtcataycttggagtattgcaggttcagtcccagaccatcacaggaaatgatataccacaataaagtgagccacacgaatttttcagtttcccagtgcctacaaaagttatgtttataacatactgcagtctattaaatgtgcattagcattgtgtctaaaaatacaatgcacataacgttaatttaaagatactttattgcttaatatgctaacaatcatctgagccttcagcaaatcataatctttttttggtggaaagttttgcctcagtattggtggctgatgactcatcagggtggtgcttg

SEQ ID NO: 105408 - DNA, 601 bp, Human
aaaagaggtatcttttcatatactaattggtcatgtctaaatgtaattttaaattcttgaaccatttattaaagactggtaataaatatatagtcaacgaactgctaggtcactttacttaaaatccatagtgttaggaaaagacctccaatgcagttggtccatttggccaccaaagaaaactgaatgtcaaagcatcgaagactggatctcagcctacgttttaactcttgaggtgtgatactgtaatatatatacagtcataccttggagtattgcaggttcagtcccagaccatcamaggaaatgatataccacaataaagtgagccacacgaatttttcagtttcccagtgcctacaaaagttatgtttataacatactgcagtctattaaatgtgcattagcattgtgtctaaaaatacaatgcacataacgttaatttaaagatactttattgcttaatatgctaacaatcatctgagccttcagcaaatcataatctttttttggtggaaagttttgcctcagtattggtggctgatgactcatcagggtggtgcttgctgaaggtttgggtggctgtggcaatttcttaaaa

SEQ ID NO: 105409 - DNA, 601 bp, Human
tgtgtctaaaaatacaatgcacataacgttaatttaaagatactttattgcttaatatgctaacaatcatctgagccttcagcaaatcataatctttttttggtggaaagttttgcctcagtattggtggctgatgactcatcagggtggtgcttgctgaaggtttgggtggctgtggcaatttcttaaaataacaagtttgccccatcaattgactcttcctctcgtgaaagacttctctgtagcgtgcgaagctgttttatagcattttgcccagagtagaagttctttcaaaagtcarttctctcaaactctgctactgctttaccaagtatatgtaatattttaaatccttcatcatttcagcaatactcacagcatcctcaccagaagtaaactccatctcagataactacgttctttgctcatccatgagaaacaacaactcatcttttcaaattttatcatgagattgcagcaatgtagtctcatcttcaggattcatttctaattacagttcttttgttatttccaccatatctgcctttctccattgaaatcttgaatccctcaaagtcatccatgaaggttggagtaaact

SEQ ID NO: 105410 - DNA, 601 bp, Human
taatttaaagatactttattgcttaatatgctaacaatcatctgagccttcagcaaatcataatctttttttggtggaaagttttgcctcagtattggtggctgatgactcatcagggtggtgcttgctgaaggtttgggtggctgtggcaatttcttaaaataacaagtttgccccatcaattgactcttcctctcgtgaaagacttctctgtagcgtgcgaagctgttttatagcattttgcccagagtagaagttctttcaaaagtcaattctctcaaactctgctactgctttacctagtatatgtaatattttaaatccttcatcatttcagcaatactcacagcatcctcaccagaagtaaactccatctcagataactacgttctttgctcatccatgagaaacaacaactcatcttttcaaattttatcatgagattgcagcaatgtagtctcatcttcaggattcatttctaattacagttcttttgttatttccaccatatctgcctttctccattgaaatcttgaatccctcaaagtcatccatgaaggttggagtaaacttctttcaagcttttgttaatgttgatatt

SEQ ID NO: 105411 - DNA, 601 bp, Human
gtggcaatttcttaaaataacaagtttgccccatcaattgactcttcctctcgtgaaagacttctctgtagcgtgcgaagctgttttatagcattttgcccagagtagaagttctttcaaaagtcaattctctcaaactctgctactgctttaccaagtatatgtaatattttaaatccttcatcatttcagcaatactcacagcatcctcaccagaagtaaactccatctcagataactacgttctttgctcatccatgagaaacaacaactcatcttttcaaattttatcatgagattrcagcaatgtagtctcatcttcaggattcatttctaattacagttcttttgttatttccaccatatctgcctttctccattgaaatcttgaatccctcaaagtcatccatgaaggttggagtaaacttctttcaagcttttgttaatgttgatattttgacttactcccttgaatcatgaatgttcttaatatctagaatggtgaattctttccggaaggttttcaatgtacttttcccagatccatcagatgcatcactatctgtggcagctatagccttatgaaatgcatttctttaat

SEQ ID NO: 105412 - DNA, 601 bp, Human
aagtcaattctctcaaactctgctactgctttaccaagtatatgtaatattttaaatccttcatcatttcagcaatactcacagcatcctcaccagaagtaaactccatctcagataactacgttctttgctcatccatgagaaacaacaactcatcttttcaaattttatcatgagattgcagcaatgtagtctcatcttcaggattcatttctaattacagttcttttgttatttccaccatatctgcctttctccattgaaatcttgaatccctcaaagtcatccatgaaggttggartaaacttctttcaagcttttgttaatgttgatattttgacttactcccttgaatcatgaatgttcttaatatctagaatggtgaattctttccggaaggttttcaatgtacttttcccagatccatcagatgcatcactatctgtggcagctatagccttatgaaatgcatttctttaataagacttgaaagtaagaattactcctggatccacgggctgcagaatggatattgtattagcaggcatgaaaacaacattcatctccttgtgcatctctgtctgagttcttgggtgaccaa

SEQ ID NO: 105413 - DNA, 601 bp, Human
gcaatactcacagcatcctcaccagaagtaaactccatctcagataactacgttctttgctcatccatgagaaacaacaactcatcttttcaaattttatcatgagattgcagcaatgtagtctcatcttcaggattcatttctaattacagttcttttgttatttccaccatatctgcctttctccattgaaatcttgaatccctcaaagtcatccatgaaggttggagtaaacttctttcaagcttttgttaatgttgatattttgacttactcccttgaatcatgaatgttcttaatctctagaatggtgaattctttccggaaggttttcaatgtacttttcccagatccatcagatgcatcactatctgtggcagctatagccttatgaaatgcatttctttaataagacttgaaagtaagaattactcctggatccacgggctgcagaatggatattgtattagcaggcatgaaaacaacattcatctccttgtgcatctctgtctgagttcttgggtgaccaaatgccttgtcaatgagtgtagtattttgaaatgaatctttttttttttttttctgagcagtaggtctcaat

SEQ ID NO: 105414 - DNA, 601 bp, Human
agaagtaaactccatctcagataactacgttctttgctcatccatgagaaacaacaactcatcttttcaaattttatcatgagattgcagcaatgtagtctcatcttcaggattcatttctaattacagttcttttgttatttccaccatatctgcctttctccattgaaatcttgaatccctcaaagtcatccatgaaggttggagtaaacttctttcaagcttttgttaatgttgatattttgacttactcccttgaatcatgaatgttcttaatatctagaatggtgaattctttccrgaaggttttcaatgtacttttcccagatccatcagatgcatcactatctgtggcagctatagccttatgaaatgcatttctttaataagacttgaaagtaagaattactcctggatccacgggctgcagaatggatattgtattagcaggcatgaaaacaacattcatctccttgtgcatctctgtctgagttcttgggtgaccaaatgccttgtcaatgagtgtagtattttgaaatgaatctttttttttttttttctgagcagtaggtctcaatggtgggcttcaaatattcagtaa

SEQ ID NO: 105415 - DNA, 601 bp, Human
tattttgacttactcccttgaatcatgaatgttcttaatatctagaatggtgaattctttccggaaggttttcaatgtacttttcccagatccatcagatgcatcactatctgtggcagctatagccttatgaaatgcatttctttaataagacttgaaagtaagaattactcctggatccacgggctgcagaatggatattgtattagcaggcatgaaaacaacattcatctccttgtgcatctctgtctgagttcttgggtgaccaaatgccttgtcaatgagtgtagtattttgaaakgaatctttttttttttttttctgagcagtaggtctcaatggtgggcttcaaatattcagtaaactatgtaaacagatgtgctgtgtattactccattctcacagtatataaagaaatacctgagagtaggtaatatttataaagaaaagaggtttaattggctcatggtcccacgggctgtacaggaagcatgactggggaggcctcaggaaactttcaatcacgggggaaggggaattatgcacttcttacatggccagagcaagaggaagagagagaagggggctggtgccacacacc

SEQ ID NO: 105416 - DNA, 601 bp, Human
aattctttccggaaggttttcaatgtacttttcccagatccatcagatgcatcactatctgtggcagctatagccttatgaaatgcatttctttaataagacttgaaagtaagaattactcctggatccacgggctgcagaatggatattgtattagcaggcatgaaaacaacattcatctccttgtgcatctctgtctgagttcttgggtgaccaaatgccttgtcaatgagtgtagtattttgaaatgaatctttttttttttttttctgagcagtaggtctcaatggtgggcttcaawtattcagtaaactatgtaaacagatgtgctgtgtattactccattctcacagtatataaagaaatacctgagagtaggtaatatttataaagaaaagaggtttaattggctcatggtcccacgggctgtacaggaagcatgactggggaggcctcaggaaactttcaatcacgggggaaggggaattatgcacttcttacatggccagagcaagaggaagagagagaagggggctggtgccacacacctttaaacaaccagatctcatgagaactctaacatgaaaacagcactaaggat

SEQ ID NO: 105417 - DNA, 601 bp, Human
aaccaacctctactagcttcagccttttcttctgcagcttcctcacttctctcagcctttacagaattgaaaacagttaggggcttattctgggttaggctttggcctaagggaatgttgtggctgatttgatcttctctccacaccactaaaactttctccatgtcagcaagaagactgtttcgctttctcatcattcatgtgttcattggaataccactttagatttacttcaagaatgtttcctttgcattcacaatttggccatctgttcagggcaagaggcctggctttccatgtrccttcctcaataaccctaataatcattgctaccttttgatttaaagtgagagatgtgtgatccttactttcacttgaacacttagaggccactacagagtaactgattgccctggtttcaatattcttgtgtctccgggaataaggaggcccaaggagagggagagacataggacaacagctggttgatggagcagtcagaacacagaacatttatcgattaagttcactgtgttagatgggtgtggttcatgacaccccaagacaattacagtagtacatcaaagattactaatcacag

SEQ ID NO: 105418 - DNA, 601 bp, Human
ctccatgtcagcaagaagactgtttcgctttctcatcattcatgtgttcattggaataccactttagatttacttcaagaatgtttcctttgcattcacaatttggccatctgttcagggcaagaggcctggctttccatgtaccttcctcaataaccctaataatcattgctaccttttgatttaaagtgagagatgtgtgatccttactttcacttgaacacttagaggccactacagagtaactgattgccctggtttcaatattcttgtgtctccgggaataaggaggcccaaggaragggagagacataggacaacagctggttgatggagcagtcagaacacagaacatttatcgattaagttcactgtgttagatgggtgtggttcatgacaccccaagacaattacagtagtacatcaaagattactaatcacagatcaccataaaagatctaataatgatgaaaactgaaatattgcaagaattaccaaaatgtgacagagacacaaagtgagcacatgctattggaaaaatggcactgataagacttgcttgatgtgggtttgtcacaaaccttcaatttgtaaaaaacac

SEQ ID NO: 105419 - DNA, 601 bp, Human
acatttatcgattaagttcactgtgttagatgggtgtggttcatgacaccccaagacaattacagtagtacatcaaagattactaatcacagatcaccataaaagatctaataatgatgaaaactgaaatattgcaagaattaccaaaatgtgacagagacacaaagtgagcacatgctattggaaaaatggcactgataagacttgcttgatgtgggtttgtcacaaaccttcaatttgtaaaaaacacactatctgcaaaacagtagtgaagcacaataaaatgttgtgtctgcagttytctggcacacaactcctaaaatttttggcatctccaaagtgatgtgtccttttgtatgctaacgagttgactggttagcccctaggtggcttcagaatggggactggtcacaggaaagaccaagacatgattagagtttagactttccaacctacaggaagggaaagaggttgaaggttaagccaatcactagcagccagtaatttaatcagtcacctacataacacagtttccatgaaaacccaaaaggactgggtttggagagcttctggatagctgaacatgtggaagttgctagag

SEQ ID NO: 105420 - DNA, 601 bp, Human
acttgcttgatgtgggtttgtcacaaaccttcaatttgtaaaaaacacactatctgcaaaacagtagtgaagcacaataaaatgttgtgtctgcagttttctggcacacaactcctaaaatttttggcatctccaaagtgatgtgtccttttgtatgctaacgagttgactggttagcccctaggtggcttcagaatggggactggtcacaggaaagaccaagacatgattagagtttagactttccaacctacaggaagggaaagaggttgaaggttaagccaatcactagcagccagtratttaatcagtcacctacataacacagtttccatgaaaacccaaaaggactgggtttggagagcttctggatagctgaacatgtggaagttgctagagggtggtctatctggagagggcatagaagcttcatgccccttcttatatgctttgccttatgtatttcttcatctgtttcttcgtgacatccttgataataaaccagtaaatgtaagtaaagtgtttccccaaattctgtgagatattctaataaattaattgaacctaagaaaggggctcgtgggagccccttgatttatgg

SEQ ID NO: 105421 - DNA, 601 bp, Human
atgctaacgagttgactggttagcccctaggtggcttcagaatggggactggtcacaggaaagaccaagacatgattagagtttagactttccaacctacaggaagggaaagaggttgaaggttaagccaatcactagcagccagtaatttaatcagtcacctacataacacagtttccatgaaaacccaaaaggactgggtttggagagcttctggatagctgaacatgtggaagttgctagagggtggtctatctggagagggcatagaagcttcatgccccttcttatatgctttgcyttatgtatttcttcatctgtttcttcgtgacatccttgataataaaccagtaaatgtaagtaaagtgtttccccaaattctgtgagatattctaataaattaattgaacctaagaaaggggctcgtgggagccccttgatttatggttggttagtcagaccaactggtaaaacacccggggcatgcaattggtattggaagtggaagacagtcttgtgagattgatccctcaacatgtgggacctgatgctatctccaggtagataataacatcagaactgaattgaattagaggacagc

SEQ ID NO: 105422 - DNA, 601 bp, Human
ctaggtggcttcagaatggggactggtcacaggaaagaccaagacatgattagagtttagactttccaacctacaggaagggaaagaggttgaaggttaagccaatcactagcagccagtaatttaatcagtcacctacataacacagtttccatgaaaacccaaaaggactgggtttggagagcttctggatagctgaacatgtggaagttgctagagggtggtctatctggagagggcatagaagcttcatgccccttcttatatgctttgccttatgtatttcttcatctgtttcttygtgacatccttgataataaaccagtaaatgtaagtaaagtgtttccccaaattctgtgagatattctaataaattaattgaacctaagaaaggggctcgtgggagccccttgatttatggttggttagtcagaccaactggtaaaacacccggggcatgcaattggtattggaagtggaagacagtcttgtgagattgatccctcaacatgtgggacctgatgctatctccaggtagataataacatcagaactgaattgaattagaggacagccagatggtgtcctgtgcagaattaat

SEQ ID NO: 105423 - DNA, 601 bp, Human
aagccaatcactagcagccagtaatttaatcagtcacctacataacacagtttccatgaaaacccaaaaggactgggtttggagagcttctggatagctgaacatgtggaagttgctagagggtggtctatctggagagggcatagaagcttcatgccccttcttatatgctttgccttatgtatttcttcatctgtttcttcgtgacatccttgataataaaccagtaaatgtaagtaaagtgtttccccaaattctgtgagatattctaataaattaattgaacctaagaaaggggctygtgggagccccttgatttatggttggttagtcagaccaactggtaaaacacccggggcatgcaattggtattggaagtggaagacagtcttgtgagattgatccctcaacatgtgggacctgatgctatctccaggtagataataacatcagaactgaattgaattagaggacagccagatggtgtcctgtgcagaattaattgcttgcttagtgtgtagaaaacaccccacacacatttggtcacagaagtattctgtgttgtgagactatagtaggagaaactgagtttgttttttcc

SEQ ID NO: 105424 - DNA, 601 bp, Human
ttccccaaattctgtgagatattctaataaattaattgaacctaagaaaggggctcgtgggagccccttgatttatggttggttagtcagaccaactggtaaaacacccggggcatgcaattggtattggaagtggaagacagtcttgtgagattgatccctcaacatgtgggacctgatgctatctccaggtagataataacatcagaactgaattgaattagaggacagccagatggtgtcctgtgcagaattaattgcttgcttagtgtgtagaaaacaccccacacacatttggtcrcagaagtattctgtgttgtgagactatagtaggagaaactgagtttgttttttcctatatcctcagatcagggatagagctttctatacccagactacagtgaatactcctgtcctattttaaattaatcttttctcaaaggtcacttcagatgcatgcagtaaacttacaaaagttattagatggattggaaatacacacttaatatcctaattggataaggagatgatttgcttttcctcattttgttagatattttgattttttaatagttgttaaagggctgtgaaatctaaatgc

SEQ ID NO: 105425 - DNA, 601 bp, Human
acagagtctcgctctgtcacccaagctggagtgctgtggtatgatcttggctcgctgcaacctctgcctcccgggttcaagcgagtctcctgcctcagcctcccgagtagctgggactacaggcgcacaccaccaggcctggctaattttttaattttagtagagacagggtttcaccatataggccaggctagtcttgaactcctgacctcaggtgatccacctgcgcctcggcctcccagagtgctgggattacaggcgtgagccactgtgcccaacaactactgtaatttttaaaaawtgcatttgtaattatcaatgaggcctaggctaaaaagcattccctcgatgctatctgctaatgcagctaccagatctcttaagttactgaatgaatttttgttcactcctttcatgtgcatagagagacttattttagggcacccaatgtggtttcatttatattataagaattatgttttctatacgtttctacaagtatacgttttttcttcatcattagtaacccgggttattctttctgcaagtattatgctaaccagtattttcttaattttagttttctcataagattcacctt

SEQ ID NO: 105426 - DNA, 601 bp, Human
taaacacttaagtggagtgtaaagtattacaaaagatttttagagaaataatttagaaataatttaaatgtactttgtcaaaatttatgtgtccaaatttgaaggaaaaacatttaaaatgccatggttttaaaattatacccaaacgagatgatgctaattgcattaaaattgctttagcaaatatgcctcataataattgctaaggagtgtgttacaaagttatctcttgcctttctttttctttctttgtttctagtcattgtagtcacatacactgctgtggtgatggttccatttrcaaataaagtctgtttttttggtttttttttcttaaagagatgtggcctgtctatgtggaattgaccaatgaaaagatatatggctgcgatttcattgtcagtgctacaggagttacaccaaatgtagaaccttttctccatggtaacagtgtaaggtgaaatttttttgtccagctgtgaatatatttgaagtatttttgtgaagatctctaattctcaaacatgaataattattattttagtgtacaactgtaacttaacatggttggaaacagtttggttaaaacattgtcttgatt

SEQ ID NO: 105427 - DNA, 601 bp, Human
gtattttttgcttttcagcacttgaagcttacaaaaaaaaaaaagaatattcttgtagttatggataaggtagtcacatggttattggatacttttcatgttgaaattctgacagttttatggatcagtcttagttggaatttgatccatggaaattcagctcaggtgtctaaactttgctgatatttttcattttctcattaaagatgagcatgcaaagtgtaacaatttaatttgttcttttactttaaaatggaaaaagtcgtttcatttttcttaacacttaacgcttatgaggaaygttgtttagtttgatctaggagaagatggtggcctgaaagtggatgatcatatgcacacatcccttcctgatatctatgctgccggtgacatctgtactacatcctggcagctgagcccagtctggcagcaggtaagctagcatatataattatatgttttcatcagagattctgtctgaaaataaagcggttgttaccaacaaatccaacttctggttttccaacttttctgcttaagtaggaagctagcacagagttgttatatatattttaaaaaaaaactagaatatttccctgtt

SEQ ID NO: 105428 - DNA, 601 bp, Human
ttcttaacacttaacgcttatgaggaatgttgtttagtttgatctaggagaagatggtggcctgaaagtggatgatcatatgcacacatcccttcctgatatctatgctgccggtgacatctgtactacatcctggcagctgagcccagtctggcagcaggtaagctagcatatataattatatgttttcatcagagattctgtctgaaaataaagcggttgttaccaacaaatccaacttctggttttccaacttttctgcttaagtaggaagctagcacagagttgttatatatatttwaaaaaaaaactagaatatttccctgtttggtaagttatcattataatggtagactgagacatcttttactttaaaagaaattatgggctattactttgtttttcattcttacctgcttatcagcactgtccaggagaactttctgtgatgatggaaatgtttaattcctcaccatctagtcaggtagccagcagtatgtcacatgagcacttgaaatgtggttaatgtgactgaggaactgaattatttttacttacttctcattaactttaaatatatgtggctacgatgttggacagc

SEQ ID NO: 105429 - DNA, 601 bp, Human
ccttgaacctgggaggcggaggttgcagtgagctgagatcgcaccactgcaccccagcctgggcaacaagagcaaaactctgtctcaaaaaaaaaaaaaaaaattcctgtagtaaacacctttcctgagccttaacaagtcccaactggatctagactttttcctaccctcacagctttacctacctcctcctaacggtggaacaaaaatactagaggaagataaagacagtgaccagaggtgtgcagaggggtagagacctaggtagatgtttgaaataaaggaaccaggcaacatttayctttgttaaagaccagctccacagttagggacattattcattcagattatgcagtgtgaagtaggagaagagctaaaagtatttcaagaggcagcaccatcattttgtgttcttacagacagtagagacatcagtaagaatggttccagcctttttgtttctaacctgcctcattctatgtcatttctgtggcaagactatcacaaattcttagagttggagtttatgggtttttttttttttaacatttttaattctctagggtaaattatatcttaatgtgttataatctgaaagagg

SEQ ID NO: 105430 - DNA, 601 bp, Human
ttgttaaagaccagctccacagttagggacattattcattcagattatgcagtgtgaagtaggagaagagctaaaagtatttcaagaggcagcaccatcattttgtgttcttacagacagtagagacatcagtaagaatggttccagcctttttgtttctaacctgcctcattctatgtcatttctgtggcaagactatcacaaattcttagagttggagtttatgggtttttttttttttaacatttttaattctctagggtaaattatatcttaatgtgttataatctgaaagaggggraaaaatccgaaaataaacagatggccttgttttgagtgcaccttataggccccatttcttggcttacacaagcaataaggatactaatttatgcagttcaagatgcaaattttccggccacttgtattagctgttctctagttgttactgtgctcagtttattctgacccccagccataaactgcctttcacttcatcaaatctataataccttgtttacagaggagattgaaaaaaaaaaatctatcacttctgctagaaatgcttaaaactcatgtctatgattatgatattatttct

SEQ ID NO: 105431 - DNA, 601 bp, Human
agattgaaaaaaaaaaatctatcacttctgctagaaatgcttaaaactcatgtctatgattatgatattatttctgcaaacaaaagacagcattaagtacatatgcacatacagggaggtagaaggaaaccaagtgcttattatacgctaacctgtttaattctctcaatagttacagagtaggtagtgttatgtttacgtttcaggtaaatgaaccgaggcccagaaaagttaaatatatatgtagatctgttgatattaaaatccactgtgactcccaaggtcagtgtttttttttttattattattatatttaagttttaggatacatgtacacaacgtgcaggtttgttacatatgtatacatgtgtcatgttggtgtgctgcacccccaccccacaagagtccccggtgtgtgatgttccccttcctgtgtccatgtgttctcattgttcagttcccacctatgagtgagaacatgtggtgtttggttttttgtccttgcaatagtttgctgagaataatggtttccagcttcatccatgtccctacaaaggacatgaactcatcattttttatggctgcatagtattccatggtg

SEQ ID NO: 105432 - DNA, 601 bp, Human
actcatgtctatgattatgatattatttctgcaaacaaaagacagcattaagtacatatgcacatacagggaggtagaaggaaaccaagtgcttattatacgctaacctgtttaattctctcaatagttacagagtaggtagtgttatgtttacgtttcaggtaaatgaaccgaggcccagaaaagttaaatatatatgtagatctgttgatattaaaatccactgtgactcccaaggtcagtgtttttttttttattattattatatttaagttttaggatacatgtacacaacgtgcargtttgttacatatgtatacatgtgtcatgttggtgtgctgcacccccaccccacaagagtccccggtgtgtgatgttccccttcctgtgtccatgtgttctcattgttcagttcccacctatgagtgagaacatgtggtgtttggttttttgtccttgcaatagtttgctgagaataatggtttccagcttcatccatgtccctacaaaggacatgaactcatcattttttatggctgcatagtattccatggtgtatatgtgccacattttcttaatccagtctatcattgttggacat

SEQ ID NO: 105433 - DNA, 601 bp, Human
ttcgccagtgtgcttttcttaatatctaaggtaagtgctcagttttaacttagattttatatcagtacaaagtactacctaaaaaccaaacgcttaagaggtttcttaatattctttcttctttggtggcataataataaatttaaaataatgttgaataaattggtgtatcacaacataatgacatatcaagtatcaatgaaattctcatttcaactaagttattctgactacaaatatgctacatatttttagcataatcctatatttctaacatttttaatttgtagaatgccaaagrtagcatttctgtattattgggcattgaattggatcctgtagttaatttaaacaaagtattatctttaagatcacctacttctaattctgctcttaaactttagtggtagaattacatttgctttagattttcttgatagttttgttatagacactaagaaataaactaaaatgaatgacaacaaaagtccagtggttttataagttggaaataaacaaaacaagagcaaaatagcaacctgactccttcactatttttggagtgaaaagggaagaatgtttctttccctaaatctggaaa

SEQ ID NO: 105434 - DNA, 601 bp, Human
tatttctaacatttttaatttgtagaatgccaaaggtagcatttctgtattattgggcattgaattggatcctgtagttaatttaaacaaagtattatctttaagatcacctacttctaattctgctcttaaactttagtggtagaattacatttgctttagattttcttgatagttttgttatagacactaagaaataaactaaaatgaatgacaacaaaagtccagtggttttataagttggaaataaacaaaacaagagcaaaatagcaacctgactccttcactatttttggagtgraaagggaagaatgtttctttccctaaatctggaaaatataaaatactgctcaaaatatgtatgaaaaaataaacataagtggggtaaaagtacacatgtgctaatgcttcagcttactgaagttatgagttctttctttgcgttttctaaattaatacatgacaactagcaaacacaatttttttaaaggaaggattagaaaaaaataatacgggaaaatataactcagctgactgaaagatttgccagcagaccagtacaaaaacgaactacggaatacaccgtttgttttttgcttat

SEQ ID NO: 105435 - DNA, 601 bp, Human
gcatttctgtattattgggcattgaattggatcctgtagttaatttaaacaaagtattatctttaagatcacctacttctaattctgctcttaaactttagtggtagaattacatttgctttagattttcttgatagttttgttatagacactaagaaataaactaaaatgaatgacaacaaaagtccagtggttttataagttggaaataaacaaaacaagagcaaaatagcaacctgactccttcactatttttggagtgaaaagggaagaatgtttctttccctaaatctggaaaatrtaaaatactgctcaaaatatgtatgaaaaaataaacataagtggggtaaaagtacacatgtgctaatgcttcagcttactgaagttatgagttctttctttgcgttttctaaattaatacatgacaactagcaaacacaatttttttaaaggaaggattagaaaaaaataatacgggaaaatataactcagctgactgaaagatttgccagcagaccagtacaaaaacgaactacggaatacaccgtttgttttttgcttattttcttgcaaacattttgtaggtacaaaaaggcacctt

SEQ ID NO: 105436 - DNA, 601 bp, Human
tacttctaattctgctcttaaactttagtggtagaattacatttgctttagattttcttgatagttttgttatagacactaagaaataaactaaaatgaatgacaacaaaagtccagtggttttataagttggaaataaacaaaacaagagcaaaatagcaacctgactccttcactatttttggagtgaaaagggaagaatgtttctttccctaaatctggaaaatataaaatactgctcaaaatatgtatgaaaaaataaacataagtggggtaaaagtacacatgtgctaatgcttcrgcttactgaagttatgagttctttctttgcgttttctaaattaatacatgacaactagcaaacacaatttttttaaaggaaggattagaaaaaaataatacgggaaaatataactcagctgactgaaagatttgccagcagaccagtacaaaaacgaactacggaatacaccgtttgttttttgcttattttcttgcaaacattttgtaggtacaaaaaggcacctttgtggaatttaaaaagtaatgctacaagttggggttcgttttataggttctaggattcatttcagattgtctt

SEQ ID NO: 105437 - DNA, 601 bp, Human
tagaattacatttgctttagattttcttgatagttttgttatagacactaagaaataaactaaaatgaatgacaacaaaagtccagtggttttataagttggaaataaacaaaacaagagcaaaatagcaacctgactccttcactatttttggagtgaaaagggaagaatgtttctttccctaaatctggaaaatataaaatactgctcaaaatatgtatgaaaaaataaacataagtggggtaaaagtacacatgtgctaatgcttcagcttactgaagttatgagttctttctttgcrttttctaaattaatacatgacaactagcaaacacaatttttttaaaggaaggattagaaaaaaataatacgggaaaatataactcagctgactgaaagatttgccagcagaccagtacaaaaacgaactacggaatacaccgtttgttttttgcttattttcttgcaaacattttgtaggtacaaaaaggcacctttgtggaatttaaaaagtaatgctacaagttggggttcgttttataggttctaggattcatttcagattgtctttcaaagacaaatgaaaagtagcatttcaatg

SEQ ID NO: 105438 - DNA, 601 bp, Human
cctttaaaaaatgtacttgctagtcattaaactaagttgttattaaattgcattaaaaattaaatgataattgtaaattatagtgggttcccaatgtgttcagttttgcataacttatagggcctgaggatctccctccactccctaatctgtggctcatcacagcgcttgtgtcttctcagcttgaggcaccagggctgtggtttcccagtgggaggggagaaactacagcgtcctgaggatgactctgctactctcctgctccttcagaacccaccttgaccttcatgacaccttcctrtctctccctccctccctccccttctctcagccgctatagcacctgtctggctttattcttctccagacctactgcagggccagatagttctacgacgttctcatgaggattgcaggatccatcacttgctactttggccattttggattccagcttcatttttaattttatatgttatgctgtagatagttttatgggaacactggtacaggagtatttagtaatttgtgaatggtaaaggtctcaagacttttctcagaacctgtgaaaatctcactgcctgctcgacttcagtatgac

SEQ ID NO: 105439 - DNA, 601 bp, Human
aagttgttattaaattgcattaaaaattaaatgataattgtaaattatagtgggttcccaatgtgttcagttttgcataacttatagggcctgaggatctccctccactccctaatctgtggctcatcacagcgcttgtgtcttctcagcttgaggcaccagggctgtggtttcccagtgggaggggagaaactacagcgtcctgaggatgactctgctactctcctgctccttcagaacccaccttgaccttcatgacaccttcctgtctctccctccctccctccccttctctcagcckctatagcacctgtctggctttattcttctccagacctactgcagggccagatagttctacgacgttctcatgaggattgcaggatccatcacttgctactttggccattttggattccagcttcatttttaattttatatgttatgctgtagatagttttatgggaacactggtacaggagtatttagtaatttgtgaatggtaaaggtctcaagacttttctcagaacctgtgaaaatctcactgcctgctcgacttcagtatgactggtgggtaggaccactgaggaatggggacagg

SEQ ID NO: 105440 - DNA, 601 bp, Human
tcaggaagacctcgggaaaatgacggtaactggtcaggaacttgaacctgcttctcacagtcccctaagaaggcgtaccagaaaggagccctaagcaggcaggagactccaggctgaggctatttctgctgtttctgtggagaacgttctctgcacgcagccatggctgctcagaaggggtgtgtgcattccaggatacaaatagccctcctggcattcccggtggctgcctgcctatccctagtggtaaggtctatgaaggaaagaaaggcaagtgactgtttacctttcccatgaaaakcttccttttcttcaacatttttgattgtaacgaaaactttatataaaatattctccctttatttttatttttttttgagacagagtctcgctctatcgcccaggctggagtgcagtggcatgatctcggctcactgcaacctcacctcccgggttcaagtgattcttctgcctcagcctccctagtagctgggattacaggcatatgccaccatgcccagctaatttttgtatttttagtagagacggagtttcaccatgttagtcaggatggtctcgatctgctgacctcgtgatccac

SEQ ID NO: 105441 - DNA, 601 bp, Human
agaacgttctctgcacgcagccatggctgctcagaaggggtgtgtgcattccaggatacaaatagccctcctggcattcccggtggctgcctgcctatccctagtggtaaggtctatgaaggaaagaaaggcaagtgactgtttacctttcccatgaaaatcttccttttcttcaacatttttgattgtaacgaaaactttatataaaatattctccctttatttttatttttttttgagacagagtctcgctctatcgcccaggctggagtgcagtggcatgatctcggctcactgcaamctcacctcccgggttcaagtgattcttctgcctcagcctccctagtagctgggattacaggcatatgccaccatgcccagctaatttttgtatttttagtagagacggagtttcaccatgttagtcaggatggtctcgatctgctgacctcgtgatccacccgcctcggcctcccaaagtgctgggattacaggcatgagccaccatgcccagcctacataaaatactctaaaatgttaatcttgctgaaacaatataagtgtgttgtctccatactggaatgcatttgaatgtttgtat

SEQ ID NO: 105442 - DNA, 601 bp, Human
tctcgctctatcgcccaggctggagtgcagtggcatgatctcggctcactgcaacctcacctcccgggttcaagtgattcttctgcctcagcctccctagtagctgggattacaggcatatgccaccatgcccagctaatttttgtatttttagtagagacggagtttcaccatgttagtcaggatggtctcgatctgctgacctcgtgatccacccgcctcggcctcccaaagtgctgggattacaggcatgagccaccatgcccagcctacataaaatactctaaaatgttaatcttgstgaaacaatataagtgtgttgtctccatactggaatgcatttgaatgtttgtattttggcaacatttgaaagtcactttaaatcatcccattcatatctcagagcaaaggtgataataaggaagtgaataaatggccctgaggccatctgaaactttttaaatgaactgccaggccataggaaaaacacatatataccacgtttgataaaaaacttaagtgtacctcaagaatttctttacgcatttagaagcacagtatagttgatacattgaaataacttccttttcttaaaatttta

SEQ ID NO: 105443 - DNA, 601 bp, Human
gctgggattacaggcatatgccaccatgcccagctaatttttgtatttttagtagagacggagtttcaccatgttagtcaggatggtctcgatctgctgacctcgtgatccacccgcctcggcctcccaaagtgctgggattacaggcatgagccaccatgcccagcctacataaaatactctaaaatgttaatcttgctgaaacaatataagtgtgttgtctccatactggaatgcatttgaatgtttgtattttggcaacatttgaaagtcactttaaatcatcccattcatatctcaragcaaaggtgataataaggaagtgaataaatggccctgaggccatctgaaactttttaaatgaactgccaggccataggaaaaacacatatataccacgtttgataaaaaacttaagtgtacctcaagaatttctttacgcatttagaagcacagtatagttgatacattgaaataacttccttttcttaaaattttaatttaatattgtgtgaatgtttttcagagttagaatttagttatacacaatttttagggactaggcaaattgaaggtttttttttttctagagggggcagtg

SEQ ID NO: 105444 - DNA, 601 bp, Human
ccatgcccagcctacataaaatactctaaaatgttaatcttgctgaaacaatataagtgtgttgtctccatactggaatgcatttgaatgtttgtattttggcaacatttgaaagtcactttaaatcatcccattcatatctcagagcaaaggtgataataaggaagtgaataaatggccctgaggccatctgaaactttttaaatgaactgccaggccataggaaaaacacatatataccacgtttgataaaaaacttaagtgtacctcaagaatttctttacgcatttagaagcacagyatagttgatacattgaaataacttccttttcttaaaattttaatttaatattgtgtgaatgtttttcagagttagaatttagttatacacaatttttagggactaggcaaattgaaggtttttttttttctagagggggcagtgatagttgatttgcttaaaaattttaggcttagtataaaaatcaaaatacttataaaatagattacaggctactttatttgctgtttggttaaacacaaacttcatgtgtaattttaatttaagaatattctaaactctgttctcctttgtaaataa

SEQ ID NO: 105445 - DNA, 601 bp, Human
ctacataaaatactctaaaatgttaatcttgctgaaacaatataagtgtgttgtctccatactggaatgcatttgaatgtttgtattttggcaacatttgaaagtcactttaaatcatcccattcatatctcagagcaaaggtgataataaggaagtgaataaatggccctgaggccatctgaaactttttaaatgaactgccaggccataggaaaaacacatatataccacgtttgataaaaaacttaagtgtacctcaagaatttctttacgcatttagaagcacagtatagttgatayattgaaataacttccttttcttaaaattttaatttaatattgtgtgaatgtttttcagagttagaatttagttatacacaatttttagggactaggcaaattgaaggtttttttttttctagagggggcagtgatagttgatttgcttaaaaattttaggcttagtataaaaatcaaaatacttataaaatagattacaggctactttatttgctgtttggttaaacacaaacttcatgtgtaattttaatttaagaatattctaaactctgttctcctttgtaaataacagcaaattta

SEQ ID NO: 105446 - DNA, 601 bp, Human
cttatgcagatggtctcatgactacagctgatacttacccatcctttttccctcccaccgccttcacctacccattcagcatttgcttcattctcatctaacaccctggctggtctgagtagccttggggtgaccctgacattcaactctgaagggtcttagccttggtcaccaacccctaaccagtcccaatgcacttgtggttcacacatggctgagcatttgctctcaaaatggccagaggaataccagcaaatgccttgctggtccgcctgggtgacaaacatattcttcccagacrattcttgtcagaatggtgcatcgtgtcctcaccagtggtatccagcctgaggaggtgaagcgattgcagcagcttgaagatgactgggactcacattgtgtcctctggtagaagcactccctgctgggagcagacttccagatccacagagcccatggtaatggggatgggaggcacatacttcccagctggcaaacatgaccacttctacgctcaccattggtttccagagggatatatcctatccactggggatggagcgccataatggtcattgattttggatgtacagaactgcat

SEQ ID NO: 105447 - DNA, 601 bp, Human
agcctgaggaggtgaagcgattgcagcagcttgaagatgactgggactcacattgtgtcctctggtagaagcactccctgctgggagcagacttccagatccacagagcccatggtaatggggatgggaggcacatacttcccagctggcaaacatgaccacttctacgctcaccattggtttccagagggatatatcctatccactggggatggagcgccataatggtcattgattttggatgtacagaactgcattctgaagtatcccccatcctcacaggggatcgggggcctcaackgcagctttaaaagattgttctatcaccctgtcaggccagcagctgctgggaaatacagaaggtggcaagaacaggggatcccgggctcatgtacctagcgcccctctgcctttgccataaggtgggtcatttggcttgttggcatctcctatgggattccacatcagtggatcacacattctgtaagttcttggatagtgatgctggccaaggccctgcaggtagaaaagaaaaatccaccccagcctacctgttagttcccctcaagatgatgtaaccccctggccaccgagtggctgc

SEQ ID NO: 105448 - DNA, 601 bp, Human
ctggtagaagcactccctgctgggagcagacttccagatccacagagcccatggtaatggggatgggaggcacatacttcccagctggcaaacatgaccacttctacgctcaccattggtttccagagggatatatcctatccactggggatggagcgccataatggtcattgattttggatgtacagaactgcattctgaagtatcccccatcctcacaggggatcgggggcctcaactgcagctttaaaagattgttctatcaccctgtcaggccagcagctgctgggaaatacagaargtggcaagaacaggggatcccgggctcatgtacctagcgcccctctgcctttgccataaggtgggtcatttggcttgttggcatctcctatgggattccacatcagtggatcacacattctgtaagttcttggatagtgatgctggccaaggccctgcaggtagaaaagaaaaatccaccccagcctacctgttagttcccctcaagatgatgtaaccccctggccaccgagtggctgcttggtcttattgagggatgctgctgtatccaggttcagcatcagtgtctgctgtggacagt

SEQ ID NO: 105449 - DNA, 601 bp, Human
gcaccagcaggtccagcctgcagtatgtgcagccctgatgcagagccctgttctggccacactaaagctgtcattctgtaaatgggttaatttttccaaggccagaacctgaagtggtctaagaggcatcatttttcctttacagtggtggtaagtgcaagatacaataattaattctttactttgcaggggatttccctgcatgccctagaacactagatcctaaaaaccactaagttggcaggttcagatcttggtaggatttctctctcaccgtctgaacacatcttttactaaggcttttttttttttttttttgagataagagtcttgctctgtcacccagtctggagtgcaatggagcgatctcggctcactgcaatctccacctcccgggttcaagctattctcctgcctcagtctctggagtagttgggattacaggcgcctgcctaattttttttttttttttttttttgggacaggtattcaccatgttggtcaggctggtcatgaattcctgacctcaagcaatccgcctgcctctgcctcccaaaatgctgggattataggtgtgagccaccatgcccagcctaagaag

SEQ ID NO: 105450 - DNA, 601 bp, Human
acaataattaattctttactttgcaggggatttccctgcatgccctagaacactagatcctaaaaaccactaagttggcaggttcagatcttggtaggatttctctctcaccgtctgaacacatcttttactaaggcttttttttttttttttttgagataagagtcttgctctgtcacccagtctggagtgcaatggagcgatctcggctcactgcaatctccacctcccgggttcaagctattctcctgcctcagtctctggagtagttgggattacaggcgcctgcctaatttttttyttttttttttttttgggacaggtattcaccatgttggtcaggctggtcatgaattcctgacctcaagcaatccgcctgcctctgcctcccaaaatgctgggattataggtgtgagccaccatgcccagcctaagaaggcttttaacatatttgtcgcattcactcatctagtccggtccacatggtatcatgaagttagtggacaaatgctgttctgagaatgtccaaaatggcctagatcccttctgaggataggaatgtggcaagtaaatactgcagcctagctcatgggcctatgaa

SEQ ID NO: 105451 - DNA, 601 bp, Human
tctgcctcccaaaatgctgggattataggtgtgagccaccatgcccagcctaagaaggcttttaacatatttgtcgcattcactcatctagtccggtccacatggtatcatgaagttagtggacaaatgctgttctgagaatgtccaaaatggcctagatcccttctgaggataggaatgtggcaagtaaatactgcagcctagctcatgggcctatgaagctctgcagttcctctatgtgagataaatgggaggaagatgcctgtgccagttcaatggcacacatgcctggtgccacgcyaatctacaggagcaaggatgcctcccccggcacagcagctgtgcagctggctttgaggcagatcactttcattctttacgatacctctggttttctagaggccagattggtgaattaaatgggaatatggtggagaccactaaccttttgttcttcaagagaggcactaatctctgccattcttcctgggatgtggagagatgacgggcggtcatcccccgtcctctcactacacagggacaggaactccccatgtggcagttctgccagctatcaaatattccctttccacttacatat

SEQ ID NO: 105452 - DNA, 601 bp, Human
ctagatcccttctgaggataggaatgtggcaagtaaatactgcagcctagctcatgggcctatgaagctctgcagttcctctatgtgagataaatgggaggaagatgcctgtgccagttcaatggcacacatgcctggtgccacgccaatctacaggagcaaggatgcctcccccggcacagcagctgtgcagctggctttgaggcagatcactttcattctttacgatacctctggttttctagaggccagattggtgaattaaatgggaatatggtggagaccactaaccttttgttcytcaagagaggcactaatctctgccattcttcctgggatgtggagagatgacgggcggtcatcccccgtcctctcactacacagggacaggaactccccatgtggcagttctgccagctatcaaatattccctttccacttacatatttgttgaccagggaaatgaccgtttggtggttccaaaccctctgtcgtccaggctggagtgcagtggcgcgatctcagctcactgcaacctccgcctcctgggttcaaacaattttctggcctcagcctcctgagtagctgggactataggtgc

SEQ ID NO: 105453 - DNA, 601 bp, Human
cctagctcatgggcctatgaagctctgcagttcctctatgtgagataaatgggaggaagatgcctgtgccagttcaatggcacacatgcctggtgccacgccaatctacaggagcaaggatgcctcccccggcacagcagctgtgcagctggctttgaggcagatcactttcattctttacgatacctctggttttctagaggccagattggtgaattaaatgggaatatggtggagaccactaaccttttgttcttcaagagaggcactaatctctgccattcttcctgggatgtggagrgatgacgggcggtcatcccccgtcctctcactacacagggacaggaactccccatgtggcagttctgccagctatcaaatattccctttccacttacatatttgttgaccagggaaatgaccgtttggtggttccaaaccctctgtcgtccaggctggagtgcagtggcgcgatctcagctcactgcaacctccgcctcctgggttcaaacaattttctggcctcagcctcctgagtagctgggactataggtgcatgccaccacgcctggctattttttgtatttttagtagagatggg

SEQ ID NO: 105454 - DNA, 601 bp, Human
ctctatgtgagataaatgggaggaagatgcctgtgccagttcaatggcacacatgcctggtgccacgccaatctacaggagcaaggatgcctcccccggcacagcagctgtgcagctggctttgaggcagatcactttcattctttacgatacctctggttttctagaggccagattggtgaattaaatgggaatatggtggagaccactaaccttttgttcttcaagagaggcactaatctctgccattcttcctgggatgtggagagatgacgggcggtcatcccccgtcctctcactrcacagggacaggaactccccatgtggcagttctgccagctatcaaatattccctttccacttacatatttgttgaccagggaaatgaccgtttggtggttccaaaccctctgtcgtccaggctggagtgcagtggcgcgatctcagctcactgcaacctccgcctcctgggttcaaacaattttctggcctcagcctcctgagtagctgggactataggtgcatgccaccacgcctggctattttttgtatttttagtagagatggggcttcactgtgttgcccaggctggtgtcgaact

SEQ ID NO: 105455 - DNA, 601 bp, Human
aatggcacacatgcctggtgccacgccaatctacaggagcaaggatgcctcccccggcacagcagctgtgcagctggctttgaggcagatcactttcattctttacgatacctctggttttctagaggccagattggtgaattaaatgggaatatggtggagaccactaaccttttgttcttcaagagaggcactaatctctgccattcttcctgggatgtggagagatgacgggcggtcatcccccgtcctctcactacacagggacaggaactccccatgtggcagttctgccagctaycaaatattccctttccacttacatatttgttgaccagggaaatgaccgtttggtggttccaaaccctctgtcgtccaggctggagtgcagtggcgcgatctcagctcactgcaacctccgcctcctgggttcaaacaattttctggcctcagcctcctgagtagctgggactataggtgcatgccaccacgcctggctattttttgtatttttagtagagatggggcttcactgtgttgcccaggctggtgtcgaactcctgagctcagggaatccacctgccttggcctccaaagtgct

SEQ ID NO: 105456 - DNA, 601 bp, Human
cagttctgccagctatcaaatattccctttccacttacatatttgttgaccagggaaatgaccgtttggtggttccaaaccctctgtcgtccaggctggagtgcagtggcgcgatctcagctcactgcaacctccgcctcctgggttcaaacaattttctggcctcagcctcctgagtagctgggactataggtgcatgccaccacgcctggctattttttgtatttttagtagagatggggcttcactgtgttgcccaggctggtgtcgaactcctgagctcagggaatccacctgcctyggcctccaaagtgctggaattacaggcgtgagccactgcgcctggcctttttcctgaaatttttttggaaaataattttctttccctacttgtgttatttctgtagatatgaccaacatgtagtcctgtagaataacaattaaaaatagttgaggtagagatttcattgttacattatattcatgcattcagtcaacagatattggtaggatttctggacatggggactggcctcaaaaagggcttaacagagaaaactatcaccttgctttcatggaggtggggcaaatagtatgagaa

SEQ ID NO: 105457 - DNA, 601 bp, Human
ttaaatcaagacataaatcatcttcttcatttgacatcgaaatcaatttgtatattttaaaagcagagatcagccatagtaattccagttatattttatgagccaaaataatagcatgcctttaatctgccactttgtttggaagtcttattttcagaaactatgaataaatcttctacaccatcttcccgagagctttagtaagacctcagactggagtagagttgaaggagggaatgccagtctgaagaaggaaaggaagaggagagacagcaaggagaacttcagttgtcaaggtatygggtgcaggggtcagaaagaaacatgactccatggaccactgcttggcccaagaccagatgtcaaaaccacagagccctgctgtagagcattacaaatgtattccaccaaatgttgggatgcatcctagacctgtgctggccagcagtccccagctgtgaggagaagcccgccattttgagttgatcacttggcagagttgatcatcataaaattatccttgtagagctaaataaggtttgtctttgacattcagtctggtttataggatagcaaaagggaagtggcctcagctagtaga

SEQ ID NO: 105458 - DNA, 601 bp, Human
tcaagacataaatcatcttcttcatttgacatcgaaatcaatttgtatattttaaaagcagagatcagccatagtaattccagttatattttatgagccaaaataatagcatgcctttaatctgccactttgtttggaagtcttattttcagaaactatgaataaatcttctacaccatcttcccgagagctttagtaagacctcagactggagtagagttgaaggagggaatgccagtctgaagaaggaaaggaagaggagagacagcaaggagaacttcagttgtcaaggtatcgggtrcaggggtcagaaagaaacatgactccatggaccactgcttggcccaagaccagatgtcaaaaccacagagccctgctgtagagcattacaaatgtattccaccaaatgttgggatgcatcctagacctgtgctggccagcagtccccagctgtgaggagaagcccgccattttgagttgatcacttggcagagttgatcatcataaaattatccttgtagagctaaataaggtttgtctttgacattcagtctggtttataggatagcaaaagggaagtggcctcagctagtagatttga

SEQ ID NO: 105459 - DNA, 601 bp, Human
cactcttgttgctcaggctggagtgcaatggtgcgatctcggctcactgcaacctccacctctggagtttaaatgattcccctgcctcagcctcccgagtagccgggattacaggcgcctgccaccacgcccagctaatttttttgtatttttagtagagacggggtttcaccatgttggccaggctggtctcaaactcctgacctcaggtgatccacctgcctcagcctcccagagtgctgggattacaggcgtgagccatggcgcccggctggtagggtctttattaaagaacagttaygagagatgtatgaagtatgagtaaagatagaataatttaggtctttaattgtaatgctatatcctaaacatggaaatctatttgaccaatacattgtggatgaggatatactttattctgccttcctttaacaaatacgtataactgagctgttactatgtgccagaccctactttaggtgccagttatataataagcaaacagacacccttcctgtcttcctggaggtgagtctaatgaggaccaggcaataaaaagtaaacaaataaatgcatcattatgtcctaaaaggaactttgg

SEQ ID NO: 105460 - DNA, 601 bp, Human
gtgatccacctgcctcagcctcccagagtgctgggattacaggcgtgagccatggcgcccggctggtagggtctttattaaagaacagttatgagagatgtatgaagtatgagtaaagatagaataatttaggtctttaattgtaatgctatatcctaaacatggaaatctatttgaccaatacattgtggatgaggatatactttattctgccttcctttaacaaatacgtataactgagctgttactatgtgccagaccctactttaggtgccagttatataataagcaaacagacacmcttcctgtcttcctggaggtgagtctaatgaggaccaggcaataaaaagtaaacaaataaatgcatcattatgtcctaaaaggaactttggaggaaatgaacaggacacagttgcagattgtacaggataaaagggacaagagcaggtgtttatggaaggctgaggtcaggaggacagagtggtggccacgtggtatggaccggttttcccggcagtgggaacaacgtgtccaaagactataagataggagaaagtttattccatttgagggatggaaaggctggtgctgttgggaaggg

SEQ ID NO: 105461 - DNA, 601 bp, Human
tataactgagctgttactatgtgccagaccctactttaggtgccagttatataataagcaaacagacacccttcctgtcttcctggaggtgagtctaatgaggaccaggcaataaaaagtaaacaaataaatgcatcattatgtcctaaaaggaactttggaggaaatgaacaggacacagttgcagattgtacaggataaaagggacaagagcaggtgtttatggaaggctgaggtcaggaggacagagtggtggccacgtggtatggaccggttttcccggcagtgggaacaacgtgtscaaagactataagataggagaaagtttattccatttgagggatggaaaggctggtgctgttgggaagggcacagtgaggtgagatggagctggagaggctggctggaccagatggagtgaagcttcatctgacatgcagtgggaagccacgagtgactttaaacagggcagcaatggtcctcttgttgggtgccatgtggagattggattaagagaggcagagtgggtggaggagaccctgaagaggctgcaccgtcagtgttggagtggagcaggggcagtgcagatggggaagccagg

SEQ ID NO: 105462 - DNA, 601 bp, Human
tatgtgccagaccctactttaggtgccagttatataataagcaaacagacacccttcctgtcttcctggaggtgagtctaatgaggaccaggcaataaaaagtaaacaaataaatgcatcattatgtcctaaaaggaactttggaggaaatgaacaggacacagttgcagattgtacaggataaaagggacaagagcaggtgtttatggaaggctgaggtcaggaggacagagtggtggccacgtggtatggaccggttttcccggcagtgggaacaacgtgtccaaagactataagatargagaaagtttattccatttgagggatggaaaggctggtgctgttgggaagggcacagtgaggtgagatggagctggagaggctggctggaccagatggagtgaagcttcatctgacatgcagtgggaagccacgagtgactttaaacagggcagcaatggtcctcttgttgggtgccatgtggagattggattaagagaggcagagtgggtggaggagaccctgaagaggctgcaccgtcagtgttggagtggagcaggggcagtgcagatggggaagccaggatgagcacagctgtcct

SEQ ID NO: 105463 - DNA, 601 bp, Human
cacgagtgactttaaacagggcagcaatggtcctcttgttgggtgccatgtggagattggattaagagaggcagagtgggtggaggagaccctgaagaggctgcaccgtcagtgttggagtggagcaggggcagtgcagatggggaagccaggatgagcacagctgtcctcaggatgtggcaggcagggcttgctgatgaagtagacgtgaggtggcagagagattgtgatggcactcatgcttctgagatgatcaactgggaatggccgatgccatggactgagatgggaatagagaagrgaaggggggaaattcaggaggtgaggagaaagttattgaaaattacgttactttttaacaagtgcagttcgaaataccaagtggagatgtcaaacaggcaattatcagattagagtagagagttcagagatattttaggtagaaatataaatttgggaaccatcagcctgtaaatagtatttaaagacatgataatgaataggatcaccttgaaaaattgaaggaagagaagagatggtcccagaacagttcaggcaaaatccaccatttagaggtcagagaaaaagagaagattatgaa

SEQ ID NO: 105464 - DNA, 601 bp, Human
gataatgaataggatcaccttgaaaaattgaaggaagagaagagatggtcccagaacagttcaggcaaaatccaccatttagaggtcagagaaaaagagaagattatgaaagggcctgagaattaaagtctagaaaggtagagggtaaaattaggagaatactgattttaagaaaacaagaaaaaagtgttttcaaggaggaaatagccaaccatttcaaataaaatgaagagtgaaataaattttaaaaagtgagggaaataaaataggaaagtgaatattggatttggaagcaaggagrttatgtgatccctctgattgatattagccaaagctaaatatggcaaaataacttctggaaatacatccttctatctaaagatttgcctgttctttagaaggacctgtttggtgcagaaggaaaataggtcaaaaatagttgcaagcattccttaccatgttggtagaaggtgttcttactccatggtttaccatcataagccatcctgcctttatgcctcttgctatgtgtattatccaggactgtttcgggtgcaagtgacggaaacccaagtcgaagaagttcaagtgaagatgaaac

SEQ ID NO: 105465 - DNA, 601 bp, Human
aaataaattttaaaaagtgagggaaataaaataggaaagtgaatattggatttggaagcaaggaggttatgtgatccctctgattgatattagccaaagctaaatatggcaaaataacttctggaaatacatccttctatctaaagatttgcctgttctttagaaggacctgtttggtgcagaaggaaaataggtcaaaaatagttgcaagcattccttaccatgttggtagaaggtgttcttactccatggtttaccatcataagccatcctgcctttatgcctcttgctatgtgtattwtccaggactgtttcgggtgcaagtgacggaaacccaagtcgaagaagttcaagtgaagatgaaacttactaatttataaaataaattagacagtgctgaatttaggatctcaaatgatgttgttaggatttcacccctactctcacactctctccctcttctttcattcttcctgatttcttctctggcaagctctctccaagtggtggagggatgaatgttggcagtgcagtgttaggtccattaacttctgatagcagaggccagcttctctcttggagcattcatattaattctggg

SEQ ID NO: 105466 - DNA, 601 bp, Human
aaataggaaagtgaatattggatttggaagcaaggaggttatgtgatccctctgattgatattagccaaagctaaatatggcaaaataacttctggaaatacatccttctatctaaagatttgcctgttctttagaaggacctgtttggtgcagaaggaaaataggtcaaaaatagttgcaagcattccttaccatgttggtagaaggtgttcttactccatggtttaccatcataagccatcctgcctttatgcctcttgctatgtgtattatccaggactgtttcgggtgcaagtgacrgaaacccaagtcgaagaagttcaagtgaagatgaaacttactaatttataaaataaattagacagtgctgaatttaggatctcaaatgatgttgttaggatttcacccctactctcacactctctccctcttctttcattcttcctgatttcttctctggcaagctctctccaagtggtggagggatgaatgttggcagtgcagtgttaggtccattaacttctgatagcagaggccagcttctctcttggagcattcatattaattctgggacaactgacactggcttgcttgtgtccc

SEQ ID NO: 105467 - DNA, 601 bp, Human
ggtcagcatgtaccacatacacacctgtgttactggacatgtgtccacatgaccgatagctggaccacaaccgtggggagctgaggagtgttctagggacagacaagaaaacagtaggtgcccactataacagtatacagaagaaaaaagtagacatcgactgtaataggacacagaagaaaacagtaggtgcccactgtaataggatactgaagtagacacagggttgcagctgagcttccaacagttcctccatatagttctttgttaacattaactcagctttcattgcagccaactrctaacttaacaattagctatgtgagcactaagtcagagattgagggtaggtataaatcatgccaagagctagaggaaatttggtaccaaataacaaccggtcttggttaagaggctaggtatccataaatgctggtcttgctctattgccattctgtgtcttgtttttgctaacttgttaatgtttctggatgttggtattattctttagtcaagtactaacctaatgacaccataaaagctttagatttctgatttctgagagcatctaataaaaaccaggacagagcaatgagaagag

SEQ ID NO: 105468 - DNA, 601 bp, Human
ccacatgaccgatagctggaccacaaccgtggggagctgaggagtgttctagggacagacaagaaaacagtaggtgcccactataacagtatacagaagaaaaaagtagacatcgactgtaataggacacagaagaaaacagtaggtgcccactgtaataggatactgaagtagacacagggttgcagctgagcttccaacagttcctccatatagttctttgttaacattaactcagctttcattgcagccaactactaacttaacaattagctatgtgagcactaagtcagagattgakggtaggtataaatcatgccaagagctagaggaaatttggtaccaaataacaaccggtcttggttaagaggctaggtatccataaatgctggtcttgctctattgccattctgtgtcttgtttttgctaacttgttaatgtttctggatgttggtattattctttagtcaagtactaacctaatgacaccataaaagctttagatttctgatttctgagagcatctaataaaaaccaggacagagcaatgagaagagtttgtctgaattgcctacccgtgtaaatataaaactgtgtttta

SEQ ID NO: 105469 - DNA, 601 bp, Human
cgtggggagctgaggagtgttctagggacagacaagaaaacagtaggtgcccactataacagtatacagaagaaaaaagtagacatcgactgtaataggacacagaagaaaacagtaggtgcccactgtaataggatactgaagtagacacagggttgcagctgagcttccaacagttcctccatatagttctttgttaacattaactcagctttcattgcagccaactactaacttaacaattagctatgtgagcactaagtcagagattgagggtaggtataaatcatgccaagagctrgaggaaatttggtaccaaataacaaccggtcttggttaagaggctaggtatccataaatgctggtcttgctctattgccattctgtgtcttgtttttgctaacttgttaatgtttctggatgttggtattattctttagtcaagtactaacctaatgacaccataaaagctttagatttctgatttctgagagcatctaataaaaaccaggacagagcaatgagaagagtttgtctgaattgcctacccgtgtaaatataaaactgtgttttaaaatgagcctgtagctgaagtaaaaat

SEQ ID NO: 105470 - DNA, 601 bp, Human
taaaagataaaggagaactattcttgaaattatttggtcatcctaaatacagtaatgaagttgggatgagtatggtaaatttattaaatttactatcacaaaagaaatatatatatcaattctgtaaattgaaaaaatacaaaagaaatttgggaaatactattttaaatgaaaaaaggtggattataggaggaaattattaataattttttagtttccttacagtatttttcctatgagtatatattttaatatgtatatattctaagttttcatttaacattatatcactagaatttcyctaggttgttatatgtttttcaaacatatttcacatacccaaaatactaattttgtaatactatagtaatttgatggattaattactctaattttaatccttcttcatttaatgtccagttttgccccagtacagataatggtaaattaaagatctttaggcacaaattctagtttttgtttctagttgtttcctttgggtaagttactagaattggaattactattgtttgtttgatgttcttaatacttagtgcccaatatcttttgggggggttattgttaactttcactttcttca

SEQ ID NO: 105471 - DNA, 601 bp, Human
caattctgtaaattgaaaaaatacaaaagaaatttgggaaatactattttaaatgaaaaaaggtggattataggaggaaattattaataattttttagtttccttacagtatttttcctatgagtatatattttaatatgtatatattctaagttttcatttaacattatatcactagaatttccctaggttgttatatgtttttcaaacatatttcacatacccaaaatactaattttgtaatactatagtaatttgatggattaattactctaattttaatccttcttcatttaatgtmcagttttgccccagtacagataatggtaaattaaagatctttaggcacaaattctagtttttgtttctagttgtttcctttgggtaagttactagaattggaattactattgtttgtttgatgttcttaatacttagtgcccaatatcttttgggggggttattgttaactttcactttcttcatcagaggagcagcatgtctctttttcaaacacctggccaatattatctattatcagtttttaaatttcccttaatctttgaaaactgctgcagtgatggtgtttattggcatttct

SEQ ID NO: 105472 - DNA, 601 bp, Human
ctggaagagcaacttgtatagactggatgcctcttagttctcacttttcattgccttattatgatctgtgtgtatgggcttgtttctagactctccattttcttttacttgtgaattatctgtcactagctcatttttttttgttactgtagcacaaagctgtatcatcacaacctgtagggtaagtcccactccttatgcattcgtgtgttcaacaagcacttactgattgcctattatgtgcacataactgatactggtcacggtcacctagtcacatcgttgtaattgacttctcacrtgggttaccttgtcatttggagggacgatgcaccatgatggtgcttgttacctagtaagaaattatctatctggatattagagctaggtgacatggcttatgaaagacagtttttgaaactgtggaaagtaatttttcaggagttttcagattgacatcataagtgctataagaggtttgctaagccctcagtcagcaagccctgtgaacggaaaggaccttacccaaggcaggtagaatgccatcgctaacactcaggtgaatctcccatgaagattagaaagatggcttactctctta

SEQ ID NO: 105473 - DNA, 601 bp, Human
cacggtcacctagtcacatcgttgtaattgacttctcacgtgggttaccttgtcatttggagggacgatgcaccatgatggtgcttgttacctagtaagaaattatctatctggatattagagctaggtgacatggcttatgaaagacagtttttgaaactgtggaaagtaatttttcaggagttttcagattgacatcataagtgctataagaggtttgctaagccctcagtcagcaagccctgtgaacggaaaggaccttacccaaggcaggtagaatgccatcgctaacactcaggtraatctcccatgaagattagaaagatggcttactctcttatctgacagattgcatacagctgcaaagagaattagtatattggaaggtagatcttagaaaacaccacagagtgataaagctgtggaaatataaagctaagtttaaaaaacatgactggtgaatgaggaggtctaaatatatcttattgaagccccagtggaagtaaccggagaaaatataggaaagacaatggttaaataagcaattgccaagagttttctataactgaagacaagttcaattgaaaacagacactgactc

SEQ ID NO: 105474 - DNA, 601 bp, Human
catttggagggacgatgcaccatgatggtgcttgttacctagtaagaaattatctatctggatattagagctaggtgacatggcttatgaaagacagtttttgaaactgtggaaagtaatttttcaggagttttcagattgacatcataagtgctataagaggtttgctaagccctcagtcagcaagccctgtgaacggaaaggaccttacccaaggcaggtagaatgccatcgctaacactcaggtgaatctcccatgaagattagaaagatggcttactctcttatctgacagattgcmtacagctgcaaagagaattagtatattggaaggtagatcttagaaaacaccacagagtgataaagctgtggaaatataaagctaagtttaaaaaacatgactggtgaatgaggaggtctaaatatatcttattgaagccccagtggaagtaaccggagaaaatataggaaagacaatggttaaataagcaattgccaagagttttctataactgaagacaagttcaattgaaaacagacactgactcatgaacagaataaattaattcaaatttatgaaatgaaatcattctgaatctgg

SEQ ID NO: 105475 - DNA, 601 bp, Human
ttacctagtaagaaattatctatctggatattagagctaggtgacatggcttatgaaagacagtttttgaaactgtggaaagtaatttttcaggagttttcagattgacatcataagtgctataagaggtttgctaagccctcagtcagcaagccctgtgaacggaaaggaccttacccaaggcaggtagaatgccatcgctaacactcaggtgaatctcccatgaagattagaaagatggcttactctcttatctgacagattgcatacagctgcaaagagaattagtatattggaaggyagatcttagaaaacaccacagagtgataaagctgtggaaatataaagctaagtttaaaaaacatgactggtgaatgaggaggtctaaatatatcttattgaagccccagtggaagtaaccggagaaaatataggaaagacaatggttaaataagcaattgccaagagttttctataactgaagacaagttcaattgaaaacagacactgactcatgaacagaataaattaattcaaatttatgaaatgaaatcattctgaatctggaaaacactaaaagtaaagaaacttttaaaagtcc

SEQ ID NO: 105476 - DNA, 601 bp, Human
tagagctaggtgacatggcttatgaaagacagtttttgaaactgtggaaagtaatttttcaggagttttcagattgacatcataagtgctataagaggtttgctaagccctcagtcagcaagccctgtgaacggaaaggaccttacccaaggcaggtagaatgccatcgctaacactcaggtgaatctcccatgaagattagaaagatggcttactctcttatctgacagattgcatacagctgcaaagagaattagtatattggaaggtagatcttagaaaacaccacagagtgataaakctgtggaaatataaagctaagtttaaaaaacatgactggtgaatgaggaggtctaaatatatcttattgaagccccagtggaagtaaccggagaaaatataggaaagacaatggttaaataagcaattgccaagagttttctataactgaagacaagttcaattgaaaacagacactgactcatgaacagaataaattaattcaaatttatgaaatgaaatcattctgaatctggaaaacactaaaagtaaagaaacttttaaaagtcccaatggaaaaaaaaagacgtaacactgaaaa

SEQ ID NO: 105477 - DNA, 601 bp, Human
gcatacagctgcaaagagaattagtatattggaaggtagatcttagaaaacaccacagagtgataaagctgtggaaatataaagctaagtttaaaaaacatgactggtgaatgaggaggtctaaatatatcttattgaagccccagtggaagtaaccggagaaaatataggaaagacaatggttaaataagcaattgccaagagttttctataactgaagacaagttcaattgaaaacagacactgactcatgaacagaataaattaattcaaatttatgaaatgaaatcattctgaatckggaaaacactaaaagtaaagaaacttttaaaagtcccaatggaaaaaaaaagacgtaacactgaaaaaagctttgtagatacgtgttgaatgaactgttgaaagcaaagtggtggaaatttgtaccagaaaaacattgaaaccaaaagtggcataccaaagtcagtatcagacagataacttcgaactattataactcattctttgagttcttagatagaattaaatgtcatttctaaaaggtctgttttgttctttctcaaactcaccttttcaaaaatcatatgatattaactcattt

SEQ ID NO: 105478 - DNA, 601 bp, Human
gctaagtttaaaaaacatgactggtgaatgaggaggtctaaatatatcttattgaagccccagtggaagtaaccggagaaaatataggaaagacaatggttaaataagcaattgccaagagttttctataactgaagacaagttcaattgaaaacagacactgactcatgaacagaataaattaattcaaatttatgaaatgaaatcattctgaatctggaaaacactaaaagtaaagaaacttttaaaagtcccaatggaaaaaaaaagacgtaacactgaaaaaagctttgtagatacrtgttgaatgaactgttgaaagcaaagtggtggaaatttgtaccagaaaaacattgaaaccaaaagtggcataccaaagtcagtatcagacagataacttcgaactattataactcattctttgagttcttagatagaattaaatgtcatttctaaaaggtctgttttgttctttctcaaactcaccttttcaaaaatcatatgatattaactcattttgggcattatccttgcatttatcatctttgtgtctcagactcttgataatggcctacccaaactaggcatgacaataaatgtt

SEQ ID NO: 105479 - DNA, 601 bp, Human
tacgtgttgaatgaactgttgaaagcaaagtggtggaaatttgtaccagaaaaacattgaaaccaaaagtggcataccaaagtcagtatcagacagataacttcgaactattataactcattctttgagttcttagatagaattaaatgtcatttctaaaaggtctgttttgttctttctcaaactcaccttttcaaaaatcatatgatattaactcattttgggcattatccttgcatttatcatctttgtgtctcagactcttgataatggcctacccaaactaggcatgacaataaaygttggttgaaatgaagaatatcatgaagacactatgttcgattcactatattatatgctatgacaataatcacataatgtagaagacagattatctgtccttaaggtcattttgttttaaataacaaactggggatcatgaattcagaagcatatgaaagcagatatttacaccaaaacaagtatagtgcttcacatctggagccctatccattaaaggattgaaaactatacctgagagatgcattgaaaagcaatcaaaattaaatatagcatggccgggcgcggtggctcataccta

SEQ ID NO: 105480 - DNA, 601 bp, Human
tcaaaattaaatatagcatggccgggcgcggtggctcatacctataatcccagcactttgggaggctgaggtaggcagatcacgagatcaggagatcaagagcatcctggctaacatggtgaaacccagtctctattaaaaatataaaaaattagctggatgtggtggcacacacctgtaatcccagctactcaggaggctgaggcaggagaatcgcttgaacccgggaggtggaggttgtagtgagtcgtgattgtgccactgcactccagcctgggcaacaaagcgagactccatctcaaaaaaaaaaaaaaaaaatttgggaggccgaggcaggcggatcacgaggtcaggagatcgagaccatcctggctaacatggtgaaaccccgtctctactaaaaatacaaaaaattagctgggcgtggtggcgggtgcctgtagtcccagctactcaggaggctgaggcaggagaatgacggggacctggaaagcagaggttgcagtgagccgagatcgtgccactgcacttcagcctgggcaacacagtgagactccgtctcaaaaaaaaaaaaaaaattaaatatagcaccaacatactt

SEQ ID NO: 105481 - DNA, 601 bp, Human
atacctataatcccagcactttgggaggctgaggtaggcagatcacgagatcaggagatcaagagcatcctggctaacatggtgaaacccagtctctattaaaaatataaaaaattagctggatgtggtggcacacacctgtaatcccagctactcaggaggctgaggcaggagaatcgcttgaacccgggaggtggaggttgtagtgagtcgtgattgtgccactgcactccagcctgggcaacaaagcgagactccatctcaaaaaaaaaaaaaaaaaatttgggaggccgaggcaggyggatcacgaggtcaggagatcgagaccatcctggctaacatggtgaaaccccgtctctactaaaaatacaaaaaattagctgggcgtggtggcgggtgcctgtagtcccagctactcaggaggctgaggcaggagaatgacggggacctggaaagcagaggttgcagtgagccgagatcgtgccactgcacttcagcctgggcaacacagtgagactccgtctcaaaaaaaaaaaaaaaattaaatatagcaccaacatactttgaaggatggttagcaggagaaataatgtaaatttta

SEQ ID NO: 105482 - DNA, 601 bp, Human
tgggaggctgaggtaggcagatcacgagatcaggagatcaagagcatcctggctaacatggtgaaacccagtctctattaaaaatataaaaaattagctggatgtggtggcacacacctgtaatcccagctactcaggaggctgaggcaggagaatcgcttgaacccgggaggtggaggttgtagtgagtcgtgattgtgccactgcactccagcctgggcaacaaagcgagactccatctcaaaaaaaaaaaaaaaaaatttgggaggccgaggcaggcggatcacgaggtcaggagatsgagaccatcctggctaacatggtgaaaccccgtctctactaaaaatacaaaaaattagctgggcgtggtggcgggtgcctgtagtcccagctactcaggaggctgaggcaggagaatgacggggacctggaaagcagaggttgcagtgagccgagatcgtgccactgcacttcagcctgggcaacacagtgagactccgtctcaaaaaaaaaaaaaaaattaaatatagcaccaacatactttgaaggatggttagcaggagaaataatgtaaattttaatgacaaaatttgttttaatg

SEQ ID NO: 105483 - DNA, 601 bp, Human
gtgaaacccagtctctattaaaaatataaaaaattagctggatgtggtggcacacacctgtaatcccagctactcaggaggctgaggcaggagaatcgcttgaacccgggaggtggaggttgtagtgagtcgtgattgtgccactgcactccagcctgggcaacaaagcgagactccatctcaaaaaaaaaaaaaaaaaatttgggaggccgaggcaggcggatcacgaggtcaggagatcgagaccatcctggctaacatggtgaaaccccgtctctactaaaaatacaaaaaattagckgggcgtggtggcgggtgcctgtagtcccagctactcaggaggctgaggcaggagaatgacggggacctggaaagcagaggttgcagtgagccgagatcgtgccactgcacttcagcctgggcaacacagtgagactccgtctcaaaaaaaaaaaaaaaattaaatatagcaccaacatactttgaaggatggttagcaggagaaataatgtaaattttaatgacaaaatttgttttaatgaacaagtctatgaaaataaattttgttcatgatacattaaaaattagaattatttatctt

SEQ ID NO: 105484 - DNA, 601 bp, Human
gcaggcggatcacgaggtcaggagatcgagaccatcctggctaacatggtgaaaccccgtctctactaaaaatacaaaaaattagctgggcgtggtggcgggtgcctgtagtcccagctactcaggaggctgaggcaggagaatgacggggacctggaaagcagaggttgcagtgagccgagatcgtgccactgcacttcagcctgggcaacacagtgagactccgtctcaaaaaaaaaaaaaaaattaaatatagcaccaacatactttgaaggatggttagcaggagaaataatgtaawttttaatgacaaaatttgttttaatgaacaagtctatgaaaataaattttgttcatgatacattaaaaattagaattatttatcttggaatatagattttaagttctaatatacttatttcactaattatgttttgtaaagggtttataagaagaccacaaagtgctgtgtgttattccaatgcaatttcttgctgacatgaataccactaatgcagttgcctgacctccaagtgctgaagcattgatattcttctcaagcctaatttgagtaaatacctaaaggaagctggttaaacca

SEQ ID NO: 105485 - DNA, 601 bp, Human
gatcgtgccactgcacttcagcctgggcaacacagtgagactccgtctcaaaaaaaaaaaaaaaattaaatatagcaccaacatactttgaaggatggttagcaggagaaataatgtaaattttaatgacaaaatttgttttaatgaacaagtctatgaaaataaattttgttcatgatacattaaaaattagaattatttatcttggaatatagattttaagttctaatatacttatttcactaattatgttttgtaaagggtttataagaagaccacaaagtgctgtgtgttattccartgcaatttcttgctgacatgaataccactaatgcagttgcctgacctccaagtgctgaagcattgatattcttctcaagcctaatttgagtaaatacctaaaggaagctggttaaaccagatagcctctgaaagtctctcctggcaaaaatttaatatagtgtctaataaaaatgaaagccacttgtgagttgtgagaaatataaacaaatcaactttttagagaaatatttaaattgagtgtttcacctagtgatttaactcatgcttatctagagtaaaaggacttttttatgcaatg

SEQ ID NO: 105486 - DNA, 601 bp, Human
ggtcagtattttcttccagggatgtggggtccagcttcttactcaagctgtcagcagggcaggtgggcagatgtggggggactcaagagccaaagacagcacattccccaggctccccatttttgggcaagcctcaccagactgaaggagatcttgctgagtcttcttctgagtcctaaacaactaatcacactaaacgtactctgtttatgcacaggcttcaaattaactcattataaaaagttgaggaaattctgaagtaacactcaacctattttattgcttgttgtacgcttaaataaaaaatgtctgggttggccgggcgtggtggtgcatgcctgtaatcccagcactttgggaggccgaagcgagtggattacctgaggtcaggagttcaagaccagcctggccaacatggtgaaaccccgtctctactaaaaatacaaaaattagctgggtgtggtggcatgtgcctgtaatcccagctgcttgggagaccgaggcaggagactcacttgaaaccctggaggcggaggttgcagtgagctgagatcacgccactgcagtccagcctggcaacagagcaagaatctgtttcaaa

SEQ ID NO: 105487 - DNA, 601 bp, Human
gtctgtattgtattgataggagtttccttttgtaattaacattcatttctttgctgtctggctctgaatttcaggagcaaaatatgtatgtagcatttacgtttttcccttttccttaaacctcattgtgaactatagtgtgttggttttgtgtttttgctgtaatttttttcattagtcatctcgaaatagtgggaatattgtaatagtctttagtttgtggttgattgagtcaggattatttgctgattatttaattcagtttgtaaaatggtataaatcattttcttaatttcattawttcataaatatttaaatgacactcatttaaaaacttttttatttacagtggtaatcaagttacactttcattttttaaaaaccctatgctgatgtacagtaaaaacatcaatcctgaggaattcatattctattttaaacattcttatgttttaaagacagctacataattttgtattctttgataatattttgtgtacttttgaaaaaatgctaaatgtagaatgtcttaattttacaagatagctgcagtgagataaaaatattgcagagaacattgcaggcaggtcagtctgttgct

SEQ ID NO: 105488 - DNA, 601 bp, Human
agttacactttcattttttaaaaaccctatgctgatgtacagtaaaaacatcaatcctgaggaattcatattctattttaaacattcttatgttttaaagacagctacataattttgtattctttgataatattttgtgtacttttgaaaaaatgctaaatgtagaatgtcttaattttacaagatagctgcagtgagataaaaatattgcagagaacattgcaggcaggtcagtctgttgcttacatgcatctgaaggtgtgatatatgcacaggctctttcttttctttcttttctttcttttctttcttttctttctttcctttctttcctttctttctcttctttcccttcattcccttctttcccttctttctcctctttctctctttctttctttcctttttttttttttttttgagacggagtctcactctgttgcccaggctggagtgcagtggtgcaatcttggctcactgcaacctccacctctgcacaggctctttctgagagcaatgcttgaagtcattcattctgaaacaccttctattattcttcttcttcactttctatgcaactgtttctatcccactatagttc

SEQ ID NO: 105489 - DNA, 601 bp, Human
atgcatgtttttgcacatcatatacattttagtatctaaatgtaaaatactctaacattttttggagagtgaagcagtgttaaagtcctcaaattataaactatgggatttgccagagacaactgaatagagagccctgcatcagcctgctgtaggaccgtcagttatgcagaaggttaagagaggcagtgtcctgggtaggaggcccatggaagggcctgggagtgacgagaagcccagcacgtgctgaacaaggacagactttatctggaatgaatgatgtgcattatttatgaaataygggtgaattaattttgtaaacggtttgactgtaaagtgacaatatgtctactttatactcttgtcatgtagcatgtaaaacaactttgaggtattataaatttggattaaattaagttgtgccagcagctgagtccatttcactgatggagaagggcttcccacagagatcagcacagcctttccggccatcactgcagctgcccatcccctgccctttctagtgagatatggtcattgagcatggcatttgcttcagttaggaacctgttgctaattggtagcgagtattcaggattct

SEQ ID NO: 105490 - DNA, 601 bp, Human
catgttgtctcacattgcagaatttttttcttgtttaaggttgaataatattctacggtattgatatacattttctttattcatttgttgtctgtagacatttaggtttttttccacatcttgattgactactataaatagtgctacaatgaacatgaaagtgcagatatctcttccagttcctgatttccattcttttggataaacaacaaactatctgaaaaggaaattaggaaaacaatgccattttcaataacatcaaaaagaatgcaatatctagaaataaacttaactaagaagrttaaagacttatacagtgacaactataaaataactgatgaaaaaattaaagacacaaacaaatgagaagacctcccatgttcatcaattgcaagacttagtattaataaaatgtacattgtaccaaaagtgatctgtagattcagtgcaattcccatcaaaattccaatgttatattttttacagaaatagaaaacacaatccaaaaattcatgtggaaccacaaaagacctgaaacagccaaatcagtcttgagaaagaaaaacaacgctagaggcgtcatgcttcctgattttgaaat

SEQ ID NO: 105491 - DNA, 601 bp, Human
tccacatcttgattgactactataaatagtgctacaatgaacatgaaagtgcagatatctcttccagttcctgatttccattcttttggataaacaacaaactatctgaaaaggaaattaggaaaacaatgccattttcaataacatcaaaaagaatgcaatatctagaaataaacttaactaagaagattaaagacttatacagtgacaactataaaataactgatgaaaaaattaaagacacaaacaaatgagaagacctcccatgttcatcaattgcaagacttagtattaataaaaygtacattgtaccaaaagtgatctgtagattcagtgcaattcccatcaaaattccaatgttatattttttacagaaatagaaaacacaatccaaaaattcatgtggaaccacaaaagacctgaaacagccaaatcagtcttgagaaagaaaaacaacgctagaggcgtcatgcttcctgattttgaaatatatttcaaagctatcgtaatttaaacagtatggtactggcataaagaaaggcatatagaccactggaacagaatagagatcccagaaaaaaatccatgcatgtgtgatcaa

SEQ ID NO: 105492 - DNA, 601 bp, Human
ttaaagatttaaacataaggcctaaaactgtaaaacttctagaagaaaacatttggggaaaagcttcatgacatggatcttggcaatgatttcttgaatatcaaaagcacaggcaaccaaagcaaaaatagacaaatgggactacattatactaaaaagcctctctgcagcaaagaaaataatcagcagagtgaaaaggcaacccatgaaatgggagaagatatttgcaaactatataactgataaggggttaatttccaaaatatataaggaactcctataactcaagagcaaaaagacwaataacctgattaaaaatggacaaaacatcagaacagacatttctccaaagaagacatacaatggccaaagtgttcagcatcactaattatcagggaaacgcaaatcaaaaccactataagctactacctcacacctgtcaagatggctattatcaaaaaacaaaagacaacaaatactggcgagggtgtggtgaaattggaaccctcgtgcactgttgataagaatgcaaaatggtgcagccactatggaaaacagtatggaaattcctttaaaaattaaaaatcaaacttccttatga

SEQ ID NO: 105493 - DNA, 601 bp, Human
agaatatagggaaaaccataatttttcaaattaacaaagtttggcatggctttctctgctcagatcctcaacagtgtagcaatggcatctttattattttacatgtactgtcattgcaacacctcatcatactttaatgtttcactgtagaaaacagtaaaactaactacaaatgatatattcaaaaatgcccagataacattagacgagaaagccagtaaaacatcacaagatgaacgcataaggacaccaaagaatattaaaaatttaaaagagagaagactagagcaaaatgttgacraagagaataaatctgaattcagataaggctgagcctggttttatctgcccagctggggttagaaagagcccaaattactagtatctcacaaatccaattctactcttagaattaaaacttgatgtaagataaattttcacaatttccaggaaagacatctgttgaatataatatttaggacattgtaacaactgatgctgagtataaagattctaaaatattccgttagccatcataatagttaaatcagtcaggaacacggttattaaatcagtgtagtagagtaccttattatgcttt

SEQ ID NO: 105494 - DNA, 601 bp, Human
ttaagaatctttcatttagcaagaaagtaaacccttgctagacagcctttgtagatatttccttagataaatgttttgtcattaaacaattagtgattattcataggaagctgggaaaatgttattagatggcattttagtgacatttatttcagccttatattaacataatcatttgaaaaggatttttaaaacttaggaaagaatgcagatatgcaagtgaccacaggctgtctgtgaatgcacagtggtcatggagggttattaaaatatcacccttgtagtggtattttctgaaatyccatttgcattttatagactctcaacactgtaaaataggctttgtgttagatgattttgcccaactgtaggttgatgtaagggttctgagcatatttaaggtgggctaaaccaagctatgcattagatgggtgaggtgtattaaatgcattttcagctctcttcataaatcaaaaagcatctatattgtttaactgctgtgttttgtcattaagcagttagtgatcattcattggaaatttgttacacagaaatagaaaactagtacaatgttactacactatgtgaagtgtttaatttc

SEQ ID NO: 105495 - DNA, 601 bp, Human
ttaaacaattagtgattattcataggaagctgggaaaatgttattagatggcattttagtgacatttatttcagccttatattaacataatcatttgaaaaggatttttaaaacttaggaaagaatgcagatatgcaagtgaccacaggctgtctgtgaatgcacagtggtcatggagggttattaaaatatcacccttgtagtggtattttctgaaatcccatttgcattttatagactctcaacactgtaaaataggctttgtgttagatgattttgcccaactgtaggttgatgtaasggttctgagcatatttaaggtgggctaaaccaagctatgcattagatgggtgaggtgtattaaatgcattttcagctctcttcataaatcaaaaagcatctatattgtttaactgctgtgttttgtcattaagcagttagtgatcattcattggaaatttgttacacagaaatagaaaactagtacaatgttactacactatgtgaagtgtttaatttctcttgctggatattgacaaaaacaaagcaaagagaaaaactctaaaattacctaaataaacgtacctgatgacccatactc

SEQ ID NO: 105496 - DNA, 601 bp, Human
tctcttcataaatcaaaaagcatctatattgtttaactgctgtgttttgtcattaagcagttagtgatcattcattggaaatttgttacacagaaatagaaaactagtacaatgttactacactatgtgaagtgtttaatttctcttgctggatattgacaaaaacaaagcaaagagaaaaactctaaaattacctaaataaacgtacctgatgacccatactcttgaccatttattaacagagaaatggttagcttttaatcttttattactggatattgatatatattttaaataactmgggaagcagcaataagataacatttagcctaatctaatcatgtatgttttaaccacttcctactgggaaattatttgtttatgaagtaaattattcttttttgaaatattttgaaatgaaattattttttcattttaacagcaaaaatgttctttgatgcattaatatgagtgatcattttagctcatcataattgaggaaatcagtgtatatattgatgtagtatttattgtgaaaaaagattgtgtttaaaagactgtcttttttatttttgtgacttaccatttagtatataataga

SEQ ID NO: 105497 - DNA, 601 bp, Human
cttgcagtgagccgagatcatgccattgcactccagcctgggcgacagagcaagaccccgtctcaaaaaataaaaaataaatagatttcacaatccattcatgcctgctaactcagtttatcctcataatgatcccatgagtttgagattgacaggcatcagctttatgtatcgttatttcagtgatttcaaagctaagtgtatcttagcagatatcaggatccatgaagatcaggaaaaccaactcagaaggtggtacgatgaaggcagtacacagacttgttgtccttgaaccatgtcygaaaaaagtccttttggggtttcatgggacccaataaatacaaatttttccccatccaaattcaaacccaactgaaaggaacaaaaagaaatctggtagggatagcttaaaataccatctgtattactgataaaaagctgattggagggtactggcttggatttggccaaacgtcttgcaccccagaattagaaagatgacccatcaagtcacaggcagcatggaaaattgccgatgcctgctgcgaggcaaggacttgatattgtgacattcttcctggtgggattgcctatacccaca

SEQ ID NO: 105498 - DNA, 601 bp, Human
tgcagtgagccgagatcatgccattgcactccagcctgggcgacagagcaagaccccgtctcaaaaaataaaaaataaatagatttcacaatccattcatgcctgctaactcagtttatcctcataatgatcccatgagtttgagattgacaggcatcagctttatgtatcgttatttcagtgatttcaaagctaagtgtatcttagcagatatcaggatccatgaagatcaggaaaaccaactcagaaggtggtacgatgaaggcagtacacagacttgttgtccttgaaccatgtccgaaaaaagtccttttggggtttcatgggacccaataaatacaaatttttccccatccaaattcaaacccaactgaaaggaacaaaaagaaatctggtagggatagcttaaaataccatctgtattactgataaaaagctgattggagggtactggcttggatttggccaaacgtcttgcaccccagaattagaaagatgacccatcaagtcacaggcagcatggaaaattgccgatgcctgctgcgaggcaaggacttgatattgtgacattcttcctggtgggattgcctatacccacagc

SEQ ID NO: 105499 - DNA, 601 bp, Human
cccatccaaattcaaacccaactgaaaggaacaaaaagaaatctggtagggatagcttaaaataccatctgtattactgataaaaagctgattggagggtactggcttggatttggccaaacgtcttgcaccccagaattagaaagatgacccatcaagtcacaggcagcatggaaaattgccgatgcctgctgcgaggcaaggacttgatattgtgacattcttcctggtgggattgcctatacccacagcagaccagaaatccgtgggtaagtagatccctggggaaggaggagaggasccagaagcctgtgcttctcctaactttccagccacacacatcactctcctgcggtgcagagaagggcagagtgtttctctcaggaaaggtccctcctgcatccaccacttaagtaatctcatgttgatttttcagtctgccagagtgaggatataagtcagaaaccggggagagggggtagaaaagtggagaggagagcttgaccccccctttcaccatagagaccaagtgattaatcattattcccacttacctgcacatcacttctggctgtttcaaagttctgcctgtgggaattgg

SEQ ID NO: 105500 - DNA, 601 bp, Human
aagtaatctcatgttgatttttcagtctgccagagtgaggatataagtcagaaaccggggagagggggtagaaaagtggagaggagagcttgaccccccctttcaccatagagaccaagtgattaatcattattcccacttacctgcacatcacttctggctgtttcaaagttctgcctgtgggaattgggaagacgaaatgccttcactgtatttatctgattttacttattattgaaaatccatgagtggatccattcctattgcactgaaaaacaaaagaaacaccagcttcttgacygcaggctgggcacagttacctctgcagtcttgttctaaactgccctcctgttgctcattggctttcaatcctgcagacagttctctcttgcttcagtgttttggtatatgctcttctctctatctagagcatccactccaacccaggcacacacgtacagtcacatcattatggtttggatctgtgtccccacccaatctcctgttgaattgtaatacctagtgttgaggtgcagcctggtgggaggtgattggatcatgggggcaggtccttcatgaatggcttggcaccatccccttg

SEQ ID NO: 105501 - DNA, 601 bp, Human
cttgatcacctctggtctaagacaggatcctcctacattctcttttgtaagactcggacttatttttcccagcatagcacaccacaattttctggttgttaaatgtctgctaaccccgtaggatcatgtcagttgagcctggtagcataaaacttatgctctgtaagtatttcttgagttgataaataagagattaaatgaccaagggatgtattctttttatttcaatatagttgttgttatatgattttagcaaatgagtatagaaagaggcaaagtaacctagaaaaagcacagatgyttaaaaattagtagaagaataactgaacccctcaaaggcaaattagacaggatgtgaaagcatgggcatgatatgagggagtgagaagagaggctccagttaacttgggaaggctcttagaaatggatactgctaagctgcttcccaagagaggctggtggattgggtctggggaggggctccagctaagtccgtgttgcagagcaggtttggtttgcagacactgcaaactttagggtcatctaaagtttaaattacactcagggaatacagcatgagtagcaggagtccttgactcgg

SEQ ID NO: 105502 - DNA, 601 bp, Human
accacaattttctggttgttaaatgtctgctaaccccgtaggatcatgtcagttgagcctggtagcataaaacttatgctctgtaagtatttcttgagttgataaataagagattaaatgaccaagggatgtattctttttatttcaatatagttgttgttatatgattttagcaaatgagtatagaaagaggcaaagtaacctagaaaaagcacagatgcttaaaaattagtagaagaataactgaacccctcaaaggcaaattagacaggatgtgaaagcatgggcatgatatgagggmgtgagaagagaggctccagttaacttgggaaggctcttagaaatggatactgctaagctgcttcccaagagaggctggtggattgggtctggggaggggctccagctaagtccgtgttgcagagcaggtttggtttgcagacactgcaaactttagggtcatctaaagtttaaattacactcagggaatacagcatgagtagcaggagtccttgactcggatttcacattctttcccatattatctcctttgtaatgttttttgctgacagtgttgatgtgatatagatagaggcattcc

SEQ ID NO: 105503 - DNA, 601 bp, Human
ttctcaggaaagggccttcagacctctcaaagtatcaaagaactgaaacttaccaggtcaccacatccagacaataaaatgcctgaccccacgttcatcatggttgcttccttgtcccatcctagttcctgttttcctacacattgttaaatttcttccctgctataaaaacccctagttttagttgatcagagagattaatttgagactgagctcccatctcccagactgcagcacccaattaaagccttcttccttgtcacttcagtcattggctttctgtgcagcaaacagcaggacytaaaccaaacccctgctgtttcagtaacatctccccagggaaagcaatatgtgggaaggaagagcagtgcagtattatctggcacataaacaaaggaagacacatcaacttctttgctctgcctatttgacattcttggtggctccatttagaaacattttaccactggtcttccaactgcctttctctgcactgtgctggtggcagagatgtgtctggtgcccagaccaaccctatcccctgctgttctcctccatccctgccttaatgatgcccggctcacactgccatttgattttc

SEQ ID NO: 105504 - DNA, 601 bp, Human
aacaaaggaagacacatcaacttctttgctctgcctatttgacattcttggtggctccatttagaaacattttaccactggtcttccaactgcctttctctgcactgtgctggtggcagagatgtgtctggtgcccagaccaaccctatcccctgctgttctcctccatccctgccttaatgatgcccggctcacactgccatttgattttcagcagtgtgatattgatgccttaaaccacctgcatctccatcccatttgtttttcaaatgaatggaactatgattaaaagaaaaatacracgctgtagcatttttaaccagtaccctggcattttctcaaattatttatgtctttctaaaaggtattatatcagtgctttccagtccaaaaatcattagaagacaagatattattaggactgagtttggaggaggaagataaacctaaagctattccaagtacagaggaatttcattatcatggacatcagtgatacaaatcccattattatcggtgtctaaagatacaaatagcactatagttttaatttttatcccagggatatgccttcaattttctcttttattataatttttat

SEQ ID NO: 105505 - DNA, 601 bp, Human
tgtgattctcccatagcacacacacactcagagaacaagaaccattagtgattacttattttaattaaatgctcagtttaagcctggcacaaaattatgaaatcctttggcgaaagttattctttatttctatttttagtataacatgaaaaagtacctgctaccctgttaaacttctcattataaaaataatgtgaaaagttacactcagacaaaaaccaccaccccattggtacaatatggaaatagggatcccagcatggatgatttagtaggtgttaatagagtaagctgagagttaaaaaaaaaaaaactaaaacaaagacatattttgtggatagtagccatcatcatatagcaataagatgtaggctatacataacggccaaatgtggaagaccaatttgagatgttcagtagcttacaagactatgtgcacaaaatgtgaaataacagaatttcaaagatgacagtactcagaaaacgagatatgtaaaagaggataattatctaccttttcttagcaatgaaacatattagaatcttgaacatgtttctccagagtaatctctccatgacagaattatcatggacattccac

SEQ ID NO: 105506 - DNA, 601 bp, Human
ttataaaaataatgtgaaaagttacactcagacaaaaaccaccaccccattggtacaatatggaaatagggatcccagcatggatgatttagtaggtgttaatagagtaagctgagagttaaaaaaaaaaaaactaaaacaaagacatattttgtggatagtagccatcatcatatagcaataagatgtaggctatacataacggccaaatgtggaagaccaatttgagatgttcagtagcttacaagactatgtgcacaaaatgtgaaataacagaatttcaaagatgacagtactcagaaaacgagatatgtaaaagaggataattatctaccttttcttagcaatgaaacatattagaatcttgaacatgtttctccagagtaatctctccatgacagaattatcatggacattccactaaatacctaaaactctctcaagatgcacccttccagcttgacctagtgcaaatctcacgtcttctgagaggcattctccaaattctccaatactctttattcaagtcccattcagaacccctgaatttgtctatactacgggtgtatctatttatgtcagaggaattcaggggccaata

SEQ ID NO: 105507 - DNA, 601 bp, Human
aactttcacaggtgtatgtgtatatgaagttagcaatgaccaagaaggaatgacacaaatttattactagattgataacaaaaaattactgaagggtttgcagacaggttgatggatccaatataactgtaaaaatttattagtctattattttgttaacagaatatgatatttaatggaccatgatattccctcacaaatttttccatctctttgcaaatgcacttgagtaaactgttgtataaaatatgtattttcttaaagttgttgctttccaaaatttgctgagaggtatatatayattgttgtctaacattgacttttctttgtatgtaaaatgtccaggttagtagcaaaagcatcagtacagttgatgatacaactgtaatatagttctctgttgttaattacataaaatgatgtggactaattgattgattgtacacttacgccagtcatcctgacactcttaatttaatcttaaagtatattctgtttgattatctggtctgggttccaccacactgttcataatatattgagaagcacattcagctatgtggaaatgtgtttttaattcctgggtagtcataaatgacaa

SEQ ID NO: 105508 - DNA, 601 bp, Human
ttttccatctctttgcaaatgcacttgagtaaactgttgtataaaatatgtattttcttaaagttgttgctttccaaaatttgctgagaggtatatatacattgttgtctaacattgacttttctttgtatgtaaaatgtccaggttagtagcaaaagcatcagtacagttgatgatacaactgtaatatagttctctgttgttaattacataaaatgatgtggactaattgattgattgtacacttacgccagtcatcctgacactcttaatttaatcttaaagtatattctgtttgatyatctggtctgggttccaccacactgttcataatatattgagaagcacattcagctatgtggaaatgtgtttttaattcctgggtagtcataaatgacaattataatgatgagcatgatgataatgatgatgataacctttgtgtggtgtgttagaatgtgggaagtaccaccactccgggtatataaatactctttacaatgcctccttttccaaattaagagactactgttccaaatatttcatatgaggagaggttctaatttgatttttatcctcaaatagtttcctgaacacagtt

SEQ ID NO: 105509 - DNA, 601 bp, Human
tcagtacagttgatgatacaactgtaatatagttctctgttgttaattacataaaatgatgtggactaattgattgattgtacacttacgccagtcatcctgacactcttaatttaatcttaaagtatattctgtttgattatctggtctgggttccaccacactgttcataatatattgagaagcacattcagctatgtggaaatgtgtttttaattcctgggtagtcataaatgacaattataatgatgagcatgatgataatgatgatgataacctttgtgtggtgtgttagaatgtgggaagtaccaccactccgggtatataaatactctttacaatgcctccttttccaaattaagagactactgttccaaatatttcatatgaggagaggttctaatttgatttttatcctcaaatagtttcctgaacacagtttattgaataactatgtttcctattagttattatgcatttgttatcatactataagctcttatgaatagagactgtttcagagctacatgttgtatctacctttctgttgcctcttttgctagtgttttagaacccaacatttccaattataataaattta

SEQ ID NO: 105510 - DNA, 601 bp, Human
tataataaatttatcattgttttcatatatatatgccagtcccccgattaatttttgcctttacagtctattatgaaaattttcaaatgcatattttaaaaacacgaattcttcatgaagttgtgtgtcatccttataaggcgccacgtcaatcttttctgattttccagttgtatcatctgtactgctaaatgaacataacatctgagaattcctgagtcttttctgtcccgtgattctcttcttgtgtctggagttgttgtcctatggtagctgctctcctgcatcttttaatcagctstactttacaagacatgaaagtaggcttgtctatttttattatttttactagcatctagtatactgctaccatgtaataggtactcaacaaatacaggtacacttcaactgaaatgtcagaaattaaatgcttttactgagatcgcacaaccagaaaatgagagttaggatttatatccattccatttgattcaaaaatcaaccctactcaatggccctatatgagatgtcataaatggtggtagtgagaataagtagctgatgagtatacttccctaacatgatacaaaatatttacaac

SEQ ID NO: 105511 - DNA, 601 bp, Human
attcttcatgaagttgtgtgtcatccttataaggcgccacgtcaatcttttctgattttccagttgtatcatctgtactgctaaatgaacataacatctgagaattcctgagtcttttctgtcccgtgattctcttcttgtgtctggagttgttgtcctatggtagctgctctcctgcatcttttaatcagctgtactttacaagacatgaaagtaggcttgtctatttttattatttttactagcatctagtatactgctaccatgtaataggtactcaacaaatacaggtacacttcarctgaaatgtcagaaattaaatgcttttactgagatcgcacaaccagaaaatgagagttaggatttatatccattccatttgattcaaaaatcaaccctactcaatggccctatatgagatgtcataaatggtggtagtgagaataagtagctgatgagtatacttccctaacatgatacaaaatatttacaacaaaccagcagccaagaacatactaccagaagcccacaggcattcccactgaagccaagaacaagaaaagtatgtctgatatcactactgtaatttggcatttttctg

SEQ ID NO: 105512 - DNA, 601 bp, Human
agaattcctgagtcttttctgtcccgtgattctcttcttgtgtctggagttgttgtcctatggtagctgctctcctgcatcttttaatcagctgtactttacaagacatgaaagtaggcttgtctatttttattatttttactagcatctagtatactgctaccatgtaataggtactcaacaaatacaggtacacttcaactgaaatgtcagaaattaaatgcttttactgagatcgcacaaccagaaaatgagagttaggatttatatccattccatttgattcaaaaatcaaccctaytcaatggccctatatgagatgtcataaatggtggtagtgagaataagtagctgatgagtatacttccctaacatgatacaaaatatttacaacaaaccagcagccaagaacatactaccagaagcccacaggcattcccactgaagccaagaacaagaaaagtatgtctgatatcactactgtaatttggcatttttctgaaagtttgacaaatgcaacaacagagttaaataaggaatagaagtagattaatggaagatgatttgagaaaaaaacttgcaagtaattttagtgttacct

SEQ ID NO: 105513 - DNA, 601 bp, Human
gcaagtgggatttcaggggattttgtttatttatagctgcggtagtattaaaggaatttttcttcctctagaagaggaggatattttttaggtttattttattttgcatagcagggtgactatagtaataacatattgtatattttaaaatagctgagaggattttaaatgttctcacaacaaagaaataaatattttagataatggatatgttcattaatctgatttgatcattttataatgtatacatgatgtatcaccatatccctttaaaccccataaacatacacaattattattwtttttttttgagatggagtctggctctgtctgataactaacttttactgaaactaggtttacatttcttttccttttttttttttttttttttttgagacggagtctcgctctgtcgcccaggctggatggagtgcagtggcgccatctcggctcactgcaagctccgccttctgggttcacgccattctcctgcctcagcctcccaagtagtgggactgcaaggtgcctgccaccacgcccggtcaattttttttttctgtatttttagtagagacatggtttcaccatgttagccagg

SEQ ID NO: 105514 - DNA, 601 bp, Human
atttcaggggattttgtttatttatagctgcggtagtattaaaggaatttttcttcctctagaagaggaggatattttttaggtttattttattttgcatagcagggtgactatagtaataacatattgtatattttaaaatagctgagaggattttaaatgttctcacaacaaagaaataaatattttagataatggatatgttcattaatctgatttgatcattttataatgtatacatgatgtatcaccatatccctttaaaccccataaacatacacaattattattttttttttttgagatggagtctggctctgtctgataactaacttttactgaaactaggtttacatttcttttccttttttttttttttttttttttgagacggagtctcgctctgtcgcccaggctggatggagtgcagtggcgccatctcggctcactgcaagctccgccttctgggttcacgccattctcctgcctcagcctcccaagtagtgggactgcaaggtgcctgccaccacgcccggtcaattttttttttctgtatttttagtagagacatggtttcaccatgttagccaggatggtccgg

SEQ ID NO: 105515 - DNA, 601 bp, Human
atggtccggatctcctgacctcgtgatctgcccacctcggcctcccaaagtgctgcaattacagggctgagctaccgcgccaggccaatatttaccaattaaaaataaaagaatatggctgggcgcagtggctcacgtctgtaatcccagcactttgggaggccgaggcaggcagatcacctgaggtcgggagtttgagaccagcctgatcaacatggagaaacccgtctctactaaaaatacagaattagccgggcgtgtggtgcatgcctgtaatcccagctacttgagaggttaaggmaggagaattgcctgagccagggaggaggaggttgcgatgagccgaaatcgcaccattgcgctccagcctgggcaacgagcgaaactccatcccaaaataaataagtaaataaacaaaaaaataaacacaggaatatatttttgactttttctgagagtcaattagaagatatcattcagttgaaattaaattattctctatagtgacattctgggaaatagcaatttcattaaatgaaatataagctcaataaataaattgacaaatttatttctgtgcatatttctagagtcacaaatt

SEQ ID NO: 105516 - DNA, 601 bp, Human
ctcctgacctcgtgatctgcccacctcggcctcccaaagtgctgcaattacagggctgagctaccgcgccaggccaatatttaccaattaaaaataaaagaatatggctgggcgcagtggctcacgtctgtaatcccagcactttgggaggccgaggcaggcagatcacctgaggtcgggagtttgagaccagcctgatcaacatggagaaacccgtctctactaaaaatacagaattagccgggcgtgtggtgcatgcctgtaatcccagctacttgagaggttaaggaaggagaattgmctgagccagggaggaggaggttgcgatgagccgaaatcgcaccattgcgctccagcctgggcaacgagcgaaactccatcccaaaataaataagtaaataaacaaaaaaataaacacaggaatatatttttgactttttctgagagtcaattagaagatatcattcagttgaaattaaattattctctatagtgacattctgggaaatagcaatttcattaaatgaaatataagctcaataaataaattgacaaatttatttctgtgcatatttctagagtcacaaattcccactcctca

SEQ ID NO: 105517 - DNA, 601 bp, Human
agtggctcacgtctgtaatcccagcactttgggaggccgaggcaggcagatcacctgaggtcgggagtttgagaccagcctgatcaacatggagaaacccgtctctactaaaaatacagaattagccgggcgtgtggtgcatgcctgtaatcccagctacttgagaggttaaggaaggagaattgcctgagccagggaggaggaggttgcgatgagccgaaatcgcaccattgcgctccagcctgggcaacgagcgaaactccatcccaaaataaataagtaaataaacaaaaaaataaayacaggaatatatttttgactttttctgagagtcaattagaagatatcattcagttgaaattaaattattctctatagtgacattctgggaaatagcaatttcattaaatgaaatataagctcaataaataaattgacaaatttatttctgtgcatatttctagagtcacaaattcccactcctcacaatttagatgatcaactccaccaatctttaccctttcttatgcttaaccaacaagaaaattcatgtccagtcttctgcatgattcagaataaacaaaaggtcaaaatctcacaa

SEQ ID NO: 105518 - DNA, 601 bp, Human
gctcacgtctgtaatcccagcactttgggaggccgaggcaggcagatcacctgaggtcgggagtttgagaccagcctgatcaacatggagaaacccgtctctactaaaaatacagaattagccgggcgtgtggtgcatgcctgtaatcccagctacttgagaggttaaggaaggagaattgcctgagccagggaggaggaggttgcgatgagccgaaatcgcaccattgcgctccagcctgggcaacgagcgaaactccatcccaaaataaataagtaaataaacaaaaaaataaacacargaatatatttttgactttttctgagagtcaattagaagatatcattcagttgaaattaaattattctctatagtgacattctgggaaatagcaatttcattaaatgaaatataagctcaataaataaattgacaaatttatttctgtgcatatttctagagtcacaaattcccactcctcacaatttagatgatcaactccaccaatctttaccctttcttatgcttaaccaacaagaaaattcatgtccagtcttctgcatgattcagaataaacaaaaggtcaaaatctcacaaaata

SEQ ID NO: 105519 - DNA, 601 bp, Human
cgaaatcgcaccattgcgctccagcctgggcaacgagcgaaactccatcccaaaataaataagtaaataaacaaaaaaataaacacaggaatatatttttgactttttctgagagtcaattagaagatatcattcagttgaaattaaattattctctatagtgacattctgggaaatagcaatttcattaaatgaaatataagctcaataaataaattgacaaatttatttctgtgcatatttctagagtcacaaattcccactcctcacaatttagatgatcaactccaccaatctttaycctttcttatgcttaaccaacaagaaaattcatgtccagtcttctgcatgattcagaataaacaaaaggtcaaaatctcacaaaatattgaaattgctatggaaaggggagtgagttagtctctttgtgagtattagaagatagataagccaaatcaatcactgactattttcagaatccatctttatagaaaatatgctttaaccttcccgctaaatcctaggaattccctgtctgcatatatgagcaaccaggatcactgtaacattgagaggaaattttataaaaatcgtatcattg

SEQ ID NO: 105520 - DNA, 601 bp, Human
ccatcccaaaataaataagtaaataaacaaaaaaataaacacaggaatatatttttgactttttctgagagtcaattagaagatatcattcagttgaaattaaattattctctatagtgacattctgggaaatagcaatttcattaaatgaaatataagctcaataaataaattgacaaatttatttctgtgcatatttctagagtcacaaattcccactcctcacaatttagatgatcaactccaccaatctttaccctttcttatgcttaaccaacaagaaaattcatgtccagtcttytgcatgattcagaataaacaaaaggtcaaaatctcacaaaatattgaaattgctatggaaaggggagtgagttagtctctttgtgagtattagaagatagataagccaaatcaatcactgactattttcagaatccatctttatagaaaatatgctttaaccttcccgctaaatcctaggaattccctgtctgcatatatgagcaaccaggatcactgtaacattgagaggaaattttataaaaatcgtatcattgaaggagaaaattatgttattcatctacagcaatgttttaggatg

SEQ ID NO: 105521 - DNA, 601 bp, Human
tcccaaaataaataagtaaataaacaaaaaaataaacacaggaatatatttttgactttttctgagagtcaattagaagatatcattcagttgaaattaaattattctctatagtgacattctgggaaatagcaatttcattaaatgaaatataagctcaataaataaattgacaaatttatttctgtgcatatttctagagtcacaaattcccactcctcacaatttagatgatcaactccaccaatctttaccctttcttatgcttaaccaacaagaaaattcatgtccagtcttctgmatgattcagaataaacaaaaggtcaaaatctcacaaaatattgaaattgctatggaaaggggagtgagttagtctctttgtgagtattagaagatagataagccaaatcaatcactgactattttcagaatccatctttatagaaaatatgctttaaccttcccgctaaatcctaggaattccctgtctgcatatatgagcaaccaggatcactgtaacattgagaggaaattttataaaaatcgtatcattgaaggagaaaattatgttattcatctacagcaatgttttaggatgtag

SEQ ID NO: 105522 - DNA, 601 bp, Human
ttcccactcctcacaatttagatgatcaactccaccaatctttaccctttcttatgcttaaccaacaagaaaattcatgtccagtcttctgcatgattcagaataaacaaaaggtcaaaatctcacaaaatattgaaattgctatggaaaggggagtgagttagtctctttgtgagtattagaagatagataagccaaatcaatcactgactattttcagaatccatctttatagaaaatatgctttaaccttcccgctaaatcctaggaattccctgtctgcatatatgagcaaccaggrtcactgtaacattgagaggaaattttataaaaatcgtatcattgaaggagaaaattatgttattcatctacagcaatgttttaggatgtagtcagatttaaaatgtgtaagcattcatgcatgcaatcattattccttttacaaggaaaagaattttataaactgcaacttaggtctgatgcctaaaattgttactaacatcctagcaagaaatgaaagtttagaaaactaccagaagtgactaaaaacacgaaaccctgaagtaagaaaagaatagttgttaggataattaaagataaa

SEQ ID NO: 105523 - DNA, 601 bp, Human
gtagtcagatttaaaatgtgtaagcattcatgcatgcaatcattattccttttacaaggaaaagaattttataaactgcaacttaggtctgatgcctaaaattgttactaacatcctagcaagaaatgaaagtttagaaaactaccagaagtgactaaaaacacgaaaccctgaagtaagaaaagaatagttgttaggataattaaagataaagaaaatgggtttgatataattatatgttacctaggaattgttggtgtgaagttatgaaagcacaagttaaaagtttttttgaattagractatataacacaaactaaaatgcagagtcacttactatacactatttatcatcttaggcctgtgaattctgaagcaatgccaattattaacctattaattttaaaaaatatatactgagcacctaatataagcactgtgctgtctatggtggatcttagagctgccagggccattcagtcattgaacacagttttcttaggttctatgatgtataaggcacagtgctaagcgctacaaatacaaatactatttacaaagcccattgtggaatagaagtttacatacatgtggcacaatg

SEQ ID NO: 105524 - DNA, 601 bp, Human
gttactaacatcctagcaagaaatgaaagtttagaaaactaccagaagtgactaaaaacacgaaaccctgaagtaagaaaagaatagttgttaggataattaaagataaagaaaatgggtttgatataattatatgttacctaggaattgttggtgtgaagttatgaaagcacaagttaaaagtttttttgaattagaactatataacacaaactaaaatgcagagtcacttactatacactatttatcatcttaggcctgtgaattctgaagcaatgccaattattaacctattaatttwaaaaaatatatactgagcacctaatataagcactgtgctgtctatggtggatcttagagctgccagggccattcagtcattgaacacagttttcttaggttctatgatgtataaggcacagtgctaagcgctacaaatacaaatactatttacaaagcccattgtggaatagaagtttacatacatgtggcacaatgtggtgaggcttatatgagagataggctcaaacctttgtagggatcctatgagggactcaaaatggtttaaggaggttaggaaaggctgcacacaggacttaga

SEQ ID NO: 105525 - DNA, 601 bp, Human
acctaggaattgttggtgtgaagttatgaaagcacaagttaaaagtttttttgaattagaactatataacacaaactaaaatgcagagtcacttactatacactatttatcatcttaggcctgtgaattctgaagcaatgccaattattaacctattaattttaaaaaatatatactgagcacctaatataagcactgtgctgtctatggtggatcttagagctgccagggccattcagtcattgaacacagttttcttaggttctatgatgtataaggcacagtgctaagcgctacaaayacaaatactatttacaaagcccattgtggaatagaagtttacatacatgtggcacaatgtggtgaggcttatatgagagataggctcaaacctttgtagggatcctatgagggactcaaaatggtttaaggaggttaggaaaggctgcacacaggacttagatgatttgaggatgctgtatacagaaaacaagaggttgctgagtgagaagtttcctgtggctaaaagagttcaacaaaggacaggggaacctgtggaaatagtcagggaccagatgtaagaactatgtatgccctagta

SEQ ID NO: 105526 - DNA, 601 bp, Human
ttttttgaattagaactatataacacaaactaaaatgcagagtcacttactatacactatttatcatcttaggcctgtgaattctgaagcaatgccaattattaacctattaattttaaaaaatatatactgagcacctaatataagcactgtgctgtctatggtggatcttagagctgccagggccattcagtcattgaacacagttttcttaggttctatgatgtataaggcacagtgctaagcgctacaaatacaaatactatttacaaagcccattgtggaatagaagtttacatayatgtggcacaatgtggtgaggcttatatgagagataggctcaaacctttgtagggatcctatgagggactcaaaatggtttaaggaggttaggaaaggctgcacacaggacttagatgatttgaggatgctgtatacagaaaacaagaggttgctgagtgagaagtttcctgtggctaaaagagttcaacaaaggacaggggaacctgtggaaatagtcagggaccagatgtaagaactatgtatgccctagtacccattcatatattatcctgtgcactgactgaaagccatcggagac

SEQ ID NO: 105527 - DNA, 601 bp, Human
tcaaaatggtttaaggaggttaggaaaggctgcacacaggacttagatgatttgaggatgctgtatacagaaaacaagaggttgctgagtgagaagtttcctgtggctaaaagagttcaacaaaggacaggggaacctgtggaaatagtcagggaccagatgtaagaactatgtatgccctagtacccattcatatattatcctgtgcactgactgaaagccatcggagacttttaaagagggaaataacttgttcgattagttttcagggaaatgatttagggagcactaaggagggatygctgatgtggaaggtgataagtttgagtatctatcatgtattaagtgttgttaaattaagtttagcctaaatctgcctccttgtagttttggcctagatgtttccccatatatcagatttttggatactctttcttatgaagggccgtcgattgtctatctgttgtcttatatttttgaaggagtatgctatatattcagaatgctagtcttaggtacacgtattgcaacatcttcttccactctgtggattgtctcattactctattaaatgtgtcctttgacaaagtgatgttcttaa

SEQ ID NO: 105528 - DNA, 601 bp, Human
tggtttaaggaggttaggaaaggctgcacacaggacttagatgatttgaggatgctgtatacagaaaacaagaggttgctgagtgagaagtttcctgtggctaaaagagttcaacaaaggacaggggaacctgtggaaatagtcagggaccagatgtaagaactatgtatgccctagtacccattcatatattatcctgtgcactgactgaaagccatcggagacttttaaagagggaaataacttgttcgattagttttcagggaaatgatttagggagcactaaggagggatcgctgawgtggaaggtgataagtttgagtatctatcatgtattaagtgttgttaaattaagtttagcctaaatctgcctccttgtagttttggcctagatgtttccccatatatcagatttttggatactctttcttatgaagggccgtcgattgtctatctgttgtcttatatttttgaaggagtatgctatatattcagaatgctagtcttaggtacacgtattgcaacatcttcttccactctgtggattgtctcattactctattaaatgtgtcctttgacaaagtgatgttcttaaaatggt

SEQ ID NO: 105529 - DNA, 601 bp, Human
aggtggaggctgcagtgggctgagatcatgccactgcactccagcctgggtgacagagcaacagtctgtttctaaataaatagaaagaaaagcatttcttatactttgaaacttccatgggcattttttatattattatctcttttttaaaaggtatatgttcttcctattttttatgactaactccttattcagaatgggcttctcaacattttgggggcccagaataagagtacaaataggctgggcacagtggctcacgcctgtaatcccagcactttgggaggccaaggtgggcagrtcacgaggtcaggagatcgagaccatcctggctaacacggtgaaaccctgtctctattaaaaatacaaaaaactagcggggtgtggtggcgggcgcctgtagttccagctactctggaggctgaggcaggagaatggcatgaacctggaaggcggagcttgcagtgagctgagatcatgccactgactccagcctgggcgacagagtcagactctgtcacaaaaaaaaaaaaaaaaaaaaaagagtacaaatagaggcccatattttatgcccctacattctccacctatagatgaaata

SEQ ID NO: 105530 - DNA, 601 bp, Human
gctgagatcatgccactgcactccagcctgggtgacagagcaacagtctgtttctaaataaatagaaagaaaagcatttcttatactttgaaacttccatgggcattttttatattattatctcttttttaaaaggtatatgttcttcctattttttatgactaactccttattcagaatgggcttctcaacattttgggggcccagaataagagtacaaataggctgggcacagtggctcacgcctgtaatcccagcactttgggaggccaaggtgggcagatcacgaggtcaggagatygagaccatcctggctaacacggtgaaaccctgtctctattaaaaatacaaaaaactagcggggtgtggtggcgggcgcctgtagttccagctactctggaggctgaggcaggagaatggcatgaacctggaaggcggagcttgcagtgagctgagatcatgccactgactccagcctgggcgacagagtcagactctgtcacaaaaaaaaaaaaaaaaaaaaaagagtacaaatagaggcccatattttatgcccctacattctccacctatagatgaaataatttaaagcattcagact

SEQ ID NO: 105531 - DNA, 601 bp, Human
cacaaaaaaaaaaaaaaaaaaaaaagagtacaaatagaggcccatattttatgcccctacattctccacctatagatgaaataatttaaagcattcagactaataatgactgataaattaggttgatatttgaaaaattaattttacattattacttttgttccctgccaatgactttaaattatcacaaatgcattaagttaaaaagaataaaattttaaagattagttcaacagtgaaaatgtatatattagattctattattttaaagaaattacttgttaatagaaaaatagtcacrtttcagataataggaaaaacatagaaatttccatttttggtctttagagcattgacatagcttatggttttgcctcacatattttgttgccacttaaagataggaggggctgggcgtggtggctcatgcctgtaatcccagccagcactttgggaggctgaggagggcagatcatgaggtcaggagttcgagaccagcctgaccaacatggtgaacccccgtctctactaaaaatacaaaaattagccaggtgtggtggtgcgtgcctgtaatcccagctactcaggaggctgaggcaag

SEQ ID NO: 105532 - DNA, 601 bp, Human
acaaatagaggcccatattttatgcccctacattctccacctatagatgaaataatttaaagcattcagactaataatgactgataaattaggttgatatttgaaaaattaattttacattattacttttgttccctgccaatgactttaaattatcacaaatgcattaagttaaaaagaataaaattttaaagattagttcaacagtgaaaatgtatatattagattctattattttaaagaaattacttgttaatagaaaaatagtcacgtttcagataataggaaaaacatagaaatktccatttttggtctttagagcattgacatagcttatggttttgcctcacatattttgttgccacttaaagataggaggggctgggcgtggtggctcatgcctgtaatcccagccagcactttgggaggctgaggagggcagatcatgaggtcaggagttcgagaccagcctgaccaacatggtgaacccccgtctctactaaaaatacaaaaattagccaggtgtggtggtgcgtgcctgtaatcccagctactcaggaggctgaggcaagagaatcgcttgaacccgggaggtagaggt

SEQ ID NO: 105533 - DNA, 601 bp, Human
ttgcatgccagcctgggcaacaaagcaagactccatctcaaaaaaaaagataagagggagattcaatcaaaggtgttgtggatctaacttttgtttaggtcaggcatgtatgtgtcatgctggtatctaataggacattttagtggtttccattttctatgtatgtgactggaacagtaggaagcctgcatgatggtaacagatcctgctgtttctgagtcagtctatacagattgaagtagcttcaatcaggtaattttcaattgtatttgattttgttgtaattacaaaacccgaaaaycccaatattttctgaggttttactccaacatatgtgttagttgaagagccactctaataaggtgaaactacaggctcctcccattccacactgttctctacattatagtatacacatctactacagttcttattattctttctttctcctgccgaagtatgaatgcctccagatggggatctagtctaatacagtagaattcaacaagcatttatgatgttccaggcacagcgctagacacgcataatacagagaggagggggcaagtgctggtggaatgggcccccagcacagagcaca

SEQ ID NO: 105534 - DNA, 601 bp, Human
atcaaaggtgttgtggatctaacttttgtttaggtcaggcatgtatgtgtcatgctggtatctaataggacattttagtggtttccattttctatgtatgtgactggaacagtaggaagcctgcatgatggtaacagatcctgctgtttctgagtcagtctatacagattgaagtagcttcaatcaggtaattttcaattgtatttgattttgttgtaattacaaaacccgaaaatcccaatattttctgaggttttactccaacatatgtgttagttgaagagccactctaataaggtgmaactacaggctcctcccattccacactgttctctacattatagtatacacatctactacagttcttattattctttctttctcctgccgaagtatgaatgcctccagatggggatctagtctaatacagtagaattcaacaagcatttatgatgttccaggcacagcgctagacacgcataatacagagaggagggggcaagtgctggtggaatgggcccccagcacagagcacaatatgtgaaatgtttggaaaaattagatctcatttatctttacttctagcccagagtgagcctac

SEQ ID NO: 105535 - DNA, 601 bp, Human
tattattctttctttctcctgccgaagtatgaatgcctccagatggggatctagtctaatacagtagaattcaacaagcatttatgatgttccaggcacagcgctagacacgcataatacagagaggagggggcaagtgctggtggaatgggcccccagcacagagcacaatatgtgaaatgtttggaaaaattagatctcatttatctttacttctagcccagagtgagcctacactacatgggcaaatgcatcagaatggaaatctcccaccaaccccaaattccaaccccaaacaggrcacacatacacacacacacacaccccacaccagtgcaagcactgctaactagcgagtacattttttcctactaagccaggcacaggccatagaaaattctcacacaacactcaaggttttcaaccctagctacacaatagaattacctggaagcttcataaattcccaatgcccagatcatacaatagagtaatttcatctcaacctccgagagtagggcccaggtgtctgattcttacagctctccaggtgcttccaacgtgcagtcaaggttctgaaccattgctatgctcttgccag

SEQ ID NO: 105536 - DNA, 601 bp, Human
agtctaatacagtagaattcaacaagcatttatgatgttccaggcacagcgctagacacgcataatacagagaggagggggcaagtgctggtggaatgggcccccagcacagagcacaatatgtgaaatgtttggaaaaattagatctcatttatctttacttctagcccagagtgagcctacactacatgggcaaatgcatcagaatggaaatctcccaccaaccccaaattccaaccccaaacagggcacacatacacacacacacacaccccacaccagtgcaagcactgctaactascgagtacattttttcctactaagccaggcacaggccatagaaaattctcacacaacactcaaggttttcaaccctagctacacaatagaattacctggaagcttcataaattcccaatgcccagatcatacaatagagtaatttcatctcaacctccgagagtagggcccaggtgtctgattcttacagctctccaggtgcttccaacgtgcagtcaaggttctgaaccattgctatgctcttgccagtgagcacggtccctggagcagtagcagcacccactacgagctcatgagaaat

SEQ ID NO: 105537 - DNA, 601 bp, Human
tttatttgtttgtttgagacagggtcctgccctgtcacccaggctggagtgcagtggcacgatcttggctcactgcaacctccacctcccgagttcaagcgattctccagcctcagcccccgagtagctgggactacaggcatgcgccaccacacccaactaatttttgtatttttagtagagatgggttttcaccatgttggccaggctggtcttgaactcctaacctcagatgatccacctgcgttggcctcccaaagtgctgggattacaggaactgtaatcccagtgtgagccaccrtgcccagcctatctagtctactgttgatggacatttaagttgattccatgtctttgctattgtgaatagtgctgcaatgaacacaacgcatgcatgtgtctttatagtagaacaatttttattctttgggtatatatccagtaatgggaggattgctgggctgaatgttagttctgtttttagttccttgtggagttgccacactgctttccacaatgcttgaactaatttacactctcaccagcagcatataagtgtttgctatttctctgcaacctcaccagcatctattatttttca

SEQ ID NO: 105538 - DNA, 601 bp, Human
atttttagtagagatgggttttcaccatgttggccaggctggtcttgaactcctaacctcagatgatccacctgcgttggcctcccaaagtgctgggattacaggaactgtaatcccagtgtgagccaccatgcccagcctatctagtctactgttgatggacatttaagttgattccatgtctttgctattgtgaatagtgctgcaatgaacacaacgcatgcatgtgtctttatagtagaacaatttttattctttgggtatatatccagtaatgggaggattgctgggctgaatgttrgttctgtttttagttccttgtggagttgccacactgctttccacaatgcttgaactaatttacactctcaccagcagcatataagtgtttgctatttctctgcaacctcaccagcatctattatttttcactttttaataatacccattctgactggtgtgagattgtagctcattgtggttttgatttccatttagtaacactgaacattttttcatgtgctttttgaccacatgtgtgttttcttttgaaaagtgttcatgtcctttccccactttttaatgaggttgtttgttcttc

SEQ ID NO: 105539 - DNA, 601 bp, Human
tcagatgtaaagtttgcaaatattttctcccattctgtcagctgcctgtttactctgttgatagttccttctgctgctcaaaagctctttagtttaatgaggcctcatttgtcaattttggcttctgttgcagttgattttgctgttttcatcatgaaatttttgctggttcctatatcctaaatggtatttcctagcttatcctccaaggtttttatagttttaggttttacttttagttctttaatccatcttgagttgattttttttatatggtgtaaggaaggggtccagtttcacycttctgcatatggctagccagctctcagcaccatttattgaataggcagttatttcccctttgcttgttcttgtcagctttgtcaaagatcagatggctgcaggtgtgtggccttatttctgggctctctattctgttcttttggtctgtgtctgtttttgtaccagtactgtgctcttttggttactgtagccttgtagtacagtttgaagttgggcaatgtgataactccagccttgctccttttgcttaggattgtcttggctaattcgggctcttttctttttgttccatatgaac

SEQ ID NO: 105540 - DNA, 601 bp, Human
tagtacagtttgaagttgggcaatgtgataactccagccttgctccttttgcttaggattgtcttggctaattcgggctcttttctttttgttccatatgaaccttagaatagttttcctaattctgtgaagaatgtcattggtagtttgataggaataacatcgaatctgtaaattgctttgggcagtatggccattttaatgatattgattcttcctatccatgagcatggaatattttccatttgtttgtgtcatctctgatgtctttgagcagtgtttcgtaattctcattgtaggsatctttcaccccttggttagctgtattcctaggtgttttattctttttgtggcaattgtgaatggcactgcacttctgatttggccctcagcttaggggtgctgttaatgtatagggatgctactgatttttgtacattgattttgtatcccaaaacttagttgaaattgcttatcatctcaaggagcttttgggcagagactatgggttattctcaatatagaatcatgtcatctgcatacaggattactttgacttcctctcctcctatttggataccttttctttctttctcttgcc

SEQ ID NO: 105541 - DNA, 601 bp, Human
gaagctaggattaacattagggtttttttggtgatataacaaatagagtccagaaaactgccaccatatgtttacttgaacccagaaatttggcagcaaatttttggaacagaatttgtagtcttgaaattctgctttgtttaactctaggccataaaatctttaatggaaatgtttgctttaaaaagtggcttattatgcatacatgatcgatttttataatttactaatgttggtttaagtttataaactatattataaatgcctggctggatcccatgagaaaatcccaaacagcagytgtcaacctctttagactctgagccctttcttcaaacaaaatctcccagtgcatcacacgtataaaagagctcagaaggccaggcacggtggctcacacctgtaatcccaacattttgggaagctgaggtgggcagatcacctgaggtcaggagttcaggaccagcctggccaacatgacgaaaccccatctctactcaaaatacaaaaattagccaggcgaggtggcacactcctgtaatcccagctactctggaggctgaggtgggagaaacacttgagcccaggaggtggaggttgc

SEQ ID NO: 105542 - DNA, 601 bp, Human
tgatatgattccacttacataaggtacttagaataatcaaattcatagagacagaaacgctataagatttgaccttatagccatatacatatatttcaaattgtaccccaaaatgtgtacaattacaatgtctcaattacatattaaaactttaaaacaagaaagtagaacggtggttgccaggtggttgggtggaggggagaatggggagttagttgtttaatgggtatagtgtttaattgtgcaagatgaaagcagttctagagatgattggtggtgatggtcacacaacatcacaaakgtacttaatagcacagatctgtactcttaaaagtggttaagatggtaaaatgtatgtaacatattttaccatgatttttaaaatttggaaaaaaatggataagcctccaaactgaaatagtaatggaagccaattcatagcatgaacgcaggaaagggcctaagactgaacttgagggagccggtagtcaagggctgggtagggaggacgagcctgttaggagatgaagaatgtggttctgcaggtgggaggaaactaaacaagcacagcatcatggaaaccaaaggaggacagtgtttc

SEQ ID NO: 105543 - DNA, 601 bp, Human
acatattaaaactttaaaacaagaaagtagaacggtggttgccaggtggttgggtggaggggagaatggggagttagttgtttaatgggtatagtgtttaattgtgcaagatgaaagcagttctagagatgattggtggtgatggtcacacaacatcacaaaggtacttaatagcacagatctgtactcttaaaagtggttaagatggtaaaatgtatgtaacatattttaccatgatttttaaaatttggaaaaaaatggataagcctccaaactgaaatagtaatggaagccaattcayagcatgaacgcaggaaagggcctaagactgaacttgagggagccggtagtcaagggctgggtagggaggacgagcctgttaggagatgaagaatgtggttctgcaggtgggaggaaactaaacaagcacagcatcatggaaaccaaaggaggacagtgtttcaaggaggaaggggtccagtgccaaatgcccctgagaatgcaaagggcatgaattgggaaatgcccacaagttttaacagcacagcggtcattggtgacctccagaatcatgtcttccatccaatctggtaatctttca

SEQ ID NO: 105544 - DNA, 601 bp, Human
aattcatagcatgaacgcaggaaagggcctaagactgaacttgagggagccggtagtcaagggctgggtagggaggacgagcctgttaggagatgaagaatgtggttctgcaggtgggaggaaactaaacaagcacagcatcatggaaaccaaaggaggacagtgtttcaaggaggaaggggtccagtgccaaatgcccctgagaatgcaaagggcatgaattgggaaatgcccacaagttttaacagcacagcggtcattggtgacctccagaatcatgtcttccatccaatctggtaayctttcatgactgtaaactccttgagagcaggcaccttgaacagacctctatatcctcctgttttgcttttcacttaagaagtgttcaataaatatttactacagagtgaactcagatgatggtatttatggtattttggggcaggtgatggaactatactgtattctgattgtgttgatgattagacaaatctatatatgtgttaaaactcatagacctgtacacctcaaaacaattaattttattgtaccttaatttaattttttttaaaaaaatggattctttttcttacatggtgat

SEQ ID NO: 105545 - DNA, 601 bp, Human
agcggtcattggtgacctccagaatcatgtcttccatccaatctggtaatctttcatgactgtaaactccttgagagcaggcaccttgaacagacctctatatcctcctgttttgcttttcacttaagaagtgttcaataaatatttactacagagtgaactcagatgatggtatttatggtattttggggcaggtgatggaactatactgtattctgattgtgttgatgattagacaaatctatatatgtgttaaaactcatagacctgtacacctcaaaacaattaattttattgtacsttaatttaattttttttaaaaaaatggattctttttcttacatggtgatgggctcttgagtattataaaatgactcttgaaattttatatatgttttctaaagagctctttgtatttatacaagatttaatgacattgaatattcaattaaagatgcaaagttttaaatacactaggagaaatgcagaaaaggtggtaggcaatatatggaaatacatgtgtgatttaagtcaatattaagaggaatgaaaaagcaagcaataaaaatatacgcattgtctcttttttttttttaacagg

SEQ ID NO: 105546 - DNA, 601 bp, Human
ccagaatcatgtcttccatccaatctggtaatctttcatgactgtaaactccttgagagcaggcaccttgaacagacctctatatcctcctgttttgcttttcacttaagaagtgttcaataaatatttactacagagtgaactcagatgatggtatttatggtattttggggcaggtgatggaactatactgtattctgattgtgttgatgattagacaaatctatatatgtgttaaaactcatagacctgtacacctcaaaacaattaattttattgtaccttaatttaattttttttwaaaaaatggattctttttcttacatggtgatgggctcttgagtattataaaatgactcttgaaattttatatatgttttctaaagagctctttgtatttatacaagatttaatgacattgaatattcaattaaagatgcaaagttttaaatacactaggagaaatgcagaaaaggtggtaggcaatatatggaaatacatgtgtgatttaagtcaatattaagaggaatgaaaaagcaagcaataaaaatatacgcattgtctcttttttttttttaacaggcaggaatgggccacttgt

SEQ ID NO: 105547 - DNA, 601 bp, Human
cagaatcatgtcttccatccaatctggtaatctttcatgactgtaaactccttgagagcaggcaccttgaacagacctctatatcctcctgttttgcttttcacttaagaagtgttcaataaatatttactacagagtgaactcagatgatggtatttatggtattttggggcaggtgatggaactatactgtattctgattgtgttgatgattagacaaatctatatatgtgttaaaactcatagacctgtacacctcaaaacaattaattttattgtaccttaatttaattttttttawaaaaatggattctttttcttacatggtgatgggctcttgagtattataaaatgactcttgaaattttatatatgttttctaaagagctctttgtatttatacaagatttaatgacattgaatattcaattaaagatgcaaagttttaaatacactaggagaaatgcagaaaaggtggtaggcaatatatggaaatacatgtgtgatttaagtcaatattaagaggaatgaaaaagcaagcaataaaaatatacgcattgtctcttttttttttttaacaggcaggaatgggccacttgtg

SEQ ID NO: 105548 - DNA, 601 bp, Human
cctcctgttttgcttttcacttaagaagtgttcaataaatatttactacagagtgaactcagatgatggtatttatggtattttggggcaggtgatggaactatactgtattctgattgtgttgatgattagacaaatctatatatgtgttaaaactcatagacctgtacacctcaaaacaattaattttattgtaccttaatttaattttttttaaaaaaatggattctttttcttacatggtgatgggctcttgagtattataaaatgactcttgaaattttatatatgttttctaaasagctctttgtatttatacaagatttaatgacattgaatattcaattaaagatgcaaagttttaaatacactaggagaaatgcagaaaaggtggtaggcaatatatggaaatacatgtgtgatttaagtcaatattaagaggaatgaaaaagcaagcaataaaaatatacgcattgtctcttttttttttttaacaggcaggaatgggccacttgtgtgtaacaaaagatggactgcgcttggaaggggaatcagaatttttattcccattgtatgccaaagaaatacactccagagtggt

SEQ ID NO: 105549 - DNA, 601 bp, Human
ttatggtattttggggcaggtgatggaactatactgtattctgattgtgttgatgattagacaaatctatatatgtgttaaaactcatagacctgtacacctcaaaacaattaattttattgtaccttaatttaattttttttaaaaaaatggattctttttcttacatggtgatgggctcttgagtattataaaatgactcttgaaattttatatatgttttctaaagagctctttgtatttatacaagatttaatgacattgaatattcaattaaagatgcaaagttttaaatacacttggagaaatgcagaaaaggtggtaggcaatatatggaaatacatgtgtgatttaagtcaatattaagaggaatgaaaaagcaagcaataaaaatatacgcattgtctcttttttttttttaacaggcaggaatgggccacttgtgtgtaacaaaagatggactgcgcttggaaggggaatcagaatttttattcccattgtatgccaaagaaatacactccagagtggtaagaaaatgttaagacaaataatttgtgctttatgaaaaataaatcatgtttaagcacaaaaattcagtaca

SEQ ID NO: 105550 - DNA, 601 bp, Human
tttttcttacatggtgatgggctcttgagtattataaaatgactcttgaaattttatatatgttttctaaagagctctttgtatttatacaagatttaatgacattgaatattcaattaaagatgcaaagttttaaatacactaggagaaatgcagaaaaggtggtaggcaatatatggaaatacatgtgtgatttaagtcaatattaagaggaatgaaaaagcaagcaataaaaatatacgcattgtctcttttttttttttaacaggcaggaatgggccacttgtgtgtaacaaaagayggactgcgcttggaaggggaatcagaatttttattcccattgtatgccaaagaaatacactccagagtggtaagaaaatgttaagacaaataatttgtgctttatgaaaaataaatcatgtttaagcacaaaaattcagtacagtttagagaagatttttaaagcgcatacatgtgcacatattcatgatatgctctttataaaaagcttgactattgcagaatttatctctgatattaccttctaaaaatatttcaatttaatatgcttcagatctgaatttggtggcctcagtagttt

SEQ ID NO: 105551 - DNA, 601 bp, Human
ttaaatacactaggagaaatgcagaaaaggtggtaggcaatatatggaaatacatgtgtgatttaagtcaatattaagaggaatgaaaaagcaagcaataaaaatatacgcattgtctcttttttttttttaacaggcaggaatgggccacttgtgtgtaacaaaagatggactgcgcttggaaggggaatcagaatttttattcccattgtatgccaaagaaatacactccagagtggtaagaaaatgttaagacaaataatttgtgctttatgaaaaataaatcatgtttaagcacaamaattcagtacagtttagagaagatttttaaagcgcatacatgtgcacatattcatgatatgctctttataaaaagcttgactattgcagaatttatctctgatattaccttctaaaaatatttcaatttaatatgcttcagatctgaatttggtggcctcagtagtttagaccataataaactaaaggttttagaaatgaaaatttttaccaagaacaatttaaacttctttatgttagatcaactaacttaaatatatttattttagggtattcaaaattatctaagaagcttagaaag

SEQ ID NO: 105552 - DNA, 601 bp, Human
gcattcaagtgttagaacttggtcttcttttttccccagagttgtgttggctgatctcctgccatattttgggaagaatcagactggtagaatggtccggtgactgaaatcaggtgactaggtcacagcaaatttaatattctggaattaataataactctcagttggccaggcgtggtggctcacgcctgtaatcccagcactttgggaggccgaggcgggcagatcacaaggtcaggagatcaagaccatcctggctaacacagtgaaaccccgtctctactaaaaatacaaaaaaatyagccgggcgtggtggcgggcgcctgtagtcccagctacttgggaggctgaggcaggagaatggcgtgaacctggaaggtggagcttgcagtgagccgagaccatgccactgcactccagcctgggccacagagtgagactccgtctccaaaaataataacaataataataataataactctcagttatattttatcaggctttttcatctccagtatgcttttaaaaaaagcaaaattatagcgaatatcttagataatcacatattaaagtcttagaatgtggcattaatgagtatgtc

SEQ ID NO: 105553 - DNA, 601 bp, Human
gactgaaatcaggtgactaggtcacagcaaatttaatattctggaattaataataactctcagttggccaggcgtggtggctcacgcctgtaatcccagcactttgggaggccgaggcgggcagatcacaaggtcaggagatcaagaccatcctggctaacacagtgaaaccccgtctctactaaaaatacaaaaaaattagccgggcgtggtggcgggcgcctgtagtcccagctacttgggaggctgaggcaggagaatggcgtgaacctggaaggtggagcttgcagtgagccgagaycatgccactgcactccagcctgggccacagagtgagactccgtctccaaaaataataacaataataataataataactctcagttatattttatcaggctttttcatctccagtatgcttttaaaaaaagcaaaattatagcgaatatcttagataatcacatattaaagtcttagaatgtggcattaatgagtatgtcaatcaacacataaaattcagtaacaatttgaataatattatgtgataacagagctgtacagtgttttataactaacatggtttccaataagagccatccca

SEQ ID NO: 105554 - DNA, 601 bp, Human
ctgggccacagagtgagactccgtctccaaaaataataacaataataataataataactctcagttatattttatcaggctttttcatctccagtatgcttttaaaaaaagcaaaattatagcgaatatcttagataatcacatattaaagtcttagaatgtggcattaatgagtatgtcaatcaacacataaaattcagtaacaatttgaataatattatgtgataacagagctgtacagtgttttataactaacatggtttccaataagagccatcccagaacaaaactatgcttcctracttctgtatggattgatatattagttataaatttccttttcaaagatgagtctaggaagcaattttccataaaattacagaaaagaaattactttatgaatttgcaaaatttgacacataactcacttatgtgtactgatgagctgagagaatttcttctttataaatataattcaacatgctactctggcctctaacatctgatcacccagtaacccctcaaaagtaatacatgagggcctgtattgaattcatactttgaattcatggcttaaacccatccaccatgcccattagtt

SEQ ID NO: 105555 - DNA, 601 bp, Human
ttgaataaagttgctacaactatttgaataaagcagcatataaaaaagtagctacaactatttgaataaagcagcatacctgaggggaggaggctacaaagatgccagtccagaacctgaatgtcatgaggacagaagccctaagccaccactgaaagactgggaggccctgtggaccaagtgaaaacaacaggacagactttagacagactggtaagagccaaaaggtagacacatccacacagtggaacataaaacttgaaatttcatatgatgaaatcttcatctaaaaaaaaaaaaagcccaataaactttacataaaggaagatcaatatccaactaaataaaaagtcaatctgaaaatgactagaaaaacacacttaagattctcaaagagataaagctatttttaaaggagttttccttaaaataacatgaaattataaaatcagaagagaaattacagggcagaaataacagggaataggtttaccctcctgcattaaacaactaaaaaatgaaaaaaaaaatatatgaaacagtggttttcaaatattggacaatgggcagctcaggagagttatccctgcaagaggaaaaa

SEQ ID NO: 105556 - DNA, 601 bp, Human
caaattgccttaactcactgcatgaagagagtttccaggctgcaatgagggaggggagccaatgcagacacaggtggtctccctgagttgaagagacagggttgggaggccaaggaatccaaggcagctgcagtttgcaaggcggagtactgcagaggaggggcttgctgcacgtggacagcgctccagagatggcagagacttcacctcatcccacccccaccaagtctatggataaatatttaccagtgtgtgtgtgtgaggaagctaccttgagactagtgaaatacccactctaagrgagcagaaggaacaatgcctggagctcacacagggtggggaacagttcatattcccaccagtcagagtggaaaacttcataaattatgggcatcaggtagaatacagaagggcatggctcagaagtggtacaagatcaacactaggaaaaaaatcctgctctggtccattctaacaaagcttaacaggaatccttgaaagtggcatgctttttccaagtgatttgctccatcccagaacagagttctaaaaaactacatttcatctgtgcacaaaagtcgaggaaagcataatcatgtta

SEQ ID NO: 105557 - DNA, 601 bp, Human
ggaaagacagaaaaaacacaaaagaatcttctagagatgaaaagtataacaactgaaatttttaaaaagccaatggtgggactaacagattaataacaatttaaagtatagctatagatactctccaaaatggagcacagagaaaaatgactagaaaaagaaagcaacagcatatcagtaactttctttttctagaaaaagaaagcaacagagtatcagtaactagagggacaatgtcaaggggctttatgtatgtgtaactggcatctccaaagaagaagaaagaagagaggacaaataytatttaaaaagaataaagtgtactttttttccaagcatgataaaatctttaagcctacagataaaacatgttcaatgaaccccaaacaaaagaaacaaggaaaactacaaggtacattgtaattaaattgcttaaaaacaagagagaaaaatcttaaagagaaagccttagaagtagctagagaaaaaggatatataacatacaaaggagtgaaaaaaatatgacatcagccttctagtcagtaacatttaaagccagaagacactgaagcaccgactttaaagtactaaaagaaaaaaa

SEQ ID NO: 105558 - DNA, 601 bp, Human
aaagaataaagtgtactttttttccaagcatgataaaatctttaagcctacagataaaacatgttcaatgaaccccaaacaaaagaaacaaggaaaactacaaggtacattgtaattaaattgcttaaaaacaagagagaaaaatcttaaagagaaagccttagaagtagctagagaaaaaggatatataacatacaaaggagtgaaaaaaatatgacatcagccttctagtcagtaacatttaaagccagaagacactgaagcaccgactttaaagtactaaaagaaaaaaaggccaacytagaactctttacctagcaaaagtatctttaaaagacaaagtcaaaataaagacttttttggacttactaaagctgaaagcaagttacttcagcagactagcaccacaagaaatattaaaggaagcctttctggcaaaaagaatatgatgctagaagaaaaatctagatgttcaccagaaaaaaattttaaataccagaactcataagtatgtggttatacaaaaaataattttaaaaaatgttagaagacactttgctcaaagccaaaagaacaatgtatttgggatgttataacagga

SEQ ID NO: 105559 - DNA, 601 bp, Human
tactaaagctgaaagcaagttacttcagcagactagcaccacaagaaatattaaaggaagcctttctggcaaaaagaatatgatgctagaagaaaaatctagatgttcaccagaaaaaaattttaaataccagaactcataagtatgtggttatacaaaaaataattttaaaaaatgttagaagacactttgctcaaagccaaaagaacaatgtatttgggatgttataacaggataggcataaaatgtatgacactaatgaaacaaagaccgtaacagaaaaagatagaagtactgctayaatgttctcacatcacacgtgagtggcaaaaattattgaggatggaccttaataagttaaagatgcttagtatatctaaagtaaactcgtaaaacaaaaagtatagctaatacatcaactaaggagataaaaatgaaatgataaataattaatccaaaaggaggcaaaggaaacaaagagaaaattagttgaatatgaaaacaaatagcaatttggtatatttgaaccaattcatagtcacattaaaataatcacattaaatataaatggtcaaaacaccccaactgaaagacagactgt

SEQ ID NO: 105560 - DNA, 601 bp, Human
ggaaatttatggcattaaatgcctatattaaaaaagaagaaaattggccgggtgcggtggctcacgcctgtaatcccagcactttgggaggccgaggcaggcggatcacgaggtcaggagatcgagaccatcctaacacggtgaaaccctgtctctactaaaaatacaaaaaattaaccgggcgtggtggcgggtgcctgtagtcccagctacttgggaggctgaggcaggagaatggcatgaacccaggagtcagaacttgcaatgagccaagatcacaccactgcactccagcctgggygacggagcgagactccatctcaaaaaaaaaaaaaaaaaaagaagaagaaaatcgatgacctcagtttcatccttaagaaactagaagaagaacatgttagaccaaaaatcaaagacagaagatccaaacaaataaaatcataaatgaaaaaggagacatcataatggataccacagaaatacaaaacatcatcattagaggctaccatgaacaagtatatgtcaataagtttgaaagcctagggaaaatggataaatatttggatacatacaaccttccaagattgaaacaagaagaaac

SEQ ID NO: 105561 - DNA, 601 bp, Human
ggctgaggcaggagaatggcatgaacccaggagtcagaacttgcaatgagccaagatcacaccactgcactccagcctgggcgacggagcgagactccatctcaaaaaaaaaaaaaaaaaaagaagaagaaaatcgatgacctcagtttcatccttaagaaactagaagaagaacatgttagaccaaaaatcaaagacagaagatccaaacaaataaaatcataaatgaaaaaggagacatcataatggataccacagaaatacaaaacatcatcattagaggctaccatgaacaagtatwtgtcaataagtttgaaagcctagggaaaatggataaatatttggatacatacaaccttccaagattgaaacaagaagaaacaggaaatctaaacagaccaataatgagtaacaacatcgaattagtaataaaaagtctccccaataaaggaaagtccaggaccagaaggcttcaccgctgaattctaccaaacatttaaagaagaattaataccagtccttctcaaactttttcaaaaacttgaagcagaggagattcttcctaactcattacacaagaccagcatagccatgatatcaa

SEQ ID NO: 105562 - DNA, 601 bp, Human
cttcatgataaaccaaaagtcaaagaagaaaagaaagatgagagaagaaatcaacaaaatagaaaacataaaacaatagaggaaattaatgaaaccaaaaatggattcttttagaagatcaataaaaattgataaaccttgaaccagactgaatattttaaaaagagagggcacaaattatcaatatcagtgatggtagaagggacactgctatgaatcccacagacattcaaagaatggtaaggaaatattacaaataactttatgccaataaatgtaatttttccacatactgtttgayagaattcttgatataggattgctgcttcaatgattaaattagtttctgccattcccatattaggttcaagttggaagtagttaattatgtatataaatgaagtggtgaattgtacttgccctctaatctacattttcaaaaagtatcttaaaacatcaatctcatagggtattgataactcctatagcagttttgatctatctttgggccataccaattaccccttacattattaatggtctttttatacacctctttctttcacagctccttctatatgtcatgcactgttgagaaaag

SEQ ID NO: 105563 - DNA, 601 bp, Human
tgctatctataacttacatacatagtatatttatattttaatacaataaaaatagttttaaaaagtcaaaaaacaaaaacaaaaacctggaaatcacattcacaatctataaacttcagttttcttacctagaaaatggaaaataaagtctctggacttcacaaaaaacatcagtttttattaaaaatgtacacgttgattgttttaaggtacttcttaaaaatatagattaaagagcaagtataattcaatataagaggtttcattatagcagttatgaatacaattttgttggtaatayagatacagagtcaattctgctctgtcaattaaaagagctttaccgtgtgaacacagaatacccagctagccgtggcataaactaataggagcttttagtctcacataacaggaagctggagggggcagctgcagctttggttcagcactaaaccatgttaaggccagagtatctaccagccacccgcctgcccctcataatcactagacagttatgaggccacatccaagacacacagccgggaaatgtgcagtgctggtgcatgtgcctttttcacaaggaatgcaaaagcttgcctag

SEQ ID NO: 105564 - DNA, 601 bp, Human
agactattttccttttgaaacatcacataattccctaccactctggaagatatttggtttcctctgagtgaaccgtaaacctacctgcatccaacagcaaaattagtgaattccttttgaagaaaattgtgtatataaaaacaagcaatcttctctaaaacaacaccaccgtatcaggattacatatcatatcaggattacgataacagagaaagtataaacaaaaccgccgtatcaggatcactgtatcgtatcaggattacgataacaaagaaagtataacacttttgtgctcataaarccactttatcttcaacaaaaagtgcaaaaaacagagccatccaaaaatgttgcttaattcatttgaaattatgagaagcctttgtgtttttaaagtaacatggtatttcttatagaaaagttaactatttctcggattcatcttcttaaagtatatcatgtcctggacataaataatccctaaaaatagaattttaattccttgaaaaagcaaaagcactggttaaaacgtggttgttttagatctttaccttgtgaactgccttgacacattgtaaccagtgcgcacaagcactgtaaa

SEQ ID NO: 105565 - DNA, 601 bp, Human
cagccttaggagtatgttgtgggctcagacaccatacagggcctggatcgttacgacttctccaaggcgctttgaaatcatcatggaagggctttggcatctctagaacaccaagaactgtgataaagagttgaaaaaaggaggaaacattcctgaggcgccggagtggcgtgaaggccctccagctctggggcccatcagcacccggaaaagtaccactggagtggcacttaggtaggatcccccagcaaacacaggtgccccgggagctcagtaacgtggtttggaaggggacagaggycccaaaggcctgaaagcccaaaaggagtactttgtggcctgcacaccaaggtttttcctaaggttcatcctgccacagaaattctttctcctccttctcctcccattcctcagccactggcgtgattaggactggctacaaagactgcctaatttggagcatttggggttcctttcgtccttgtgatccccaatgcattctgccagcccctttctaaaagaaatggcttctctggaggagggcatctacagccttaaaattaattccaaacgtagctcctataatttcatgaaccctcaa

SEQ ID NO: 105566 - DNA, 601 bp, Human
gatcgttacgacttctccaaggcgctttgaaatcatcatggaagggctttggcatctctagaacaccaagaactgtgataaagagttgaaaaaaggaggaaacattcctgaggcgccggagtggcgtgaaggccctccagctctggggcccatcagcacccggaaaagtaccactggagtggcacttaggtaggatcccccagcaaacacaggtgccccgggagctcagtaacgtggtttggaaggggacagaggccccaaaggcctgaaagcccaaaaggagtactttgtggcctgcacrccaaggtttttcctaaggttcatcctgccacagaaattctttctcctccttctcctcccattcctcagccactggcgtgattaggactggctacaaagactgcctaatttggagcatttggggttcctttcgtccttgtgatccccaatgcattctgccagcccctttctaaaagaaatggcttctctggaggagggcatctacagccttaaaattaattccaaacgtagctcctataatttcatgaaccctcaatttgcagctggaagtgagggtcaaaatgaaactgaggaaccaaac

SEQ ID NO: 105567 - DNA, 601 bp, Human
cggagtggcgtgaaggccctccagctctggggcccatcagcacccggaaaagtaccactggagtggcacttaggtaggatcccccagcaaacacaggtgccccgggagctcagtaacgtggtttggaaggggacagaggccccaaaggcctgaaagcccaaaaggagtactttgtggcctgcacaccaaggtttttcctaaggttcatcctgccacagaaattctttctcctccttctcctcccattcctcagccactggcgtgattaggactggctacaaagactgcctaatttggagcrtttggggttcctttcgtccttgtgatccccaatgcattctgccagcccctttctaaaagaaatggcttctctggaggagggcatctacagccttaaaattaattccaaacgtagctcctataatttcatgaaccctcaatttgcagctggaagtgagggtcaaaatgaaactgaggaaccaaacaagttccagaacaggtagggtagacctaaagatagcgacgcttaattgacttatgtgagggttctccaggagatcctgggagatgacatgccaaaaggaaaggaagaggctgtcac

SEQ ID NO: 105568 - DNA, 601 bp, Human
gtttccaaaagccgttgccagtatgcccacccaggcctggccctgcatacggtgcgagagattgccagaatcaaagatctgttgctttcccacaccttggccatcttgcaggagaacacctgtcacctctaccatctttaaacagaaaaggcacagtcaggagtcttcctaagaaaggagaccagtagcctgacaaaacacatgaactagatttgaactctatgtcccgggtcaaggatgtgtttgaagaattcgttggcatggagtaaaccaggacaggatattttcctcaaaacctttycgtaagacttctgcttctggctggtagggtggggtacaatgggatgggaggaaggctaaggtaaactgcccttgatgttattaaggtttttcttcccagcaaaaatgccttaaggtagccagtaaagaagagagtttgatagaatacaaagagtttcccaatctaaatccctgtcctctgcagcctgcttttgatcacttggtgaataaagtcacccttctacttgtctttaaaaaaatgtagaattttaaaagtgaggtaggtgatttgtatattatattcgtatattataggaattct

SEQ ID NO: 105569 - DNA, 601 bp, Human
caggaattcaagaccagcctgggcaacatagttaaaactcatctctatttaaaaaaaaaaaaaaaaatcagctgggtgtggtggcacacacctgtaattccagctacttgggaggctgaggtgggaggatcacttgaatccacgagtctcaggctacagtgaactgtatactcacaccactggactccagcctggcaacagagtgaaactcccatctcttaaaaaaaaaaaaaaaaaaaagttttttaacaaaaaataggccagatgtagtggctcacgcctgtaatcccagcactttggraggccaaagcgggtggatcacttgagcccaggagtttgagaccagcctaggcaacatagtgagaccctgcctctaaaaaacattttttaaataaaaaatgtaagtatacactcaaaaagataagcgagatctacacaccgagttttcctttccaaaaaaaatttctatcaaaaaaaaatttttttaattttagatggaaaaccaacctactcctctctccctgcatttttgtgtggcaaatttaagtgttacactctgcggtgtttataacatgcaggagagaaccttgctgtaatttat

SEQ ID NO: 105570 - DNA, 601 bp, Human
cagctgggtgtggtggcacacacctgtaattccagctacttgggaggctgaggtgggaggatcacttgaatccacgagtctcaggctacagtgaactgtatactcacaccactggactccagcctggcaacagagtgaaactcccatctcttaaaaaaaaaaaaaaaaaaaagttttttaacaaaaaataggccagatgtagtggctcacgcctgtaatcccagcactttggaaggccaaagcgggtggatcacttgagcccaggagtttgagaccagcctaggcaacatagtgagacccygcctctaaaaaacattttttaaataaaaaatgtaagtatacactcaaaaagataagcgagatctacacaccgagttttcctttccaaaaaaaatttctatcaaaaaaaaatttttttaattttagatggaaaaccaacctactcctctctccctgcatttttgtgtggcaaatttaagtgttacactctgcggtgtttataacatgcaggagagaaccttgctgtaatttatctttttttcttcaggaaaaggaatgagcattgtagttctgagtgtagtattatcaagagtagcctaaa

SEQ ID NO: 105571 - DNA, 601 bp, Human
aaaaaaaatttttttaattttagatggaaaaccaacctactcctctctccctgcatttttgtgtggcaaatttaagtgttacactctgcggtgtttataacatgcaggagagaaccttgctgtaatttatctttttttcttcaggaaaaggaatgagcattgtagttctgagtgtagtattatcaagagtagcctaaatcaaaaagcacaatctggccaggcgcggtggctcagcctgtaatcccagacctttgggaggtggaggcgggcggatcacgaggtcaggagatggagaccatcytggctaacgcagtgaaactcttctctacaacaaaaaaaattagccggcgtggcagcaggcgcctgtagtcccagctcttccggaggctgaggcaggagaatggcgggaacccgggaggcggagcttccggcgagcccagatggcgccactgcactccagcctgggcggcggaactagactccgtctcaaaaagaaaaaaaaaaaggccgggttcggtggctgatgcctgtaatcccagcactttgggaggccgaggagggcggatcacgaggtcaggaaatcgagaccatcttggctaac

SEQ ID NO: 105572 - DNA, 601 bp, Human
ctcctctctccctgcatttttgtgtggcaaatttaagtgttacactctgcggtgtttataacatgcaggagagaaccttgctgtaatttatctttttttcttcaggaaaaggaatgagcattgtagttctgagtgtagtattatcaagagtagcctaaatcaaaaagcacaatctggccaggcgcggtggctcagcctgtaatcccagacctttgggaggtggaggcgggcggatcacgaggtcaggagatggagaccatcttggctaacgcagtgaaactcttctctacaacaaaaaaaattagccggcgtggcagcaggcgcctgtagtcccagctcttccggaggctgaggcaggagaatggcgggaacccgggaggcggagcttccggcgagcccagatggcgccactgcactccagcctgggcggcggaactagactccgtctcaaaaagaaaaaaaaaaaggccgggttcggtggctgatgcctgtaatcccagcactttgggaggccgaggagggcggatcacgaggtcaggaaatcgagaccatcttggctaacacggtgaaaccccgtctctactaaaactaccaaaaatta

SEQ ID NO: 105573 - DNA, 601 bp, Human
agcattgtagttctgagtgtagtattatcaagagtagcctaaatcaaaaagcacaatctggccaggcgcggtggctcagcctgtaatcccagacctttgggaggtggaggcgggcggatcacgaggtcaggagatggagaccatcttggctaacgcagtgaaactcttctctacaacaaaaaaaattagccggcgtggcagcaggcgcctgtagtcccagctcttccggaggctgaggcaggagaatggcgggaacccgggaggcggagcttccggcgagcccagatggcgccactgcacyccagcctgggcggcggaactagactccgtctcaaaaagaaaaaaaaaaaggccgggttcggtggctgatgcctgtaatcccagcactttgggaggccgaggagggcggatcacgaggtcaggaaatcgagaccatcttggctaacacggtgaaaccccgtctctactaaaactaccaaaaattagggggcgtggtggcgggcacctgtagtcccacctacttgggaggctgaggcaggagaatggcatgaacccgggaggcggagcttgcagtgagccgagatcgtgccagtgcactcca

SEQ ID NO: 105574 - DNA, 601 bp, Human
ctggccaggcgcggtggctcagcctgtaatcccagacctttgggaggtggaggcgggcggatcacgaggtcaggagatggagaccatcttggctaacgcagtgaaactcttctctacaacaaaaaaaattagccggcgtggcagcaggcgcctgtagtcccagctcttccggaggctgaggcaggagaatggcgggaacccgggaggcggagcttccggcgagcccagatggcgccactgcactccagcctgggcggcggaactagactccgtctcaaaaagaaaaaaaaaaaggccgggytcggtggctgatgcctgtaatcccagcactttgggaggccgaggagggcggatcacgaggtcaggaaatcgagaccatcttggctaacacggtgaaaccccgtctctactaaaactaccaaaaattagggggcgtggtggcgggcacctgtagtcccacctacttgggaggctgaggcaggagaatggcatgaacccgggaggcggagcttgcagtgagccgagatcgtgccagtgcactccagcctgggcgacagagccagactctgtcacagaaaagaaaaaaaaaaaaaaacaaacc

SEQ ID NO: 105575 - DNA, 601 bp, Human
tggccaggcgcggtggctcagcctgtaatcccagacctttgggaggtggaggcgggcggatcacgaggtcaggagatggagaccatcttggctaacgcagtgaaactcttctctacaacaaaaaaaattagccggcgtggcagcaggcgcctgtagtcccagctcttccggaggctgaggcaggagaatggcgggaacccgggaggcggagcttccggcgagcccagatggcgccactgcactccagcctgggcggcggaactagactccgtctcaaaaagaaaaaaaaaaaggccgggtkcggtggctgatgcctgtaatcccagcactttgggaggccgaggagggcggatcacgaggtcaggaaatcgagaccatcttggctaacacggtgaaaccccgtctctactaaaactaccaaaaattagggggcgtggtggcgggcacctgtagtcccacctacttgggaggctgaggcaggagaatggcatgaacccgggaggcggagcttgcagtgagccgagatcgtgccagtgcactccagcctgggcgacagagccagactctgtcacagaaaagaaaaaaaaaaaaaaacaaacct

SEQ ID NO: 105576 - DNA, 601 bp, Human
gcggtggctcagcctgtaatcccagacctttgggaggtggaggcgggcggatcacgaggtcaggagatggagaccatcttggctaacgcagtgaaactcttctctacaacaaaaaaaattagccggcgtggcagcaggcgcctgtagtcccagctcttccggaggctgaggcaggagaatggcgggaacccgggaggcggagcttccggcgagcccagatggcgccactgcactccagcctgggcggcggaactagactccgtctcaaaaagaaaaaaaaaaaggccgggttcggtggctsatgcctgtaatcccagcactttgggaggccgaggagggcggatcacgaggtcaggaaatcgagaccatcttggctaacacggtgaaaccccgtctctactaaaactaccaaaaattagggggcgtggtggcgggcacctgtagtcccacctacttgggaggctgaggcaggagaatggcatgaacccgggaggcggagcttgcagtgagccgagatcgtgccagtgcactccagcctgggcgacagagccagactctgtcacagaaaagaaaaaaaaaaaaaaacaaacctcaattttca

SEQ ID NO: 105577 - DNA, 601 bp, Human
ggtggctcagcctgtaatcccagacctttgggaggtggaggcgggcggatcacgaggtcaggagatggagaccatcttggctaacgcagtgaaactcttctctacaacaaaaaaaattagccggcgtggcagcaggcgcctgtagtcccagctcttccggaggctgaggcaggagaatggcgggaacccgggaggcggagcttccggcgagcccagatggcgccactgcactccagcctgggcggcggaactagactccgtctcaaaaagaaaaaaaaaaaggccgggttcggtggctgaygcctgtaatcccagcactttgggaggccgaggagggcggatcacgaggtcaggaaatcgagaccatcttggctaacacggtgaaaccccgtctctactaaaactaccaaaaattagggggcgtggtggcgggcacctgtagtcccacctacttgggaggctgaggcaggagaatggcatgaacccgggaggcggagcttgcagtgagccgagatcgtgccagtgcactccagcctgggcgacagagccagactctgtcacagaaaagaaaaaaaaaaaaaaacaaacctcaattttcatt

SEQ ID NO: 105578 - DNA, 601 bp, Human
tctacttaagtgatagatattccatttaacctcaaagaattattatttagcatttatttttatggcatttggtgtgactaccctcccatcctggagacatcagagttgtgaaggtagccagtaatctagaaattcagtttactcttagtggtccctgggatattagtctggagtcacagagcctctcaaggcccattaacaggctcccccaaccttagcagtcctttcagggcatgtcaacatttcgcttcacttaaattttagaaaggcagctatttctacctttaaagctcaaaagaarcaaactgcccattttgtcttgggagacagaggaatttgctttttcagttggtttttattcatatctaacttcaaaattcatacctgcttattataaaagttttgagacaagtaaagcgaaaaaaatgtgatttttaaaaaacccaaacaaaataaaagcaacagaaggaaaaacgtacatggtaaaattgattttttttaaatcaatagtagagtcaaatattggcaaaatctggatatacaaaatttgactcaggaaaattgatcttggtagaaatgtgatcaacaaagaaaactcaga

SEQ ID NO: 105579 - DNA, 601 bp, Human
gttaaattgcatatttgtctaaataattcatatttttttctatccctatcttgcgtttggagctcattttatgattgttattcttttatctttcaataaatactcaaaatgttaaaaaaatatgattcaggaatttttaattgtcttagccacaaatttataggatttccaggatctgtaacaatggataaataattttataaaaatcctaaatttacacagaattataaagatataatcattttaaacagcacctattttgcaaattttataaatctctttctaggactcatctctgctkctacaatcaacccagaatgtgactgtaaatgcgcgcaactcagaaggggaggtcacaggcaggttaaaagtcggtgagtccagcttcatcatggtgctttgcatgcatgttgtccatgaatagtgctaaatgaatgcattgttttttcttctaaagaaatcaaagctacttatgaacaaaatatgaattttctaaatatcatgctgtgttgaccacagactagcaccacagagtggggtggggggtgaggggacagcctgaagtgctttgattagagttatttttgttccaagaaataga

SEQ ID NO: 105580 - DNA, 601 bp, Human
aacaaatatttgttgaatgactatgggctaccttatatgctatcaagtaataataataaagactatgtaattatttcttagaagctataaaagtagaagaatcttcttatattcctataaaaattaattagcggccgggcacggtggctcacgcctgtaatcccagcactttgggaggccgaggtgggtggatcatgaggtcaggagatcaagaccatcctggctaacacagtgaaaccacgtctctactaaaaatactaaaaattagccgggcgtggtggcggtcgcctgtagtctcagytacttgggcggctgaggcaggagaatggcgtgaacccgggaggcggagcttgcagtgagccaagatcgcatcactgcactccagcctgggcgacagagtgagactgtgtctcaaaaaaaacaaaacaaaacaaacaaacaaaaaagttaattagtacaagtacacattcctctgtttatctttttgttgggtgtggattttcgtatattatgcaagggaatttagatataatataaacctgcctctcatttcatagatgaaaaaactgaaggactaaaaagcagatttgctcaagagcac

SEQ ID NO: 105581 - DNA, 601 bp, Human
aatcttcttatattcctataaaaattaattagcggccgggcacggtggctcacgcctgtaatcccagcactttgggaggccgaggtgggtggatcatgaggtcaggagatcaagaccatcctggctaacacagtgaaaccacgtctctactaaaaatactaaaaattagccgggcgtggtggcggtcgcctgtagtctcagctacttgggcggctgaggcaggagaatggcgtgaacccgggaggcggagcttgcagtgagccaagatcgcatcactgcactccagcctgggcgacagagygagactgtgtctcaaaaaaaacaaaacaaaacaaacaaacaaaaaagttaattagtacaagtacacattcctctgtttatctttttgttgggtgtggattttcgtatattatgcaagggaatttagatataatataaacctgcctctcatttcatagatgaaaaaactgaaggactaaaaagcagatttgctcaagagcacatagctagttagtagagaagtcaaaacaggaaagactgagggcttacttctctcagccagctgtttccactggccctcctctctaatcagatttcttga

SEQ ID NO: 105582 - DNA, 601 bp, Human
agttggaaagtctctgttatattgagaaccttgagctaggaaatagcaccaagctcaccaaatccaaggttttcttccgtacatgacttcccacagttgcaacccttctagtctcatatttcctggaagaagttaaattttgccaatttgggtattaaaatgtaatttatgtgaactagccatattaatctcatttaattaagtgaataagtgttttctacaaaaccactgaaaacaatttgcattcaatacagtcaaaaccaaaaatcccaattaaattctgacatgatttggatgtgcrtcccctccaaatgtcatggtgaaatgtgattcccaatgtggaaggtggggcctaatggatggtattgtatcatgagggtggatccctctcaaacggcttgcaccatacccttggtgaagagtgggttatcactccattagttcacatgacatctggttgtttaaaagagtctgggacctctctcttctctcttgctcctactcttaccacgtgatgcacctgctccttctttgccttctggaatgataggaagcttcctgaggccctcactagaagcatacgctgaagccatgtttgtac

SEQ ID NO: 105583 - DNA, 601 bp, Human
gtaaaagcattcctatttctccacatcctctccagtacctgttgtttcctgacttgttagtgatcgccattccaactggtgtgaaatggtatctctttgtggttttgatttgcatttctctgatgaccagtgatgatgagcattttttcatgtgtctgttagctgcaaaaatgtcttcttttgagaagtgtttgttcatatcctttgcccacgtttttgattcgcttcttataaatttgtttaagttctttgtagattctggatattagccctttatatactttaatttctagggtacacrtgcaaaacatgcaagtttgttatgtatgtatacacgtgccatgttgctttgctgcacccattaactagtcatttacattaggtatctcccctaatgctatccctaccccattcccccaccccatggacaggggtgggcatttagtgctgtaaatcagatgagtagactgcaaaaattttctcccattctgtaggttgcctgttcactctgatggtagtttcttttgctgtgcagaagctcattagtttaattagatcccttttgtcaattttgactttggttgccattgcttttggtgtt

SEQ ID NO: 105584 - DNA, 601 bp, Human
tacctgttgtttcctgacttgttagtgatcgccattccaactggtgtgaaatggtatctctttgtggttttgatttgcatttctctgatgaccagtgatgatgagcattttttcatgtgtctgttagctgcaaaaatgtcttcttttgagaagtgtttgttcatatcctttgcccacgtttttgattcgcttcttataaatttgtttaagttctttgtagattctggatattagccctttatatactttaatttctagggtacacatgcaaaacatgcaagtttgttatgtatgtatacamgtgccatgttgctttgctgcacccattaactagtcatttacattaggtatctcccctaatgctatccctaccccattcccccaccccatggacaggggtgggcatttagtgctgtaaatcagatgagtagactgcaaaaattttctcccattctgtaggttgcctgttcactctgatggtagtttcttttgctgtgcagaagctcattagtttaattagatcccttttgtcaattttgactttggttgccattgcttttggtgttttagtcatgaagtccttgcccatgcctatgtcctg

SEQ ID NO: 105585 - DNA, 601 bp, Human
cttagtttgaaattctgggttgaaaattcttttctttaagaatgttgaatattggcccccacactcttctggcttgtagactttctgccaagagatctgctcttagtcttatgggattccctttgtggataacctgacctttctctctggctgccgttaacattttttccttcatttcaaccttggtgaatctgacaattatgtgtcttgggattgctcttctcaaggagtatctttgtggtgttctttgtatttcctgaatttgaatgttggcctcccttgctaggctggggaagttctsctggataatatcctgaagaaatttttccagcatgattccattctccccatcactttcaggtacaccaatcaaacgtagatttgatcttttcacgtagtcccatatttcttgctttgttcatttctttttattctgaaaaattttttttttaatttcagttatgagtaaaaaaaaatctctaaagagatagatcaaaaaacaaaaaccagtcagaacttttggaaatgaaagacacatttagggaactataaaatgcagtggaaagttttaaaaatagactagtccaaatagaagaaagaa

SEQ ID NO: 105586 - DNA, 601 bp, Human
tgtagactttctgccaagagatctgctcttagtcttatgggattccctttgtggataacctgacctttctctctggctgccgttaacattttttccttcatttcaaccttggtgaatctgacaattatgtgtcttgggattgctcttctcaaggagtatctttgtggtgttctttgtatttcctgaatttgaatgttggcctcccttgctaggctggggaagttctgctggataatatcctgaagaaatttttccagcatgattccattctccccatcactttcaggtacaccaatcaaaygtagatttgatcttttcacgtagtcccatatttcttgctttgttcatttctttttattctgaaaaattttttttttaatttcagttatgagtaaaaaaaaatctctaaagagatagatcaaaaaacaaaaaccagtcagaacttttggaaatgaaagacacatttagggaactataaaatgcagtggaaagttttaaaaatagactagtccaaatagaagaaagaatttcagagctcgaagacaagtcttttgaattaactgaatcagacacaaataaagaaaaacaaatttaaagaaat

SEQ ID NO: 105587 - DNA, 601 bp, Human
gccaagagatctgctcttagtcttatgggattccctttgtggataacctgacctttctctctggctgccgttaacattttttccttcatttcaaccttggtgaatctgacaattatgtgtcttgggattgctcttctcaaggagtatctttgtggtgttctttgtatttcctgaatttgaatgttggcctcccttgctaggctggggaagttctgctggataatatcctgaagaaatttttccagcatgattccattctccccatcactttcaggtacaccaatcaaacgtagatttgatyttttcacgtagtcccatatttcttgctttgttcatttctttttattctgaaaaattttttttttaatttcagttatgagtaaaaaaaaatctctaaagagatagatcaaaaaacaaaaaccagtcagaacttttggaaatgaaagacacatttagggaactataaaatgcagtggaaagttttaaaaatagactagtccaaatagaagaaagaatttcagagctcgaagacaagtcttttgaattaactgaatcagacacaaataaagaaaaacaaatttaaagaaatgaacaaaatctc

SEQ ID NO: 105588 - DNA, 601 bp, Human
gtacaccaatcaaacgtagatttgatcttttcacgtagtcccatatttcttgctttgttcatttctttttattctgaaaaattttttttttaatttcagttatgagtaaaaaaaaatctctaaagagatagatcaaaaaacaaaaaccagtcagaacttttggaaatgaaagacacatttagggaactataaaatgcagtggaaagttttaaaaatagactagtccaaatagaagaaagaatttcagagctcgaagacaagtcttttgaattaactgaatcagacacaaataaagaaaaayaaatttaaagaaatgaacaaaatctctacaaaatatggaattatgtaaaacaaccaaactaacaatcttaggtgtcctgagagaaaagaaaaaacaaaatgtttggaaaatgtatttaagggaataatttaggaaaactttcctggctttgttagagatttagacatccaagtacaagaagttcaaataacttttgggagactcattgcaaaaaggacatcaccaaggcatatagtcatcaagctatctgaagtcaatgtgaaggaaaacattctaagtgcagtgagacaaaaggatcag

SEQ ID NO: 105589 - DNA, 601 bp, Human
aatatggaattatgtaaaacaaccaaactaacaatcttaggtgtcctgagagaaaagaaaaaacaaaatgtttggaaaatgtatttaagggaataatttaggaaaactttcctggctttgttagagatttagacatccaagtacaagaagttcaaataacttttgggagactcattgcaaaaaggacatcaccaaggcatatagtcatcaagctatctgaagtcaatgtgaaggaaaacattctaagtgcagtgagacaaaaggatcaggtaacctataaaggaaaacctatcagactaayagcaaatttcttagcagaaaccttacaagtcagaaaggattggggtactatctttagtatcattaaagagaacaactgtcagccaagaattttgtatccagacaaagtaagtttcataaatgaaggaaaaataaagtctttatcagacaagcaaatgctgatggaatttgtcagcactagactaaccctaaaagaaatgctgaaaggaattctaaatgttgaacaaaaggtcaatacacaccagaatagaaactcctgaaagcacaaaattcacaggggttataaaacaataacacaatg

SEQ ID NO: 105590 - DNA, 601 bp, Human
gaaaatgtatttaagggaataatttaggaaaactttcctggctttgttagagatttagacatccaagtacaagaagttcaaataacttttgggagactcattgcaaaaaggacatcaccaaggcatatagtcatcaagctatctgaagtcaatgtgaaggaaaacattctaagtgcagtgagacaaaaggatcaggtaacctataaaggaaaacctatcagactaacagcaaatttcttagcagaaaccttacaagtcagaaaggattggggtactatctttagtatcattaaagagaacwactgtcagccaagaattttgtatccagacaaagtaagtttcataaatgaaggaaaaataaagtctttatcagacaagcaaatgctgatggaatttgtcagcactagactaaccctaaaagaaatgctgaaaggaattctaaatgttgaacaaaaggtcaatacacaccagaatagaaactcctgaaagcacaaaattcacaggggttataaaacaataacacaatgaaggaaaaacagtcactaggtaacaatcaacatgataactcgaacagtacctcacatctcaatattcacattga

SEQ ID NO: 105591 - DNA, 601 bp, Human
acatcaccaaggcatatagtcatcaagctatctgaagtcaatgtgaaggaaaacattctaagtgcagtgagacaaaaggatcaggtaacctataaaggaaaacctatcagactaacagcaaatttcttagcagaaaccttacaagtcagaaaggattggggtactatctttagtatcattaaagagaacaactgtcagccaagaattttgtatccagacaaagtaagtttcataaatgaaggaaaaataaagtctttatcagacaagcaaatgctgatggaatttgtcagcactagactarccctaaaagaaatgctgaaaggaattctaaatgttgaacaaaaggtcaatacacaccagaatagaaactcctgaaagcacaaaattcacaggggttataaaacaataacacaatgaaggaaaaacagtcactaggtaacaatcaacatgataactcgaacagtacctcacatctcaatattcacattgaatgtaagtggtctaaatgctccacttaaaagatacagattagcaaaatggattaaaaaatcacaaaccaaatatctgctgttttcagcagacaacatggaaggattctcat

SEQ ID NO: 105592 - DNA, 601 bp, Human
accagaatagaaactcctgaaagcacaaaattcacaggggttataaaacaataacacaatgaaggaaaaacagtcactaggtaacaatcaacatgataactcgaacagtacctcacatctcaatattcacattgaatgtaagtggtctaaatgctccacttaaaagatacagattagcaaaatggattaaaaaatcacaaaccaaatatctgctgttttcagcagacaacatggaaggattctcatagactcaaggttaaggggtcgaaaacaatatttcatgcaaatggaaaccacaagygagaatgagtagctattcttacatcaaataaaacagacttgaaagcaacaatgtaaaaacaaaaccaaaaaatgtagttatataatgatgagaggatcagtacaccaagaagctataacaatcctcaatatatacgtacttaagtccagagctcttagatagataataaaaaattactactatacctaagaaaagagatagacagcaaaacaataacagtggaggacttcaatactccactgacggcattagacaaatcattgaggcagaaagtcaacaaagaaaactggacttaaactg

SEQ ID NO: 105593 - DNA, 601 bp, Human
cagacaacatggaaggattctcatagactcaaggttaaggggtcgaaaacaatatttcatgcaaatggaaaccacaagtgagaatgagtagctattcttacatcaaataaaacagacttgaaagcaacaatgtaaaaacaaaaccaaaaaatgtagttatataatgatgagaggatcagtacaccaagaagctataacaatcctcaatatatacgtacttaagtccagagctcttagatagataataaaaaattactactatacctaagaaaagagatagacagcaaaacaataacagtgraggacttcaatactccactgacggcattagacaaatcattgaggcagaaagtcaacaaagaaaactggacttaaactgtactctagaacaaatacacaaaatatatttaaataacattatactcaacaagtgcagaatatccattcttcccatcagcacatgaaacattctccatggtagatcatatgataggccacaaaccaagtctcaataaattttttaagagcaaaataatatcaagtatcttctcagaccacagcaaaataaaactggagataaattccaaaagaaaccctcaaa

SEQ ID NO: 105594 - DNA, 601 bp, Human
gtgcagaatatccattcttcccatcagcacatgaaacattctccatggtagatcatatgataggccacaaaccaagtctcaataaattttttaagagcaaaataatatcaagtatcttctcagaccacagcaaaataaaactggagataaattccaaaagaaaccctcaaaattatacaaatgtatggaaattacagaatctgctcctgaatgattttggggttaacaatgacattaaaatggaaatttaaaaatgtttcaaagtgaataagagtgagtcaacttatcagaacctctgggmtatagcaaaagcagtactaagaggaaagtttatagcccaaattcctacatcaaagtttgaaatatcacaaattgcaaacctgacatcacacctcaaggaactagagaaacaagaataaaccaaacccaaagctaccataggaaaagaaataacaaagatcagagcagaaacaaaaaaaaaatacaaaagatcaatgaaacaaaatctgactttttgaaaatattttttaaaatcattagctatattaatcaagaaaagaagagagaagattcaaataagctcgattagaaatgaaaatgg

SEQ ID NO: 105595 - DNA, 601 bp, Human
aacctctgggatatagcaaaagcagtactaagaggaaagtttatagcccaaattcctacatcaaagtttgaaatatcacaaattgcaaacctgacatcacacctcaaggaactagagaaacaagaataaaccaaacccaaagctaccataggaaaagaaataacaaagatcagagcagaaacaaaaaaaaaatacaaaagatcaatgaaacaaaatctgactttttgaaaatattttttaaaatcattagctatattaatcaagaaaagaagagagaagattcaaataagctcgattagawatgaaaatggagacagtgcaactgacatcacagaaatactaaggatcatttgagtttcctgtagacacttctgtgcacacaaactagaaaatctagaggaagtggataaattcctggaaacaaacaactcctttagtttgaatcagaaagaaatagaattcctgaacagaccaataacaagcaatgagattgaatcagtaatagaaaaaactgctgaaaacaacaaaaaagctcagggctagacagattcacatctgaattcaaaagactgaggagaaagaaatcctccctaactcatta

SEQ ID NO: 105596 - DNA, 601 bp, Human
aaacaaaatctgactttttgaaaatattttttaaaatcattagctatattaatcaagaaaagaagagagaagattcaaataagctcgattagaaatgaaaatggagacagtgcaactgacatcacagaaatactaaggatcatttgagtttcctgtagacacttctgtgcacacaaactagaaaatctagaggaagtggataaattcctggaaacaaacaactcctttagtttgaatcagaaagaaatagaattcctgaacagaccaataacaagcaatgagattgaatcagtaatagaaraaactgctgaaaacaacaaaaaagctcagggctagacagattcacatctgaattcaaaagactgaggagaaagaaatcctccctaactcattatacgaacccagtattaccctgatatcaaagccaggaaagaaaatattagtaaatgaaaactacagactaatatccccaaagaatatagatgcaaaaatcctcaacaaaatactagctgactgaatccaacagcactccaagaaaatcattcaccatgagcaagttggtttcattctagggatggttcaacatatgcgagtcaagaaa

SEQ ID NO: 105597 - DNA, 601 bp, Human
ctaaacagaattaaaaacaaaaaccatatgatcatctcagtagatgcagaaaaagcattaaacaaaatctagcattcttttctgataaaaaccctcaaccaactaggcatagaagaaatatatctcaaaataatagaagccatatatgacaaactcatggccaacattatactggaaggaaaaaagttgaaagcattccccctaagaactattacagaacaagacgaggatgcccattttcaccacttgtattcaacatcgtactgaaagtgctagccagagtaatcattgcaagataaaraaacaaagggcatccaaattggaaaagaaatcaaagtatctctgtttgccaatgatgcgatcttatagctagaaaaccctacacactcctccagaagactcctagatttgatgaatgaattcagtaaagtctcaggttacaaaaataaatgtacacaaattagtagcactgctatacaccaacagcaaccaagccgagaatccaatcaagaagtcaattcattttacaatggttacaaaaaaaaaataccgagaaatatacttaaccaaggagatgaaagatctctgcaaggataactac

SEQ ID NO: 105598 - DNA, 601 bp, Human
taaccaaggagatgaaagatctctgcaaggataactacaaaacattgctgaaagaaatcatagatgatgcaagcaaattgaaatacatctcatattcatgtattagaagaatcaatattgcaaaatgaccatactgaccaaagcagtctacaaattcaatgcaatttctattaaaataccagcatcattcttacagaattaggaaatataatcctaaaattcatacggaaccaaaaaagtgcctgaatagccaaatacatcctaagcaaaaagaataaatctaaaaatatcacattaccgracttcaaattatactacaaggctgtagtaacccaaacagcatggtagtggtataaaagtagatacatagatcaatggatcagaatagagaacccagaaataaagtgaagtacttacaactaattgatctttgacaaaccatacaaaaacataaactggggaaaacacatcctattcaataaatggtgctgggaaaattggattgcctaggtcgtgtagaagaatgaaactggatttctactctcaccatatacaaaaattagctctagatgggtttaagacttaaatctaagacttgaaa

SEQ ID NO: 105599 - DNA, 601 bp, Human
tctactctcaccatatacaaaaattagctctagatgggtttaagacttaaatctaagacttgaaatcataaaaattctagaagaaaatctatagaaaactcttctggacaatgatttaggtgactaaaacctcaatagtaaatgcaacaaaagcaaaaataaatggaacctaattaaactaaaaaacttctgcacagcaaaataaatactcatcagagtaaacagacagcctatagaatgggagaaaatatgtactaattatgcatctgacaaaggactaatatctaacttgggaaaaaakatttttaaaaaagttaatatctggaatctacgaggaaataaaacagatcagcaagaaaaaaaaaatgaataatatcattaaaaagtaggcaaaggggccgggcacagtggctcatgcctgtaatcccagcactttgggaatccgaagcaggaggatcacgaggtcaaaacatcaagaccatcctggccaacatggtgaaaccctgtttctactaaaaatacaaaagttagctgggtgcagttgcacgcacctgtagtcccagctactcaggaggctgaggcaggagaattcgcttgaacc

SEQ ID NO: 105600 - DNA, 601 bp, Human
aacagtatggagatttctcaaagaactaaaagtagatttaacctagcaatcccactgctgggtatctacccaaaggaaaagaagtcattatatcaaaaagacacctgcacacacatgtttatcacagcacaattcaaaatcacaaagatataaaatcaacctaaatgcccatcaaacaatgtgtggataaagaatatgtgatatacctgaggtcaggagttcgagaccagcctggacaacatgttgaaaccccatctctaccaaaaatacaaaaattaggtatggtggcaggcgcctgtawtcccagctactcaagaggctgaggcaggagaattgcttgaacctgggaggtggaggttgcagtgagccgagatcacgccactgcactccagcctgggcaacagagcaagactctgtctcaaaaaaaaaaaaagtgctatatcacatatatatatatgatatatgtaattgtggtgtgtggatatatacaccatggaaatatattcagccatgaaaaagagtgatataatgtcttttgcagtgacttggatggaattggaggccattattttatgtgaagtaacactcaggaatcaaaaat

SEQ ID NO: 105601 - DNA, 601 bp, Human
caaattacaacgaaatcaacccctgggggagctggtgatgtttgtagcacacattggtcactgccacccagataatccaagtcacttttttcaattgctgaacgatctgctgtgctacagccacaccgtcttggatccagaacttcaatgacattttgcaaatctttgatcttcctttgaaataagaatcacagcattcaaagagttgcagttacaagcttctcagaaggcttgtacactcagagtgtggctgatatcaagaatataaatgtaaaatacaagaacaataaagtgaatatargatttcagaattccacgcacacctaagagacagcaatgccatcacagctaaaatatccttgtgtgtaatgattgaactcaatggaagaaacatttggaatgctgcccaaactgtcagtgttatcttaagtgtgtgtttcactaaagtcaccaagatacaggctgctgctttgaaattcttctaaggaaacggggtggcaactcaggatctgagtatgaaggaccttccagcgtagatgccacagggaggagaagcttcaaacgcaaggctggaacaggctttggaagtgctgatactaga

SEQ ID NO: 105602 - DNA, 601 bp, Human
gccacccagataatccaagtcacttttttcaattgctgaacgatctgctgtgctacagccacaccgtcttggatccagaacttcaatgacattttgcaaatctttgatcttcctttgaaataagaatcacagcattcaaagagttgcagttacaagcttctcagaaggcttgtacactcagagtgtggctgatatcaagaatataaatgtaaaatacaagaacaataaagtgaatataggatttcagaattccacgcacacctaagagacagcaatgccatcacagctaaaatatccttgkgtgtaatgattgaactcaatggaagaaacatttggaatgctgcccaaactgtcagtgttatcttaagtgtgtgtttcactaaagtcaccaagatacaggctgctgctttgaaattcttctaaggaaacggggtggcaactcaggatctgagtatgaaggaccttccagcgtagatgccacagggaggagaagcttcaaacgcaaggctggaacaggctttggaagtgctgatactagaagaagaagaagaaataaaagaacagtagcagagatatttaaatttccagccattacttgatt

SEQ ID NO: 105603 - DNA, 601 bp, Human
gaggaatacacaaacataaagatgtgatcatttctgctaggattttgattctgttcttctgagtgccaaattctcagatactacagaagagattctgagacaagcctacagaggcctcaaaagaagcaagagtgcaagaatatggataactaaatgctacagattacatttcaggagggggaattctgaagtcaagaaagagaatgttgtgaacagtaaagaagggtggggaagtaccagtcctgaggaggagggagatgcccatggtgggtgggttgacgtgtgtcactcttctgtgaaraacagcagggactttccaaggaggtgcccagcatgcctgtggaggaggagggagccaaatctgctgccctcagcaccagttgccttctaagccaggaagacttccagaaaatctacatggcccaactgtataatgaacccagggctgccctgggaaagccacaaactgaaagatactgaaataaacagcattgatgggccaagagacaagttactgtcagttgaggatattgaacgctttaaaaaaaaaaaaaacactcatcttcaggaagactagccgctgcagtggctggaaagactg

SEQ ID NO: 105604 - DNA, 601 bp, Human
cctcagtccccagccccttcctacctcttgctcacccacaccctctcagtagccagtcttttccattttaggtttatccatcctccatttcatttgcaaaaaatgaccacatatatgttttcttaggctcccatcatacttacatgaggatagcatacggtaggtagtcttttgaactttactttttcactgaatagtatggccctcaaaattactccatattaattcataaacatcttccttattatttttcacagctgcatagtaccctattatgtggagttgccgtgattattcagcyattcacccatatatatgaacatttaagttgttctcactgttgtgcagttatgtcacaaagagtaacaattgcatatgtattttgtttttttttttggtttgcttttttttgttttttttgttttttttgtttttttttgaggcggagtctccctctgtcgcccaggctggagtgcagtggcgcagtcttagctcactgcaagctccgcctcccaggttcacgccattctcctgcctcagcctcccgagtagctgggactacaggcgcccgccaccatgccgggctaattttatgtatttt

SEQ ID NO: 105605 - DNA, 601 bp, Human
gcaaaaaatgaccacatatatgttttcttaggctcccatcatacttacatgaggatagcatacggtaggtagtcttttgaactttactttttcactgaatagtatggccctcaaaattactccatattaattcataaacatcttccttattatttttcacagctgcatagtaccctattatgtggagttgccgtgattattcagctattcacccatatatatgaacatttaagttgttctcactgttgtgcagttatgtcacaaagagtaacaattgcatatgtattttgtttttttttttggtttgcttttttttgttttttttgttttttttgtttttttttgaggcggagtctccctctgtcgcccaggctggagtgcagtggcgcagtcttagctcactgcaagctccgcctcccaggttcacgccattctcctgcctcagcctcccgagtagctgggactacaggcgcccgccaccatgccgggctaattttatgtatttttagtagagacggggtttcaccgtgttagccaggatggtctccatctcttgacctcgtgatccacccgcctcggcctcccaaagtgctgggattac

SEQ ID NO: 105606 - DNA, 601 bp, Human
cccatcatacttacatgaggatagcatacggtaggtagtcttttgaactttactttttcactgaatagtatggccctcaaaattactccatattaattcataaacatcttccttattatttttcacagctgcatagtaccctattatgtggagttgccgtgattattcagctattcacccatatatatgaacatttaagttgttctcactgttgtgcagttatgtcacaaagagtaacaattgcatatgtattttgtttttttttttggtttgcttttttttgttttttttgttttttttgtttttttttgaggcggagtctccctctgtcgcccaggctggagtgcagtggcgcagtcttagctcactgcaagctccgcctcccaggttcacgccattctcctgcctcagcctcccgagtagctgggactacaggcgcccgccaccatgccgggctaattttatgtatttttagtagagacggggtttcaccgtgttagccaggatggtctccatctcttgacctcgtgatccacccgcctcggcctcccaaagtgctgggattacaggcgtgagccacgtgcccggctgtattttgttt

SEQ ID NO: 105607 - DNA, 601 bp, Human
cttacatgaggatagcatacggtaggtagtcttttgaactttactttttcactgaatagtatggccctcaaaattactccatattaattcataaacatcttccttattatttttcacagctgcatagtaccctattatgtggagttgccgtgattattcagctattcacccatatatatgaacatttaagttgttctcactgttgtgcagttatgtcacaaagagtaacaattgcatatgtattttgtttttttttttggtttgcttttttttgttttttttgttttttttgtttttttttgaggcggagtctccctctgtcgcccaggctggagtgcagtggcgcagtcttagctcactgcaagctccgcctcccaggttcacgccattctcctgcctcagcctcccgagtagctgggactacaggcgcccgccaccatgccgggctaattttatgtatttttagtagagacggggtttcaccgtgttagccaggatggtctccatctcttgacctcgtgatccacccgcctcggcctcccaaagtgctgggattacaggcgtgagccacgtgcccggctgtattttgttttcttggagg

SEQ ID NO: 105608 - DNA, 601 bp, Human
cacagctgcatagtaccctattatgtggagttgccgtgattattcagctattcacccatatatatgaacatttaagttgttctcactgttgtgcagttatgtcacaaagagtaacaattgcatatgtattttgtttttttttttggtttgcttttttttgttttttttgttttttttgtttttttttgaggcggagtctccctctgtcgcccaggctggagtgcagtggcgcagtcttagctcactgcaagctccgcctcccaggttcacgccattctcctgcctcagcctcccgagtagmtgggactacaggcgcccgccaccatgccgggctaattttatgtatttttagtagagacggggtttcaccgtgttagccaggatggtctccatctcttgacctcgtgatccacccgcctcggcctcccaaagtgctgggattacaggcgtgagccacgtgcccggctgtattttgttttcttggaggtatatcctcagggtagattcctagaagtgggattgtggatatgtacatacttagttttgttcagttttatcaaattgtgctctagaagatggtaacaatttagattcccagcgg

SEQ ID NO: 105609 - DNA, 601 bp, Human
ttgcttgaacctgagaggcagaggttgcagtgagccgagatcacgccactacactccaacctgtgtgatagagtgagactctgtctccaaaaaagaaaaaaaagtccatctttaaacttgaaatgccgtcattatcatatactagatttccatgtctatcagagtctaattattactttatcccactagtccagtggtgtccagtcttttgccttccctgggccacactggaagaagaataattgtcttaggccccatataaaatacactaatgatagctgatgagctaaaaaaaaaattkcaaattaatctcataatgcttaaagacagtttacaaatttatgttgagctgaattcaaagctgtcctgggctgcatgcagccggcgggctacaggttggacaagcttgcactagtctgttcgtgtttccatgcctagataccacattcttttaattatagagacttcatggtatgttttaatgtctagtggggctggcctttcttgtgttttctttttccaagctattcttgtatgtttgtttttacatatgaacttttgcatcaatttgctcattctataacatagtttattggcatta

SEQ ID NO: 105610 - DNA, 601 bp, Human
cagtgagccgagatcacgccactacactccaacctgtgtgatagagtgagactctgtctccaaaaaagaaaaaaaagtccatctttaaacttgaaatgccgtcattatcatatactagatttccatgtctatcagagtctaattattactttatcccactagtccagtggtgtccagtcttttgccttccctgggccacactggaagaagaataattgtcttaggccccatataaaatacactaatgatagctgatgagctaaaaaaaaaattgcaaattaatctcataatgcttaaagamagtttacaaatttatgttgagctgaattcaaagctgtcctgggctgcatgcagccggcgggctacaggttggacaagcttgcactagtctgttcgtgtttccatgcctagataccacattcttttaattatagagacttcatggtatgttttaatgtctagtggggctggcctttcttgtgttttctttttccaagctattcttgtatgtttgtttttacatatgaacttttgcatcaatttgctcattctataacatagtttattggcattattactgtattgcattgaatttataaat

SEQ ID NO: 105611 - DNA, 601 bp, Human
aattgtcttaggccccatataaaatacactaatgatagctgatgagctaaaaaaaaaattgcaaattaatctcataatgcttaaagacagtttacaaatttatgttgagctgaattcaaagctgtcctgggctgcatgcagccggcgggctacaggttggacaagcttgcactagtctgttcgtgtttccatgcctagataccacattcttttaattatagagacttcatggtatgttttaatgtctagtggggctggcctttcttgtgttttctttttccaagctattcttgtatgtttktttttacatatgaacttttgcatcaatttgctcattctataacatagtttattggcattattactgtattgcattgaatttataaattaactctggaagaaatgacatcctataatgttgggtcaccctatccaagaatgcggaatgtcttttcatttattcaagtgtctttcagaagtattacaaatttttcctcatatatttttcacacacatcttattaaatgaatttctaaatttttaatcatctttgttgttattgtaaatggcactttctccactattatttattttaactttt

SEQ ID NO: 105612 - DNA, 601 bp, Human
cttgccttagggttaaaatacatcattttaccatgttaagacagcatccctcaatgcctattttctagaatgttcattgatcataaatgtgtgctgaattttgccaaatactttttcagcatctatgaagataatatgatttatttttattagattaattagtatgatgttaatcattcctcacttaaagtcaatcttgcattcctggaataaatctcactttatcaaggtatattattttcttaatgtggtgttgcgctgtgcttctttctggtacttctatttagaattttttgcattmatgagtaatactagcttatagtatttttttccttatgcttgcttttctcatttaagtatcagtgctaagcttacttactttcaatactctggaataatttacagagcattgtgactatccagcttttgaaagtttgttagaattcgcttgtgacaccatctgtgcttggttcttttatgtggggtagttttttaacttccccatttcttgtataaacacaggtctgatcaaactttctcatttaatgagatcaattttagcaatcactatttccctgtggaactgcctgtttcatcatgg

SEQ ID NO: 105613 - DNA, 601 bp, Human
acatcattttaccatgttaagacagcatccctcaatgcctattttctagaatgttcattgatcataaatgtgtgctgaattttgccaaatactttttcagcatctatgaagataatatgatttatttttattagattaattagtatgatgttaatcattcctcacttaaagtcaatcttgcattcctggaataaatctcactttatcaaggtatattattttcttaatgtggtgttgcgctgtgcttctttctggtacttctatttagaattttttgcattcatgagtaatactagcttawagtatttttttccttatgcttgcttttctcatttaagtatcagtgctaagcttacttactttcaatactctggaataatttacagagcattgtgactatccagcttttgaaagtttgttagaattcgcttgtgacaccatctgtgcttggttcttttatgtggggtagttttttaacttccccatttcttgtataaacacaggtctgatcaaactttctcatttaatgagatcaattttagcaatcactatttccctgtggaactgcctgtttcatcatggttttcaagcttatttgcag

SEQ ID NO: 105614 - DNA, 601 bp, Human
taaaaatcttttttgtcatatttaacgcttttgacttgaattccactttgtctgatatcaggatttttatcccagctcatttagtattcatttcctgcattacttttgtccattccttaagtggcttctcactaagtctcctcatctgtcctctccgtggccttcactcaccataattcctgtgatggagcaggtgtgtgagaagttgtagtcctggcacttgttaatttttctccctcaactcacagttctgcctttaagtaatgcaagggtgtgtttttctttctttctttctcttttyttttttttttttttttttttgagatggggtcttgctctgtctcccaggctggagtgcagtggtgcgatcttggctcgctgcaagctccaccccccaggtgcaagctccaccccccaggttgacgccattctcctgcctcagcctcctgagtagctgagactacaggagcccaccaccatgctcggctaattttttgtatttttagtagagacggggtttcaccgtgttagccaggatggtctcgatctcctgacctcgtgatccaccggcctcggccttccaaagtgctgggattatggg

SEQ ID NO: 105615 - DNA, 601 bp, Human
taaaagtgatcatctggctgggtgcagtggctcatgcctgtaatcccagcactttgggaggcagaggtgggcggatcacttgaggccaggagttcaagactagcctgggcaacatggcaaaactccatctctactaaaaatacaaaagtcagccgggtgcctatagtctcagctattcaggaagctgaggcaggagaatcgcttgaacccgggaggcggaggttgcagtgagctgagatcatgccactgcactccagcctgggcgacagagcgagaccctgtctttaaaaaaaaaaaaaaagtgatcatcttacagcatttttggaaggctgtgtaagttttgcatatgattatcagggacatttactagaaataacctaagtttcactggcatagcataactagctttgtctgctcaggaaattctcaagcctggtctcttattttatttcattttattttatttaacacaagtaaaggtcattagtgccaggcttatgaagtagaactgtataatacaagattttgccacaaaagtagtagagctaacaagcacagctttgtgcttccagcccagtcctttctctgtgataccacattt

SEQ ID NO: 105616 - DNA, 601 bp, Human
agtctcgctctgttgcccaagctggagtgcagtggcctgatctcagctcattgcaacctccacctcccgggttcaagcaattctcctgcctcagcctccccagtagctgggactacaggcgcacgccgccacacccagctaatttttatattttcagcagaaacggggtttcaccgtgttgcccaggttgtcgcgaactcctgatgagctcaggcaatctgcccgcctcggcttcccaaagtgctgggattacaggcgtaagccaccgcgcccagcaggaagcatgaactctttcttccamatcagttgcaggcatcgcgtctccggacgctgctcttagcctcgatggatggaccatggattcctagtcaagactctctcatgcttgcatcccaatgcttagcaaattgtcctgaaaccaggcttacatgcttttctttttagtgaaccacagaattctttaagctgtgagctatatctcactcatttgcacattgtcaatgcttagcacagaaccttgtacataaaaagcatgcaatagatttgtattgaatggaaccattcactttcctgcattttctttgatttgaggaacagttta

SEQ ID NO: 105617 - DNA, 601 bp, Human
tctgttgcccaagctggagtgcagtggcctgatctcagctcattgcaacctccacctcccgggttcaagcaattctcctgcctcagcctccccagtagctgggactacaggcgcacgccgccacacccagctaatttttatattttcagcagaaacggggtttcaccgtgttgcccaggttgtcgcgaactcctgatgagctcaggcaatctgcccgcctcggcttcccaaagtgctgggattacaggcgtaagccaccgcgcccagcaggaagcatgaactctttcttccaaatcagttkcaggcatcgcgtctccggacgctgctcttagcctcgatggatggaccatggattcctagtcaagactctctcatgcttgcatcccaatgcttagcaaattgtcctgaaaccaggcttacatgcttttctttttagtgaaccacagaattctttaagctgtgagctatatctcactcatttgcacattgtcaatgcttagcacagaaccttgtacataaaaagcatgcaatagatttgtattgaatggaaccattcactttcctgcattttctttgatttgaggaacagtttatgtggatt

SEQ ID NO: 105618 - DNA, 601 bp, Human
tgcaatagatttgtattgaatggaaccattcactttcctgcattttctttgatttgaggaacagtttatgtggatttgctgctcagacttactatgaaaataaacttatttgttgactattttattgatataataactatagaaaaaaaattgtcacagttcaaccccttatacttaataaggcctcctagaattgtaagatgaacctctagtgagcaaaacagtgaactcttactggattaattattccaattatttctcaattttaaagtcagataacttgatagtcaccattaaatgyaaatcagtgtttatataataaatacataggcatatcagtgacccagaagagataaacaggaactctgagtctcagatggggaaaataacattacaaataccaaaaaataaagtgaagcttttaaaaaaaaaaaggagatgtaacatagagaaaaaagtcaactttataactggcactcttgccaaaaatatttatttatttaaatgaagactcactggagggttttaaatacaaattaataaaattaagaacacttggatgaccatgtccaaaacggatcaatgcattaatagaaaggct

SEQ ID NO: 105619 - DNA, 601 bp, Human
gtcaccattaaatgcaaatcagtgtttatataataaatacataggcatatcagtgacccagaagagataaacaggaactctgagtctcagatggggaaaataacattacaaataccaaaaaataaagtgaagcttttaaaaaaaaaaaggagatgtaacatagagaaaaaagtcaactttataactggcactcttgccaaaaatatttatttatttaaatgaagactcactggagggttttaaatacaaattaataaaattaagaacacttggatgaccatgtccaaaacggatcaatgcrttaatagaaaggctttacttaatgtctaccaggtatccaaaaatttttatgagaactgttagggtcagaggggacacacacaaaaaaaattataacatatgacttattttctcaacttccttttttttttttttttttggagaggtagtctcactctgtcgcccaggctggagtgcagtggcgtgatctcggctcactgcaagctccgcctcccaggttcatgccattctcccgcctcagcctcccgagtagttgggactacagatgcctgccagcacacccagctaattttttgtattt

SEQ ID NO: 105620 - DNA, 601 bp, Human
gtctcagatggggaaaataacattacaaataccaaaaaataaagtgaagcttttaaaaaaaaaaaggagatgtaacatagagaaaaaagtcaactttataactggcactcttgccaaaaatatttatttatttaaatgaagactcactggagggttttaaatacaaattaataaaattaagaacacttggatgaccatgtccaaaacggatcaatgcattaatagaaaggctttacttaatgtctaccaggtatccaaaaatttttatgagaactgttagggtcagaggggacacacacamaaaaaattataacatatgacttattttctcaacttccttttttttttttttttttggagaggtagtctcactctgtcgcccaggctggagtgcagtggcgtgatctcggctcactgcaagctccgcctcccaggttcatgccattctcccgcctcagcctcccgagtagttgggactacagatgcctgccagcacacccagctaattttttgtatttttagtagagactgggtttcaccgtgttagccaggatggtctcgatctcctgacctcatgatccgcctgcctcggcctcccaaa

SEQ ID NO: 105621 - DNA, 601 bp, Human
ctatttactgtagatgagaaggaagttgtggttggtacagataaacttcgagtaactggtatgtactaactcgagaaaaacacaacattccatggagtacacatctgcaaaaacacattgtactattgacaagtttatgtggaatctttcaagcagataagagagtttgaatgtgttgcattttctccattgcatttctgttgaactccctcgatgctctcctagaagaacaaaatcctccccacagatcttggcccacccttcttccatcacagttttaccctttgtcccttccttcctyccttccttcttttttttttctttttagacagagtctcgctctgttgcccaggctggagtgcagtagcacaatctcggctcactgcaacctttgcctcctgggttcaagcaattctcctgcctcagcctcccgagtagctgagactacaggcacccgccaccatgcctggctaatttttgtatttttcgtagaggcagggtttctccatgttggccaggctggtctcaaactcctgacctcaaatgattcacccaccttggcctcccaaagtgctgggattacaggtgtgagccacaacac

SEQ ID NO: 105622 - DNA, 601 bp, Human
gagaagagaaaattttatgaaaaaaatgtttcagaacatattctaaattcacttgccaaagactagaagacacaggcagatacttgttaaatctatcccagtgcctttctgtactactgtgaaaaccaatagcaatgttattgtctcacacaatactaccaatactcccaaatgaaaaagaaataatatttcctggccaaggaagtagactccaccctattacaggccctaacaaactataaagatcataacctaatgttgcatactctaagacagtaatgtatctggttttgttactaamatgaaggacactagcgcatttaattaacggaaattggtaattgtccaacaaagcaccttaagcatcagaaatgcactgttgtgtaggataaagaatatgggctgggtagacttggattccattcctacctctgcaattactagctgcgtaatttcaagcaagttaatttttattttctgtttcctaacttctaaaagtgagttgataatatcaactgtactatcattgctgggttaagtggattaaatgtgcaaaggacagcagagttcttggtagagtatcattgtactgcagggcagt

SEQ ID NO: 105623 - DNA, 601 bp, Human
ctgggggccaggcagagtggttcacacctgtaatcccagcactttgggaggctgaggtggatggatcgcttgagctcatgagtttaagaccagcctggacaacatggcgaaaccccatctctacaaaagaaaaagtacaaaaattatccaggcgtagtggtgcgtgcctgtggtcccagctacttgggaggctgaggtgggaggatcacctgagcctgggaggcagaggttgcagtgagcagagattgagccactgcactccagcctgggcaacagagtgagaccgtgtctcagtaataayaataataataataataataataataataataataatagtgctgggcctcatccccagagcttctgattcagcaggtctgaaatgtgacttgagaatctgtgtttctagagagtccccagttgctgctgatgccacagctctggggaccacactttgagaaccactgctgtggactaacatgaatcagcaggagaaacaacaggtcagcaacatgttgacgctctctgtagaagagcagtccccaaccattttggcaccagggactggtttcatggaagaaaatgttttcacagtgtggga

SEQ ID NO: 105624 - DNA, 601 bp, Human
aaccccatctctacaaaagaaaaagtacaaaaattatccaggcgtagtggtgcgtgcctgtggtcccagctacttgggaggctgaggtgggaggatcacctgagcctgggaggcagaggttgcagtgagcagagattgagccactgcactccagcctgggcaacagagtgagaccgtgtctcagtaataataataataataataataataataataataataataatagtgctgggcctcatccccagagcttctgattcagcaggtctgaaatgtgacttgagaatctgtgtttctagaragtccccagttgctgctgatgccacagctctggggaccacactttgagaaccactgctgtggactaacatgaatcagcaggagaaacaacaggtcagcaacatgttgacgctctctgtagaagagcagtccccaaccattttggcaccagggactggtttcatggaagaaaatgttttcacagtgtgggagatggttttgggatgaaactactccacctcagatcatcaggtattagattctcatcaggagcacgcaacctagatcccttacacatacagttcacagtagggttcgcact

SEQ ID NO: 105625 - DNA, 601 bp, Human
agtgagcagagattgagccactgcactccagcctgggcaacagagtgagaccgtgtctcagtaataataataataataataataataataataataataataatagtgctgggcctcatccccagagcttctgattcagcaggtctgaaatgtgacttgagaatctgtgtttctagagagtccccagttgctgctgatgccacagctctggggaccacactttgagaaccactgctgtggactaacatgaatcagcaggagaaacaacaggtcagcaacatgttgacgctctctgtagaasagcagtccccaaccattttggcaccagggactggtttcatggaagaaaatgttttcacagtgtgggagatggttttgggatgaaactactccacctcagatcatcaggtattagattctcatcaggagcacgcaacctagatcccttacacatacagttcacagtagggttcgcactcctatgagaatctaatgcctctactgatctgataggaggcggggctcaggcagtaacgctcgctggcccactgctcacctcctgctgtgaggcccagttcctaacaggccacaggccagtatc

SEQ ID NO: 105626 - DNA, 601 bp, Human
ataataataataataataataataataataataatagtgctgggcctcatccccagagcttctgattcagcaggtctgaaatgtgacttgagaatctgtgtttctagagagtccccagttgctgctgatgccacagctctggggaccacactttgagaaccactgctgtggactaacatgaatcagcaggagaaacaacaggtcagcaacatgttgacgctctctgtagaagagcagtccccaaccattttggcaccagggactggtttcatggaagaaaatgttttcacagtgtgggagwtggttttgggatgaaactactccacctcagatcatcaggtattagattctcatcaggagcacgcaacctagatcccttacacatacagttcacagtagggttcgcactcctatgagaatctaatgcctctactgatctgataggaggcggggctcaggcagtaacgctcgctggcccactgctcacctcctgctgtgaggcccagttcctaacaggccacaggccagtatccgtctatggcccagggatccagagtccctgctctagaacatgctttcaagttatccttttaaaggacaa

SEQ ID NO: 105627 - DNA, 601 bp, Human
ctttgttcattccttttcattcttttttctctaatcttgtcttcatgctttatttgattaagttgatcttcaatctctgatatcctttcttctgattgatcaattcggctattgatacttgtgtatgcttcacaaagttctcatgctgtgttttcagctccatcaggtcatttatgttcttctctaaactggttattctagtagcaactcctctaaccttttttcaaggttcttagcttccttgcattgggttataacatgctcctttagctcagacaagcttgttattactcaccttccraagcctacttctgttcaattcatcaaactcattctctgtccagttttgttcccttgctggcaaggagttgtgatcctttggaggagaagaggcattctggtttttggaattttcagcctttttatgctggtttttccttatcttcctggatttatctacctttgctctttgatgttggtgacctttggatggggtttcatgtagacgtcctttttgttgatgttgatgctattcctttctgtttgttagttttccttctaacagtcaggcccctctgctgcaggtctgctagagtttgct

SEQ ID NO: 105628 - DNA, 601 bp, Human
ctagtagcaactcctctaaccttttttcaaggttcttagcttccttgcattgggttataacatgctcctttagctcagacaagcttgttattactcaccttccgaagcctacttctgttcaattcatcaaactcattctctgtccagttttgttcccttgctggcaaggagttgtgatcctttggaggagaagaggcattctggtttttggaattttcagcctttttatgctggtttttccttatcttcctggatttatctacctttgctctttgatgttggtgacctttggatggggtttcatgtagacgtcctttttgttgatgttgatgctattcctttctgtttgttagttttccttctaacagtcaggcccctctgctgcaggtctgctagagtttgctggacgtccactccagcccctgtttgcctggatatcaccagtggaggctgcagaacagcaaagactgctacttgttccttcctctggaagtttcgtcccagaggggaacctgccagatgccaggcggagctctcctgtatgaggtgtctgtcgacccctgctgggaggtgtctcccagtcaggaggcacaggggtcag

SEQ ID NO: 105629 - DNA, 601 bp, Human
tgctggtttttccttatcttcctggatttatctacctttgctctttgatgttggtgacctttggatggggtttcatgtagacgtcctttttgttgatgttgatgctattcctttctgtttgttagttttccttctaacagtcaggcccctctgctgcaggtctgctagagtttgctggacgtccactccagcccctgtttgcctggatatcaccagtggaggctgcagaacagcaaagactgctacttgttccttcctctggaagtttcgtcccagaggggaacctgccagatgccaggcrgagctctcctgtatgaggtgtctgtcgacccctgctgggaggtgtctcccagtcaggaggcacaggggtcagggacccacttgaggaggcagtctgtaccttagaatagctcaagcgctgtgctgggagatccgctgctctcttcagagctggcaggcaggaacatttaagtctgctgaagctgcacccacagccgccccttcccccaggtgctgtcccagggagatgggagttttatctataactccctgactggggctactgcctttctttcagagatgccctgcccagagaggagga

SEQ ID NO: 105630 - DNA, 601 bp, Human
gctacttgttccttcctctggaagtttcgtcccagaggggaacctgccagatgccaggcggagctctcctgtatgaggtgtctgtcgacccctgctgggaggtgtctcccagtcaggaggcacaggggtcagggacccacttgaggaggcagtctgtaccttagaatagctcaagcgctgtgctgggagatccgctgctctcttcagagctggcaggcaggaacatttaagtctgctgaagctgcacccacagccgccccttcccccaggtgctgtcccagggagatgggagttttatctrtaactccctgactggggctactgcctttctttcagagatgccctgcccagagaggaggaatctagagaggctgtctggctacagcagctttgtcgaggctcggtggggatccacctaggtcaaccttctcagcggctttgtttgcactgtgaggggaaaactgctaactcaaacctcagtaatggtggacgcccctcccctcaccaagcccaagtgtcccaggtcaactttagactgctgtgttggcagcaagaatttcaagccaatggatcttagcttactaggctccatggggatggg

SEQ ID NO: 105631 - DNA, 601 bp, Human
agcgctgtgctgggagatccgctgctctcttcagagctggcaggcaggaacatttaagtctgctgaagctgcacccacagccgccccttcccccaggtgctgtcccagggagatgggagttttatctataactccctgactggggctactgcctttctttcagagatgccctgcccagagaggaggaatctagagaggctgtctggctacagcagctttgtcgaggctcggtggggatccacctaggtcaaccttctcagcggctttgtttgcactgtgaggggaaaactgctaactcaarcctcagtaatggtggacgcccctcccctcaccaagcccaagtgtcccaggtcaactttagactgctgtgttggcagcaagaatttcaagccaatggatcttagcttactaggctccatggggatgggatccgctaagctagaccaattggctccctggcttcagccccctttccaggagaatgaatggttctgtcttgctggcattccaggtgccactgtggtatgaaaaaaaactcctgcagctagctcagtgtctgtccaaatgaccacccagttttgtgcttgaaatccagggccct

SEQ ID NO: 105632 - DNA, 601 bp, Human
tgtgctgggagatccgctgctctcttcagagctggcaggcaggaacatttaagtctgctgaagctgcacccacagccgccccttcccccaggtgctgtcccagggagatgggagttttatctataactccctgactggggctactgcctttctttcagagatgccctgcccagagaggaggaatctagagaggctgtctggctacagcagctttgtcgaggctcggtggggatccacctaggtcaaccttctcagcggctttgtttgcactgtgaggggaaaactgctaactcaaacctcrgtaatggtggacgcccctcccctcaccaagcccaagtgtcccaggtcaactttagactgctgtgttggcagcaagaatttcaagccaatggatcttagcttactaggctccatggggatgggatccgctaagctagaccaattggctccctggcttcagccccctttccaggagaatgaatggttctgtcttgctggcattccaggtgccactgtggtatgaaaaaaaactcctgcagctagctcagtgtctgtccaaatgaccacccagttttgtgcttgaaatccagggccctggtgg

SEQ ID NO: 105633 - DNA, 601 bp, Human
cccttggctaggcgagggagttctccaaccccttgcacttcccaagtgaggcaacaccccaccctgctttggctcaccctccgtgggctgcacccactgtctaaccagtcccaatgagatgagccaggtacctcagttggaaatgcagaaatcacccatcttctgcattaatctcgctgggagctgcagaccggagctgttcctgtttggccatcttgccagacaccaccaaccaacaatgggtaactttttgagaattagactgagttccaatcccagctgttccattaagtaagcacaygacctcaaatgaatatttcacctctcagtgctttatactacaaagatctgtagccactggtctctcaccattacaggacagtatacagaattcaacaaagcagatgcaaattgatcgtgaaattaaattgcatgtcttgcaaaagatgtagggtttaggaagtcagaaatgatgagaaatactggaattgctggcaaagccactaacaaaagaccaggaaagttagacttgccagcaactaaagaagtgaaaatcagccatgatgatgacatgatagtcatttcaaagatcggtaacctt

SEQ ID NO: 105634 - DNA, 601 bp, Human
cagtcccaatgagatgagccaggtacctcagttggaaatgcagaaatcacccatcttctgcattaatctcgctgggagctgcagaccggagctgttcctgtttggccatcttgccagacaccaccaaccaacaatgggtaactttttgagaattagactgagttccaatcccagctgttccattaagtaagcacatgacctcaaatgaatatttcacctctcagtgctttatactacaaagatctgtagccactggtctctcaccattacaggacagtatacagaattcaacaaagcagaygcaaattgatcgtgaaattaaattgcatgtcttgcaaaagatgtagggtttaggaagtcagaaatgatgagaaatactggaattgctggcaaagccactaacaaaagaccaggaaagttagacttgccagcaactaaagaagtgaaaatcagccatgatgatgacatgatagtcatttcaaagatcggtaaccttaacttcacaagattaatattcactcttgtgatgactgacaatgccctcaatttaactattacagttgttcctcattatcttcaggggatacgttcaaagagcccc

SEQ ID NO: 105635 - DNA, 601 bp, Human
ggcaaagccactaacaaaagaccaggaaagttagacttgccagcaactaaagaagtgaaaatcagccatgatgatgacatgatagtcatttcaaagatcggtaaccttaacttcacaagattaatattcactcttgtgatgactgacaatgccctcaatttaactattacagttgttcctcattatcttcaggggatacgttcaaagagccccaggggatacctcaagctgcagatagtactaaaccctatatatgctgcactgtgttttttcttatacatacatactgtgataaagttcrgtttataaatgagacccagtaagagattaacaacaatagctcataataaaataaagcaattataaaaatatactgtaataaaagttgtgtgaatgtcatctctctctctgtctcagaatatcttatttgactgtcctcacccttcttgtgatgatgtgagatgagaaaatgcctacatgataagatgacccgaggtgaatgatacaggattgtgtatagtgcttaacacttatgaattgtttatttctggaattttccatttaatattttaggacggtgggtaactgaaacctcagagag

SEQ ID NO: 105636 - DNA, 601 bp, Human
acttcacaagattaatattcactcttgtgatgactgacaatgccctcaatttaactattacagttgttcctcattatcttcaggggatacgttcaaagagccccaggggatacctcaagctgcagatagtactaaaccctatatatgctgcactgtgttttttcttatacatacatactgtgataaagttcggtttataaatgagacccagtaagagattaacaacaatagctcataataaaataaagcaattataaaaatatactgtaataaaagttgtgtgaatgtcatctctctctccgtctcagaatatcttatttgactgtcctcacccttcttgtgatgatgtgagatgagaaaatgcctacatgataagatgacccgaggtgaatgatacaggattgtgtatagtgcttaacacttatgaattgtttatttctggaattttccatttaatattttaggacggtgggtaactgaaacctcagagagcaaaattgcagaaagtaaaactgtgataaggggggactattgaattatagctttatcgccaatggtaaacatttagtgaacaatgtcctattgtgccactagggtaggc

SEQ ID NO: 105637 - DNA, 601 bp, Human
aaataaagcaattataaaaatatactgtaataaaagttgtgtgaatgtcatctctctctctgtctcagaatatcttatttgactgtcctcacccttcttgtgatgatgtgagatgagaaaatgcctacatgataagatgacccgaggtgaatgatacaggattgtgtatagtgcttaacacttatgaattgtttatttctggaattttccatttaatattttaggacggtgggtaactgaaacctcagagagcaaaattgcagaaagtaaaactgtgataaggggggactattgaattatrgctttatcgccaatggtaaacatttagtgaacaatgtcctattgtgccactagggtaggcagaattctaaggatgcccccactgagccctgtatatttccttctcctttcagtgtggatggaatctgtaaatatgagatgtctctcctgtgattatgtcacttatatggtaagaggaaggtaatctgggtagcccaatctatcccatgagccctttataaccagagaggttaatctggctggtagtagagggggaagtcagataaattggaaaagcaagaaaaattcactgctgtgttgc

SEQ ID NO: 105638 - DNA, 601 bp, Human
ttgtgtatagtgcttaacacttatgaattgtttatttctggaattttccatttaatattttaggacggtgggtaactgaaacctcagagagcaaaattgcagaaagtaaaactgtgataaggggggactattgaattatagctttatcgccaatggtaaacatttagtgaacaatgtcctattgtgccactagggtaggcagaattctaaggatgcccccactgagccctgtatatttccttctcctttcagtgtggatggaatctgtaaatatgagatgtctctcctgtgattatgtcayttatatggtaagaggaaggtaatctgggtagcccaatctatcccatgagccctttataaccagagaggttaatctggctggtagtagagggggaagtcagataaattggaaaagcaagaaaaattcactgctgtgttgctgaaggaagaaagagggaccatgtgacaagaagtggtggcctctagaaagggaaagaggcccttggctggcagcaggaaacaagaaatgagcctcagtcttgcaagcacaaagaactgaatgaattctgccaacacctgcatgacacagaaggtagagtct

SEQ ID NO: 105639 - DNA, 601 bp, Human
gtgcttaacacttatgaattgtttatttctggaattttccatttaatattttaggacggtgggtaactgaaacctcagagagcaaaattgcagaaagtaaaactgtgataaggggggactattgaattatagctttatcgccaatggtaaacatttagtgaacaatgtcctattgtgccactagggtaggcagaattctaaggatgcccccactgagccctgtatatttccttctcctttcagtgtggatggaatctgtaaatatgagatgtctctcctgtgattatgtcacttatatggyaagaggaaggtaatctgggtagcccaatctatcccatgagccctttataaccagagaggttaatctggctggtagtagagggggaagtcagataaattggaaaagcaagaaaaattcactgctgtgttgctgaaggaagaaagagggaccatgtgacaagaagtggtggcctctagaaagggaaagaggcccttggctggcagcaggaaacaagaaatgagcctcagtcttgcaagcacaaagaactgaatgaattctgccaacacctgcatgacacagaaggtagagtctggccctggg

SEQ ID NO: 105640 - DNA, 601 bp, Human
aaacctcagagagcaaaattgcagaaagtaaaactgtgataaggggggactattgaattatagctttatcgccaatggtaaacatttagtgaacaatgtcctattgtgccactagggtaggcagaattctaaggatgcccccactgagccctgtatatttccttctcctttcagtgtggatggaatctgtaaatatgagatgtctctcctgtgattatgtcacttatatggtaagaggaaggtaatctgggtagcccaatctatcccatgagccctttataaccagagaggttaatctggmtggtagtagagggggaagtcagataaattggaaaagcaagaaaaattcactgctgtgttgctgaaggaagaaagagggaccatgtgacaagaagtggtggcctctagaaagggaaagaggcccttggctggcagcaggaaacaagaaatgagcctcagtcttgcaagcacaaagaactgaatgaattctgccaacacctgcatgacacagaaggtagagtctggccctgggcttccagacgagagccctgccttgctgacacctgtgagaccctgagcacagaacctggtcagacactct

SEQ ID NO: 105641 - DNA, 601 bp, Human
cctgaaaccaacagagctgtgagctaacacatgaggatcgttttaagtagctaagtttgccataattcctaacagaaatagaagactaaatagagccatcctacaactccaactatgtttgaaaaagtgacaccaaaaaacttgacttattcttttttatttcatataatttcacagttttttgttaccattatgaccagggttttttgtttgtttgtttgtttgttttgttttgttttgagacagcgtcttgctctgtggccaggctgggtgtagtggcacgatctcagctcactgcaamctttgcctcctgggttcaagcaattcccctgcctcatcctcccgagtagctgagaatacaggctcatgtcaccacgcccagctaatttttgaattttcagaagagatggggtttcaccatgttagccaggatggtcttgatctcttgacctcgtgatctgcccgcctcagcctcctaaagtgctgggattacaggcgtgagccactgcgcccagccaataagaatgtttttataagctttaatgcttccacacaaattcccattaaaacttttctccactacctgtgataacagttgggt

SEQ ID NO: 105642 - DNA, 601 bp, Human
attcctaacagaaatagaagactaaatagagccatcctacaactccaactatgtttgaaaaagtgacaccaaaaaacttgacttattcttttttatttcatataatttcacagttttttgttaccattatgaccagggttttttgtttgtttgtttgtttgttttgttttgttttgagacagcgtcttgctctgtggccaggctgggtgtagtggcacgatctcagctcactgcaacctttgcctcctgggttcaagcaattcccctgcctcatcctcccgagtagctgagaatacaggckcatgtcaccacgcccagctaatttttgaattttcagaagagatggggtttcaccatgttagccaggatggtcttgatctcttgacctcgtgatctgcccgcctcagcctcctaaagtgctgggattacaggcgtgagccactgcgcccagccaataagaatgtttttataagctttaatgcttccacacaaattcccattaaaacttttctccactacctgtgataacagttgggtccctatttcaagtggattgactccaggtagcctttggagtttctcaggtcagcaaacgcaacag

SEQ ID NO: 105643 - DNA, 601 bp, Human
tgctctgtggccaggctgggtgtagtggcacgatctcagctcactgcaacctttgcctcctgggttcaagcaattcccctgcctcatcctcccgagtagctgagaatacaggctcatgtcaccacgcccagctaatttttgaattttcagaagagatggggtttcaccatgttagccaggatggtcttgatctcttgacctcgtgatctgcccgcctcagcctcctaaagtgctgggattacaggcgtgagccactgcgcccagccaataagaatgtttttataagctttaatgcttccayacaaattcccattaaaacttttctccactacctgtgataacagttgggtccctatttcaagtggattgactccaggtagcctttggagtttctcaggtcagcaaacgcaacagtagttgacagccaaggaaagagaagtgataggaaaagagacgggcagcctcactctgaggactggaaagaaaattcaattctttgcttcttttctccgcccttgtcacttgcacagcagcccatagctctggtgaaaggggaagataaggtggctctctccttaagatggtgcactcgaaactcctg

SEQ ID NO: 105644 - DNA, 601 bp, Human
taattactcaaataagctaaaacctctctttaattcttaaacagcttccatttagattttagtcaactaggatactgaataatagtttttaagcgaaatttatggaagcgattaaacaatttcagcagttcagtctgaaaccaatttaggcctttaagcaggctcatcttcctcccccacaaaattagacaccaagtggccaaagttaacatttcttttattaactcaagttacagaacatactattggaataacatcaaaatgttgtcttcaaaaaactattctacaccattgccagaaytgacttctggcagatgacaaattgttagtttggctgccctaagtgtattttagctccctggcaacaatttgctaggctcagtccatttcccaatattatctttaaaaacagagttctataatagtatccatttcccaccactaataagaaaaaataagatctagcaatagtcccaattccatttctttatgccttctgtgcagctaagcaagatcacataaagtcaaaagtgatagtgtagaaatgccagagtcacccataaagccagtgacaaaaatggacctggagaacaaagtgttc

SEQ ID NO: 105645 - DNA, 601 bp, Human
aacatactattggaataacatcaaaatgttgtcttcaaaaaactattctacaccattgccagaactgacttctggcagatgacaaattgttagtttggctgccctaagtgtattttagctccctggcaacaatttgctaggctcagtccatttcccaatattatctttaaaaacagagttctataatagtatccatttcccaccactaataagaaaaaataagatctagcaatagtcccaattccatttctttatgccttctgtgcagctaagcaagatcacataaagtcaaaagtgataktgtagaaatgccagagtcacccataaagccagtgacaaaaatggacctggagaacaaagtgttcagcaactgaagaagtgaaaataaacaaggatgttaagtcgaaaaagacgtgaagacagatatctggaaggtgcttttaggagtaccatatccttcaaacacatacccaagggcacagaacactgtctgatgcagcactgcacgcagcgatcaacgccgtgctgcagtccatggtatttcagctgaaaggaacaagagtcccaattaaaacaggcttaaactggaaggacatgtatt

SEQ ID NO: 105646 - DNA, 601 bp, Human
tagctccctggcaacaatttgctaggctcagtccatttcccaatattatctttaaaaacagagttctataatagtatccatttcccaccactaataagaaaaaataagatctagcaatagtcccaattccatttctttatgccttctgtgcagctaagcaagatcacataaagtcaaaagtgatagtgtagaaatgccagagtcacccataaagccagtgacaaaaatggacctggagaacaaagtgttcagcaactgaagaagtgaaaataaacaaggatgttaagtcgaaaaagacgtraagacagatatctggaaggtgcttttaggagtaccatatccttcaaacacatacccaagggcacagaacactgtctgatgcagcactgcacgcagcgatcaacgccgtgctgcagtccatggtatttcagctgaaaggaacaagagtcccaattaaaacaggcttaaactggaaggacatgtattatctcacataggaaggctggggaaagggtaactccaggttgttgattaatttagtagccaagtaatattttacgctacctttcttctctgcaagtatgttgatatttcccttttg

SEQ ID NO: 105647 - DNA, 601 bp, Human
gaaaaaataagatctagcaatagtcccaattccatttctttatgccttctgtgcagctaagcaagatcacataaagtcaaaagtgatagtgtagaaatgccagagtcacccataaagccagtgacaaaaatggacctggagaacaaagtgttcagcaactgaagaagtgaaaataaacaaggatgttaagtcgaaaaagacgtgaagacagatatctggaaggtgcttttaggagtaccatatccttcaaacacatacccaagggcacagaacactgtctgatgcagcactgcacgcagcratcaacgccgtgctgcagtccatggtatttcagctgaaaggaacaagagtcccaattaaaacaggcttaaactggaaggacatgtattatctcacataggaaggctggggaaagggtaactccaggttgttgattaatttagtagccaagtaatattttacgctacctttcttctctgcaagtatgttgatatttcccttttgggttgcaaaatgattccatcaattgcaaacatcacttgcctctgcaaagacttctctaaacatctatctataagagggcctcagtgatttggcatct

SEQ ID NO: 105648 - DNA, 601 bp, Human
tcacccataaagccagtgacaaaaatggacctggagaacaaagtgttcagcaactgaagaagtgaaaataaacaaggatgttaagtcgaaaaagacgtgaagacagatatctggaaggtgcttttaggagtaccatatccttcaaacacatacccaagggcacagaacactgtctgatgcagcactgcacgcagcgatcaacgccgtgctgcagtccatggtatttcagctgaaaggaacaagagtcccaattaaaacaggcttaaactggaaggacatgtattatctcacataggaaggstggggaaagggtaactccaggttgttgattaatttagtagccaagtaatattttacgctacctttcttctctgcaagtatgttgatatttcccttttgggttgcaaaatgattccatcaattgcaaacatcacttgcctctgcaaagacttctctaaacatctatctataagagggcctcagtgatttggcatcttaagttactctcccagctgaaatttttctcagattaaattatttgaatttcttttgtatgtggcgtttggctggatttattgtttataacataatttattttgag

SEQ ID NO: 105649 - DNA, 601 bp, Human
ggacctggagaacaaagtgttcagcaactgaagaagtgaaaataaacaaggatgttaagtcgaaaaagacgtgaagacagatatctggaaggtgcttttaggagtaccatatccttcaaacacatacccaagggcacagaacactgtctgatgcagcactgcacgcagcgatcaacgccgtgctgcagtccatggtatttcagctgaaaggaacaagagtcccaattaaaacaggcttaaactggaaggacatgtattatctcacataggaaggctggggaaagggtaactccaggttgtygattaatttagtagccaagtaatattttacgctacctttcttctctgcaagtatgttgatatttcccttttgggttgcaaaatgattccatcaattgcaaacatcacttgcctctgcaaagacttctctaaacatctatctataagagggcctcagtgatttggcatcttaagttactctcccagctgaaatttttctcagattaaattatttgaatttcttttgtatgtggcgtttggctggatttattgtttataacataatttattttgagttttaatgtggaatttaaaactcaca

SEQ ID NO: 105650 - DNA, 601 bp, Human
ggcttaaactggaaggacatgtattatctcacataggaaggctggggaaagggtaactccaggttgttgattaatttagtagccaagtaatattttacgctacctttcttctctgcaagtatgttgatatttcccttttgggttgcaaaatgattccatcaattgcaaacatcacttgcctctgcaaagacttctctaaacatctatctataagagggcctcagtgatttggcatcttaagttactctcccagctgaaatttttctcagattaaattatttgaatttcttttgtatgtggygtttggctggatttattgtttataacataatttattttgagttttaatgtggaatttaaaactcacattcattgtgataagttctctatttgtcttatctgtgccatattatttcatgatttttattttttaatcttaccaggtttgaatctgaaaaaagcctggtataaagggagatagagtgggaccagattatgcagggatttgctggccattttaagaatttaggatttgttttagttcaatggggaggcattgaattgttttgaacagggtactccttgattcattatacatctt

SEQ ID NO: 105651 - DNA, 601 bp, Human
gttgttgattaatttagtagccaagtaatattttacgctacctttcttctctgcaagtatgttgatatttcccttttgggttgcaaaatgattccatcaattgcaaacatcacttgcctctgcaaagacttctctaaacatctatctataagagggcctcagtgatttggcatcttaagttactctcccagctgaaatttttctcagattaaattatttgaatttcttttgtatgtggcgtttggctggatttattgtttataacataatttattttgagttttaatgtggaatttaaaaatcacattcattgtgataagttctctatttgtcttatctgtgccatattatttcatgatttttattttttaatcttaccaggtttgaatctgaaaaaagcctggtataaagggagatagagtgggaccagattatgcagggatttgctggccattttaagaatttaggatttgttttagttcaatggggaggcattgaattgttttgaacagggtactccttgattcattatacatcttaagatcaatccaaccattacaaaggaggttggaggaaagaatggaggcagtaagaccagtta

SEQ ID NO: 105652 - DNA, 601 bp, Human
tgttgattaatttagtagccaagtaatattttacgctacctttcttctctgcaagtatgttgatatttcccttttgggttgcaaaatgattccatcaattgcaaacatcacttgcctctgcaaagacttctctaaacatctatctataagagggcctcagtgatttggcatcttaagttactctcccagctgaaatttttctcagattaaattatttgaatttcttttgtatgtggcgtttggctggatttattgtttataacataatttattttgagttttaatgtggaatttaaaactsacattcattgtgataagttctctatttgtcttatctgtgccatattatttcatgatttttattttttaatcttaccaggtttgaatctgaaaaaagcctggtataaagggagatagagtgggaccagattatgcagggatttgctggccattttaagaatttaggatttgttttagttcaatggggaggcattgaattgttttgaacagggtactccttgattcattatacatcttaagatcaatccaaccattacaaaggaggttggaggaaagaatggaggcagtaagaccagttagg

SEQ ID NO: 105653 - DNA, 601 bp, Human
caagtaatattttacgctacctttcttctctgcaagtatgttgatatttcccttttgggttgcaaaatgattccatcaattgcaaacatcacttgcctctgcaaagacttctctaaacatctatctataagagggcctcagtgatttggcatcttaagttactctcccagctgaaatttttctcagattaaattatttgaatttcttttgtatgtggcgtttggctggatttattgtttataacataatttattttgagttttaatgtggaatttaaaactcacattcattgtgataagtkctctatttgtcttatctgtgccatattatttcatgatttttattttttaatcttaccaggtttgaatctgaaaaaagcctggtataaagggagatagagtgggaccagattatgcagggatttgctggccattttaagaatttaggatttgttttagttcaatggggaggcattgaattgttttgaacagggtactccttgattcattatacatcttaagatcaatccaaccattacaaaggaggttggaggaaagaatggaggcagtaagaccagttaggaggatgtcaattgtagtac

SEQ ID NO: 105654 - DNA, 601 bp, Human
tgtatgtggcgtttggctggatttattgtttataacataatttattttgagttttaatgtggaatttaaaactcacattcattgtgataagttctctatttgtcttatctgtgccatattatttcatgatttttattttttaatcttaccaggtttgaatctgaaaaaagcctggtataaagggagatagagtgggaccagattatgcagggatttgctggccattttaagaatttaggatttgttttagttcaatggggaggcattgaattgttttgaacagggtactccttgattcatyatacatcttaagatcaatccaaccattacaaaggaggttggaggaaagaatggaggcagtaagaccagttaggaggatgtcaattgtagtacacgtaatcagcgaaggtgacctggattgggtggtagcaatggtcagagagggaagtgaattactccagtttaagatctgacagctacagacttgcctatgaatcgggtgtatggcaggcagccaggaggagactcaaagatgatatttgttttggttgatggcattactctctgggtaacggagaggcctgaggaggaggagaattca

SEQ ID NO: 105655 - DNA, 601 bp, Human
ttagttcaatggggaggcattgaattgttttgaacagggtactccttgattcattatacatcttaagatcaatccaaccattacaaaggaggttggaggaaagaatggaggcagtaagaccagttaggaggatgtcaattgtagtacacgtaatcagcgaaggtgacctggattgggtggtagcaatggtcagagagggaagtgaattactccagtttaagatctgacagctacagacttgcctatgaatcgggtgtatggcaggcagccaggaggagactcaaagatgatatttgttttkgttgatggcattactctctgggtaacggagaggcctgaggaggaggagaattcatttgcagggcagacagcatcaacagttaatattttagacacgtaaattgaagataatctgggaaaactgccaagtgcatgtcatgtcagctattgggcatgtgagttagctactgctcagagcagaagtctagactagagataaatgtgggtgtcatcaaccaactgagctccaaaaaatgccaacagtagaggccaagtaaaggcagagcagccaccaaaggagaataagggacagacaatgcgg

SEQ ID NO: 105656 - DNA, 601 bp, Human
ataatctgggaaaactgccaagtgcatgtcatgtcagctattgggcatgtgagttagctactgctcagagcagaagtctagactagagataaatgtgggtgtcatcaaccaactgagctccaaaaaatgccaacagtagaggccaagtaaaggcagagcagccaccaaaggagaataagggacagacaatgcggtgggagggatattacgataatcgtttttctggtgtcaagagagactattttctcagaatttggacccaggagagatgacagaaattgtcattggatttattattacrgaagttattgctatcttaaggagagcatttttcattggagtaataaaggcaaaaggcaggttgaagtggttacaaagtgaataggacgggaggcagtagaggcattatgtggtgacattaagcggaagtttggctgaacgagagaaatggaatttttttggcatcacttgaaaagaccgtatcagtccataaatgctcaatgaaggtgtagaatgaatcttaacaaatagttatcagtgttgatacaaaaatgaatgcatgtctgagatatatattactgtctgaacagaagtattaata

SEQ ID NO: 105657 - DNA, 601 bp, Human
aggccaagtaaaggcagagcagccaccaaaggagaataagggacagacaatgcggtgggagggatattacgataatcgtttttctggtgtcaagagagactattttctcagaatttggacccaggagagatgacagaaattgtcattggatttattattacggaagttattgctatcttaaggagagcatttttcattggagtaataaaggcaaaaggcaggttgaagtggttacaaagtgaataggacgggaggcagtagaggcattatgtggtgacattaagcggaagtttggctgaaygagagaaatggaatttttttggcatcacttgaaaagaccgtatcagtccataaatgctcaatgaaggtgtagaatgaatcttaacaaatagttatcagtgttgatacaaaaatgaatgcatgtctgagatatatattactgtctgaacagaagtattaatattgaattcaatgtatttctataattgaaggaacctagaaacagcagtatgttgcaaagaatggaacaacttagagttatttgccgttcagttgctgagctctgtccaagagcaccctgattgctgggctctgtaccatg

SEQ ID NO: 105658 - DNA, 601 bp, Human
gaaattgtcattggatttattattacggaagttattgctatcttaaggagagcatttttcattggagtaataaaggcaaaaggcaggttgaagtggttacaaagtgaataggacgggaggcagtagaggcattatgtggtgacattaagcggaagtttggctgaacgagagaaatggaatttttttggcatcacttgaaaagaccgtatcagtccataaatgctcaatgaaggtgtagaatgaatcttaacaaatagttatcagtgttgatacaaaaatgaatgcatgtctgagatatatattactgtctgaacagaagtattaatattgaattcaatgtatttctataattgaaggaacctagaaacagcagtatgttgcaaagaatggaacaacttagagttatttgccgttcagttgctgagctctgtccaagagcaccctgattgctgggctctgtaccatgatcttttcaactgccttcatgaccgtctcaatccatcttgcaccacagtcttattacagatcttcatgtgagcatcattcatcatataatgctctaggatccagaagggaagaatggtgttgtttgagtactact

SEQ ID NO: 105659 - DNA, 601 bp, Human
agcatttttcattggagtaataaaggcaaaaggcaggttgaagtggttacaaagtgaataggacgggaggcagtagaggcattatgtggtgacattaagcggaagtttggctgaacgagagaaatggaatttttttggcatcacttgaaaagaccgtatcagtccataaatgctcaatgaaggtgtagaatgaatcttaacaaatagttatcagtgttgatacaaaaatgaatgcatgtctgagatatatattactgtctgaacagaagtattaatattgaattcaatgtatttctataaytgaaggaacctagaaacagcagtatgttgcaaagaatggaacaacttagagttatttgccgttcagttgctgagctctgtccaagagcaccctgattgctgggctctgtaccatgatcttttcaactgccttcatgaccgtctcaatccatcttgcaccacagtcttattacagatcttcatgtgagcatcattcatcatataatgctctaggatccagaagggaagaatggtgttgtttgagtactactccttcacagtagaattggacaaaccatttaccatgtctaatctcaatgac

SEQ ID NO: 105660 - DNA, 601 bp, Human
agtggttacaaagtgaataggacgggaggcagtagaggcattatgtggtgacattaagcggaagtttggctgaacgagagaaatggaatttttttggcatcacttgaaaagaccgtatcagtccataaatgctcaatgaaggtgtagaatgaatcttaacaaatagttatcagtgttgatacaaaaatgaatgcatgtctgagatatatattactgtctgaacagaagtattaatattgaattcaatgtatttctataattgaaggaacctagaaacagcagtatgttgcaaagaatggarcaacttagagttatttgccgttcagttgctgagctctgtccaagagcaccctgattgctgggctctgtaccatgatcttttcaactgccttcatgaccgtctcaatccatcttgcaccacagtcttattacagatcttcatgtgagcatcattcatcatataatgctctaggatccagaagggaagaatggtgttgtttgagtactactccttcacagtagaattggacaaaccatttaccatgtctaatctcaatgacatattctaaaaataaaaaagttaacattattagactaggct

SEQ ID NO: 105661 - DNA, 601 bp, Human
ttgatacaaaaatgaatgcatgtctgagatatatattactgtctgaacagaagtattaatattgaattcaatgtatttctataattgaaggaacctagaaacagcagtatgttgcaaagaatggaacaacttagagttatttgccgttcagttgctgagctctgtccaagagcaccctgattgctgggctctgtaccatgatcttttcaactgccttcatgaccgtctcaatccatcttgcaccacagtcttattacagatcttcatgtgagcatcattcatcatataatgctctaggatscagaagggaagaatggtgttgtttgagtactactccttcacagtagaattggacaaaccatttaccatgtctaatctcaatgacatattctaaaaataaaaaagttaacattattagactaggctttcttttattttcctttttatttatactttcctgtataaataatgcatattatacagggtcattttaatgcatgatttatataatgatagtttatagtagaacttttttcctgtctaaaattttagattatatgacttcaaataatatgtttcattttccacaaagaagaggtat

SEQ ID NO: 105662 - DNA, 601 bp, Human
tcaactgccttcatgaccgtctcaatccatcttgcaccacagtcttattacagatcttcatgtgagcatcattcatcatataatgctctaggatccagaagggaagaatggtgttgtttgagtactactccttcacagtagaattggacaaaccatttaccatgtctaatctcaatgacatattctaaaaataaaaaagttaacattattagactaggctttcttttattttcctttttatttatactttcctgtataaataatgcatattatacagggtcattttaatgcatgatttatrtaatgatagtttatagtagaacttttttcctgtctaaaattttagattatatgacttcaaataatatgtttcattttccacaaagaagaggtattataccaattatatttcttatatcatcttgattgtgaatatttaaatgaatgcaaacataaagaaaatgcaattaaattgaagatcaacaaccatttcctgagaatcattttatgaaatcatttaggaaaattcattttattatacgcaaataggttctgaggagcatttaactttgaggctgaatagtgatgatataatcaagag

SEQ ID NO: 105663 - DNA, 601 bp, Human
ctctaggatccagaagggaagaatggtgttgtttgagtactactccttcacagtagaattggacaaaccatttaccatgtctaatctcaatgacatattctaaaaataaaaaagttaacattattagactaggctttcttttattttcctttttatttatactttcctgtataaataatgcatattatacagggtcattttaatgcatgatttatataatgatagtttatagtagaacttttttcctgtctaaaattttagattatatgacttcaaataatatgtttcattttccacaaagaagaggtattataccaattatatttcttatatcatcttgattgtgaatatttaaatgaatgcaaacataaagaaaatgcaattaaattgaagatcaacaaccatttcctgagaatcattttatgaaatcatttaggaaaattcattttattatacgcaaataggttctgaggagcatttaactttgaggctgaatagtgatgatataatcaagagcatataatttggacatttatcatttcaatgtagagaaactgctgctcttatttaaagataatacatatcagtttatagattttat

SEQ ID NO: 105664 - DNA, 601 bp, Human
ctaggctttcttttattttcctttttatttatactttcctgtataaataatgcatattatacagggtcattttaatgcatgatttatataatgatagtttatagtagaacttttttcctgtctaaaattttagattatatgacttcaaataatatgtttcattttccacaaagaagaggtattataccaattatatttcttatatcatcttgattgtgaatatttaaatgaatgcaaacataaagaaaatgcaattaaattgaagatcaacaaccatttcctgagaatcattttatgaaaycatttaggaaaattcattttattatacgcaaataggttctgaggagcatttaactttgaggctgaatagtgatgatataatcaagagcatataatttggacatttatcatttcaatgtagagaaactgctgctcttatttaaagataatacatatcagtttatagattttatatctccctgtaagtacattaccataatcatatgtcaatataatatcactaattatagttacattagaaggtaagtaattggcatgcatttaaaaactaattactgagttttattgccactgaaactct

SEQ ID NO: 105665 - DNA, 601 bp, Human
ttatactttcctgtataaataatgcatattatacagggtcattttaatgcatgatttatataatgatagtttatagtagaacttttttcctgtctaaaattttagattatatgacttcaaataatatgtttcattttccacaaagaagaggtattataccaattatatttcttatatcatcttgattgtgaatatttaaatgaatgcaaacataaagaaaatgcaattaaattgaagatcaacaaccatttcctgagaatcattttatgaaatcatttaggaaaattcattttattatackcaaataggttctgaggagcatttaactttgaggctgaatagtgatgatataatcaagagcatataatttggacatttatcatttcaatgtagagaaactgctgctcttatttaaagataatacatatcagtttatagattttatatctccctgtaagtacattaccataatcatatgtcaatataatatcactaattatagttacattagaaggtaagtaattggcatgcatttaaaaactaattactgagttttattgccactgaaactctttgaataaattcagctattgggggaaaa

SEQ ID NO: 105666 - DNA, 601 bp, Human
ccaattatatttcttatatcatcttgattgtgaatatttaaatgaatgcaaacataaagaaaatgcaattaaattgaagatcaacaaccatttcctgagaatcattttatgaaatcatttaggaaaattcattttattatacgcaaataggttctgaggagcatttaactttgaggctgaatagtgatgatataatcaagagcatataatttggacatttatcatttcaatgtagagaaactgctgctcttatttaaagataatacatatcagtttatagattttatatctccctgtaagyacattaccataatcatatgtcaatataatatcactaattatagttacattagaaggtaagtaattggcatgcatttaaaaactaattactgagttttattgccactgaaactctttgaataaattcagctattgggggaaaagaattgacgctgctgtgaaagttgattatatgaaatgggtcattttgtcatacccaagtaaatcgaggggctggggaaaaagcactcagggcatgtagcacctttttcaagaactgaattttcctcaagcctagctgctgaaatggcctgctgtcacc

SEQ ID NO: 105667 - DNA, 601 bp, Human
tagattttatatctccctgtaagtacattaccataatcatatgtcaatataatatcactaattatagttacattagaaggtaagtaattggcatgcatttaaaaactaattactgagttttattgccactgaaactctttgaataaattcagctattgggggaaaagaattgacgctgctgtgaaagttgattatatgaaatgggtcattttgtcatacccaagtaaatcgaggggctggggaaaaagcactcagggcatgtagcacctttttcaagaactgaattttcctcaagcctagytgctgaaatggcctgctgtcaccctaagaccagtgttacctagtaaatgctgaaacaacctgctgtgacaccaagagttctacctgctgccctcactcaccaatcagagcttgccagctcccaaaagcttctctagtgccaatgagccttctttcaaaacaatacataacatttctttcttttttttgagatagagtcttactttgttgtccaggctagagtgcaatggtacgatcttggctcactgcaacctctgcctcccaggttcaaatgattctcatgcctcagcctccagaatag

SEQ ID NO: 105668 - DNA, 601 bp, Human
aattggcatgcatttaaaaactaattactgagttttattgccactgaaactctttgaataaattcagctattgggggaaaagaattgacgctgctgtgaaagttgattatatgaaatgggtcattttgtcatacccaagtaaatcgaggggctggggaaaaagcactcagggcatgtagcacctttttcaagaactgaattttcctcaagcctagctgctgaaatggcctgctgtcaccctaagaccagtgttacctagtaaatgctgaaacaacctgctgtgacaccaagagttctacckgctgccctcactcaccaatcagagcttgccagctcccaaaagcttctctagtgccaatgagccttctttcaaaacaatacataacatttctttcttttttttgagatagagtcttactttgttgtccaggctagagtgcaatggtacgatcttggctcactgcaacctctgcctcccaggttcaaatgattctcatgcctcagcctccagaatagctgggattacaggcgtgcgccaccacacctggctaatttttgtatttttagtagagacgggatttgatcatgttggccaggctgg

SEQ ID NO: 105669 - DNA, 601 bp, Human
tcagggcatgtagcacctttttcaagaactgaattttcctcaagcctagctgctgaaatggcctgctgtcaccctaagaccagtgttacctagtaaatgctgaaacaacctgctgtgacaccaagagttctacctgctgccctcactcaccaatcagagcttgccagctcccaaaagcttctctagtgccaatgagccttctttcaaaacaatacataacatttctttcttttttttgagatagagtcttactttgttgtccaggctagagtgcaatggtacgatcttggctcactgcaamctctgcctcccaggttcaaatgattctcatgcctcagcctccagaatagctgggattacaggcgtgcgccaccacacctggctaatttttgtatttttagtagagacgggatttgatcatgttggccaggctggtctcgaaatcctggcctcaagtgatctgcctgccttggcctcccaaagtgctgggattaccggcgtgagccactgcgcccaccgacgtttctctttctaataaaactcccaactttctctttgttctttggagatatgccccaaattgcaattctgtgattgcccc

SEQ ID NO: 105670 - DNA, 601 bp, Human
gctgtcaccctaagaccagtgttacctagtaaatgctgaaacaacctgctgtgacaccaagagttctacctgctgccctcactcaccaatcagagcttgccagctcccaaaagcttctctagtgccaatgagccttctttcaaaacaatacataacatttctttcttttttttgagatagagtcttactttgttgtccaggctagagtgcaatggtacgatcttggctcactgcaacctctgcctcccaggttcaaatgattctcatgcctcagcctccagaatagctgggattacaggcrtgcgccaccacacctggctaatttttgtatttttagtagagacgggatttgatcatgttggccaggctggtctcgaaatcctggcctcaagtgatctgcctgccttggcctcccaaagtgctgggattaccggcgtgagccactgcgcccaccgacgtttctctttctaataaaactcccaactttctctttgttctttggagatatgccccaaattgcaattctgtgattgccccaaaaaccatttaatttagagattcatctctgtatttattttgacccaacactgtgctcaaataa

SEQ ID NO: 105671 - DNA, 601 bp, Human
ccctcactcaccaatcagagcttgccagctcccaaaagcttctctagtgccaatgagccttctttcaaaacaatacataacatttctttcttttttttgagatagagtcttactttgttgtccaggctagagtgcaatggtacgatcttggctcactgcaacctctgcctcccaggttcaaatgattctcatgcctcagcctccagaatagctgggattacaggcgtgcgccaccacacctggctaatttttgtatttttagtagagacgggatttgatcatgttggccaggctggtctcraaatcctggcctcaagtgatctgcctgccttggcctcccaaagtgctgggattaccggcgtgagccactgcgcccaccgacgtttctctttctaataaaactcccaactttctctttgttctttggagatatgccccaaattgcaattctgtgattgccccaaaaaccatttaatttagagattcatctctgtatttattttgacccaacactgtgctcaaataaaaattgcctatggaagtggaatagattgcagtctccagttttgttttacaagggtatgtgttatagaaagttaaa

SEQ ID NO: 105672 - DNA, 601 bp, Human
tcatgcctcagcctccagaatagctgggattacaggcgtgcgccaccacacctggctaatttttgtatttttagtagagacgggatttgatcatgttggccaggctggtctcgaaatcctggcctcaagtgatctgcctgccttggcctcccaaagtgctgggattaccggcgtgagccactgcgcccaccgacgtttctctttctaataaaactcccaactttctctttgttctttggagatatgccccaaattgcaattctgtgattgccccaaaaaccatttaatttagagattcatstctgtatttattttgacccaacactgtgctcaaataaaaattgcctatggaagtggaatagattgcagtctccagttttgttttacaagggtatgtgttatagaaagttaaatgtgttgacttttttctcagtcataatatcatcttgtttatataaaaatagagaaaataattacagaaaactttatgcccacattccttttgtttttatatcttagttatggaaagaaatcattgttttttgatgattcataaagctcactctagtttcgtgataacaaagcattacttgggtttcaa

SEQ ID NO: 105673 - DNA, 601 bp, Human
ggagatatgccccaaattgcaattctgtgattgccccaaaaaccatttaatttagagattcatctctgtatttattttgacccaacactgtgctcaaataaaaattgcctatggaagtggaatagattgcagtctccagttttgttttacaagggtatgtgttatagaaagttaaatgtgttgacttttttctcagtcataatatcatcttgtttatataaaaatagagaaaataattacagaaaactttatgcccacattccttttgtttttatatcttagttatggaaagaaatcattrttttttgatgattcataaagctcactctagtttcgtgataacaaagcattacttgggtttcaaacaatgctacataaaccacagtaaatatacttatataaaattaagcatagctctgcttgtcttcttgggaattgacttgaggtgtattaaaatttacattttctattttgcaaatcagaagaagcaaggaggaaagaaaaggataaaatgaatacatatcattatacaaattagtatgttaaattattttcctctctatgccaagcaggaaatgttgtcaacacatcagcaaaccag

SEQ ID NO: 105674 - DNA, 601 bp, Human
tctccagttttgttttacaagggtatgtgttatagaaagttaaatgtgttgacttttttctcagtcataatatcatcttgtttatataaaaatagagaaaataattacagaaaactttatgcccacattccttttgtttttatatcttagttatggaaagaaatcattgttttttgatgattcataaagctcactctagtttcgtgataacaaagcattacttgggtttcaaacaatgctacataaaccacagtaaatatacttatataaaattaagcatagctctgcttgtcttcttggraattgacttgaggtgtattaaaatttacattttctattttgcaaatcagaagaagcaaggaggaaagaaaaggataaaatgaatacatatcattatacaaattagtatgttaaattattttcctctctatgccaagcaggaaatgttgtcaacacatcagcaaaccagacattgtactctaaaatttgactggcaacatttattgtggaaactccagtggttggtatagcctaactttacgtaatgatctccattatcgtttaggtttgcttaagtggtattttaagaaaatgtgacttg

SEQ ID NO: 105675 - DNA, 601 bp, Human
aaaaatagagaaaataattacagaaaactttatgcccacattccttttgtttttatatcttagttatggaaagaaatcattgttttttgatgattcataaagctcactctagtttcgtgataacaaagcattacttgggtttcaaacaatgctacataaaccacagtaaatatacttatataaaattaagcatagctctgcttgtcttcttgggaattgacttgaggtgtattaaaatttacattttctattttgcaaatcagaagaagcaaggaggaaagaaaaggataaaatgaatacrtatcattatacaaattagtatgttaaattattttcctctctatgccaagcaggaaatgttgtcaacacatcagcaaaccagacattgtactctaaaatttgactggcaacatttattgtggaaactccagtggttggtatagcctaactttacgtaatgatctccattatcgtttaggtttgcttaagtggtattttaagaaaatgtgacttgttacagcatacacgaagatctgtttcttatctgagtataatttacataaattataattttcatgaaacattaaccttcacttttgtg

SEQ ID NO: 105676 - DNA, 601 bp, Human
ctaactttacgtaatgatctccattatcgtttaggtttgcttaagtggtattttaagaaaatgtgacttgttacagcatacacgaagatctgtttcttatctgagtataatttacataaattataattttcatgaaacattaaccttcacttttgtgtgttcctttatttcagttgattatagtttttatgtaaatcatcctactaaatctgtttgtaattttaaaatttcactttgttctgatttaagtctgttttgcttttgtgccacaagctattatttcttggataagggctttttwccagcgtgggtttttatcatatcttcatatttaaataaaattactaaggaagtagtaattataataacaaagctaatatagccagtaatactgtggagaaaatgtgaaggtactgtgaactgtagggctggctgggcgcggtggctcacgcctataatcccagcactttaggaaggccaaggaagacagatcaccggaggtcaggtgtttgagaccagactggccaacatgttgaaaccctgtctctactaaaaatacaaaatattagccgggtgtggtggtgggcacctgtagtcccag

SEQ ID NO: 105677 - DNA, 601 bp, Human
tttacgtaatgatctccattatcgtttaggtttgcttaagtggtattttaagaaaatgtgacttgttacagcatacacgaagatctgtttcttatctgagtataatttacataaattataattttcatgaaacattaaccttcacttttgtgtgttcctttatttcagttgattatagtttttatgtaaatcatcctactaaatctgtttgtaattttaaaatttcactttgttctgatttaagtctgttttgcttttgtgccacaagctattatttcttggataagggcttttttccagygtgggtttttatcatatcttcatatttaaataaaattactaaggaagtagtaattataataacaaagctaatatagccagtaatactgtggagaaaatgtgaaggtactgtgaactgtagggctggctgggcgcggtggctcacgcctataatcccagcactttaggaaggccaaggaagacagatcaccggaggtcaggtgtttgagaccagactggccaacatgttgaaaccctgtctctactaaaaatacaaaatattagccgggtgtggtggtgggcacctgtagtcccagctact

SEQ ID NO: 105678 - DNA, 601 bp, Human
tattttaagaaaatgtgacttgttacagcatacacgaagatctgtttcttatctgagtataatttacataaattataattttcatgaaacattaaccttcacttttgtgtgttcctttatttcagttgattatagtttttatgtaaatcatcctactaaatctgtttgtaattttaaaatttcactttgttctgatttaagtctgttttgcttttgtgccacaagctattatttcttggataagggcttttttccagcgtgggtttttatcatatcttcatatttaaataaaattactaargaagtagtaattataataacaaagctaatatagccagtaatactgtggagaaaatgtgaaggtactgtgaactgtagggctggctgggcgcggtggctcacgcctataatcccagcactttaggaaggccaaggaagacagatcaccggaggtcaggtgtttgagaccagactggccaacatgttgaaaccctgtctctactaaaaatacaaaatattagccgggtgtggtggtgggcacctgtagtcccagctactcaggaggctgaggcaggagaattgcttgaactgggaggcggag

SEQ ID NO: 105679 - DNA, 601 bp, Human
agtataatttacataaattataattttcatgaaacattaaccttcacttttgtgtgttcctttatttcagttgattatagtttttatgtaaatcatcctactaaatctgtttgtaattttaaaatttcactttgttctgatttaagtctgttttgcttttgtgccacaagctattatttcttggataagggcttttttccagcgtgggtttttatcatatcttcatatttaaataaaattactaaggaagtagtaattataataacaaagctaatatagccagtaatactgtggagaaaaygtgaaggtactgtgaactgtagggctggctgggcgcggtggctcacgcctataatcccagcactttaggaaggccaaggaagacagatcaccggaggtcaggtgtttgagaccagactggccaacatgttgaaaccctgtctctactaaaaatacaaaatattagccgggtgtggtggtgggcacctgtagtcccagctactcaggaggctgaggcaggagaattgcttgaactgggaggcggagattgcagtgagcggagatcttgccactgcccttcagcctgggtgacagagtgaga

SEQ ID NO: 105680 - DNA, 601 bp, Human
atagtttttatgtaaatcatcctactaaatctgtttgtaattttaaaatttcactttgttctgatttaagtctgttttgcttttgtgccacaagctattatttcttggataagggcttttttccagcgtgggtttttatcatatcttcatatttaaataaaattactaaggaagtagtaattataataacaaagctaatatagccagtaatactgtggagaaaatgtgaaggtactgtgaactgtagggctggctgggcgcggtggctcacgcctataatcccagcactttaggaaggccraggaagacagatcaccggaggtcaggtgtttgagaccagactggccaacatgttgaaaccctgtctctactaaaaatacaaaatattagccgggtgtggtggtgggcacctgtagtcccagctactcaggaggctgaggcaggagaattgcttgaactgggaggcggagattgcagtgagcggagatcttgccactgcccttcagcctgggtgacagagtgagattccgtcttaaaaaaaaaaaaaaaattagtaagggctgctcaaaagatcttttgcccaggatgaggatttctcaac

SEQ ID NO: 105681 - DNA, 601 bp, Human
cactgcccttcagcctgggtgacagagtgagattccgtcttaaaaaaaaaaaaaaaattagtaagggctgctcaaaagatcttttgcccaggatgaggatttctcaacacagaggctgggaaacctttacccaggcaatttttcttcagtgtccaatattgaaactagtacaagggttgatttaaaaataaaccttgtaattgtttcattatagaagctcctcaacttgcaatggcttgccttctacaaagccatggcaagtcggggaccctctgtatttcctaaagaggaaagtgcacartgtgaggatgaatcctgagattcctgtggaaccacaagagagagaaaaactctttgcaagtggcagccacagcctcttaagccaagggtaggacctgagccagaggtgggaccctaggcagggcagggcctaagataggcatgagcaacctggggaaatcatgatgcacatatataagcaatgtggtgctgcttgtatctgtgaatatgcccataaaattcaagaggatatagatttaaatataatgtgaaatatacgtttgtattccatgtagaatttgttgcttccagtgaattggat

SEQ ID NO: 105682 - DNA, 601 bp, Human
ttaaaaaaaaaaaaaaaattagtaagggctgctcaaaagatcttttgcccaggatgaggatttctcaacacagaggctgggaaacctttacccaggcaatttttcttcagtgtccaatattgaaactagtacaagggttgatttaaaaataaaccttgtaattgtttcattatagaagctcctcaacttgcaatggcttgccttctacaaagccatggcaagtcggggaccctctgtatttcctaaagaggaaagtgcacagtgtgaggatgaatcctgagattcctgtggaaccacaagrgagagaaaaactctttgcaagtggcagccacagcctcttaagccaagggtaggacctgagccagaggtgggaccctaggcagggcagggcctaagataggcatgagcaacctggggaaatcatgatgcacatatataagcaatgtggtgctgcttgtatctgtgaatatgcccataaaattcaagaggatatagatttaaatataatgtgaaatatacgtttgtattccatgtagaatttgttgcttccagtgaattggattatttgtttattcctggacactcagcacattttcctgct

SEQ ID NO: 105683 - DNA, 601 bp, Human
tgtaattgtttcattatagaagctcctcaacttgcaatggcttgccttctacaaagccatggcaagtcggggaccctctgtatttcctaaagaggaaagtgcacagtgtgaggatgaatcctgagattcctgtggaaccacaagagagagaaaaactctttgcaagtggcagccacagcctcttaagccaagggtaggacctgagccagaggtgggaccctaggcagggcagggcctaagataggcatgagcaacctggggaaatcatgatgcacatatataagcaatgtggtgctgcttrtatctgtgaatatgcccataaaattcaagaggatatagatttaaatataatgtgaaatatacgtttgtattccatgtagaatttgttgcttccagtgaattggattatttgtttattcctggacactcagcacattttcctgctcctggactgctgctctttttgaaattcttgctctcaatctccatatgttcataaaagtttatttattttaaggttcagacccacttcattttcctatatgaaaataggaaatagtccctgatgccttaaagtaattcttccccattgatgaccctc

SEQ ID NO: 105684 - DNA, 601 bp, Human
atggcaagtcggggaccctctgtatttcctaaagaggaaagtgcacagtgtgaggatgaatcctgagattcctgtggaaccacaagagagagaaaaactctttgcaagtggcagccacagcctcttaagccaagggtaggacctgagccagaggtgggaccctaggcagggcagggcctaagataggcatgagcaacctggggaaatcatgatgcacatatataagcaatgtggtgctgcttgtatctgtgaatatgcccataaaattcaagaggatatagatttaaatataatgtgaaakatacgtttgtattccatgtagaatttgttgcttccagtgaattggattatttgtttattcctggacactcagcacattttcctgctcctggactgctgctctttttgaaattcttgctctcaatctccatatgttcataaaagtttatttattttaaggttcagacccacttcattttcctatatgaaaataggaaatagtccctgatgccttaaagtaattcttccccattgatgaccctccaaataattttgttgcactttgctactggcacattactttctatcacatattgttatt

SEQ ID NO: 105685 - DNA, 601 bp, Human
tcctaaagaggaaagtgcacagtgtgaggatgaatcctgagattcctgtggaaccacaagagagagaaaaactctttgcaagtggcagccacagcctcttaagccaagggtaggacctgagccagaggtgggaccctaggcagggcagggcctaagataggcatgagcaacctggggaaatcatgatgcacatatataagcaatgtggtgctgcttgtatctgtgaatatgcccataaaattcaagaggatatagatttaaatataatgtgaaatatacgtttgtattccatgtagaattygttgcttccagtgaattggattatttgtttattcctggacactcagcacattttcctgctcctggactgctgctctttttgaaattcttgctctcaatctccatatgttcataaaagtttatttattttaaggttcagacccacttcattttcctatatgaaaataggaaatagtccctgatgccttaaagtaattcttccccattgatgaccctccaaataattttgttgcactttgctactggcacattactttctatcacatattgttatttatgtatgaaaacccctatagcatat

SEQ ID NO: 105686 - DNA, 601 bp, Human
aggcatgagcaacctggggaaatcatgatgcacatatataagcaatgtggtgctgcttgtatctgtgaatatgcccataaaattcaagaggatatagatttaaatataatgtgaaatatacgtttgtattccatgtagaatttgttgcttccagtgaattggattatttgtttattcctggacactcagcacattttcctgctcctggactgctgctctttttgaaattcttgctctcaatctccatatgttcataaaagtttatttattttaaggttcagacccacttcattttcctatrtgaaaataggaaatagtccctgatgccttaaagtaattcttccccattgatgaccctccaaataattttgttgcactttgctactggcacattactttctatcacatattgttatttatgtatgaaaacccctatagcatatagattaaacgtgtgggctctgaattcaaattacagccttgccacttctcagctgtggaactctaggcacgttaattaacctttctcttcctcagcttcctcatgggtaaataggaaaatactacctgcgttgcaggggtctgagtattaaacaagtta

SEQ ID NO: 105687 - DNA, 601 bp, Human
attttcctgctcctggactgctgctctttttgaaattcttgctctcaatctccatatgttcataaaagtttatttattttaaggttcagacccacttcattttcctatatgaaaataggaaatagtccctgatgccttaaagtaattcttccccattgatgaccctccaaataattttgttgcactttgctactggcacattactttctatcacatattgttatttatgtatgaaaacccctatagcatatagattaaacgtgtgggctctgaattcaaattacagccttgccacttctcrgctgtggaactctaggcacgttaattaacctttctcttcctcagcttcctcatgggtaaataggaaaatactacctgcgttgcaggggtctgagtattaaacaagttaggatacatcaaagagcatgtcactttcacctgtgtttttctgcaccccagctgacacagggccttgcatataattaggttctcagactcatgaaacaactgggaacatactgatttctaggaattagaaggttcattttaaatatttaaagcttttaatttttctgtaaatatcctgactaccttagaaaca

SEQ ID NO: 105688 - DNA, 601 bp, Human
ctgctctttttgaaattcttgctctcaatctccatatgttcataaaagtttatttattttaaggttcagacccacttcattttcctatatgaaaataggaaatagtccctgatgccttaaagtaattcttccccattgatgaccctccaaataattttgttgcactttgctactggcacattactttctatcacatattgttatttatgtatgaaaacccctatagcatatagattaaacgtgtgggctctgaattcaaattacagccttgccacttctcagctgtggaactctaggcacrttaattaacctttctcttcctcagcttcctcatgggtaaataggaaaatactacctgcgttgcaggggtctgagtattaaacaagttaggatacatcaaagagcatgtcactttcacctgtgtttttctgcaccccagctgacacagggccttgcatataattaggttctcagactcatgaaacaactgggaacatactgatttctaggaattagaaggttcattttaaatatttaaagcttttaatttttctgtaaatatcctgactaccttagaaacaaataatacaagatacaattt

SEQ ID NO: 105689 - DNA, 601 bp, Human
agacccacttcattttcctatatgaaaataggaaatagtccctgatgccttaaagtaattcttccccattgatgaccctccaaataattttgttgcactttgctactggcacattactttctatcacatattgttatttatgtatgaaaacccctatagcatatagattaaacgtgtgggctctgaattcaaattacagccttgccacttctcagctgtggaactctaggcacgttaattaacctttctcttcctcagcttcctcatgggtaaataggaaaatactacctgcgttgcaggrgtctgagtattaaacaagttaggatacatcaaagagcatgtcactttcacctgtgtttttctgcaccccagctgacacagggccttgcatataattaggttctcagactcatgaaacaactgggaacatactgatttctaggaattagaaggttcattttaaatatttaaagcttttaatttttctgtaaatatcctgactaccttagaaacaaataatacaagatacaatttttatacataaaatctagagaattagttaaattactattacttaaaatatatgggtgtatgcaatttt

SEQ ID NO: 105690 - DNA, 601 bp, Human
gcttcctcatgggtaaataggaaaatactacctgcgttgcaggggtctgagtattaaacaagttaggatacatcaaagagcatgtcactttcacctgtgtttttctgcaccccagctgacacagggccttgcatataattaggttctcagactcatgaaacaactgggaacatactgatttctaggaattagaaggttcattttaaatatttaaagcttttaatttttctgtaaatatcctgactaccttagaaacaaataatacaagatacaatttttatacataaaatctagagaattwgttaaattactattacttaaaatatatgggtgtatgcaattttcagaaggactttttttcttttttgatttgaagactaatattgctttctagttttaaaataagcctgctaatttgtaattgctttgaaaaacatattttgtttataggaacataatgaaattgtgatagcctcagaaaagtagggaaagagttgggcctatttttctacctgtaactcaaacatctgcaaaaattctgcaagaaagaacaaaatccatatgttctttaatatctaggctaaatgtttattttgtttgg

SEQ ID NO: 105691 - DNA, 601 bp, Human
gacccgtttcaagaccttaggtaagaatttttgttcaaatattaacaacctctcctgtagaagacaagagggtatgtgctggaataatgttagcagtgactacttcctgactgtttcttatttcatcagttgcctttattttcaagactttccgcttataactagatagtatttattaaaatccaaaggaggtcaaaaagtcctactgactccacacttggtgcctgttcacagcctcctccttcctcctccttcttcctctccaatctgcctctcacactggtatcaaaatgactttgcyaaatgcaagctggttaaaatgcttcatcgctcccacatcacatcagccataggaaaatcctaagtgctccactgggcacccacagcccttcatagtctgggctgtgactggcgggacctcctcccctaccctgtcacccagacatgagtgactgccatatcctcgcccacccatcccacaccatcccctctgtgcttttgcactgactgttgcatctccctggggtgcccccctccccgaggagacctcatgaatgtctgctcatccctcaagtgttaattgagatgctacaggtttatg

SEQ ID NO: 105692 - DNA, 601 bp, Human
actgtttcttatttcatcagttgcctttattttcaagactttccgcttataactagatagtatttattaaaatccaaaggaggtcaaaaagtcctactgactccacacttggtgcctgttcacagcctcctccttcctcctccttcttcctctccaatctgcctctcacactggtatcaaaatgactttgctaaatgcaagctggttaaaatgcttcatcgctcccacatcacatcagccataggaaaatcctaagtgctccactgggcacccacagcccttcatagtctgggctgtgacyggcgggacctcctcccctaccctgtcacccagacatgagtgactgccatatcctcgcccacccatcccacaccatcccctctgtgcttttgcactgactgttgcatctccctggggtgcccccctccccgaggagacctcatgaatgtctgctcatccctcaagtgttaattgagatgctacaggtttatgattcatatattttacaaacctattattttctcctgaaaagtgtcagcatacgtttcctgaagttttttacaattcttaacacaaagcatgtgcatatatatattacatt

SEQ ID NO: 105693 - DNA, 601 bp, Human
atccaaaggaggtcaaaaagtcctactgactccacacttggtgcctgttcacagcctcctccttcctcctccttcttcctctccaatctgcctctcacactggtatcaaaatgactttgctaaatgcaagctggttaaaatgcttcatcgctcccacatcacatcagccataggaaaatcctaagtgctccactgggcacccacagcccttcatagtctgggctgtgactggcgggacctcctcccctaccctgtcacccagacatgagtgactgccatatcctcgcccacccatcccacrccatcccctctgtgcttttgcactgactgttgcatctccctggggtgcccccctccccgaggagacctcatgaatgtctgctcatccctcaagtgttaattgagatgctacaggtttatgattcatatattttacaaacctattattttctcctgaaaagtgtcagcatacgtttcctgaagttttttacaattcttaacacaaagcatgtgcatatatatattacattatccatctctacactatctgcaaacaaggcaaaacctttgcactttttagtggaagacaaaggtgccttat

SEQ ID NO: 105694 - DNA, 601 bp, Human
gcctcctccttcctcctccttcttcctctccaatctgcctctcacactggtatcaaaatgactttgctaaatgcaagctggttaaaatgcttcatcgctcccacatcacatcagccataggaaaatcctaagtgctccactgggcacccacagcccttcatagtctgggctgtgactggcgggacctcctcccctaccctgtcacccagacatgagtgactgccatatcctcgcccacccatcccacaccatcccctctgtgcttttgcactgactgttgcatctccctggggtgcccccctccccgaggagacctcatgaatgtctgctcatccctcaagtgttaattgagatgctacaggtttatgattcatatattttacaaacctattattttctcctgaaaagtgtcagcatacgtttcctgaagttttttacaattcttaacacaaagcatgtgcatatatatattacattatccatctctacactatctgcaaacaaggcaaaacctttgcactttttagtggaagacaaaggtgccttatgtggccgtgaaatgtgcaaaaggcactcttgaaaatgtcagtttactttaaat

SEQ ID NO: 105695 - DNA, 601 bp, Human
aaaatgactttgctaaatgcaagctggttaaaatgcttcatcgctcccacatcacatcagccataggaaaatcctaagtgctccactgggcacccacagcccttcatagtctgggctgtgactggcgggacctcctcccctaccctgtcacccagacatgagtgactgccatatcctcgcccacccatcccacaccatcccctctgtgcttttgcactgactgttgcatctccctggggtgcccccctccccgaggagacctcatgaatgtctgctcatccctcaagtgttaattgagatrctacaggtttatgattcatatattttacaaacctattattttctcctgaaaagtgtcagcatacgtttcctgaagttttttacaattcttaacacaaagcatgtgcatatatatattacattatccatctctacactatctgcaaacaaggcaaaacctttgcactttttagtggaagacaaaggtgccttatgtggccgtgaaatgtgcaaaaggcactcttgaaaatgtcagtttactttaaatttttaaaagatatatgcactattagtagtgaaaataacattataaaaaccaagt

SEQ ID NO: 105696 - DNA, 601 bp, Human
tctgggctgtgactggcgggacctcctcccctaccctgtcacccagacatgagtgactgccatatcctcgcccacccatcccacaccatcccctctgtgcttttgcactgactgttgcatctccctggggtgcccccctccccgaggagacctcatgaatgtctgctcatccctcaagtgttaattgagatgctacaggtttatgattcatatattttacaaacctattattttctcctgaaaagtgtcagcatacgtttcctgaagttttttacaattcttaacacaaagcatgtgcatrtatatattacattatccatctctacactatctgcaaacaaggcaaaacctttgcactttttagtggaagacaaaggtgccttatgtggccgtgaaatgtgcaaaaggcactcttgaaaatgtcagtttactttaaatttttaaaagatatatgcactattagtagtgaaaataacattataaaaaccaagtgcacaataaatccatatttgcaaaatagttggaaacatttggtgtatctcttttttaatttgtagtaacatgcacataacataaaattcaccatcttaaccatttttag

SEQ ID NO: 105697 - DNA, 601 bp, Human
ctgaaaagtgtcagcatacgtttcctgaagttttttacaattcttaacacaaagcatgtgcatatatatattacattatccatctctacactatctgcaaacaaggcaaaacctttgcactttttagtggaagacaaaggtgccttatgtggccgtgaaatgtgcaaaaggcactcttgaaaatgtcagtttactttaaatttttaaaagatatatgcactattagtagtgaaaataacattataaaaaccaagtgcacaataaatccatatttgcaaaatagttggaaacatttggtgtrtctcttttttaatttgtagtaacatgcacataacataaaattcaccatcttaaccatttttagtgtacagttcagtagtcttaagtacattcatattacttcgtggtcattaccaccatccatctccagaactctttttatctcgcaaaactgaaaccctgtatccatttaacaagtcctcattctctgctcccggtcacccctggcactcaccattctactttctgtctctgtggatttgactaatctgggtgcctctcatatgagcgaaataatacagttttttccttttgtgcctag

SEQ ID NO: 105698 - DNA, 560 bp, Human
tgaggcatgagaattgcttgaacctgggaggcagagtttgcagtgagccaagaccatgccactgcacttcagcctgggcgacagagccagactccgtctttttatcaaggggaaaaaaaattgttattatactacatagatattctccctaaataataaaggattaggaaaagcagcattttttatatatttaatgtccaattaaatattcatcaaaagcaaataggagttcaatttatcttacccacaaagtgaacatktgtaacataaaaatagattgtgactataattaaattataacaaggtttaattttgaaaatggataaaaagattaacattaaagaatttttatagagaagaaaaacattttattttcctaggttagaaaaatcattcaaatctgtggaaataatcccattaaagccaatttaaaattataaaataatatagattgtagaaatgccaaaacacttttaaagtaaatgtcaatttaaaaaatatatagatctcaattaaataattcatctcatgttatcccattaaatcttctcactgtatat

SEQ ID NO: 105699 - DNA, 601 bp, Human
agagccagactccgtctttttatcaaggggaaaaaaaattgttattatactacatagatattctccctaaataataaaggattaggaaaagcagcattttttatatatttaatgtccaattaaatattcatcaaaagcaaataggagttcaatttatcttacccacaaagtgaacatgtgtaacataaaaatagattgtgactataattaaattataacaaggtttaattttgaaaatggataaaaagattaacattaaagaatttttatagagaagaaaaacattttattttcctaggtkagaaaaatcattcaaatctgtggaaataatcccattaaagccaatttaaaattataaaataatatagattgtagaaatgccaaaacacttttaaagtaaatgtcaatttaaaaaatatatagatctcaattaaataattcatctcatgttatcccattaaatcttctcactgtatatacggcaggctcttactgaaaaagaaacggcacaagagtattcttttgctttctaaaaggcggtactgaggaaggattgagcaacttgagtgttaaaaccaaggcaattgaaaaaaataacaaa

SEQ ID NO: 105700 - DNA, 601 bp, Human
ctttttatcaaggggaaaaaaaattgttattatactacatagatattctccctaaataataaaggattaggaaaagcagcattttttatatatttaatgtccaattaaatattcatcaaaagcaaataggagttcaatttatcttacccacaaagtgaacatgtgtaacataaaaatagattgtgactataattaaattataacaaggtttaattttgaaaatggataaaaagattaacattaaagaatttttatagagaagaaaaacattttattttcctaggttagaaaaatcattcaratctgtggaaataatcccattaaagccaatttaaaattataaaataatatagattgtagaaatgccaaaacacttttaaagtaaatgtcaatttaaaaaatatatagatctcaattaaataattcatctcatgttatcccattaaatcttctcactgtatatacggcaggctcttactgaaaaagaaacggcacaagagtattcttttgctttctaaaaggcggtactgaggaaggattgagcaacttgagtgttaaaaccaaggcaattgaaaaaaataacaaaactgcaaggaaatgc

SEQ ID NO: 105701 - DNA, 601 bp, Human
actatcggcgacaattcattaggtctttcttcaatttttgttgaaagtaaagaattagaaactgtgtaacttgccaaatgattacctcgtaatcactgtagtcattcaatttgtcaattctgtcaccaattttttaattttcccttgcacattacccctggaagtatttctaccccagtgtaatacattataatcgattcagaatgaatgagcatgtcttttctttataaagtgggagaaggagattgttaaaaaggatctgggaaggggaacccctgcaagctcccagcctggcagttcrgggcaacagtcctcttctgcccctgatgaagtaactgggactggatgcaccatctctggtaaccaggagaacacttgacaaatatatgaaacaaccactttcagacactgggtagcacgaagtgcaaaacaagacagaaactaatgaggtgagccctacacttgcccgagctctctgcccacaggcatgttcagaatcagggcacagggaaggggaatccagtcagtgcacgggaacctctgggagtggaggagaaagagatccgagagtggggagttgaggctaatggagtctgtgggg

SEQ ID NO: 105702 - DNA, 601 bp, Human
gtcaattctgtcaccaattttttaattttcccttgcacattacccctggaagtatttctaccccagtgtaatacattataatcgattcagaatgaatgagcatgtcttttctttataaagtgggagaaggagattgttaaaaaggatctgggaaggggaacccctgcaagctcccagcctggcagttcggggcaacagtcctcttctgcccctgatgaagtaactgggactggatgcaccatctctggtaaccaggagaacacttgacaaatatatgaaacaaccactttcagacactggrtagcacgaagtgcaaaacaagacagaaactaatgaggtgagccctacacttgcccgagctctctgcccacaggcatgttcagaatcagggcacagggaaggggaatccagtcagtgcacgggaacctctgggagtggaggagaaagagatccgagagtggggagttgaggctaatggagtctgtggggcacaggatcagagaagagggcatatgccaggaaagagctccggaaatcgcatacaagttcccaggtatgcacgtatcagaggtttttcaactgctcccctatatatgggcac

SEQ ID NO: 105703 - DNA, 601 bp, Human
ggtataccaatttgcacactagcattgttacaataaattctattttcctttccccatggctcccaacacaatgtgttttaaatattttaaattttgccaatctgatagattagaaattacatctcattatagtttacatttctcttaatatgagtgaggtggagcaacttttcatatgtttaaaggccatttttgtattcctttctgtgaattgtttgtctttttctactttttaaaaatacttttcctctcaatttttaagacttctttaaatattgggaatattagcccttcatccctkatacatgttttaaataatttttcccagcttcagttggtttttgacttattgtactttatgctgtgcaaactttttaatgcttacatactcatgtttattaatcttttttattgtatctggattttaagtttgaatttaacatgtttcttgcatggctttatcttttacaattagacctctgatccacttagagttgattattgtgtgaggtatgaggtataaggtgtgaggtctaattctaattttatcttttccaattggccaaccagatgtgccagcaactagattatttattacaaa

SEQ ID NO: 105704 - DNA, 601 bp, Human
taccaatttgcacactagcattgttacaataaattctattttcctttccccatggctcccaacacaatgtgttttaaatattttaaattttgccaatctgatagattagaaattacatctcattatagtttacatttctcttaatatgagtgaggtggagcaacttttcatatgtttaaaggccatttttgtattcctttctgtgaattgtttgtctttttctactttttaaaaatacttttcctctcaatttttaagacttctttaaatattgggaatattagcccttcatcccttatayatgttttaaataatttttcccagcttcagttggtttttgacttattgtactttatgctgtgcaaactttttaatgcttacatactcatgtttattaatcttttttattgtatctggattttaagtttgaatttaacatgtttcttgcatggctttatcttttacaattagacctctgatccacttagagttgattattgtgtgaggtatgaggtataaggtgtgaggtctaattctaattttatcttttccaattggccaaccagatgtgccagcaactagattatttattacaaactct

SEQ ID NO: 105705 - DNA, 601 bp, Human
cttttcctctcaatttttaagacttctttaaatattgggaatattagcccttcatcccttatacatgttttaaataatttttcccagcttcagttggtttttgacttattgtactttatgctgtgcaaactttttaatgcttacatactcatgtttattaatcttttttattgtatctggattttaagtttgaatttaacatgtttcttgcatggctttatcttttacaattagacctctgatccacttagagttgattattgtgtgaggtatgaggtataaggtgtgaggtctaattctmattttatcttttccaattggccaaccagatgtgccagcaactagattatttattacaaactctactttttcccctgtgatttgaaatacaacctttaccaccaaatgtctctatacacttggggctgttcctgcaattgtaattctattgcaccagtctctccattcatgagccagtaaggagtctgttaactaaataggctttttttttttggcggcggggaggggagcggatggagtcttgctctgttgcccaggctggagtgcagtggcaggatcccagctcactgcagcctctgcc

SEQ ID NO: 105706 - DNA, 601 bp, Human
ttaagacttctttaaatattgggaatattagcccttcatcccttatacatgttttaaataatttttcccagcttcagttggtttttgacttattgtactttatgctgtgcaaactttttaatgcttacatactcatgtttattaatcttttttattgtatctggattttaagtttgaatttaacatgtttcttgcatggctttatcttttacaattagacctctgatccacttagagttgattattgtgtgaggtatgaggtataaggtgtgaggtctaattctaattttatcttttccarttggccaaccagatgtgccagcaactagattatttattacaaactctactttttcccctgtgatttgaaatacaacctttaccaccaaatgtctctatacacttggggctgttcctgcaattgtaattctattgcaccagtctctccattcatgagccagtaaggagtctgttaactaaataggctttttttttttggcggcggggaggggagcggatggagtcttgctctgttgcccaggctggagtgcagtggcaggatcccagctcactgcagcctctgcctcctgggttcaagcga

SEQ ID NO: 105707 - DNA, 601 bp, Human
tgtttattaatcttttttattgtatctggattttaagtttgaatttaacatgtttcttgcatggctttatcttttacaattagacctctgatccacttagagttgattattgtgtgaggtatgaggtataaggtgtgaggtctaattctaattttatcttttccaattggccaaccagatgtgccagcaactagattatttattacaaactctactttttcccctgtgatttgaaatacaacctttaccaccaaatgtctctatacacttggggctgttcctgcaattgtaattctattgyaccagtctctccattcatgagccagtaaggagtctgttaactaaataggctttttttttttggcggcggggaggggagcggatggagtcttgctctgttgcccaggctggagtgcagtggcaggatcccagctcactgcagcctctgcctcctgggttcaagcgattctcctgcctcagcctcctgagtagctggtattacaggagcctgccatcatgcatggctaattattgtattttgtttgtttgtttgtttgtttgtttttggtagagaccgggttttgccatgttggccaggctg

SEQ ID NO: 105708 - DNA, 601 bp, Human
tattaatcttttttattgtatctggattttaagtttgaatttaacatgtttcttgcatggctttatcttttacaattagacctctgatccacttagagttgattattgtgtgaggtatgaggtataaggtgtgaggtctaattctaattttatcttttccaattggccaaccagatgtgccagcaactagattatttattacaaactctactttttcccctgtgatttgaaatacaacctttaccaccaaatgtctctatacacttggggctgttcctgcaattgtaattctattgcaccrgtctctccattcatgagccagtaaggagtctgttaactaaataggctttttttttttggcggcggggaggggagcggatggagtcttgctctgttgcccaggctggagtgcagtggcaggatcccagctcactgcagcctctgcctcctgggttcaagcgattctcctgcctcagcctcctgagtagctggtattacaggagcctgccatcatgcatggctaattattgtattttgtttgtttgtttgtttgtttgtttttggtagagaccgggttttgccatgttggccaggctggtct

SEQ ID NO: 105709 - DNA, 601 bp, Human
atcttttacaattagacctctgatccacttagagttgattattgtgtgaggtatgaggtataaggtgtgaggtctaattctaattttatcttttccaattggccaaccagatgtgccagcaactagattatttattacaaactctactttttcccctgtgatttgaaatacaacctttaccaccaaatgtctctatacacttggggctgttcctgcaattgtaattctattgcaccagtctctccattcatgagccagtaaggagtctgttaactaaataggctttttttttttggcggcrgggaggggagcggatggagtcttgctctgttgcccaggctggagtgcagtggcaggatcccagctcactgcagcctctgcctcctgggttcaagcgattctcctgcctcagcctcctgagtagctggtattacaggagcctgccatcatgcatggctaattattgtattttgtttgtttgtttgtttgtttgtttttggtagagaccgggttttgccatgttggccaggctggtctcgatctcctggcctcagatgatccactcgccttggcctgccaaagtgctgggattacagagaag

SEQ ID NO: 105710 - DNA, 601 bp, Human
ttgaaatacaacctttaccaccaaatgtctctatacacttggggctgttcctgcaattgtaattctattgcaccagtctctccattcatgagccagtaaggagtctgttaactaaataggctttttttttttggcggcggggaggggagcggatggagtcttgctctgttgcccaggctggagtgcagtggcaggatcccagctcactgcagcctctgcctcctgggttcaagcgattctcctgcctcagcctcctgagtagctggtattacaggagcctgccatcatgcatggctaattwttgtattttgtttgtttgtttgtttgtttgtttttggtagagaccgggttttgccatgttggccaggctggtctcgatctcctggcctcagatgatccactcgccttggcctgccaaagtgctgggattacagagaagatattttaatgtctggtaggactagttgtgcacacatgcgtgcacgtgctcacaggcttgcacgtgctcacaggcgtgcacgtgctcacacacacacacacaagactttgtacatcattgaacattagtctgcctattcttggttatgtatttttgcacatg

SEQ ID NO: 105711 - DNA, 601 bp, Human
catcattgaacattagtctgcctattcttggttatgtatttttgcacatgaacttgagtattaacttgtcgacttccagaaaacttattttgtattaggattatattaagtttttaaattaccttagggaaaactgacaacttactgtgttgagtcatctacccaagaacagggggtgtctttccatttgttcaaagctacttctatacctctcaggagcattgaaaagttttcttcatatgtgttttccacatttatttgttgctattaaaaggaggtttattacatcatcattattccstgttactgttttagatatgaaggctattgattcctgtgtgttaattttatatctcactaccttactaaaccttttatggtttggatccatttgatgattgattcactgggattttccaagtatactatcagatcatttgcaaataggtatagttttacaccttattttccaagtataatatctctaatcaatttctcttggctaattggatttcccaatgtcctcaatgcaatgtgagaaagaaatggagatagtaagcatcactgcctttttccagtcaaagtggaaatgcctctggta

SEQ ID NO: 105712 - DNA, 601 bp, Human
aagcgattctcccacctcagcctccaagtagctaggactacaggaatgcactacaattattattattattattattgtgagacagggtcttgctgtgttgcccagtctggtcttgaactcccggcctcaagtgatcctcccacctcacctcccaaagtgctgggattactggtgtcagccactgtgcctggctatgctatgattataaagtttaagtaaccctgttactcttggttcaataattaggaagtttttcctcattttcaatgttctggaataatttgtggagtattgggatgtwctggtctctaaaggtttgatagaattttctctggaaccatatgggcctgatgaaatttttaaagacagtgttttaatattaatagtgtatttcttcttttatggaaaattgtgtttaagctttctaactttaatgggagttgattttggccaactgtatttccctaggaaattattcacttaatctaagtttttaactgtatttgtgtagtggtctgaaagtagtctcataggaatttttaaattcctgttgttttcatggttttatacagctcattgataaaaatcaatgtctataaat

SEQ ID NO: 105713 - DNA, 601 bp, Human
agcgattctcccacctcagcctccaagtagctaggactacaggaatgcactacaattattattattattattattgtgagacagggtcttgctgtgttgcccagtctggtcttgaactcccggcctcaagtgatcctcccacctcacctcccaaagtgctgggattactggtgtcagccactgtgcctggctatgctatgattataaagtttaagtaaccctgttactcttggttcaataattaggaagtttttcctcattttcaatgttctggaataatttgtggagtattgggatgttytggtctctaaaggtttgatagaattttctctggaaccatatgggcctgatgaaatttttaaagacagtgttttaatattaatagtgtatttcttcttttatggaaaattgtgtttaagctttctaactttaatgggagttgattttggccaactgtatttccctaggaaattattcacttaatctaagtttttaactgtatttgtgtagtggtctgaaagtagtctcataggaatttttaaattcctgttgttttcatggttttatacagctcattgataaaaatcaatgtctataaata

SEQ ID NO: 105714 - DNA, 601 bp, Human
ttatgtggatacacatgtattatctgtaaatgcatgtgcatgttcatgagtgcatgtgtctccgcaatggttggaaaattattcagtgcatagagtaaaattctttctacaaattaataatgttaaatattagcaatttcttcagatttgatatgacacgtatcatagcttctgaccatccagagtgttatcattgttaaataaatgtatatatttttctatttacttagccttcatgcttttgattgcctaatatcttttgaaaccaaaactaatattttatacaatcctattattacamttgctattgtattacttcctggaagcatacttttctaaactaattcatgtgattaatgtctcagattattcagtgacgttgcactggtataaaatcttactgggaatatctggaaccgtgaatggtattctcactttgactttgatctccttgatcctgttgggtaagtttagaagatcttaattaaataaaaatatgaaagatgtttacttgtctcttataaatctttttataattattcattcattcttcactacattaaccaagattgaattagaagctactgcatgtaaagctcta

SEQ ID NO: 105715 - DNA, 601 bp, Human
ggttgagttttaagtctagatcatgcttggagatttttgtccataatatgttcaatacaaaatttaaaactaaactcggacaaagtgtattttctaatatgaaaattcagtacttacttgcccttatcaatttggaagctttgaagatcatgtgcaccttttccaagattctttcttgaactttttccacaggtcaaacaaatttatcagaatgtatcactaacactacattattttatacataaatttgttaatatttttaatatgttacattataagtaaataatgcaataaatatgcratttattatttaggtcatgcacagttcgttttgtgtattgagttctttacaaacctcaattcatataactgctaaacaatatcatgaagtattattatcgttcttatacaattagatataagaaggcaagagaggttgttaagtgaggtgtccacatggagttaatcttatttttaatctaactgaactacatggggcaagaggaggaatactagaatgggaatgtggagggaaatttattcttacttctgttagttgcagactctctggcaactcttgaccaaccacagctaacaaggc

SEQ ID NO: 105716 - DNA, 601 bp, Human
gttttaaaaaaagatttttaggccgggcgcggtggctcacgcctgtaatcccagcactttgggaggccgaggcatgccgatcacgaggtcaggagatcgagaccatcctggctaacacggtgaaactccgtctctactaaaaatacaaaaagtagtcgggcatgatgtcaggcgcctgtagtcctagctactcgggaggctgaggcaggagaatctcttgaacatgggcggcagaggttgcagtgagcggagattgtgccactgcactccagcctgggcgacagagtgagactccgactcaaaaaaaaaagataaattttctgcatttgacaaaatattattgctggggcaatgagaagcaataaattactaaggaataaagaagttcaggaataaaaatatatttcttaaagtctgatgttttacctgtgttaaaaattaaaatgttgtattagaaaaacttctgcactcatttttatgttaattttgaaatccagtaatggttaagactatgtggtctgcacatgagtaatagtaaagttgacatatatatatataaaaatttcttgcactacattacttttatttagtaatttataca

SEQ ID NO: 105717 - DNA, 601 bp, Human
tttaagtttttgtttgaatttttttgtattatttagagttagaataatatggaataaaattgattttaagaaaaatttgataaagtaatggtggttttttggaaaagtatttcatagatctaaagaaccaaatttcaccatctcatatagttcttataattcttgatttaactactttcaaaaattaatttctatttctcagtaaggtttttcagactcctagaacatatttttgagttatgaaatccaaatatatacatacgattgcatcagaagcgaatactttcaacaattattcttycatttattctttgacaaattcagaataatcattccacatttagtccaaatatatacattacaatgagaactctattccctgaaaatatgaaatgtttagaggcacattcaatcattaacgtgaaaattccccttgtaatcttcgaaaatagacttacagggaataacaactatcgttaccacagaggccattaagataagacagataattcccaggatcccaacaatgagcttctctggagctgatggtaaatctgcagggagagaaatgggaacagtgcgaaaggagaggtggatacag

SEQ ID NO: 105718 - DNA, 601 bp, Human
aaatatattatcgaccgaaagaagcttttcataaagtgtttaaaacatttacatcttaccatttcttcttcattatctatagaaagcagactggagttcttcgaagtacaggccagcaaactctcttcccaagttcttctttccttaccaatgtagtaacaactgttggaatatgtaatccactcctcaggacaatggccacaatgacgtgctaaataaagatatgaattactatctagaccaatatgaatttttaaaaatgaaaattagttcacatatttgcaaacatataaacctataygtatgcaacatatctatacatcttcatgggctggtaaatatatagtgtcaaaatacccagtcacttatacacacatgcgcaataaagggtcagcctttcatctcctaattgtgttcccatataaagcaaaccagcaaacaaaaatccactctatacatgtcttgaaaaatcaatgaactaatctgatttttaaggaacaataaataacttgtatcttatcatattatagcagtaagaatttgaacacaacagataaaaagaaagcatagtgattttacttatagttgatgacaagtgaat

SEQ ID NO: 105719 - DNA, 601 bp, Human
acaacaggcaaggctggtaccactggcaaggatgatctaccaggagacttgctaccaatacagccagaggaagtacttccttctcataccaagagacaccagagtggatgtgggtgaggaggatcagcaaaggaacccaatgactaccagtgcaccacccagggtcctctttgtccctgagggcatgagactcacttccccatccagagacacaggattgaatggattcttagtgttctttgtacatactacagcagtgaacagtaataaacgacagataaccgcaataatatggaggaaytgcataaatatcagataggagtgaaaaacacagacatgaaattcacagtgtatgattccctttatataaattcaaaagcaggtaaacgttatttataacattaaaagtcaagacagtgttttggagaggagtcaggataagtgatgagggcatacacaggggtggaactactagagctggaaacttttatttcatgatctgacttgtatcacaggagttcattcactttgtgatcaatctgcatgaccagatcacatcatgcccgataaaattagatagcaaaatgtattgtggattgaa

SEQ ID NO: 105720 - DNA, 601 bp, Human
aatatattaaatttgaaaaccactatttgcagtgccaaaaactttcataaatgtttataattttgatataaatgaacccatcaatgtttatacttagtacttttattcttctcatgttaataaagaagttttaattcttgcattataatagttaccccaattgactgaataaacacagtaaggatttaaataagtctcctgatactgtgcattcattcctccagatactgtgactaaatcaaactatttttgtgctatatttctcagagttggagatttagaagagaaattagaggttgtsattcagaaataaatgacatggaagctacatattgggttttctgggtaccacaccattctttaactagataagccctcacttttttatctgatttggttttggtggaataacagtgatcctgaccaggtggtgtagactcgtctctctctgctactccctactaaaaacaactataaactctgggattaatgaaagacaaaagcaatggagaactctgaaaggtggaaagagaaagatgaaattgtctgggaccctagcatcagggatcaaccaagtgtccgagcgagcatgttaagtcct

SEQ ID NO: 105721 - DNA, 601 bp, Human
ggtctattgtaaaatatttatgtcagcatttcactaactttccacatctttcttcatctctatgattccacatagatttattcatattattcttctgaatttatcctttatatatatattgttatatagcgccatacaaaacaacttactcatgtttgaaagccaaaccattcattgtcacccatggatgatgactgctgttacgaaacacaccaatccatgaggatggtgaaatgatggacagaaatttctaaaagaaaagaaagaattttcacttaaataataattatgaaaacattayaaaaacaatatattaaatttgaaaaccactatttgcagtgccaaaaactttcataaatgtttataattttgatataaatgaacccatcaatgtttatacttagtacttttattcttctcatgttaataaagaagttttaattcttgcattataatagttaccccaattgactgaataaacacagtaaggatttaaataagtctcctgatactgtgcattcattcctccagatactgtgactaaatcaaactatttttgtgctatatttctcagagttggagatttagaagagaaattaga

SEQ ID NO: 105722 - DNA, 601 bp, Human
tttttttcttttttttgctcgtcagctatcgttagtgttagtgtattttatgtgtggcccaagactcttcttcttccaatgtggcccacagaagccaaagattggacacccctggtccatctgataatcaagaaggttactagctgaccaatgagcggttgaaatatatggactactatggtctattgtaaaatatttatgtcagcatttcactaactttccacatctttcttcatctctatgattccacatagatttattcatattattcttctgaatttatcctttatatatatattgktatatagcgccatacaaaacaacttactcatgtttgaaagccaaaccattcattgtcacccatggatgatgactgctgttacgaaacacaccaatccatgaggatggtgaaatgatggacagaaatttctaaaagaaaagaaagaattttcacttaaataataattatgaaaacattacaaaaacaatatattaaatttgaaaaccactatttgcagtgccaaaaactttcataaatgtttataattttgatataaatgaacccatcaatgtttatacttagtacttttattcttctcat

SEQ ID NO: 105723 - DNA, 601 bp, Human
gggtaattaaatttttcataatattagtaagagtcattattctgaacactcaacagagtagtcccccttcatccacgagggatatgtttcaagattccagtggatgcctgaaacggcagatagtgcagaacctatagagagattatgttttctctacacattcataactgtgataaaatttaatttataaattaggcacaataagagattgacaacaataactactaataacaaaattatagcaatatgccaacagcactactcttgtgctttgaggatattcttaagaaaaaaagtaagygtggctttttaataaaaacaagcactgcaattccctgatagtccagctcgagcttgtccaactcgctgcccacgggccgcatgtgacccaggacagcttcaaatgcggcccaatacatatacgtaaactttcttaaaacattctgtgattttttttttcttttttttgctcgtcagctatcgttagtgttagtgtattttatgtgtggcccaagactcttcttcttccaatgtggcccacagaagccaaagattggacacccctggtccatctgataatcaagaaggttactagctgacc

SEQ ID NO: 105724 - DNA, 601 bp, Human; identical to SEQ ID NO: 105716

SEQ ID NO: 105725 - DNA, 601 bp, Human; identical to SEQ ID NO: 105717

SEQ ID NO: 105726 - DNA, 601 bp, Human; identical to SEQ ID NO: 105718

SEQ ID NO: 105727 - DNA, 601 bp, Human; identical to SEQ ID NO: 105719

SEQ ID NO: 105728 - DNA, 601 bp, Human; identical to SEQ ID NO: 105720

SEQ ID NO: 105729 - DNA, 601 bp, Human; identical to SEQ ID NO: 105721

SEQ ID NO: 105730 - DNA, 601 bp, Human; identical to SEQ ID NO: 105722

SEQ ID NO: 105731 - DNA, 601 bp, Human; identical to SEQ ID NO: 105723

SEQ ID NO: 105732 - DNA, 601 bp, Human
aaactggaattactacaagaagtaatcgtagatacaaccatcacaaaattaggatctagtatctaatacaaaagtacagtgacagcagaacctgaccaggtaaatgacataacaatttcactcatcagacagtacagaatattaagcataaaagaattatttagcccaaatggtatttaaatctaatttaggtaactagatgatgagtctgttcctactctactccattttccaaaggaaatccgacaaaacaaagatgtttgttattccaagccttctctcacatgaatcctcaatatakcattggaaaatactcaagaaggaatgaataattaacatttccccagtaattcccttttgtaccaccatgagactcagacgctgcttcatgttgaaaagagaaaaaggggaggtgagatgagaaaaattccaagtaaaatgatcatgacatagcatctggcagagattgaaaaatcatcaacattgccaaaagaattgtcagtgatgaaagtcaagagaacaaaatgaggttttccgacaagccacagccccatctaacctaaggggcaaaaatctccactgccgacgctacccctttcac

SEQ ID NO: 105733 - DNA, 601 bp, Human
gcaataatatccttagaatgcacaataagcactttggatcctttttatcaataataaccaataaactatattttatgtttgggaactatcctgatattgacacagaaaagctggactagaagcaactccataggttctaccaagttactcacctaaagacacaagtttatacttacttcaggaaaatatataagcaaaaaggagggagattgtatttttccccccaaaagggaggaggggaagataatctacacatgaaaggagaaaaatgatttcccagttctaactggaggcaattttrcaagagtattaacctctgtgatggcatacaaattagtataaatagttcaaagtagtaataaaagctacgaatttatatcacttacatgccttccagtcaaaacaaataactaatgttttctataacctcacctaaaacacctagtaggtactcaatgtttgatgactcagaactaatctctcaatgtctgaattttaaagatgggcatgcaaagtatgagaaaaacaaaggagggtaatcatctctgaattgtcgagtgtcaagtttgtataatacagcataaaactggaattactacaa

SEQ ID NO: 105734 - DNA, 573 bp, Human
ttcttgagacagagtctcactctgtcacccaggctgcagtgcaatggcatgatctcagctcactgcaccctccgcctctcaggttcaagcgattctcctgcctcagcctcctgagtagctgggattacaggctcccacccgccatcatacctggataatttttgtatttttgtagagaccgggccatggggtgggggggagccggggactccaccatgttagccaggctggtcttgaactgctgacctcagatgattcacctatctcagcctsccaaagtgctgggattacaggcatgaaccaccgcacccagcctagtatcttaaatttttgataagccaaataaaacctaatttcaaatcagttccatgagcacatcattggtataatttgaatacttttcatgcgttacattaatagcaaataatttaacaactttaataaaggaagacgaattttgctcaactcaaaaaaaagtacaaaattcaggtcagtcctattttttgaatgaaatggttgggcctctaaacgattggtttctctacccccttaagtatctgatatattcctgta

SEQ ID NO: 105735 - DNA, 516 bp, Human
ttcttgagacagagtctcactctgtcacccaggctgcagtgcaatggcatgatctcagctcactgcaccctccgcctctcaggttcaagcgattctcctgcctcagcctcctgagtagctgggattacaggctcccacccgccatcatacctggataatttttgtatttttgtagagaccgggccatggggtgggggggagccggggactccaccmtgttagccaggctggtcttgaactgctgacctcagatgattcacctatctcagcctcccaaagtgctgggattacaggcatgaaccaccgcacccagcctagtatcttaaatttttgataagccaaataaaacctaatttcaaatcagttccatgagcacatcattggtataatttgaatacttttcatgcgttacattaatagcaaataatttaacaactttaataaaggaagacgaattttgctcaactcaaaaaaaagtacaaaattcaggtcagtcctattttttgaatgaaatgg

SEQ ID NO: 105736 - DNA, 490 bp, Human
ttcttgagacagagtctcactctgtcacccaggctgcagtgcaatggcatgatctcagctcactgcaccctccgcctctcaggttcaagcgattctcctgcctcagcctcctgagtagctgggattacaggctcccacccgccatcatacctggataatttttgtatttttgtagagaccgggccatggrgtgggggggagccggggactccaccatgttagccaggctggtcttgaactgctgacctcagatgattcacctatctcagcctcccaaagtgctgggattacaggcatgaaccaccgcacccagcctagtatcttaaatttttgataagccaaataaaacctaatttcaaatcagttccatgagcacatcattggtataatttgaatacttttcatgcgttacattaatagcaaataatttaacaactttaataaaggaagacgaattttgctcaactcaaaaaaaagtacaaaattcagg

SEQ ID NO: 105737 - DNA, 601 bp, Human
ggagaaggaagaggaggaggaagaagaggaggaggagaaagaagaggaggaggaggaagaagaacaacaataacaactacattaacagagctcttcaggatcctcaaaaatttgtaagagcagaaaggggtcttggggaaaaaaagtttaaaaaccactgatctagccaatataaaatgttcagtactggccaggcgtggtggctcacacctgtaatcccagcactttgggaggctgaggccggaggatctcgccagctcaaaactttgagaccagcctgggcaacatggtaaaatcccayctctacaaaaaaatacaaaaattagccaggcgtggtggtgcgtgcctgttgtcccagctacttgggaggctgaggtgggaggatcacttgagcctgggaggtggagggtgcagtgagctgagatcacaccactgcactccagcctgagtgacagaggtagaccccgtctcaaaagaaaaacaactggtcagtactgctagtctctgacaataagacattttttccttatctaacatattgcaatttgatcagcattgatggaaaaaaagaaaaggcaatataaagtgaaaaaaacagtag

SEQ ID NO: 105738 - DNA, 601 bp, Human
tgcaccattgcactccagccggggtgacagggcaagattctgtctcaaaaaaacaaaaacacagatgctacagaaaggaacattcagaagatgaacaaaaacactctttgaaattaaaatgataagaactggcacggtggctcatgcctgtaatcctagcactctgggagaccgaggccaggcagatcgcatgagctcaggaattcgagatgagcctgggcaacatggcaaaacgccatctctaccaaaaatacaaaaaatagccggccttggtggcgcatgcttgtggttccagctactsaagaggccgaggtgggaggatcacttgagcctggaaggcacaggttgcggtgagctgagattgcaccactgcactcaagcctgggtgacagagtaagactccagctcaaaaaaaagaaaaaaaaaattaaaatgatagcagaaaaaaataataaaaaaatggaagaaagttgagaaaaatcttatgagaattaaaacagaagcttaaggaaatgaaagagaccagatgaaataaaatcaggaagtctaataaaaagtccaagccaggtgaggtggtgcatgcctgtaattccagagtcag

SEQ ID NO: 105739 - DNA, 601 bp, Human
atgatcaattttaaaccgacaatggggaaagctgagaaagctgatttggaccacagaacccccattgacttaggaattgtctgggccaagtacatctagaaataaaggtaaagatggagctaaaaacagaaggaagggatgaaagtctatttaacaagtagattaacactctcttctattccctcttctgttcaacacagctgaaaattagaagataatgctgctgagaaagaaaaacggggtttctgtactagggattacaaggtacagctgagggatagagtacaaacaatattaaaakcaaggagactaaatgcatttactgtatgttatgacttcaaaccctctctccattcacctccaagaacactgacaaccaagattctctccagcagtgcactgagtaattcttcttcagggaatctgaccagcaaaaagacttaaagacctaacatcagagactcccaaaaaggaactcagcaagatcattctgcagtaaagacccacaaacccacacaagagcataaaaaacaaaaacaaaaacacaactctcagtgctcacctcttaaatagaagcaaatagccaagaaacactagtttt

SEQ ID NO: 105740 - DNA, 601 bp, Human
atcatccaagttagaaagtagaaagcaaatggaaaagtagtaattgacctaaaagactcaataatgatcaattttaaaccgacaatggggaaagctgagaaagctgatttggaccacagaacccccattgacttaggaattgtctgggccaagtacatctagaaataaaggtaaagatggagctaaaaacagaaggaagggatgaaagtctatttaacaagtagattaacactctcttctattccctcttctgttcaacacagctgaaaattagaagataatgctgctgagaaagaaaaasggggtttctgtactagggattacaaggtacagctgagggatagagtacaaacaatattaaaatcaaggagactaaatgcatttactgtatgttatgacttcaaaccctctctccattcacctccaagaacactgacaaccaagattctctccagcagtgcactgagtaattcttcttcagggaatctgaccagcaaaaagacttaaagacctaacatcagagactcccaaaaaggaactcagcaagatcattctgcagtaaagacccacaaacccacacaagagcataaaaaacaaaaac

SEQ ID NO: 105741 - DNA, 601 bp, Human
caagcaatcctcccgccttagtgtcccaaagtgctgggattacaggtgtgagtcaccatgccccccggccaaagtgtacttttaaaaaagaaaagagtcaggctcactggcctgactctatagtcccagctactcaggaggctgaggcaggaggatcacttgagccaggagttccgggctgtagtacgctataatcatgcctgtgaatggactgcactccagcctgggcaacacagaaagaccccgtctcaaaaaacaaaccaactaaccaaccctaagcaagtattaagtgttggttctyggaaaatctgaatcatccaagttagaaagtagaaagcaaatggaaaagtagtaattgacctaaaagactcaataatgatcaattttaaaccgacaatggggaaagctgagaaagctgatttggaccacagaacccccattgacttaggaattgtctgggccaagtacatctagaaataaaggtaaagatggagctaaaaacagaaggaagggatgaaagtctatttaacaagtagattaacactctcttctattccctcttctgttcaacacagctgaaaattagaagataatgctgctg

SEQ ID NO: 105742 - DNA, 601 bp, Human
tttgtaaagatagggtctcactatgttgcccaggctggtctccaactcctggcctcaagcaatcctcccgccttagtgtcccaaagtgctgggattacaggtgtgagtcaccatgccccccggccaaagtgtacttttaaaaaagaaaagagtcaggctcactggcctgactctatagtcccagctactcaggaggctgaggcaggaggatcacttgagccaggagttccgggctgtagtacgctataatcatgcctgtgaatggactgcactccagcctgggcaacacagaaagaccccrtctcaaaaaacaaaccaactaaccaaccctaagcaagtattaagtgttggttctcggaaaatctgaatcatccaagttagaaagtagaaagcaaatggaaaagtagtaattgacctaaaagactcaataatgatcaattttaaaccgacaatggggaaagctgagaaagctgatttggaccacagaacccccattgacttaggaattgtctgggccaagtacatctagaaataaaggtaaagatggagctaaaaacagaaggaagggatgaaagtctatttaacaagtagattaacactc

SEQ ID NO: 105743 - DNA, 601 bp, Human
gataatggactttggggactcacagggaagtgggagagggataaaagactacatacacactgggtagagtgtacactgctcgggtgatgggtgcaccaaaatctcataaatcaccactaaagaactcttccatgcaaccaaacacccaccacctgttccccgaaaactactgaaaaataaaagttgtacagtatacaacttaatgacaatttaagaaaccaaaataggctgggctcagtggctcatgactgtaatctcagccttttgggaggccgaggccagaggatcactcgaggccagmgcattgctcaaggccaagagtttgagaccaccctggtcaacaaagcaagatctatctctatgaaaaaacttaaaaattagccaggtgtggtggtatgtgcctatagtcctagctactcgggaggctaagccaggaagactgcttaagcccaggagtttgaggatgcagtgagctatgatcacatcactactctccagcctgggtaacagagcaagaccctgactgtaagaaaaaaacaaactggcagggtatggtgtcatatgcctgtagtcccagctactcaggaggctgaggcaggag

SEQ ID NO: 105744 - DNA, 601 bp, Human
gagataatggactttggggactcacagggaagtgggagagggataaaagactacatacacactgggtagagtgtacactgctcgggtgatgggtgcaccaaaatctcataaatcaccactaaagaactcttccatgcaaccaaacacccaccacctgttccccgaaaactactgaaaaataaaagttgtacagtatacaacttaatgacaatttaagaaaccaaaataggctgggctcagtggctcatgactgtaatctcagccttttgggaggccgaggccagaggatcactcgaggccwgagcattgctcaaggccaagagtttgagaccaccctggtcaacaaagcaagatctatctctatgaaaaaacttaaaaattagccaggtgtggtggtatgtgcctatagtcctagctactcgggaggctaagccaggaagactgcttaagcccaggagtttgaggatgcagtgagctatgatcacatcactactctccagcctgggtaacagagcaagaccctgactgtaagaaaaaaacaaactggcagggtatggtgtcatatgcctgtagtcccagctactcaggaggctgaggcagg

SEQ ID NO: 105745 - DNA, 601 bp, Human
aatagtacagagaatttcagtacaccttttacctggcttcctctaagacaaaatcttcctttttttttttttctgagacggagtcttgctctgtcgcccaggctggagtgcagtggtgcgatctcggctcactgcaatctccacctcccaggttcaagcaattctcctgcctcagcctccatagctgggattacaggcgcccaccagcatgcccagctactctttgcatttttagtagagaccatgttggccaggctggtctcgaactcctgaccttgtgatcggaacccccccccgcccygcccccggcctcccaagtgctgggaattacagctgtgagacaccatgcccggccagcctctaagataaaatcttacataaccacagcacaattatcaaaactaagaaattaacagtgatataatgttattaactaaactatgtaacttatttagaatttcacccatttttctaatgccctttttctgttccaagatgtcatccaggatcccacattgcatttagctgtcatgtctccttggtctcctctgatatgtgagattttccccattttcccttgttttcatgacatggacacttt

SEQ ID NO: 105746 - DNA, 601 bp, Human
agaaaaatgaaagtggatacaactcacagagacataaaattaaccttaagaaatagagacacaggccgggtgcagtgactaacgcctataatcccagtactttgggaggctgaagcaggtggatcacttgaggtcgggagtttgagaccagcctgaccaacatggtgaaaccttgtctctattaaaaattcaaaaatgagatgggtggatcatctgaggtcaggagtttgagaccaggctggccaacatggtgaaaccctgtctctactaaaaatataaaaacttagtcaggcatggtggcgtgtgcctgtaatcccagctaccaaggaggctgaggcaggaaaactgctcgaacccgggaggcagaagttgcagtgagccaagatcactccactggactccagcctgggtgacagagtgaaactccatctcaaaaaaaataaaaaaattagcaggacatggtggtggcacgcatctgtagtcccagctactcagcaggctgaggcacaagaatcgcttaaaccctggaggcagaggttgcagtgagctgagactgcgccactgcactccagcctgggcaagagtgagactccatctcaaa

SEQ ID NO: 105747 - DNA, 601 bp, Human
gtcagtttctgcctggcactgaatgaattaattaaccaatggagagaaacttcaccaagtagacttcattcagtactttaggcagttaatgtggtccagagtttggcctaaaacaactttgcattcttagaaaaatgaaagtggatacaactcacagagacataaaattaaccttaagaaatagagacacaggccgggtgcagtgactaacgcctataatcccagtactttgggaggctgaagcaggtggatcacttgaggtcgggagtttgagaccagcctgaccaacatggtgaaaccytgtctctattaaaaattcaaaaatgagatgggtggatcatctgaggtcaggagtttgagaccaggctggccaacatggtgaaaccctgtctctactaaaaatataaaaacttagtcaggcatggtggcgtgtgcctgtaatcccagctaccaaggaggctgaggcaggaaaactgctcgaacccgggaggcagaagttgcagtgagccaagatcactccactggactccagcctgggtgacagagtgaaactccatctcaaaaaaaataaaaaaattagcaggacatggtggtggcacgc

SEQ ID NO: 105748 - DNA, 601 bp, Human
cactataaaaaattaatccgctatgataatggtagcttaaatcatatgctatgattgtagtaacaaagccaagcaaaagacactatctagtcattgttccatcctggtaacaaagacagttgagaaaagtacctagggatcacaacagaaaagctcagctgcaagcaaacctcactgcaatatcatatccaagggcgtctcacctaggtgatgcaattctagaggaaaacaaaatcaaataaaccaagctaatgctacttcagtgtaacttacctagtcaataaaactaaagtttaaaaayctagtagcctttctctaaaagacctaaattgaatcaagattttttgtttctcctaaagttaatttaaaaaaaaaaaaactagctggccaggagcagcggctcacgccggtaatcccagcactttgggaggccaaggcaggcggatcacctgaggtcaggagtttgagactaacctggccaacatggtgaaaccccgtctctactaaaaatacaaaattggccaggcgtgatggcatgcgcctgtaatccagctactcgggggggctgaggcaggacaatcgcttaaacctgggaggcaga

SEQ ID NO: 105749 - DNA, 601 bp, Human
aaagtaaaaaataaaataaatatccaatattgaggccaggagcggtcgcactttggtaggccgaggcaggcagatcacttgaggtcaggagtttgaggccagcctgggcaacatggcaaaaccccgtctctactaaaaatacaaaaattacccagcatagtggcacacacctgtagtcccagttacttgagaggctgagcccagatgattgcttgagcctgggagtcggaggctgcagtgagccaagactgcgccactgcactccagcttgggcaacagagtgagactcctgtctcaaaawacaaaactaaactaaactaaactaaactaatattggggctgggcacagtggctcatgcctgtaatcccagcactttgggaggctgaggtgggcagatcacttgaggtcaggagttcaagatcagcctggccaacatggtgaaatcctatctctactaaaaatacaaaaattaggcaggtctagtactcaggatgctgaggcacaagaatcgcttgaacctgggaagtggaggctgcagggagccaagatcacagcactgcactctggcctgggagacagagcaagactgcaaaaaaaaaa

SEQ ID NO: 105750 - DNA, 601 bp, Human
acgcctgtaatcccagcactttgggaggccaaggtgggtagatcacctgaggtcaggagtttgagaccagcctggccagcatggtgaaattctgtctgtactaaaaatgcaaaaattagccaggcattgtggctcatgcctgtaatcccagctactccggaggctgaggcaggacaatcacttaatcctgggaggcaaaggttacagtgagccaagactgtgccactgcactccagcctgtgcaacacagtgagacttcatctcgagaaagaaaaaaaaaagaaaaaaaaaaaaaaaaaamcaattagccaggcatggtggtacatactgttgtcccagacacttgagaggctaaggtgggaggattgcttgagcccaggaggtcaaagctacaatgaaccgtgatcatgccactgcagtccagcctgggtgacacagcgagacactgtctcaaaaaaaaaaaaaaaaaaaagaagaaagaaagaaaacaagtgctgggacacaaagcaagtctcaacaaatttcaaatgtttgaaatcatatagaacgtattatctgccctcagtgaaactgaacaagaaatttacaactaaaagatatc

SEQ ID NO: 105751 - DNA, 601 bp, Human
ggaatcccaaccttgccttaaaaaaaaaaaaaaaaaaaaagagagagagagacagagagagataaatcacataccatacaattcacctacttttttttttttggaaacagagtgcagtggcatgatcgtggctcaccatggcctcaacctcctgggttgaaataatcctctgaccttagcctccagagtagcagacgatacaggtggaaagtgctgggattacagatatgagaaattcaccgttttaaggccaggtgcggtggctcatggctgtaatctcagcactttgagaggccaaggygggcagatgacttgaggtcaggagtttcagatcagcctggccaacatggtgaaaccccatctctactaaaaatacaaaaatcagccgggtgtggtggcagagacccacaatctgagctacttgggaggctgaggcagggaaatcacttgaacccgggaggcggaggttgcagtgagccgagattgtgccactgcactccagcctgggcaacagagaaagactctgtctccaaaaaaaaagaaaaagaaattcaccagtgaaagtaattctagatgaaggtatctcctaattgaaaacaag

SEQ ID NO: 105752 - DNA, 601 bp, Human
atctcggctcactgcaacgtccacctcctgggttcaagcaattctcctgtctcagcctcccgagtatctgagattacaggcgtgtgccaccatgcctggctaatttttttacttttagtagagacagggtttcactatgttcgcctggctggtctcaaactcctgacctcatgatccgcctgccttgacctcccaaagtgctgggattacaagcatgagcgtccacatctggcctcaattattttcttcatggcatctggaaacttgtcttggttggcagaagctgcttctgctgttacaytgatttttttgttgttgttgttttaagccaagtctttcaaaaatcatcaagccatcccttgctggaattaattctccagctgtattttaggccaggcgcggtggctcacagctgtaatcccaacactttgggaggctgaggcaggcagatcacctgaagtcaggagtttgagatcagcctggccaacatggcaaaacctcatttctactaaaaatacaagaattagccgggtgtggtgatgcgcgcctgtaatcccagctacgcaggagactgaggcaggagaatcgtttgaacccagga

SEQ ID NO: 105753 - DNA, 601 bp, Human
taagaaccatacctaaaaggccgggtgcggtggctcacgcctgtaatcccagcactttgggaggccgaggcgggcggatcacgaggtcaggagattgagaccatcctggctaacatggtgaaactccatctctactaaaaatacaaaaaattagccaggcgtggtggcgggcacctgtagtctcagctacttgggacgctgaggcaggagaatggcgtgaacccgggaggcagagcttgcagtgagtcgagactgcgccaccgcgctccagactgggtgacagagcgagactctgtctcamaaaatatatataaataaataaatcagccgggcgtgggggagtgcgccttgtaaacccagctacttgggaggctcaggcaacagaatcgcttgaatctgggaggcagagattgcagtgagctgagagtgcaccactgtactacagtctgggcgacacagtgagactctgtctcaaagcaaacaaacaaacagatctgttcaggcagctatcctttctcctcagtgattttcttttttttcccccgagacgatgtcttgctctgtcacccaggctggagtgcagtgacgcgatctcggctca

SEQ ID NO: 105754 - DNA, 601 bp, Human
tttttagtagagacggggtttcaccgtgttagccaacatggtgtcgatctccagaccttgtgatccgcccgccttggcctcccgaagtgctgggattacaggcgtgagccactgcgcctggcctcctaaatgtatttctttacagcacttttgactagattaataaattatttgattaactgttaaatgtccaacttctccccactagaagttccatgagagtaaggttggttgatttgttcactgcagtatgctatatacccaggatgcagaatagtgcctgatatataacaaaaactcyaggaaataaagaataatgaagatgttgagaatgacaaatgccagagaagataagctttagcacagttagggattggcttttgataggaggagggcatttactgcagtatactggaatgaaagaggattagtacaaatactgttacatgtacttagatgatgtggtaagaaaaataaataagggcattcctgccttatactttccatttctctaagaagcaaggtcttcaaagtaagggtcaaagaagagtggtaaaagtggtaaagttagcttttgaggagtacagagttagtatgaaat

SEQ ID NO: 105755 - DNA, 601 bp, Human
agcaaagaaaaagatatcccactgaacacttcattttctcttccatgacaaaaacattcacttgagaatatattagttcgaacatcaaagtacatttgttgatatacataggcaacatcacaaactgactaaaagtaaattttatagtatataagtcaagaacagtactctcttccttctctgaaaatagcaaattgtgacttacaaattatgcagctaggtagtactataaaggccacaatcattatcatgctaagatcatgttttcctaaatgcatttcgtttttttttttttttttttgagacggagtctcgctctgtcacccaggctggagtgcagtggctcaatctcagctcaccgcaacctccgcctcccggggttcacgccattctcctgcctcagcctcctgaatagctgggactacaggcgcccgacaccaggcccggctaattttttgtatttttagtagagacggggtttcaccgtgttagccaacatggtgtcgatctccagaccttgtgatccgcccgccttggcctcccgaagtgctgggattacaggcgtgagccactgcgcctggcctcctaaatgtatttcttt

SEQ ID NO: 105756 - DNA, 601 bp, Human
aggctggtctcgaactcctgacctcaagtgatctgcccacctcggcctcccaaagtgctgggattacagccatgagccactgcgcctggccgaaagaaatatttattgattgcctactaggcaccatcattagcagctgagaatcctgtggtaaaagaataaaaagcagacaagaatctatgcccttgcaaaggttacagtctgctaagacaaacaataagctaattaagtaaaatagtatgttagagagtagtatgagagaaaaaaaccaggaaaaggacaataaaagatattatggtaygatgtcaatatttttagataagatactcaataaaggctaagaaaatgactctcaccactcctacccacatatctatatactgtaaaccagtaccctgcatttcaatatataagattttttttagttacataaataaaacaccacaaactttatgtatgtcaattcctgtacagcaaatatttctaacaaataggtttttaaagaaaaaattgaactgtttctcaaattccatataaacgcttatgcatttctcattcactttgccttaatatgggattactgcatataggctgcagaaag

SEQ ID NO: 105757 - DNA, 601 bp, Human
atatatatatatatatattttttttttttttttttttttttgagacagtctcacactcttgcccaagctggtatataggggtgtgattttgtctcagtgcagcctcaacctcctggctcaagcaatcctctcgagtagctgggactacaggtgcatgccaccatgccccactaatttctgtatttttttatagagacagggttttgccatgttgtccaggctagtctggaacccctaggttcaagagatcttccccacttggccttccaacacgctgggactataggcatgagccactacaccctgcctaaagataatatctttatatgaaaaatcaatgcaatgttgataagtctttacatgtttttacatatattcaagaatgaaagctacagtaaattacataaattgattatctactaagtgccgatttatacacattgccccatttagttctcatttattcgttcatcgattatttatttatttatttatttagagacagagtctcgctcagtcgcccaggctggagtgcagtggcgtgatctcggctcaccgcaatttctgcctcctgggttcaagcaattttagtgcctcagcc

SEQ ID NO: 105758 - DNA, 601 bp, Human
atatatatatatatatatatatattttttttttttttttttttttttgagacagtctcacactcttgcccaagctggtatataggggtgtgattttgtctcagtgcagcctcaacctcctggctcaagcaatcctctcgagtagctgggactacaggtgcatgccaccatgccccactaatttctgtatttttttatagagacagggttttgccatgttgtccaggctagtctggaacccctaggttcaagagatcttccccacttggccttccaacacgctgggactataggcatgagccactacaccctgcctaaagataatatctttatatgaaaaatcaatgcaatgttgataagtctttacatgtttttacatatattcaagaatgaaagctacagtaaattacataaattgattatctactaagtgccgatttatacacattgccccatttagttctcatttattcgttcatcgattatttatttatttatttatttagagacagagtctcgctcagtcgcccaggctggagtgcagtggcgtgatctcggctcaccgcaatttctgcctcctgggttcaagcaattttagtgcc

SEQ ID NO: 105759 - DNA, 601 bp, Human
atatatatatatatatatatatatattttttttttttttttttttttttgagacagtctcacactcttgcccaagctggtatataggggtgtgattttgtctcagtgcagcctcaacctcctggctcaagcaatcctctcgagtagctgggactacaggtgcatgccaccatgccccactaatttctgtatttttttatagagacagggttttgccatgttgtccaggctagtctggaacccctaggttcaagagatcttccccacttggccttccaacacgctgggactataggcatgagccactacaccctgcctaaagataatatctttatatgaaaaatcaatgcaatgttgataagtctttacatgtttttacatatattcaagaatgaaagctacagtaaattacataaattgattatctactaagtgccgatttatacacattgccccatttagttctcatttattcgttcatcgattatttatttatttatttatttagagacagagtctcgctcagtcgcccaggctggagtgcagtggcgtgatctcggctcaccgcaatttctgcctcctgggttcaagcaattttagtg

SEQ ID NO: 105760 - DNA, 601 bp, Human
atgatcatctctaatctttatacattcctgccaggtagcttattctcatccctacttttctcattttacaaataacaagacaatggcaactttggtttaaatatttgtatttgaactttagtttgagtatctgattgttctccactcagaatggtaagtatctgccccaagagcagttttataaaatactgttgatatattgtcaactgtcctaatgccatagacagccagagactcacaaacatcataactttccataagagacatgatttttccaatataaaataaaagtcattaggtraggaaaacaagttttcctctgtaccacacaatgatagcttccttctgtggtgaaaacaaatgtaaagttctattgcctggctgctgttttccctatcaagagaaaatggtgaaataataagagaatagaaagaaggcagactacaaaaaagaaaggaaaaaaagtatacaagttaaaaaacagtccagtattaattaggggagataaataaaaagaatggaagaaagacagactccagaaagaggatgttgatatggactctattttagaagttttaccacctcattaatgtttgtgtgc

SEQ ID NO: 105761 - DNA, 601 bp, Human
tgagccaccacacctggccgctttcaaattttaagaaatgacatgctatatatcaaaacataaaagagaatattcaggaaaaaaaaaacacctaagaaataacactggaaattaaataatgtttttgggtgcaggtctcaaagtactgcatttaagatattcactgtttaggtgacaagtatctcttcaaggggtagtgggctagaatacagattttacactgtatttaaagaaaacattccaaaggatgaaagacaaaaatccaacaaataaatacacattactttttttttttttttttgcaacggagtttcgctcttgttgcccaggctagagtgcaatggcgcaatctcagctcactgcaacctctgcatcctggattcaagcgattctcctgcctcagcctcccaagtagctgggattataggcgcccgccaccacgcctggctaattttttgtatttttaatagagatggggtttcatcatgttggccaagctggtctcaaactcctgacctcagatgatccacctgcctcagcctcccaaagtgctgggattacaggtgtgagccaccgcaccctgcccacataacttcttttt

SEQ ID NO: 105762 - DNA, 601 bp, Human
aaacctaaggtaaatgtcaatgagcagcctaagctatcagagtaaaggaattaatgcttctttgaaagcttctctcaagctaaaatgtgtctctttcctattgggtctagaatactttcaaacctgttttttaactaccgtgcttgtatttctcccatacattttccccagaacatgcgagtgtgtgcgcgcacgcatgcacgcgtgtgtgtgtataatgtaacaaaaaggaggaagatctttttgcagccctacataaaaatgtctttacgtactatccatatctatattacaggaagaraagcctgaaaacaagtatcaagttcttgcatcatgataaagtcgtttccaagctttcaaatttttttttttttttttagacagactctcattcttgtcgctcaggctgaagtgcagtggtgtgatctcggctcactgcaacctctgcctcccgggttcaaacgattctcctgcctcagcctcccgagtagctgggattacaggcgcccgccaccacgcccagctaatttttgtatttttagaaaagatggggtttcgccatgttggccaggctggtcttcaactcctgacctcaggtgat

SEQ ID NO: 105763 - DNA, 601 bp, Human
caatttattacatagttcattttccccagtgatttgaggtaccaccttcatacttattttccatatgaaactgggtctgttcctagcttttctttttttttttttgagacagtctcactctgttagccaggctggagtgcagtggcacaatcacagctcacggcaacctccacctcctgggctcaagcaattctcctgcctcagcctcctgaggagctgggattacaggcacatgccaccacgcccggctaatttttgtatttttagtagagacgaggtttcactaggttggccaggctgktctcaaactcctgacctcaggtaatccacctgccttggcctcccaaagtgctgggactacaggcatgagccaccacgctcgcctgttgctagcttttctactctgttctacttttccataacttttcatgcagcaagaccacattgctttaattatagaggcttttttttttttttgacagtttcactctgtcacccatgctggggtgcagtgacacgatctcagatcactgacctctccctcctgggatcaagtgattctcatgtctcagccacccaagtagctgggattacaggcatg

SEQ ID NO: 105764 - DNA, 601 bp, Human
tttttcactgtttgaaaatatactgctagtttgtaaggcctgctcttgccaggtggaaggaaacctatacaccagagaatagaatactcacacaattatttcatattttttcaatttggtaacctcaactcaacttacctgctttacattgtatccagcttttgcactagtttcaataaacataacattcagctctttggctttcctctctccctcctcaattgacacttgcctgtaaagaaacaaacaaacttcttacttttgagacatgaggcagtattataaagattataaagaaagytctgaaaataactttccttgatataaggactggttatacaggtcacattagtttaaaaattcattaatctgccacactcttgaaatttgtgtgtttctgtgtgtgtatacttaacatttttttaaagacttttttttgttactgatttgctttcacttgactgggctcatcctgtaatttttttacttttacaaacttaatagcttgaggatgctcgagcccaggaatgttgaggctgcagcaggccattattaggccaccacatcactgcactccagtctgggcaacagaacctgtctc

SEQ ID NO: 105765 - DNA, 601 bp, Human
tggtggctcacacctgtcccagcactttgggaggccaaggcaggcggatcacctgaggtcaggagtttgagaccagcctgaccaacatgaaaaaaaccccatctctactaaaaatacaaaattagctgggcatggtggcgcatgccagtaatcccagctacccgagaggctgaggcaggagagctgcttgaacccaggaggtggaggttgcagtgagccgagatcacgccattgcattcaagcctcggcaacaagagcgaaactccatctcaaaaaagaaaaaaaaaaaaaaaaagaaaakaaaatttacctttaaagcaatgtagtaggaatgtagtgacaatatggtagatttaccactttgcagtagttctatccacgatctgaagtttgcaagtcttttctctttttccaaaaactatgccacatttatatttttcactgtttgaaaatatactgctagtttgtaaggcctgctcttgccaggtggaaggaaacctatacaccagagaatagaatactcacacaattatttcatattttttcaatttggtaacctcaactcaacttacctgctttacattgtatccagcttttgcac

SEQ ID NO: 105766 - DNA, 601 bp, Human
taacacagtgaaaccccgtctctactaaaaatacaagacattagccaggcgtgatgcaggcacctgtagtcccagctactcgggaggctgaggtaggagaatggcgtgaacctgggaggtgaagcttgcagtgagccgagaccgcgccactgcactccagcctgggcgacagagcaagactccatctcaaaaaaaaaaaaaattattggtccataaatcttataaatctgggaccactaccctacatgatatacagccttgaagagttaagcatgtgagtctctggctgacctatcttgtrgaaaatggcttgataatgtgacatctccctatattttcctgccctcccccaaaaagacctgttgtaaacactgttcaaacaccagcattttattaaggataaagtaaccagaatttacttttacaacaagaagtggaacaccattactgacagtaaatacttgctttcatttatctcagtcttggcatcaaactctgaaataaaatttaccggccgggcatggtggctcacacctgtcccagcactttgggaggccaaggcaggcggatcacctgaggtcaggagtttgagaccagcctg

SEQ ID NO: 105767 - DNA, 601 bp, Human
tggtctaggccgggcgcggtggctcacacctgtaatcccagcactttgggaggctgaggcaggcagatcacgaggtcaggagattgagaccatcctggctaacacagtgaaaccccgtctctactaaaaatacaagacattagccaggcgtgatgcaggcacctgtagtcccagctactcgggaggctgaggtaggagaatggcgtgaacctgggaggtgaagcttgcagtgagccgagaccgcgccactgcactccagcctgggcgacagagcaagactccatctcaaaaaaaaaaaaaattattggtccataaatcttataaatctgggaccactaccctacatgatatacagccttgaagagttaagcatgtgagtctctggctgacctatcttgtagaaaatggcttgataatgtgacatctccctatattttcctgccctcccccaaaaagacctgttgtaaacactgttcaaacaccagcattttattaaggataaagtaaccagaatttacttttacaacaagaagtggaacaccattactgacagtaaatacttgctttcatttatctcagtcttggcatcaaactctgaaat

SEQ ID NO: 105768 - DNA, 601 bp, Human
ctgctttgtcttagaatagtggcatatggctaatataatggtattacacaaattatttaactgtctgtggctcctatgggttcagttacgtatcacttactacgttccatacacattgctaggttctgggaatatataattccgatgagagagagagagagagagagagagagagagagagattttcaatatactatggtaagtaatgatactgtttttgctgagatcaggtcggtgaaaacacataagagaatcaggtgtcacagacaggaggtaggatgggaaatgtcagagaaaatgytgctgaggagctgacatctaaactgaaacttataaggagtacaattaggaaagggaaaaaaaatgaacattctaagcaaaggaaacaaaagcatgagcacaggtatcaaaccatgaccatgaaacaatatgttaatgaggaaagaatcagtgatcattcaatattacttacattatgattcaaggcatggagggaaataaattaaaaaatataaaaacaatataaagacttcttcctaaagctttaactatttaaatgatgttactgttaccctctgttgatcaccctcaattaagaaaa

SEQ ID NO: 105769 - DNA, 601 bp, Human
gtggtggctcacacctgtaattccagcactctgggagacagaggcaggcagatcacttaaggccaggagtttgagtcaagcctggccaacaaggtgaaaccctgtctttactaaaagtacaaaaattagccgggaatggtgctgcacacctgtaatcccagctactggggagtgtgaggcatgacaatcacttgaaccctggaggcagaggttgcagtgagccgagattgcaccactgcactcagcctggctgacacagcaagaccctgtctcaaataaaaaaataaataaatataagagraaatatatataagaaatagaaaagagaaagccagatgaagctacccactgctttgtcttagaatagtggcatatggctaatataatggtattacacaaattatttaactgtctgtggctcctatgggttcagttacgtatcacttactacgttccatacacattgctaggttctgggaatatataattccgatgagagagagagagagagagagagagagagagagagattttcaatatactatggtaagtaatgatactgtttttgctgagatcaggtcggtgaaaacacataagagaa

SEQ ID NO: 105770 - DNA, 601 bp, Human
ctgaccaacatagtgaaactccgtctctactaaaaatacaaaaaaattagctgggcatggtggcgctcgactgtagtcccagctactcgggaggctgcggcaggagaatcacttcaacccaggaggcagaggttgcagtgagctgagatcgtgccactgcactccagcctggcgacagagtgagactccatctcaaaaaaaataaataaataaaaaataaaaatagtctgggtgcagtggctcacacctgtaatcccagcactttgggaggccgaggtgggcagatcacgaggtcaggagrtcgagaccatcctggtgaacacggtgaaaccccctatctactaaaaatacaaaaaattagccaggcgtggtggtgggcgcctgtagtcccagctgctcgggaggctgaggcaggagaatggcgtgaacctgggaggcggagcttgcagtgagccgagatcacgccactgcactccagcctcgatgacagagcgagactccatctcgaaaataaataataaataaataaataacaaaaataataaaaataaaattggaagcaatcaaacattatgaagatactagacatcagtggtgctta

SEQ ID NO: 105771 - DNA, 601 bp, Human
aaggctgcaatgagctgtgatcatgccactgcactccagcctgggcaacagagcaagaccacaactcaaaaaaataaaaataagaagggccaggcatggtggctcacacctgtaattccagcaatttgggagaccgaggcaggcagatcacgaggtcaggagatcgagaccatcctgaccaacatagtgaaactccgtctctactaaaaatacaaaaaaattagctgggcatggtggcgctcgactgtagtcccagctactcgggaggctgcggcaggagaatcacttcaacccaggaggmagaggttgcagtgagctgagatcgtgccactgcactccagcctggcgacagagtgagactccatctcaaaaaaaataaataaataaaaaataaaaatagtctgggtgcagtggctcacacctgtaatcccagcactttgggaggccgaggtgggcagatcacgaggtcaggagatcgagaccatcctggtgaacacggtgaaaccccctatctactaaaaatacaaaaaattagccaggcgtggtggtgggcgcctgtagtcccagctgctcgggaggctgaggcaggagaatggcgtga

SEQ ID NO: 105772 - DNA, 601 bp, Human
ctacaaaaaatataaaaattagctagacacagtggcatgcacttataatcccagctaggcaggaggctgaggcatgagaatcacttgaaccagggaggcggaggttgcagtgagccaagattgtgccactcactccagcctgggcaacagagcaagactgtctaaaaaaaacccaaaacaaaaacaaaaacaatctaaattaaaagtaagaagggctgggcgccgtggctcacgcctgtatacccagcactttgggaggccgagatggatggatcttgaggtcaggatcatataaaaatayaaaaattggctgggcgtggtggcatgcgcctgtagtcccagctatttgggaggctgaggcaggagaactgcttgaacccgggaggcaaggttgcagtgagccgaggtggtgccactgcactccagcctgggcaacagagggagactccatctcaaaaaaaaaaaaaaaatttctaacatcagattatggtaatagttgtacaatgctataaatttactaaaaatcgaccaggcagaggggctcatacctataatctcgaaatcttcgaggccaagttgggaggatcacctgagtctagga

SEQ ID NO: 105773 - DNA, 601 bp, Human
ctcaatgttttccaagacagtgactagactgtgaaatttacctcagaaagtcctgaataccagcacaacttctgaattgtgactgacctacatagcaagaactcagaagagatcagagattatttcacgataatcagttttatttcctttatcagatattttaatttttacccctataaattcagtgcagactttagctttggtaatagcagagcagcttgtataagactaacactcttgtacatacagcaatgattaactctggatatggggacatttcttttttctttcgtgttttttgttttttattttgagacagggtcttgctctattgctcaggctggagtgcagtggtgtgatctcagctcactgctgcctcgaccccctgggccaagcaatccacccagctcaacctcccaagtagttgggactaccacgctgggttaatttctgtgtttttttgtagagacagggtttcgtcatgttgcccaagcaggtctcaattgctgggctcaagaaatcagcctgccttgccttggcctcccaaaagcgctgggaatacaggcctgtgcaaccacacacagcccacgagggacagttc

SEQ ID NO: 105774 - DNA, 601 bp, Human
catggttagtatgtacacaagctttcattgacctgttagagctgatgcccatcagctatcactagtttctcataaagtcttctctctttcaaacaaatcttctttttatgataagtactaatgattttagaagttgaagatcaaggagtttttcttttctttttccatttttcagtactacaaaatatataataaggtgacaccacacacttattgcttcactaaaagaatgtactaattcccagatgaaaagccaggtgaaggctaaagtaatcaccttatcattatcatttcttcagcmatttaaacaccataccactttcaaaaacaaagtaatacttatgcattagaaaaaaagaatttgggccaggcaccatggctcacacctgtaattccaacactttgggaggccaaggctggtggatcacttgaggcctgggcaatatagcaagacccatctctaggaaaaataaataattagctgggtatgatagtgggggcctgtagtcctagctacttagaaggctgatgaggcaggaggattgcttgagcccagcagttcaaggctgcagtgagccgtgttcataccactatactccag

SEQ ID NO: 105775 - DNA, 601 bp, Human
catccccagttacctatccaaatcaagtacactcagttcagctcagatactttttttgcgatttttttttttttttttttttgagatggagtcttgctctgtcgcccaggctgtaatgcaatggcacaatctcaggtcactccaacctccgcctcccaggttcaagtgattctcctgcctcagccttcccagtagctgggattacaggcgcccgccaccacacccagctaattttttgtatttttagtagagacagagtttcaccatgttggtcaggctggtctcgaactcctgacctccrgtgattcacccaccttggcctcccaaggtgctgggattacatgtttgagccactgcgccaggccgataatgctgttttttaaacaaagcattcctcaaccattctaactatatgtgatatcattcaattagtcaataaacctctttgtgccagcattcgttttgcttctctcctttttaatttttttgaatcaagggtcttgctctgtcatccaggctggagtgcagtggcgtgctaatagctcactgcaacctccaactcctggggtcaagtgacggtcccatctcaggctctctcagg

SEQ ID NO: 105776 - DNA, 601 bp, Human
tcttgaactcctggcctcaagtgatctgcctgcttcagtctcccaaaacactgggattacaggcatgagccactgtgcctggcccctacttcatttttctctatagaatctataacctccttaaggattatatttcactaattgtctaactctccataccagaatgtaagctccataatggcacagacttaggtattttgttccattattgtatccccagtgcctataacataactaggcatgcaggaggtgatcaacaaatatctgagttaattaatgactgaataaaacctgatcaatrtaatttctctgtcagttcatattcattatacatatagatttctgaccattcagttatattgaagtcctactgtgggctgggcatggtggctcacgcctgtaaccccagcactttgggaggccaaggtgggcagatcacctgaggtcaggagttcaagaccagcctggccaacatggcaaaactccatctctactaaaaaatacaaaaattagccaggcgaggtggagcatgcctataatcccagctattcagtaggctgaggtaggagaatcacttgaaccctggaggcagagattgcag

SEQ ID NO: 105777 - DNA, 601 bp, Human
gagatcctgtcaaatctctcatgaaaatggcttcctctctcactgggaataaaatgccaaatcctcactactgcccacatggtcttaaggcctctgttctccataactatctctgtgagctcttttcttatcatatgccccttccttcactctagtgtaaccttactaatttccttactattccttaaacatgacaagttcctttgaatttgtcactgcacttgaagcttggcatgctcttccctggatgtataaatggctcactttctcaattccttcagttctttgctcaaatatcacyttatcagacaggctttccctccttttataagacatcaatatatcataattcccttcaccagtattctttatccttcttaccctactttatttttctgtttttcttttctttttttttctttttgaaacagtctcactctgtctcccagactggagtgcagtggcatggtctcggctcactgcaacctccgcctcactgcaacctccaccacccaggttcaagtgattcttgtgcttcagccttctaagtagctgggattacaggtgagcaccaccacactcggctgattttcgtattttt

SEQ ID NO: 105778 - DNA, 601 bp, Human
aaacttggtgctttctccaaaatactccaattagattaaaagaatcagtgtcactaacctaaactcaactcaggacatcccaaagtgggccaaaaaaactttacaaaggttttcaaattcaaacttacttcttggtttaaaaaaaagaaaaacctatttcttaaatgccaatgatatgctaacaaaggcttctgccatattaggaatcacaaatgactaagtatgagactagtacagtttgtaatacttaaaaaaaaatcctcatatttactaagtatccagtttttttgtttttttttttcttttttgagacggagtctcgctctgtcacccaggctggaatacagtggcgcaatctcggctcactgcaacctctgcctcccgggttcaagtgattctcacgcctcagcctcctgagtagctgggattacaggcgcgtgacaccatgtctggctaatttttttgtatttttagtagagatggggtttcaccatgttggtcaggctggtcttgaactcctgacctgataatctgcccaccttggcctcccaaagtactgggattacaggcgtgagccactgcacccagccgagaatccact

SEQ ID NO: 105779 - DNA, 601 bp, Human
ggcctggagtttgagaccagcctggccaacacggcaaaactctgtctttaccaaaaaatacaaaaaattagctgggcatggtggcacacgcgtgcaatcccagctactcggcaggctgaggcacgagaatcgcttgaacccaggagattgaggtaacagtgagctgagatcgtgccactgcactcaagcctgggcaacacgcaagactgtgtctcaaaaaataaaaaaaaattaaaaataaaaatatatccaaatttttttaatctatagttttaatctatatatttaacaaacttggtgytttctccaaaatactccaattagattaaaagaatcagtgtcactaacctaaactcaactcaggacatcccaaagtgggccaaaaaaactttacaaaggttttcaaattcaaacttacttcttggtttaaaaaaaagaaaaacctatttcttaaatgccaatgatatgctaacaaaggcttctgccatattaggaatcacaaatgactaagtatgagactagtacagtttgtaatacttaaaaaaaaatcctcatatttactaagtatccagtttttttgtttttttttttcttttttgag

SEQ ID NO: 105780 - DNA, 601 bp, Human
aacaatcaaatcaaagaagggaagaaaagacactgagtacttactctgttggaatgtttacgtattttctcattttaatcctcttatttgtgaggaaaatgttaataaccccattttaaacaaatctaaggctaaagaatttgccatagaccaaataaatggcagagctgagattccaaagctcgtattttttataatacctaagctgcctagtataaatggagtattttttatatggaaagcactgtgaaagggctatgtgaagaaacagctaataatcttgggtaagaagaatttgttytgtaaaatactattacacataaatgacagacacaaaaagctaatccatttttttacgacaaaaattttaggctgggtgcagtggctcatgcctgtaatcccagcactttgggaggccaagatgggatgatcacttgggcccagaagttcgagatcagcctgggaataaggagatcctgtctctacagaaaattaatttaaaaatataccaggtcaggcacagtggctcatgcctataattccagcactctgggaggccaaggtgggcagatcacttgaggcctggagtttgagaccagcc

SEQ ID NO: 105781 - DNA, 601 bp, Human
tgcagctagggttaagaaccaatgctgtagtaacaatttttaagggtgtgaaacaatcaaatcaaagaagggaagaaaagacactgagtacttactctgttggaatgtttacgtattttctcattttaatcctcttatttgtgaggaaaatgttaataaccccattttaaacaaatctaaggctaaagaatttgccatagaccaaataaatggcagagctgagattccaaagctcgtattttttataatacctaagctgcctagtataaatggagtattttttatatggaaagcactgtgwaagggctatgtgaagaaacagctaataatcttgggtaagaagaatttgttttgtaaaatactattacacataaatgacagacacaaaaagctaatccatttttttacgacaaaaattttaggctgggtgcagtggctcatgcctgtaatcccagcactttgggaggccaagatgggatgatcacttgggcccagaagttcgagatcagcctgggaataaggagatcctgtctctacagaaaattaatttaaaaatataccaggtcaggcacagtggctcatgcctataattccagcactc

SEQ ID NO: 105782 - DNA, 601 bp, Human
aattacctgggaagcttaaaaacaaacaaaactccagatgcttgggcctcaccctcaaagactgattcaactgatgtggggtggggctgagccattcgtgttttattcaaatatctctggatgattctaatgtgcagctagggttaagaaccaatgctgtagtaacaatttttaagggtgtgaaacaatcaaatcaaagaagggaagaaaagacactgagtacttactctgttggaatgtttacgtattttctcattttaatcctcttatttgtgaggaaaatgttaataaccccattttraacaaatctaaggctaaagaatttgccatagaccaaataaatggcagagctgagattccaaagctcgtattttttataatacctaagctgcctagtataaatggagtattttttatatggaaagcactgtgaaagggctatgtgaagaaacagctaataatcttgggtaagaagaatttgttttgtaaaatactattacacataaatgacagacacaaaaagctaatccatttttttacgacaaaaattttaggctgggtgcagtggctcatgcctgtaatcccagcactttgggaggcc

SEQ ID NO: 105783 - DNA, 601 bp, Human
accctcccagttcaatttgcctagctgacactcatccttcaggacccattccttgataactccttaaaagcttctctaactcactccccagttccttaaatcttcttcctcctgtctaataaaatctttttaaaaaatacactgtctcactgtgttgccaggctggagtgcaatgaaaatgtgatcataactcatgatagccttgaactcctgggttcaagcaatcctcctgcctcagcctcctgagtagctaggactacagggatgtgccaaggcacccagctaattcttttttttttttaacattttcaaataatttattaggaatttaaaactgaaaataaaacctggaaaaagaagttacagatgtggagagaagagacaccggagggtggtaacttgctggcttcgaaataccatgtaacatcttaaaaaaaaaaaaaaaaaaacccaaacaaatcagcaaacggaattccagggttctgagcccatggttgggtccagtggggtggaagggtccgggtatgggggacagggaagctaagtgtctctggactcagctcaaatgtgtagaaaattaaaaataaaaaccaacaaaatg

SEQ ID NO: 105784 - DNA, 601 bp, Human
gggaaaacttcttttcacatggtgtaaggcagaaagggtaaaagcctatttccataatttaatacagcatttaatgtgcatatagaaagagcatagaatacaagcccagaaagaaactctactattaactaccccattattacagctttgtaatctcaaggatatttactatctctaattcttagattcattctaataaaaaggggatacagttgtgaagttcaaaggacacaatgatgatgcttctccttggaataccctcccagttcaatttgcctagctgacactcatccttcaggayccattccttgataactccttaaaagcttctctaactcactccccagttccttaaatcttcttcctcctgtctaataaaatctttttaaaaaatacactgtctcactgtgttgccaggctggagtgcaatgaaaatgtgatcataactcatgatagccttgaactcctgggttcaagcaatcctcctgcctcagcctcctgagtagctaggactacagggatgtgccaaggcacccagctaattcttttttttttttaacattttcaaataatttattaggaatttaaaactgaaaataaa

SEQ ID NO: 105785 - DNA, 601 bp, Human
ttgccactcagaaaatctctgaatccacttatgacctacaagttcccctcaacccccaccaccactttgggttgtcctacctttccagaccaaaccaatgtctatgtcatatgtacggactgaggtcttatgtttccctaaaatgtataaaaccaagctgtaacccaactactttgggcagatgttctcagaatctcgactgtgcctctgtggaggttgcagtgagtggacattgcaacactgcaccccagtctgggcaacacagtgagactccgtctcaaaaaaaaaaaaaaaaaaaaaagaccgactcaggcatgatcactcatatttggctcaaaatagacctctttaaatattttacagtttggctttttttgtcaacactctggaggaggggaaaacttcttttcacatggtgtaaggcagaaagggtaaaagcctatttccataatttaatacagcatttaatgtgcatatagaaagagcatagaatacaagcccagaaagaaactctactattaactaccccattattacagctttgtaatctcaaggatatttactatctctaattcttagattcattctaataaaaagggga

SEQ ID NO: 105786 - DNA, 601 bp, Human
tcacaatagtgttcatgctcctaggagaatatcatgttgccattgatctgacaggaggcagagctcaggctgtaatgctggcttacctgctgctcatctcctgctgtgtgggttggttcctaacaggccacggaccagtattgggctgtggcccaagggttggggacccctgacctacatcgtaataaccttggtctccacaaccttttatcttagcctagacactcctcctttctattgattccaggtctttagataactctttcaaccaattgccactcagaaaatctctgaatccacwtatgacctacaagttcccctcaacccccaccaccactttgggttgtcctacctttccagaccaaaccaatgtctatgtcatatgtacggactgaggtcttatgtttccctaaaatgtataaaaccaagctgtaacccaactactttgggcagatgttctcagaatctcgactgtgcctctgtggaggttgcagtgagtggacattgcaacactgcaccccagtctgggcaacacagtgagactccgtctcaaaaaaaaaaaaaaaaaaaaaagaccgactcaggcatgatcactcatatt

SEQ ID NO: 105787 - DNA, 601 bp, Human
cattatatatatacatatactgcttcataacatctattttaacattccttaacatatggtccagcagttctacttgggagtatatattcaaaagaattgaaagcagtaaacagatatttgcacaccaatgttcatggcagcattattgacaatagccaaaaggtagaaacaacccacgtgctatatatgtaaatatatattatatattatacatagtatatccataaaatgcagtattattctgccttaaaaaggaaagaaattctgacacctactacaatatggatgcatcttgaggacrttatgcaagtgaaacaagtcacacacaaaggaacaaatattgtatgagttcacttatatgagatacctagagtaatcaaattcacagacacaaagtagaatggctggctgtcaatggctgggggaagggggaaatgaggagttattatttaatgggtacagaatgtcaattttacaagaatgaaaagggttctggatggatagcagtgatttttgcactatagtgtgaatgtactttaaaaaaatcctattttgtctacggaaaatggatacaatcttaggataatgaacacaatcttag

SEQ ID NO: 105788 - DNA, 601 bp, Human
cacatatctacctattttcattatatatatacatatactgcttcataacatctattttaacattccttaacatatggtccagcagttctacttgggagtatatattcaaaagaattgaaagcagtaaacagatatttgcacaccaatgttcatggcagcattattgacaatagccaaaaggtagaaacaacccacgtgctatatatgtaaatatatattatatattatacatagtatatccataaaatgcagtattattctgccttaaaaaggaaagaaattctgacacctactacaatayggatgcatcttgaggacattatgcaagtgaaacaagtcacacacaaaggaacaaatattgtatgagttcacttatatgagatacctagagtaatcaaattcacagacacaaagtagaatggctggctgtcaatggctgggggaagggggaaatgaggagttattatttaatgggtacagaatgtcaattttacaagaatgaaaagggttctggatggatagcagtgatttttgcactatagtgtgaatgtactttaaaaaaatcctattttgtctacggaaaatggatacaatcttagga

SEQ ID NO: 105789 - DNA, 601 bp, Human
ggctggagtgcagtggtactatctaggcttaccgcaacctctgcctcccaggttcaagcgattctcctgcctcagcctcctgagtagatgagattacaggcatcggccaccacatctggctaaattttgtatttttagtagagacaggggttcattgtactggccaggctggtctcgaactcctgacctcaagtgatccacgcatcttggcctcccaaagtgctgtgattacaggcatgagccaccacgtgtggccagatatgtacattgtttttacagacataatgctattaatagagtmcagtatagtataaacataactcacacacattggaaaccagaaaattcatgtgactcattttattgatatattcactttattgtagtgatctagagccagactgcagtatctccgaggtacacctgtatgcagttttggcctcaatgattttaacacctggccatctagtcagaatgtatattcagcacatttctctttcagtagagatgaggacaaaggaaaagaagtggcaaagatttcacagggaagagtttcctgaacacatgttcacagatagaaaagtacaaggtatacttaaga

SEQ ID NO: 105790 - DNA, 601 bp, Human
catgccaccacacctggctaatttttgtattttttttgtagaaaagaggttttgccatgttacccagggtggtctccaactcctgagctcaagtgatctgcctacctcagcctcccaaagtgctgggattacaggcatgcaccaccgcacctggtggcactattttttttagatgcagtctcactttgtcacctaggctggagtgcagtggcacaatctcagctcgccacaacctccgcctcctgggttcaagtgattctcctgccttatccttccaagtagctggtaccacaggtgtgcrccaccacaccgggctaattcttgtatttttagtagagatggggtttcaccatgttggccgggctagtcttaaactcctgacctcaggtgatccacctgcctcagcctcccaaagtgctgagattaaaggcatgtgccactgcgactggactgaaatgccaattttgaaagaagttctactatgggtaaaatactatgaaacagcattgcatgctacagagaaatcatttgtgataaaagaatcgatcaatgcagaaaactacattgtattaatagtattattttaagaaattgccacagc

SEQ ID NO: 105791 - DNA, 601 bp, Human
aaacaatctagtacctgacaatgtgacactctatcaaacgttaacagcattttgcagatacattttttatttttgtatacagaaattcactgcataataacgatatagacccatcttttttttttttttttttttggagatatggtcttgctctgtcacccaagctggagtgcagtggcacaatcatggctccctgaggtctcgacctcatgggctcaagtaatcctcccacctcagcctcccaagtagctgggactacaggggcatgccaccacacctggctaatttttgtattttttttgtagaaaagaggttttgccatgttacccagggtggtctccaactcctgagctcaagtgatctgcctacctcagcctcccaaagtgctgggattacaggcatgcaccaccgcacctggtggcactattttttttagatgcagtctcactttgtcacctaggctggagtgcagtggcacaatctcagctcgccacaacctccgcctcctgggttcaagtgattctcctgccttatccttccaagtagctggtaccacaggtgtgcgccaccacaccgggctaattcttgtatttttagtaga

SEQ ID NO: 105792 - DNA, 601 bp, Human
cagcaactagggaagctgaggcaggagaactgcttgaacccgggaggtggaggatgcagtgagccaagatggtgccactgcactccaccctgggcaacagagcgagactccatctcaaagaaaaaaatctttatttgagaagggtcttgctctgtcacccaggctggagtacagtggcatgatcatagctcactgcagccttgacctcctgggctgaagtgatcctcccaccttggcattccaaagtgttgggattacagatatgaactattataccccgtttaaaccagcaagggtttctaaaagtttaataatataaggttaggcaatcctgatcttttttatgagcattaaacaatgaattaaaagcagaatataaactttgtcagctcaaaatttcatgcattaggaaaaactccaatgtccattaataaaccacctttcatcaagacataaagaatacagggtatgaaggaaaacatattttatagaaattgagtcaaaagtgttctcccaccaatatcagctgaaaacttgaaaatcacaatctatttattatcacaaataggcagtaagtatagtgactacagaaacaatctag

SEQ ID NO: 105793 - DNA, 601 bp, Human
gagtgtggcgacacgagcttgtaatcctagctacttggaagcctggggtgggaaaatcaagcaattgagcccagaagtttgagaccactggcaacacagagagaccttgttttaaaaaacaaacaaaaaacattctaagagtgaatgctgcaacaattaatgactgtgaaagctgttaattttatgaacaaaaaaataagtaggccgagcatggtggctcacgcctgtaatcccagtactttgagaggctgaggcgggtggatcacgaggtcaggagatcgagaccatcttggctaacacrgtgaaaccccatctctactaaaaatacacaaaattagctgggcatgatggcacatgcctgcagtcccagcaactagggaagctgaggcaggagaactgcttgaacccgggaggtggaggatgcagtgagccaagatggtgccactgcactccaccctgggcaacagagcgagactccatctcaaagaaaaaaatctttatttgagaagggtcttgctctgtcacccaggctggagtacagtggcatgatcatagctcactgcagccttgacctcctgggctgaagtgatcctcccacctt

SEQ ID NO: 105794 - DNA, 601 bp, Human
aacagggcgagactctgtctttaaataaataaataaataaataataaaataaaatgtctattcattctataaacgagtattatataaaaagcaatataccaaatacaaagaggtataaagacatgattcctgtttttttaactggtgggataagacaaaagtaaacagctatgaaataagcagcaaaaatgtcatttgaataataaagtattacagaaacgcagaaaaaggacagatcattcatttaacaaaactgtatagtagcattcctatctttcatataaagagtgaggttcagggytgggcgcggtggctcacgcctgtaatcccagcactttgggaggccaaggggtgtggatcacgaggtcaggagttcaagaccagcctggacatggtgaaaccctgtctctacagaaaatacaaaaatgagctgggtgtggtggcacatgcctgtaatcccagctacttgggagactgaggcaggagaatcacttgaacctgggaggcggaggttgcagtgagccaagatcacgccactgcattccagcctgggcgacacagcaagacttcttcttggcgggggtgtgggggggagagttag

SEQ ID NO: 105795 - DNA, 601 bp, Human
aaggtggcggctggactgaatctctatcaggtctgacaagctgcagctagtgagccctgactgctcggggctgctctctgaaagcctccaatgaaagggagaacaaggagaagggagagggagaggggaagggatgagggaggagaaaggggtcttacctgtgagtcctgccacggcaggggcagcacaggggctccctagggctccatcccaggaggtggcagcagggattggatggcccctccttgtcattcactgttgtctctgctgcttctggcttggcactggtcttatacacacrggctgacctgaaaccttatcctagagaagttggttgacagcctgatcacttgacaagaggctggctggtgagggcagtgaggtgagaggggaggtgagtgagttccagatctggttcagtcctcttgacttggggtgctttaatatagctcctttaagctgtggacgcttccttggtgacaagggtgtatgggggggtggacctgctgccacttttgagtccaaaggtcaaggcctcccacgataggctgggcacagctctcccaggtctcttaataataatgtcatttctttgtgccta

SEQ ID NO: 105796 - DNA, 601 bp, Human
ccaccttcagcctcccgagtagctgggactacaggtgtgcatcaccatacccagctaattttttattttttgtagagatgggggtctctctatgttgcctattctggtcttgaactcttggcctcagcgtgatcacttgacaagaggggcagttcttagccactcatggaaaatggaatggatggacacagactcaggtcaaaagcccaccttggggctctagaactttcagtagtcaagctgcgggaggagggaaagccacagtggtgggcacaggtaggaggtgccttgaggccagcastccccaatcttcttcccaattcactccagactctcctagacccctagcagccggcagccttttgccactggccagtggaggaagaagtcaaaagtggaaccctcattactgtagctctgctggggctcctgagggatgggatgttctagtcagcatggtccattaatgtttgctggttgcttcttgcaccagataccgtgctgagggctttacagacactgactgatttgatcccttcataaggctacaagtagttgctattattattctcatttcgtaaaccagggacctgaggcttcc

SEQ ID NO: 105797 - DNA, 601 bp, Human
cagtggtgcaatccaggctcactgcagccttgacctcttggactcaagtgaccctcccaccttcagcctcccgagtagctgggactacaggtgtgcatcaccatacccagctaattttttattttttgtagagatgggggtctctctatgttgcctattctggtcttgaactcttggcctcagcgtgatcacttgacaagaggggcagttcttagccactcatggaaaatggaatggatggacacagactcaggtcaaaagcccaccttggggctctagaactttcagtagtcaagctgcrggaggagggaaagccacagtggtgggcacaggtaggaggtgccttgaggccagcactccccaatcttcttcccaattcactccagactctcctagacccctagcagccggcagccttttgccactggccagtggaggaagaagtcaaaagtggaaccctcattactgtagctctgctggggctcctgagggatgggatgttctagtcagcatggtccattaatgtttgctggttgcttcttgcaccagataccgtgctgagggctttacagacactgactgatttgatcccttcataagg

SEQ ID NO: 105798 - DNA, 601 bp, Human
tttcctgcttgtcaccacaatgtacctggcactttttactaggcactgcttctctctctgctccttctaaaacccagttgcctctgggtggtgcccactccacggagttctgggttccctccctgctgagggagagctgcctgcctggagcccagggcctcaccagtgagcaggtggtagtccagcagcttctccttgaggatgtcgtaggtcaccacctcagcacagttgacgatagcattcctcatgatgttgggcaaagttcctgttaggaaggcggtggggagggatgtgaaatggrtggggagggaggaatgggaaatgggagaaatggatgccctggctgcaaggccacaggccccagttttggggccatagtgccccattccaatggtctcagccagaggatcccaccccagctgagcagattccacattttcctttctagggttaacaactctcagattatccatgttttcctcagagacagagaacagagaggcccacttgtgttcatttggccacatttggagggtgatctgcaatagctgtcaaaattaaaatatgcttcctggagacccagctgcagccagaaaagaaa

SEQ ID NO: 105799 - DNA, 601 bp, Human
aggtcatgcaggctgtttgaggaaactgaagtcggagaaggtgagagacccctgcttaaagctatatagtgagaggtggtgctgggactggaacccaagtctccagcctcccagcccaggggtctttcctgcttgtcaccacaatgtacctggcactttttactaggcactgcttctctctctgctccttctaaaacccagttgcctctgggtggtgcccactccacggagttctgggttccctccctgctgagggagagctgcctgcctggagcccagggcctcaccagtgagcaggtgrtagtccagcagcttctccttgaggatgtcgtaggtcaccacctcagcacagttgacgatagcattcctcatgatgttgggcaaagttcctgttaggaaggcggtggggagggatgtgaaatgggtggggagggaggaatgggaaatgggagaaatggatgccctggctgcaaggccacaggccccagttttggggccatagtgccccattccaatggtctcagccagaggatcccaccccagctgagcagattccacattttcctttctagggttaacaactctcagattatccatgttt

SEQ ID NO: 105800 - DNA, 601 bp, Human
acttatctgctgctctttgagggaggcataacccagggcctggcacctacaagatgctccagaaatgttggacaagtgaaagcagtaactgagacaagtggctacagctgaagactgtaatgatagaggcactttttggaagaacagtctgtcaattgcagtatagttttattacgtcattcccaggcttgagaacctatagcagctcttgttcacttgttgggtccattctaacactgggcaccaaaaaactctctgttgaagacatcagcagtgggaggtgaaagggccaagctaagarcttaccagtaggataaacaacattgttgggtgtggtgtctgacggtcagggtttgagccatggctccaccattttaacctgtgatcttggataagttacttaacttttctgacactcagtcttttccttagttaatgtggacaatactacccagttcaaggggctgttgggataacgtgtgtaaagtgctcagcacgaggcctaatatagagtgacttagctattgtgataatcataaacaacctgcattatcgagtgctcactttgtgtgagggactgtgggagataaaagatgtctga

SEQ ID NO: 105801 - DNA, 601 bp, Human
cagaggtgcggttctaactccaccctgctgctgggtgtttctgggctcagttacaccccgggtggccagccctaacatggccccctgccaggacatggagaagcttgggctttgcagggtgaatacagtgtggcaccagatttagctcttctccagagaggctggctgtgctgtgatggcatagcacagtgtccccacctcagctgtggctcaccaactcagggagaagcccacgagctggcccctgcccctctctcagcctgtccctccactaaccacctcctgggcccgtttgctcccrccagactcagctagtcacattccctgacgatgccaggccctcttccctccatgcctttgctcctcttgctccctctgcctggactgtcccctcctctcctccttccctggctggttgctctttgctctggaggactcagtttgggcactgtgacctcatgccatgggttttcttgactcttgtggggacgatagtactgtgacaacaaatgtaaactctggagtcagacctgggttcaaatccaagctctcccagtttctagctttacaatctggacacatcacttaatctttctaagcc

SEQ ID NO: 105802 - DNA, 601 bp, Human
tcagaggtgcggttctaactccaccctgctgctgggtgtttctgggctcagttacaccccgggtggccagccctaacatggccccctgccaggacatggagaagcttgggctttgcagggtgaatacagtgtggcaccagatttagctcttctccagagaggctggctgtgctgtgatggcatagcacagtgtccccacctcagctgtggctcaccaactcagggagaagcccacgagctggcccctgcccctctctcagcctgtccctccactaaccacctcctgggcccgtttgctccyaccagactcagctagtcacattccctgacgatgccaggccctcttccctccatgcctttgctcctcttgctccctctgcctggactgtcccctcctctcctccttccctggctggttgctctttgctctggaggactcagtttgggcactgtgacctcatgccatgggttttcttgactcttgtggggacgatagtactgtgacaacaaatgtaaactctggagtcagacctgggttcaaatccaagctctcccagtttctagctttacaatctggacacatcacttaatctttctaagc

SEQ ID NO: 105803 - DNA, 601 bp, Human
cttctcacttgcatgtcatagcacccctggtgaggtggacagggaagggatggctccctccattttgtaggaaagtgggggctgccctcttgattcttcagtgtcgtcagggaatatttacgagccccagcctcacatgggcccagcagggcttctttagcacaggctctagttttttctcttgttccttgggtttcctagaatcccaaaggactctctgtggcagacatattacaaataggctgatgatgcatgtgtgatggtgcagctgcagtcgccagctctgtgttgctgggtggcrtccctccaggctccgtggctgatctcccactccattgtgggcccctcctgtcccgtgcttgccatccttcctgcttatcattcattatctaaccagatttcacggggatacacgtctccaaccttccattttgtccaaatggatctatcttggtttattttctcttgcctaaatattaggcatgcctaatgggtttcaaaaattaatataatttattttccatcttgtcagtgcaaaacaaaggtgttcttgaggcatggcagtgaagaccagaatccctcctcctcttctacttctgtt

SEQ ID NO: 105804 - DNA, 601 bp, Human
aataatttttttttgcttttgtatgaactctccagtttgtatacatagatgatctcaagttataatttaaatttaggaaagtgctgaggatgaatagatatttgctttttcccagggtctggaggggtaggagcagggaagcagggaaatgacattaccgagtgcctcctgtatgccaacgattttttgtttgttttgtttcagagaaggagttatgctctgttgccaaggctggagtgcagtcattattcacaggtgcagtcatggctcactgcagccctgaactcctgggctcaagcartcctctcgcttaagcctcccaggtagcaggtgcacaccacatgtctgctttccaaggagttttaggtcaaccctcacaacaagcctgtgaagcagcgattgttattcccacttctctggtagcacaccaaggtgcaaggattccctgtggctaggtggttagtaaggtagaatggggtgaggtttgaacccagtcctgacaatcatcagagctacgcaaggctgccaagaagtagaaaaagatagtggcattttgggtccccattatcaattcgaaaaatgtacagtcttaagcttggaa

SEQ ID NO: 105805 - DNA, 601 bp, Human
aaactgagaccaggagtttgagagtgatttgcacatgtcagtcaagtcaaaagaaagagaaactcttttttcttttttcgtttttgttttttgagatggggtctcactctgtcacctaggctagggtgcagtggtgtaagctcggctcactgcaacctccgcctcctgggctcaagtgatcctcccacctgagccccccgagtagctgggaccgcaggcgcatgtcaccatgcctggctaaaaagggaaacttttaatttaattcaattcaatttaatttttttttttgagacagagtctygcctaggctggagtgcagtggtgtggttttggctcactgcaacctcagtctcctgggttcgagtgattctcttgcctcagcctcccgagtagctaggattacaggcacccaccaccatgcctgggtaatttttttttttttttttggtatttttagtagagacagagtttcaccatgttggccaggctggtctcaaactcttgacctcaagtgatccgcccgcctcggcctcccaaaggcgtgagccactgcaccaaccggaaacttttcaaaatatgggttttatttgaaaaccaagcc

SEQ ID NO: 105806 - DNA, 601 bp, Human
agcatcctctgggtaggtggtgtgttaatattgccatatggaaattcatggaagatatagttcctggccctagaaacttacaaactgagaccaggagtttgagagtgatttgcacatgtcagtcaagtcaaaagaaagagaaactcttttttcttttttcgtttttgttttttgagatggggtctcactctgtcacctaggctagggtgcagtggtgtaagctcggctcactgcaacctccgcctcctgggctcaagtgatcctcccacctgagccccccgagtagctgggaccgcaggcrcatgtcaccatgcctggctaaaaagggaaacttttaatttaattcaattcaatttaatttttttttttgagacagagtctcgcctaggctggagtgcagtggtgtggttttggctcactgcaacctcagtctcctgggttcgagtgattctcttgcctcagcctcccgagtagctaggattacaggcacccaccaccatgcctgggtaatttttttttttttttttggtatttttagtagagacagagtttcaccatgttggccaggctggtctcaaactcttgacctcaagtgatccgc

SEQ ID NO: 105807 - DNA, 601 bp, Human
tttgagaccagcctggtcaacacagtgaaaaccccatctctactaaaaatacaaaaactagccagagtgtggtggcacgcacctgtagtcccagctactcgagagtctgaggcaggagaattacttgaacctgggaggtggatgttgctgtgagccaagattgtgttagcctgggcacagagcaagactttgactcaaaaaaaaaaaaaaaaaaaaaaaacagtggagaaagagatctagtattttggcctagaaacctcacaagactcaccaatctcgtttttctttctccaaaaggctrgacttggcagttagtaggctcctgatcccagtcaaaatatctcttagaatattttatcctccctttctcagaatcatcacctgaatagcatcctctgggtaggtggtgtgttaatattgccatatggaaattcatggaagatatagttcctggccctagaaacttacaaactgagaccaggagtttgagagtgatttgcacatgtcagtcaagtcaaaagaaagagaaactcttttttcttttttcgtttttgttttttgagatggggtctcactctgtcacctaggctagggtgcagtg

SEQ ID NO: 105808 - DNA, 601 bp, Human
ccataccaagtgattccatgattccactttgcactttgggtatatacctaaaaaaatggaaaggaggtttcttttttttttttttttttttgagacagagtcacgctctgtcgcccagctggagtgcagtggtgcgatctcagctcactgtgagctccacctcctgggttcaagcaatcaagcgattttcctgcctcagtctccccagtagatctttaagtctgcaacccagacatactgacagctgacaatcccttggatgtaccttgaatgtttttatcttgtttctgggcctttgcaygaaccattccctttgcctaggatgactttcacttcactttctttacctgcataacacctacttgacctttaggtgtcttcctccaagaagcttcctggccccccaaccacgtcagatgtcccttatctgtgtacctgctcttgggtgctttgtatacatctctatttgtagctttgatcacccagtatggtgactgatggtttgcagtttgtctttcctgccccaccatcctccaccccagtgagctccttgaggacaggactggtcttgttcaccccagcacctaacataacatatggc

SEQ ID NO: 105809 - DNA, 601 bp, Human
cacacatgaggaaacattactaacacccagaagtgatcctttgtgtctaccatcagtcactattcacccaaagaataaccagtatcctgatttttaacaccaaatatttgttttacctgttcttaaacattatataaatggaatgatactatatgtactattttgtatctttcactcaacgctatgtgagattcatccaagttacataaaattgtagttctttaattttcattcaaaaataggcagaggccttaaatagacatttctccaaagaagatatgcagatggccaataaccacaygaaaagagccatagcatcactaatcattaatcaaaatcacaatgagagaccaccttacacccattaggatggctactatcaaaaaccagaaaataagtgttgaagaggatgtggagaaacaaacccttatacactgcagctgggaatgagaatggtccagctgctatggaaaacagtatgatggtccctcaaaaaattaaatatagaattacccataccaagtgattccatgattccactttgcactttgggtatatacctaaaaaaatggaaaggaggtttcttttttttttttttttt

SEQ ID NO: 105810 - DNA, 601 bp, Human
gagcagcagacttacatataaacattgtttaaaaaatacgtttgccaaaaaaatggaaataacccaaacatccatcaattgcggaacggatatatgctaataaaatgtggtatatccaagcaatgaaaagaaatgaagtggccgggcatggtggctcacgcctgtaatcccagcactttgggaggccgaggcgggcggatcatgaggtcaggagattgagactatcctggctaacacgatgaaaccccgtctctactaaaaatacaaaaaattagccaggcgtggtggtgggcgcctgtartcccagctactcgggaggctgaggcaggagaatggcgtgaacccaggaggcagagcttgcagtgagccgagattgtgccactgcactccagcctgggtgacaaaagcaagacttcatctcaaaaaaaaaaaaaaaaaaaaaaaaaaagaagaaaaggaatgaagtactgatccatgctataccgtggatgaaccttgaaaacattatgctaagtaaaagaagccagtcatgaaagaccacacattgtgtttccatgtatataaaatgtccagaacaggcaaatatataaagacagatggt

SEQ ID NO: 105811 - DNA, 601 bp, Human
cgcaggttattaagagaactttgaaaaatattgttttgaatattgaaaatcacgtgttttggggaaggagagaattaacagcctttctttgccttaaaatactttacattttatgtaattgcaattggaatgaagcagctcctaaagtagtcagcatttgggtcagggaaattgagcacaggagcaaactgctgtttgttttctcaactccttcacaatgctcagctgaagaggttcccacttaaaagagctgctgaagtcatttctattttagaagggtagtatgaatgagtttttctaygtgttaactagaatttatggtaatttgtaaaatgtttttccatttttaaacttaagagtcttttatgtccacccacgaagcagcagtcactgctaggggtcttaggctaacatctgccaccccaccagtctgcatggcccataagcaggtgtggagaggaccagagttcacctgtcagcagcaccacggaatcaactgtccagcctttctgccattaattaccacagatgtggtctttttcctgatattctattcccaccggaggctttttattaagaccttgtacctgtgaacgcattt

SEQ ID NO: 105812 - DNA, 601 bp, Human
tcaggctgatctcaagcaatacttcccacctcagcctcccaaagggctgagattacaggcatgagccgccatgcctgtccagagtatgtccctatcgtaggtttatcactagaatgttttgatctgaagacatagccttaatgattctaagtgtaattctaacctaaaatcaaaatccttggtttgtaaacatcaaattcaattttatattaattcgtacggcaactaagcaaaaaacaattttttaaatgtccatattatttattacactaaacaattctgaccaccaagagggggcggragggaacaacactatgagaccatgaaaacatcttgcttctcaacaaactttcctccctcgctttaacatttttgaggattctttcccaaacctattacatgtatattatgatggttacgaatttcccaactccgccactcctttcagtgcactattattattattattttatttatttatttttttgagatggagtctcgctctgtcgcccaggcttgagtgtagtggcgcgatctccgctcaccacaacctccgcctcctgggttcaagcgattctcctgcctcagcctcccgagcagc

SEQ ID NO: 105813 - DNA, 601 bp, Human
tatttttatttatttatttttagatagggtcctgctatatcacccaggctggaatgcagtggcacaatcagagatcagagttcattacagtctcaaactcctgagttcaagtgattcttccatctcagcctccagagtagttgagactacaggcggtcaccaccacacccagctcattttaaaatttttttgtagagatagagtctcgctatgtagttcaggctgatctcaagcaatacttcccacctcagcctcccaaagggctgagattacaggcatgagccgccatgcctgtccagartatgtccctatcgtaggtttatcactagaatgttttgatctgaagacatagccttaatgattctaagtgtaattctaacctaaaatcaaaatccttggtttgtaaacatcaaattcaattttatattaattcgtacggcaactaagcaaaaaacaattttttaaatgtccatattatttattacactaaacaattctgaccaccaagagggggcgggagggaacaacactatgagaccatgaaaacatcttgcttctcaacaaactttcctccctcgctttaacatttttgaggattctt

SEQ ID NO: 105814 - DNA, 601 bp, Human
tattctaattaacatttgagatactaaacgaattaatgaccgaagacaacctttgaaacttattcaattattttttaaaagtgtactagcataatttaagatcagtttgcctaagattacatcttttattttatttttatttatttatttttagatagggtcctgctatatcacccaggctggaatgcagtggcacaatcagagatcagagttcattacagtctcaaactcctgagttcaagtgattcttccatctcagcctccagagtagttgagactacaggcggtcaccaccacaccyagctcattttaaaatttttttgtagagatagagtctcgctatgtagttcaggctgatctcaagcaatacttcccacctcagcctcccaaagggctgagattacaggcatgagccgccatgcctgtccagagtatgtccctatcgtaggtttatcactagaatgttttgatctgaagacatagccttaatgattctaagtgtaattctaacctaaaatcaaaatccttggtttgtaaacatcaaattcaattttatattaattcgtacggcaactaagcaaaaaacaattttttaaatgtc

SEQ ID NO: 105815 - DNA, 601 bp, Human
ttttagtggagatggggtttcaccatgttggccaggatggtgtctatctcttgaccttgtggtccacctgcctcggcctcccaaagtgatgagattacaggtgtgagccaccgggtctggcccactcctgtattttaaaagttgaattgaaaaacaccgagttaaaagatgcattttttcccatgaattgtgtgaatgaaataaagctaaattcacaaagcatgaacatagcagtcgttctcattttgctcacagttctaaaaatgcaaattctccccaacttcttagagcatgacaggtsttcagctggcaatctttccatgtttacataagaagctagaattgatcatatggttttacagtgctttcccgaaaatctgtgattgttattagattctgtttttcctctattacctctcaaaggaaataaagcagcaaattactcccatattttgagctctaaattcaagaactactaaattcactgccagccattacaaatattcagttctttattaaggtacacatcattacagtaggctcagagtgctaatacatgaataataactatagttagtaaaacaatgcaaatggagatcag

SEQ ID NO: 105816 - DNA, 601 bp, Human
ttttccttggtaacacatcctggttttttttttgttttttttttttttgtttttttttttttgagatggagtcttgctctgtcgccaggctggagtgcagtggcgcgatctcggcttactgtaacctccatctcccaggttcaagcgattctcctgcctcagtctcccgagtagctgggattacaggtacgtgccaacatgcccagctaatttttgtatttttagtggagatggggtttcaccatgttggccaggatggtgtctatctcttgaccttgtggtccacctgcctcggcctccyaaagtgatgagattacaggtgtgagccaccgggtctggcccactcctgtattttaaaagttgaattgaaaaacaccgagttaaaagatgcattttttcccatgaattgtgtgaatgaaataaagctaaattcacaaagcatgaacatagcagtcgttctcattttgctcacagttctaaaaatgcaaattctccccaacttcttagagcatgacaggtgttcagctggcaatctttccatgtttacataagaagctagaattgatcatatggttttacagtgctttcccgaaaatctgtg

SEQ ID NO: 105817 - DNA, 601 bp, Human
gaaaggcggtgcaggaacactgcctggagctgcctggtaagggagaggtcattgtggtcatcgctgatggtccccatccaaggcagggctcggcatcgtggtggaaaggagggagtgaaaaggtggaggctcaaacgacagccaactgaacgggagagggaaagaacaaaagggactaagaaaaagagagaagagaaataaagaaccaaggacagaaaggattagcacaggccggacccggaggctcatgcctaaaattctaggactttgtgaggccgaggcgggcggattgcttgagctsagcagttcgaggccagcctggccaacatggcgaaaccccatctctacaaaacacaaaaattagccaggcgtggtggcgggcgcctgtaatcccagctactcggcaggcggatcgcttgaacctgggaggtggaggctgcagtgagccgagatcgcgccactgcactccagcctgggagacagagcgaaagcctgtctcaaacaaacaaacaaaaacaaaaaataaaaccgagagaaagaaaagagtacaaacttgggtgggagagaaggtaaatggaagagcgggcagcgcacgcagaac

SEQ ID NO: 105818 - DNA, 601 bp, Human; identical to SEQ ID NO: 33129

SEQ ID NO: 105819 - DNA, 601 bp, Human; identical to SEQ ID NO: 33130

SEQ ID NO: 105820 - DNA, 601 bp, Human; identical to SEQ ID NO: 33131

SEQ ID NO: 105821 - DNA, 601 bp, Human; identical to SEQ ID NO: 33132

SEQ ID NO: 105822 - DNA, 601 bp, Human; identical to SEQ ID NO: 33133

SEQ ID NO: 105823 - DNA, 601 bp, Human; identical to SEQ ID NO: 33134

SEQ ID NO: 105824 - DNA, 601 bp, Human; identical to SEQ ID NO: 33135

SEQ ID NO: 105825 - DNA, 601 bp, Human; identical to SEQ ID NO: 33136

SEQ ID NO: 105826 - DNA, 601 bp, Human; identical to SEQ ID NO: 33137

SEQ ID NO: 105827 - DNA, 601 bp, Human; identical to SEQ ID NO: 33138

SEQ ID NO: 105828 - DNA, 601 bp, Human; identical to SEQ ID NO: 33139

SEQ ID NO: 105829 - DNA, 601 bp, Human
cagatcctcttgtgcattcagctttcttaaaaacacatcaaaggctgcaaagaagctcagaaaaaactaaattgaaggacaggtggaatacaatgactctatgtgaggaacttgccaactcacatctttcaaagccagatcagcttatatagtacatgcattatagtcatatgaaatgttgtcttggtgctttcttcttggaggactatggcagcagctttaagactactaacaaagattattacacaggtcatcttatccacaggcaaactgctttgcacaactagaacattaacagttstttttaagttaagttcagatgaaactgtcacaagacagacttgatgtattttatatatactgggaaactttagaaacagccatttattatttggattaaatgtgtgatgtgttctgcaatttggaatacacttttcagtttatagccagtctccacatgagcagattcataccattgcaatacacaggagttcataaataagattctactcaggtaggcagtaactagcaagttttgagtcaacaaagtctcagtattacatagttctcttcaccaaagatgagtctcccggatttcagc

SEQ ID NO: 105830 - DNA, 601 bp, Human
ttaagttccacctcaaagtgaatcttagagcctggtgtaagtgctccactttagagatgtaccttaattactactgtatttgcaaattaagggaaatttaggtcatcatttgattttctgaaatctaaaaggaactgaccatcattaccaagtctttctagataatcaagggtagatggctgtttttaatgtaggaattaatgtaggcattcctgctttcaggtttaagtatgaatcaaagcatattttaatttgctagtgcaaatggacccagaattggaagggctatgtaactacacartatgcacaccacagccatgtcagtgtcacagatcctcttgtgcattcagctttcttaaaaacacatcaaaggctgcaaagaagctcagaaaaaactaaattgaaggacaggtggaatacaatgactctatgtgaggaacttgccaactcacatctttcaaagccagatcagcttatatagtacatgcattatagtcatatgaaatgttgtcttggtgctttcttcttggaggactatggcagcagctttaagactactaacaaagattattacacaggtcatcttatccacaggcaaact

SEQ ID NO: 105831 - DNA, 601 bp, Human
ggcgtgtgccaccacgcccagccttgggtgtttttctttcagctcctccagtactttcatactattctaataaatatattttgttggtatgaagctatgaagcaaaagtagctattaccaatgcatacatacagtacactggttttaagttccacctcaaagtgaatcttagagcctggtgtaagtgctccactttagagatgtaccttaattactactgtatttgcaaattaagggaaatttaggtcatcatttgattttctgaaatctaaaaggaactgaccatcattaccaagtcttwctagataatcaagggtagatggctgtttttaatgtaggaattaatgtaggcattcctgctttcaggtttaagtatgaatcaaagcatattttaatttgctagtgcaaatggacccagaattggaagggctatgtaactacacagtatgcacaccacagccatgtcagtgtcacagatcctcttgtgcattcagctttcttaaaaacacatcaaaggctgcaaagaagctcagaaaaaactaaattgaaggacaggtggaatacaatgactctatgtgaggaacttgccaactcacatctt

SEQ ID NO: 105832 - DNA, 601 bp, Human; identical to SEQ ID NO: 33129

SEQ ID NO: 105833 - DNA, 601 bp, Human; identical to SEQ ID NO: 33130

SEQ ID NO: 105834 - DNA, 601 bp, Human; identical to SEQ ID NO: 33131

SEQ ID NO: 105835 - DNA, 601 bp, Human; identical to SEQ ID NO: 33132

SEQ ID NO: 105836 - DNA, 601 bp, Human; identical to SEQ ID NO: 33133

SEQ ID NO: 105837 - DNA, 601 bp, Human; identical to SEQ ID NO: 33134

SEQ ID NO: 105838 - DNA, 601 bp, Human; identical to SEQ ID NO: 33135

SEQ ID NO: 105839 - DNA, 601 bp, Human; identical to SEQ ID NO: 33136

SEQ ID NO: 105840 - DNA, 601 bp, Human; identical to SEQ ID NO: 33137

SEQ ID NO: 105841 - DNA, 601 bp, Human; identical to SEQ ID NO: 33138

SEQ ID NO: 105842 - DNA, 601 bp, Human; identical to SEQ ID NO: 33139

SEQ ID NO: 105843 - DNA, 601 bp, Human; identical to SEQ ID NO: 105829

SEQ ID NO: 105844 - DNA, 601 bp, Human; identical to SEQ ID NO: 105830

SEQ ID NO: 105845 - DNA, 601 bp, Human; identical to SEQ ID NO: 105831

SEQ ID NO: 105846 - DNA, 601 bp, Human; identical to SEQ ID NO: 33129

SEQ ID NO: 105847 - DNA, 601 bp, Human; identical to SEQ ID NO: 33130

SEQ ID NO: 105848 - DNA, 601 bp, Human; identical to SEQ ID NO: 33131

SEQ ID NO: 105849 - DNA, 601 bp, Human; identical to SEQ ID NO: 33132

SEQ ID NO: 105850 - DNA, 601 bp, Human; identical to SEQ ID NO: 33133

SEQ ID NO: 105851 - DNA, 601 bp, Human; identical to SEQ ID NO: 33134

SEQ ID NO: 105852 - DNA, 601 bp, Human; identical to SEQ ID NO: 33135

SEQ ID NO: 105853 - DNA, 601 bp, Human; identical to SEQ ID NO: 33136

SEQ ID NO: 105854 - DNA, 601 bp, Human; identical to SEQ ID NO: 33137

SEQ ID NO: 105855 - DNA, 601 bp, Human; identical to SEQ ID NO: 33138

SEQ ID NO: 105856 - DNA, 601 bp, Human; identical to SEQ ID NO: 33139

SEQ ID NO: 105857 - DNA, 601 bp, Human; identical to SEQ ID NO: 105829

SEQ ID NO: 105858 - DNA, 601 bp, Human; identical to SEQ ID NO: 105830

SEQ ID NO: 105859 - DNA, 601 bp, Human; identical to SEQ ID NO: 105831

SEQ ID NO: 105860 - DNA, 601 bp, Human
gccgacccattcttttatttttttgtagagatggtgtctcgcctagactggtcaggaactcctggccttaagtgatcctcctgccttggcttcccaaagcactaggattacaggcatgagccaccacaccaggcctacactttcttaatgttttaaaaaatcaataatattttaatggtttcccatttacctttttttccctttcctttatgagtagtgccttttgtgtcacgtttaagaaatctttacttaccataaggccataaagatattcttctatgctttcttctgtaaggactctttttttttaacctttcatgttttagacctgttatccatttggtgtttatttttgtgtttggtttgaggtgtaggggtcaggatttgttattttccagatggatatttagttgtcccagtacaatttattgcataaaaccatcctttcctcactatatgacagggttgcctttatcatgagtcgagtaaccatatgtgtgtgaaactgtttctaaattctctgttttgttccatttgattatttgtatatccttgcttaattctgcactgttttaattactataatttgatatctggtggt

SEQ ID NO: 105861 - DNA, 601 bp, Human
ctcaaattttattttctgcatatttgctgctaagtatataaaagtatacttaagaattgctagatgacatggtaactcttaagtttaacattttgggaaatgccagactgccaaagtggctgcaccattttgctttctgcctgccatgtgtcagcattctaagttttccacatcccagccaacacttgttattgtctgtctttttttttttttctgtgtaagacggagtctcgctctgtcgcccaggatggagtgcagtggcacgctgtcggctcactgcaagctccgcctcccgggttcrtgccattcttctgcctcagcctcctgagtagctgggattacaggcgcctgccaccacgcccggctaatttttttgtatttttagtagagacggggtttcatggtgtcagccaggatggtcttgatctcctgacctcgtgatctgcccgcctcggcctcccaaagtgttggaatcacaggcgtgagccaccgcccccagccctgtcttttttattgtagccatcctgatgggtataaactggtatcttgtggttttagtttgcatttctctgatggctaatgatgttgaacatcttttcat

SEQ ID NO: 105862 - DNA, 601 bp, Human
aaggggcatgtgtcttcagatattgcttgtgtcccatttttttccttctctgggattctagttacatataacggttttgtatcccatacatttcttatgtattttgtcctcctgtattttttactctttttttctctgtacttcagtttgaatgttttctagttattttctagcaatctattttctagtaagcctttctcctgctttttaaaattaactgataaaacagcctagtacgttcttaatttctgataatatagtttcaattctagaattttttgatttttcatttttatggaartggcccatcttgtcatccattttctccatttttaagcttttttttaaatattagccatagttatctttaagttcatgtctgtgaatagctatatctggattacctgtaagtccatatctgatccctttttctctttgttctcaattatacgatgcagtcttttgacatgtctagtggtttttaatgagccttcagaccttgtatgtgaaagagattatagaatcttagcatctccagtcttcctgctttagcagctttctgatgtctttaaagaggtatttgttgtatttcatcctgttt

SEQ ID NO: 105863 - DNA, 601 bp, Human
ttctgtatgtattgtctctgtttcagatagtatctttcagtctttaccaaaacactttgtaaacacttttatgacgggacttaccatagtgttgtatattgcccttatttcagtagattgtgagcctttttaagtgtgttaagacttgctttatttcctaaatcaagattggtttttttaaatgttccgaatggagttgggtaaatatgtattctttgattgttggatgcatgcatctccatatatctttcagataactctcattgttgtgttctaaccttccgtattctttgtgactttktgttttttgttcattgagacttatcaataattgtatgtaccacaatggtggatttgtcaatttctctgtatattttattgatttaataatactgttttatacattttgggactatttcgttaggcttgcacatatttagaggtgatgtaccttcttggcaaattttgcaatacatattgaccatctttatcctcagtaaggcatgtttgtcttaaatctaccttacctcaccttgatatagctacatatttcttcctttccttttctttttttcttttccttccttcctccctctctccc

SEQ ID NO: 105864 - DNA, 601 bp, Human
tgagtgttccaggcagcggaggtgagaagcacaagctgaacccaaactgctgttttaaaaatttgtcttctcggccgggcgcgttggctcacacctgtaatcccagcactttgggaggccgaggcgggcggatcacgaggtcaggagatcgagaccatcctggctaacacggtgaaacctgtctctactaaaaaatacaaaaaattagccaggcgtggtggcaggtgcctgtagtcccagctactcgggaggctgaggcaggagaacggcatgaactcgggaggcggagcttgcagtgagycgagatcgtgccacttgcactccagcctgggcgacagagtgagactctgtcttaaaaaatttgtcttctcataatcccactggccgatttcttctccaggctacaagcctccacatccctgaccccgtacattttccagcataccctctggggtttctcactttttcttcattattcctttacagatttattcaacaaatttgtttagcaccgcctcactgccacacagtagctttgttttagaagctgagcgtgcagcattgaacttttttcaacttatgttctactcagatgactggt

SEQ ID NO: 105865 - DNA, 601 bp, Human
gtcgaagagagaatacagagcataaaaagacatctcttttagggccttcagtcaatataaagggtgtaaataaaaaaattttttgggggggtctctgttagagaggatttcaggtaacaggtttcagttaaagaaagaaacagttaaagaagaatttgaggactttggggaatttgctgatcccagactgtgaatttcagtgggtacaatagagaagggcttgagagggaggagaaatacttcagattagtggatgtatttagttgtttagggatcaaagtctggctgatgctacattacstggctgggatttggggtttctgatggtaacaattttaactgaatgataagggaacactgatcaactgttccttctgtggtgcttcaccctctgtagtggagtggcagccaaggataaggaaatacttccccaggagacagctctgtcggagaacttggcatatacaaaacaaatgtaggactgtagcacaacaggagagggaaggctcatatggaggacaaagctgggaaccttttccatctttgaaatctggctcagtattaagaagaagattcatcttcagatagcccatattcaagt

SEQ ID NO: 105866 - DNA, 601 bp, Human
attgcatttaggtattttaaattaaggtctgcagtgtcttgaggatgtatatatcccctacattaagaaagctgaatatatgataaagcagacttacacattagtaaattaagagattgccattagggtaagattcataagagacttcataactcaatttctctgaaatgaagaatatcattgctgtgtttaaaatgtttccacactgcttttcagtagtatatttcttacaaaacatgagttttataactttatttcccatatttcattaggtgacattccacaaagaatgttgtcaaaracacacattttatcttttcaagttattaagcattgatacaaaaataggtggcagacttttgtttggtcctataaaatgtagtaatttaatttaaatgtatgaagaaaatgttataactccttagtttttcttttcagtaaaattaagattaaaaattatgaactatattatataattttacaggaatactaggtatgtcctagagtgtaggaaactacagatggaaattaccaacacaagcagttgccattgttcatacacatgcatatgtgtgtaatttgaatttatactaaataaaag

SEQ ID NO: 105867 - DNA, 601 bp, Human
gcactattcccaaagagaggaggttttcaccacaggcatactacggtacttaaaaaaaaaattcttctcgcagtatctcatttaagcttcatattcaaggtaagctttttcagaagcaaaaattgggatgcacattaaaatgacttgcccagagtcatgtagcaatgtagtggcagaaccaggattaggacccaggtctgtgacattaacctttccccttgctccttagttcactgcatccaggggagctctggagcattttaccgtaagtagataagattttatacatacaccaatcatrtacgatctatagcagtcacgaataagttttcctcagtaatgaacagaaaactagtgaggataatagcagtaagaatgataggtattattaagcacttaacatggtctagtaaagacttcatttgaattatcttattgaatccttactgttgcccttatttcacattgaggcaatggagacacagtgataaattaagtcagatgttgataatttggattctgaagaaagagaaaatctgtttgagtcttaaaaatcccttcctattttcaaattacaaaagaatttggaagtaacatctga

SEQ ID NO: 105868 - DNA, 601 bp, Human
tcctttttctccagaagatatttgatgctttggtcaaatttttgaccaataagaagaggagataaagaggatggagataaagttgctctagaggtgatgctatcaccagagttctttaaagcagcagtccccaaccttgttggcaccagggatgggggttgggggtgggaggaatgtggacagggagatggttttgagatgaaattgttccacctcagatcatcaggcattagattctcataaggaatgggcagcctagatcccttgctcgtgcagttcgcagtaggtttcattctcttaygagaatccaatgctgctgctgatgtgacgggaggcagagctcaggcagtaatgctcacttgcccaccacttacttcctgctgtgcaacctggttcctaacagggtctgtggccccgggggttagggacccttgctttaaaggttatggtaggtggaaaacaaagatgctctaggtcagaggggcagcttatatggaaattaggaaatgagacactgcagttagtgtacgaagttgaaatcagccaagtgtcactgtagtatactgtgaagagtggaatagctaagacctgagaagtaaac

SEQ ID NO: 105869 - DNA, 601 bp, Human
atcctgcaggtttggatagccactgaaagagctgaataaaatagctgcttaggtttctccttgcatttcccaagcagtaagttgtgttagaactgcgtggtaattttttgaagggagttgaagaaaaaggaaaagaggtaaaaatattgaatgtaatagttctacattttaaatttattgtactgatgtttgtcgtactatgtaccaggcattttgctaaacactgggaatatagtggtaactggccctattgctgcctttttcctaataagatgatatgctggctattttattatcttayggcagaagtgcttttgttagatacacttcaatatcgacttaagacccttagaatgccaagatttttatgtttctcatcagatattaatcattaagcatataactattataagataagatattatactgctattcaagccagaagttcatttagggcagaagatactaggtgcttcccgtgtttctcaatgttctgtgtcagcctgtaaggtgagatgtatatagtctaaatgatctttcagttctcttatatatagatgggtaatgcggacatgcagttttgtgaaacctggcacttcaa

SEQ ID NO: 105870 - DNA, 601 bp, Human
tattttagaaaatgagacataccttataattttctaggtttttgtttagttggttgattttcaaatttctaacgtgtttcactgattgtgtatgctaagggtattttataaagaaaatttgatatgggattatggttttttcctcaaataatgtttcttgtagttctcattttaattcattagcagtaaaacatgagaaggtaaaccttccatattgtttttaaaatgttagtgatttttaagacttggtaaataggcactacatgcttaagccttctagaataacccaaagctttattaygcacgttggactttatctcctgtaactcagtggagaatatttttctgtcatgctttgtttttatataaattttcttttcaaatatctggtttattttgtggtaatttctgggcttaagtgttatttccagaatgtatctcgaaaactttaaaaatgtttatgctctgaaaaaagaacgtagaagtagcaactagtatttgtagaggaattcaagacattagcttgctttttttgcgccacccacgttcatataggattatcccataatattatataattaaaatatttttattgtggttt

SEQ ID NO: 105871 - DNA, 601 bp, Human
taactagcatatatttgctatattatccatttatttattgaatggttagtgtactgggttactaagctcaatgtttaatagggcagagagaacagtattaaaattttaaatcttattaagttttgatgatcagttaaaataatgtatgtgaaagcattttgagaactataggttgcttctggatgcaggcaacagaagacctcactgaaattggtcttaaaaataggggtattgggggacagagcgaggctccatctcaaaaaataaataaataaataaataaaaataaattaaaaaaaarggggggggtattggttatttcatgtaagaaaaattccagcagcatggtagagatttggctgtgttcaagcgggctccaggtctctgcctttgcccatgcatcattgtcttcacactggctttttcatgtcgataaaatggcagtggtagctctaggccttatatgtgaacacagcatcatataaagcagcactatctaatagaatttgttccatatttgtgctgtccaatatagtagccattaactatgtgtagttattgagtgtgtagtgcaactgaaaaacctgagtttttaatcttt

SEQ ID NO: 105872 - DNA, 601 bp, Human
cagagatcagttgtgtcccagaatccacagcagatgttctaaaattaattctaattgtactgtttaaatcgcttgcctctccatctcccactctgaaaacactaaacacagtggtagagaaaggatagaatatcctgattggcttattgtagctagatgttacacccctgggatttactacaaaactaaagtaattcagtgtggtatttgcatagggataggcatgtagttcaatagaacagaatagagagctcagaaatgtacccacatatacatggttaattgatttttgacaaaagarccaaggtaaatcaatgagaaaaggacagtcttttcaataaatggtgctggaaaacctggatatccatatagaaaaaaaataagcctcagtatttaccttacatcatatacaaaatgtttatggaatagcggctttgcataggggagtaatcaaaggtaaggaagagacaaattgaatatagttgatagatggtcttgaatacccagctgtggtatttaatatttgtcctataggcattgggcagcctttagaggggtgtttaaaagttttaagtagtcaagtcattgttacaggaattaa

SEQ ID NO: 105873 - DNA, 601 bp, Human
aattgctccagacatccttaactatcatgtgaaattgaatgcatattttaattgcttattgaaatgtggtaggcatacctgagattaacttttttgctcttcttttaaatgagatataattcgtataccataaaattcaccagtgtagattatgcagttcagtggttcttagtccattcacaagttggtacaaccatgaacgctatctaattctagaacattttcatcaatccgaaaagaaacccagtacccattagcaatcacttaccaactcctccttcccctacatcctggcaaccaytaatgtactttctgtgtctatggatttacctgttctgggaatttgatatagatggagtcatgcaatatgttcttttgtccagctttttcacttagcataatgttttcaaggtccatccgtatggtagctgtatcagtccttcattctgtgaccaaatagtattccatttgctactgtgaagtttgtatacaagttttggtatgggtataagttttcacttctcttgggtatctagttagtagtagaatttcctggattgtgtggtaagttctgtgtttaactttttgaggaactgccaaa

SEQ ID NO: 105874 - DNA, 601 bp, Human
cagatgatctctacagtcttcatgtggacgatgatctatgtctaatttatcagtaaatatcagcatctagtagggtgctttcgataaattttgttgaatgaaagaaaaaaggcaaattaaggtatttattcagtaaacaaaaagggatagtgaagaaccaagctccaggacttttgaagatagactttcttgtctgtggtgcactgagaatcagctctatcttagtattcatttacgtgtggagatctagaacagagttacattctttctggtgacaagctgagactacctggctgctcartatccagctcctgggagacaagggcctcaaaactgttgggattggggggtggggcaggtagggaatcttactaccatttgttaggatttttaccatcaaacctaggagtagcttggaactgggtaagatcttagaatttagagaagccatagcctgaacaccacacacttctcactgaggaagataggggtgataagatcatggaggaactggagaggaatatgaagacagtgcctacaaccaccacatacacagtaaacattctctcttctcagtggttgaagttgttcctgattacag

SEQ ID NO: 105875 - DNA, 601 bp, Human
ggctgctcagtatccagctcctgggagacaagggcctcaaaactgttgggattggggggtggggcaggtagggaatcttactaccatttgttaggatttttaccatcaaacctaggagtagcttggaactgggtaagatcttagaatttagagaagccatagcctgaacaccacacacttctcactgaggaagataggggtgataagatcatggaggaactggagaggaatatgaagacagtgcctacaaccaccacatacacagtaaacattctctcttctcagtggttgaagttgttcytgattacagctctcttatctgttctccctttgatttgctgactgatggatgcagtccatttaagaaatgagcatagcatattggaaagagcactagacttagattctagtcccagttctgtcacttaacagctatgtgttgaggtgaggtgagggaagagtacttggatctctggatctcttttaactttaatattctcctctataagggtagaagatgaactagaggatcacaacagtaccatttagttttccgttcagtggcaattttgacatacttttttgagcatacataatctca

SEQ ID NO: 105876 - DNA, 601 bp, Human
ggtaaatgtctttgggctctgaatctcacacagggctcactgagaataagaaacatccttcttgggctttgtatgaataagaaagaaataaactttcattgtgttaagccactgagatttatggatttattaaagcatctagcattacttatactaatacagagattaaatctagtgatatgtagaagagataatatattatgactaagttgaatgtatcctagtagagttataccatattcatagatcagaagtctcaaattatatatatctgtgccacataagataatctctgtagagytgatgaaatatcaatcagaatcccaagaaatactttttgaaagaacttcaacaactgattctaaagttcacagagaaaatagaacagaagacactgaagaagaacaaggtgagagggtttgcactgcaatatattgagactaattttaaagctataataatgaacatacagtggcagtggcacaaataccaaatgccaaacgtaccaatggaataatagctcagaaacaggaccatgcatatttagatacttaatatatgatagagtggcagaacaaactccttaagcagtggtataggg

SEQ ID NO: 105877 - DNA, 601 bp, Human
tttaaaagacagtttggcattatctagtataactgaagatccacatgttttatgaactaatacttctattcctaagaatacatacccaagagaaatgtgtgcacattatgcagtagactatctacagaaatgtccacagcagcatttttatagattcaaaagattgaagccactccaatgtctgtctgttgtagaatggataaagcttttttttcaagccatgtaatacagtatttagtgaaaatgagccagctataactctgtgtaactctatggcggaatctcataaacagtgttaatrctgaatagtgtactgtgtgtggttccatttacatatcattcacaaataggcatagctaaattatatttttagggatatgtatatatgtggtaaatgtataaagaaaatccagataattgtcatcacagagttaggatggtattaactgtaaaggtgggaggagagggttatgggatgaagggagatagggagggttctggccttggtctatttttttgacttgattgaaatgactgatgttcactttataattatttgttgaattttatataaacttgtacataccttacatatttcaca

SEQ ID NO: 105878 - DNA, 601 bp, Human
ctctgtgtaactctatggcggaatctcataaacagtgttaatactgaatagtgtactgtgtgtggttccatttacatatcattcacaaataggcatagctaaattatatttttagggatatgtatatatgtggtaaatgtataaagaaaatccagataattgtcatcacagagttaggatggtattaactgtaaaggtgggaggagagggttatgggatgaagggagatagggagggttctggccttggtctatttttttgacttgattgaaatgactgatgttcactttataattatttkttgaattttatataaacttgtacataccttacatatttcacaatttttaaaaattgtttttatgtgttgtcagagtagctagaaagaatagtatatgtttcaaaattggaaataattatttacaatgaggaaagacaacttttctcatttttaaaatatcacaataatctagtttcaatttcctgaaacttaagacatgatttcttttttcctcttttttttttttttgagacagagtcttgttctgtcacccaggctggagtgcaatggcaccatctcagctcactgcaacctccacct

SEQ ID NO: 105879 - DNA, 601 bp, Human
ctgatgttcactttataattatttgttgaattttatataaacttgtacataccttacatatttcacaatttttaaaaattgtttttatgtgttgtcagagtagctagaaagaatagtatatgtttcaaaattggaaataattatttacaatgaggaaagacaacttttctcatttttaaaatatcacaataatctagtttcaatttcctgaaacttaagacatgatttcttttttcctcttttttttttttttgagacagagtcttgttctgtcacccaggctggagtgcaatggcaccatctcagctcactgcaacctccacctcctggggttaaagcgattctcctgcctcatcctcctgagtacctggaattacaggtgtctgccactacgcccagctaatttttttgtatttggagtagagacagggtttcaccatgttggccaggctggtttcaaactcctgacctaaagtgatctgcctgtctctgcctcccaaagtgctaggattacaggcatgagccaccgcgcccggcccaagccatgatttctttattttacaagcacttgcttatacttatgctagatttactgactact

SEQ ID NO: 105880 - DNA, 601 bp, Human
tttataccttttgagtagttttaattccatagtttcacttgtaagtgctatgattctattagcttggaatggaatttggcaataataaagttgagcgtatgttaattttttttttcagttcttggtaggcaggagttaaaagtgcaggcatgggctctagcagatactccagcagtataggctcttcgatccaaaatgtagtgtcatatgtcaagattccagaaaatgcaagtcccttgggatatttataagttcttatttaagagcccatatgctttaaatatttattaaacatatttakaaagataatcctgatttatttactctgtaaacagatgccaaagattatagtaatatgcatttgtgcacgtatatatatgcacacattatatacggaaatggactgcacttttaactcctgactaccaagaactgaaaacacttttaacatatgctcaactgtataattgtcaaattccattccaaacaaatagaatcacatatatatatttaaaattttagacaagcttattttccatggaagtttttatgtatataaaactttttatattttatgtataaaagttttatatttaactat

SEQ ID NO: 105881 - DNA, 601 bp, Human
taactaacctaaatggaggttctagccagggcactcactaagtttcaggctttcattgtttttccttaaattggtatggaaattttaaactcaagagccttcctactactggagtgtttggtcagcagtagatagaaagaaaaacaagcaatggggaaaggattccctatttaataaatggtgttggaaaaacgagccagccatatgcagaaagctgaaactggatcccttccttacaccttatacaaaaattaagatgggttaaagatttaaacgtaagacctaaagccataaaaactcyagaagaaaatctaagcagtaccattcaggacataggcatgggcaaagatttcatgactaaaacatcaaaaacaatggcaacaaaagccaaaatagataaataggatctgattaaactaaagagcttctgcacagcaaaagaaactttattatcagaatgaacaggcagcctacagaatgggagaaaatttttgcgatctatccatctgacaaagggttaatatccggaatctacaaagaacttaaatttacaaaaaaaaaaaaaaaaaaaaaaaagccatcaaaaagtgggtgaaggata

SEQ ID NO: 105882 - DNA, 601 bp, Human
aggttctagccagggcactcactaagtttcaggctttcattgtttttccttaaattggtatggaaattttaaactcaagagccttcctactactggagtgtttggtcagcagtagatagaaagaaaaacaagcaatggggaaaggattccctatttaataaatggtgttggaaaaacgagccagccatatgcagaaagctgaaactggatcccttccttacaccttatacaaaaattaagatgggttaaagatttaaacgtaagacctaaagccataaaaactctagaagaaaatctaagyagtaccattcaggacataggcatgggcaaagatttcatgactaaaacatcaaaaacaatggcaacaaaagccaaaatagataaataggatctgattaaactaaagagcttctgcacagcaaaagaaactttattatcagaatgaacaggcagcctacagaatgggagaaaatttttgcgatctatccatctgacaaagggttaatatccggaatctacaaagaacttaaatttacaaaaaaaaaaaaaaaaaaaaaaaagccatcaaaaagtgggtgaaggatatgaacagacactgctc

SEQ ID NO: 105883 - DNA, 601 bp, Human
agccagggcactcactaagtttcaggctttcattgtttttccttaaattggtatggaaattttaaactcaagagccttcctactactggagtgtttggtcagcagtagatagaaagaaaaacaagcaatggggaaaggattccctatttaataaatggtgttggaaaaacgagccagccatatgcagaaagctgaaactggatcccttccttacaccttatacaaaaattaagatgggttaaagatttaaacgtaagacctaaagccataaaaactctagaagaaaatctaagcagtaccrttcaggacataggcatgggcaaagatttcatgactaaaacatcaaaaacaatggcaacaaaagccaaaatagataaataggatctgattaaactaaagagcttctgcacagcaaaagaaactttattatcagaatgaacaggcagcctacagaatgggagaaaatttttgcgatctatccatctgacaaagggttaatatccggaatctacaaagaacttaaatttacaaaaaaaaaaaaaaaaaaaaaaaagccatcaaaaagtgggtgaaggatatgaacagacactgctcaaaagaa

SEQ ID NO: 105884 - DNA, 601 bp, Human
taagatgggttaaagatttaaacgtaagacctaaagccataaaaactctagaagaaaatctaagcagtaccattcaggacataggcatgggcaaagatttcatgactaaaacatcaaaaacaatggcaacaaaagccaaaatagataaataggatctgattaaactaaagagcttctgcacagcaaaagaaactttattatcagaatgaacaggcagcctacagaatgggagaaaatttttgcgatctatccatctgacaaagggttaatatccggaatctacaaagaacttaaatttacaaaaaaaaaaaaaaaaaaaaaaaagccatcaaaaagtgggtgaaggatatgaacagacactgctcaaaagaagacatttatgcagccaacaaacatatgaaaaaaagctcatcatcactggtcattagagaaatgcaaatcaaaaccatcatgagataccatctcaagccagttagaatggtgatcattaaaaagtcaggaaacaacaggtgctagagaggatgtggagaaatgggaacacttttatactgctggtgggagtgtaaattagttcaaccatggtggaagacagtgtggtgat

SEQ ID NO: 105885 - DNA, 601 bp, Human
tacgtttactgcggcactgttcacaatagcaaagactgggaatcaacccaaatgcccatcagtgatagactggataaagaaaatgtggcacatatacaccatggaatactatgcagccataaaaaaaagaatgagttcatgtcctttgcaaggacatggttgacactggaaaccatcattctcagcaaactaacacaaaaacagaaaactaaacaccgcatgttctcactcataagtgggagttgaacaatgacaacacatggacacggagcggaacatcacacactggggcttgtcaggragtggggggctagtctagggatagtggtagaagtacgtaatgtagatgatgggttgataggtgcagcaagccaccatggcacatgtatacctgtgtaacaaacctgcacgttctgcacatgtatcccagaacttaaagtataataataataataataataataataataaaaagatcagcaaagaaaaaaaaggaaggcttttaaagttcctcttcttttagataaaactggtttaattaatgctagacaacaaagcaaaaccttctaagtttgatttgggcatttacaacacagaaata

SEQ ID NO: 105886 - DNA, 601 bp, Human
accatcattctcagcaaactaacacaaaaacagaaaactaaacaccgcatgttctcactcataagtgggagttgaacaatgacaacacatggacacggagcggaacatcacacactggggcttgtcagggagtggggggctagtctagggatagtggtagaagtacgtaatgtagatgatgggttgataggtgcagcaagccaccatggcacatgtatacctgtgtaacaaacctgcacgttctgcacatgtatcccagaacttaaagtataataataataataataataataataataaaaagatcagcaaagaaaaaaaaggaaggcttttaaagttcctcttcttttagataaaactggtttaattaatgctagacaacaaagcaaaaccttctaagtttgatttgggcatttacaacacagaaatagtgtggatatgatgtagggattccttttccctagaaatatttttaggcagtatgccctcctctcttcctccaccagcttgaatttcattttagatcttaatagcttccgacagaaaggaaggttgtgggatttgctgttttagacagttaacattcttaatgctgcaatat

SEQ ID NO: 105887 - DNA, 601 bp, Human
catcattctcagcaaactaacacaaaaacagaaaactaaacaccgcatgttctcactcataagtgggagttgaacaatgacaacacatggacacggagcggaacatcacacactggggcttgtcagggagtggggggctagtctagggatagtggtagaagtacgtaatgtagatgatgggttgataggtgcagcaagccaccatggcacatgtatacctgtgtaacaaacctgcacgttctgcacatgtatcccagaacttaaagtataataataataataataataataataataaaaagatcagcaaagaaaaaaaaggaaggcttttaaagttcctcttcttttagataaaactggtttaattaatgctagacaacaaagcaaaaccttctaagtttgatttgggcatttacaacacagaaatagtgtggatatgatgtagggattccttttccctagaaatatttttaggcagtatgccctcctctcttcctccaccagcttgaatttcattttagatcttaatagcttccgacagaaaggaaggttgtgggatttgctgttttagacagttaacattcttaatgctgcaatataa

SEQ ID NO: 105888 - DNA, 601 bp, Human
tctcactcataagtgggagttgaacaatgacaacacatggacacggagcggaacatcacacactggggcttgtcagggagtggggggctagtctagggatagtggtagaagtacgtaatgtagatgatgggttgataggtgcagcaagccaccatggcacatgtatacctgtgtaacaaacctgcacgttctgcacatgtatcccagaacttaaagtataataataataataataataataataataaaaagatcagcaaagaaaaaaaaggaaggcttttaaagttcctcttcttttagrtaaaactggtttaattaatgctagacaacaaagcaaaaccttctaagtttgatttgggcatttacaacacagaaatagtgtggatatgatgtagggattccttttccctagaaatatttttaggcagtatgccctcctctcttcctccaccagcttgaatttcattttagatcttaatagcttccgacagaaaggaaggttgtgggatttgctgttttagacagttaacattcttaatgctgcaatataaataacaatttatgaattaccacaagaagattttgaagatgagtattgaaa

SEQ ID NO: 105889 - DNA, 601 bp, Human
tggagtgcagtggcacgatctcgctcactgcaagctccgcctcccgggtttacgccattctcctgcctcagcctcccgagtagctgggactacaggtgcccgccaccacgcccagctaactttgtttttgtatttttagtagagacggggtttcaccgtgttagcaggatggtctcaatctcctgacctcgtgatccgcccgcctcggcctcccaaagtgctgggattacaggcgtcagccaccgcgcccggccgtaacatagttttttataaaggtgattatatcaagtgaacatgagtyaaaaattttaagtaattaattagtgagggagcctgaaaaaaatgttgcctttgtaaattcaaagatcagacaaatatataagcccaccaagaaggccaaatgaatttgcttcataaatacaaaaactggctcttccacagttgagagaggaagtcagttgaacttccaccaggcgggatttgtttgcacatctacaaacacaaattatttgcattactctcacttttctacacattatcttctgtttacagagttggaaaatagctcagaaaccaaggtacaaaccccctagaatcagat

SEQ ID NO: 105890 - DNA, 601 bp, Human
cttccacagttgagagaggaagtcagttgaacttccaccaggcgggatttgtttgcacatctacaaacacaaattatttgcattactctcacttttctacacattatcttctgtttacagagttggaaaatagctcagaaaccaaggtacaaaccccctagaatcagataacttggcatgtgctctaaacaatacagagttttaagagatatttagttttttgggtttcatttaaaaatatttcagtatccttacataactagcgttgaaaggtaaatattagctaagtttattacttaartcctgcgttttgtaccataaatgacaatgtgcagaaagtacctgaattggcccaagtcaaaaaaaaaactgttaaaataataatggaatttaactttgttgtgacataaatagaaaaatgattgtttctaacaagtgcttaactgaccctccaaaaataaaattactgtcttctatagacgtgtactgatgaaaaatataggtgtgttaattttaggattttatttaagtaatattgccaattgggacctttaaattagtttggaacatgtatagaacagggtgtatcatcggcttaaat

SEQ ID NO: 105891 - DNA, 601 bp, Human
aatagaaaaatgattgtttctaacaagtgcttaactgaccctccaaaaataaaattactgtcttctatagacgtgtactgatgaaaaatataggtgtgttaattttaggattttatttaagtaatattgccaattgggacctttaaattagtttggaacatgtatagaacagggtgtatcatcggcttaaattgattaataattactcattaatattgatctttatagcagcctgtaatgtatgttgtagaagacatttctttaagaaaagcaactaggataagtcaacttaaatgggtayacaccattgaaatttgaaattattttggcacaattgagttttctccttaagtttgttggaatggcattgaaaaactcaatcacgttatttacaaggagtaaaatatctttgaagttttatttactttagaatggattataatgactagtaatagctatagagagtactcagtgctagcactcttgatgcatttttctactttttctttatgaggaataagcagatctctcatagtggtgacctttcacactgtgttttcctcattgagcaagtgtctttattgtggctaacttgtgtgtg

SEQ ID NO: 105892 - DNA, 601 bp, Human; identical to SEQ ID NO: 32737

SEQ ID NO: 105893 - DNA, 468 bp, Human
tgcaaacttcacctcccgggttcacgccattctgcctcagcctcccgagtagctgggactacaggtgcccgccaccacgccgggctaatttttttgtatttttagtagagacggagtttcaccgtgttagccaggatggtctcaatctcccgacctggtgatctgccygccttgacctcccaaaagtttgttaaaattagatcgtagtgattagaaattagatttaggggttccagaatgcccggaaaagcaaatagtctctggaagaataaaataagcctggcccacatggcaaaaccccatctctactaaaaatacaaaaattagccggaagtggtggcaagtgcctgtaatcccagctactcaggaggctgaggcaggagcatcacttgatcccaggaggcggaggttgcagtgagccgagatcatgccactgcactccagcctgtgcgacaagagcaaaacgct

SEQ ID NO: 105894 - DNA, 601 bp, Human
tgcctcagcctcccgagtagctgggactacaggtgcccgccaccacgccgggctaatttttttgtatttttagtagagacggagtttcaccgtgttagccaggatggtctcaatctcccgacctggtgatctgcccgccttgacctcccaaaagtttgttaaaattagatcgtagtgattagaaattagatttaggggttccagaatgcccggaaaagcaaatagtctctggaagaataaaataagcctggcccacatggcaaaaccccatctctactaaaaatacaaaaattagccggamgtggtggcaagtgcctgtaatcccagctactcaggaggctgaggcaggagcatcacttgatcccaggaggcggaggttgcagtgagccgagatcatgccactgcactccagcctgtgcgacaagagcaaaacgctgtctgaaaaataaataaataaataaataaataaaataaaacaccatctcagaccttattatttctaacttggcacataagctgaactaggcacacacacaaataaagcaaatgaaaacttgcagaaataaacaaacaatggaatcagcctcctgggaactccaga

SEQ ID NO: 105895 - DNA, 601 bp, Human
tgacctcccaaaagtttgttaaaattagatcgtagtgattagaaattagatttaggggttccagaatgcccggaaaagcaaatagtctctggaagaataaaataagcctggcccacatggcaaaaccccatctctactaaaaatacaaaaattagccggaagtggtggcaagtgcctgtaatcccagctactcaggaggctgaggcaggagcatcacttgatcccaggaggcggaggttgcagtgagccgagatcatgccactgcactccagcctgtgcgacaagagcaaaacgctgtctsaaaaataaataaataaataaataaataaaataaaacaccatctcagaccttattatttctaacttggcacataagctgaactaggcacacacacaaataaagcaaatgaaaacttgcagaaataaacaaacaatggaatcagcctcctgggaactccagaatttggagttactaggcacagactttgactttaatataacagtgtttactgtgttcaagggtatttaaaaaacaaaaagattgagaattttagcagagaactgaaatttatttaaaaaatggaaattttagaacaaaaaa

SEQ ID NO: 105896 - DNA, 601 bp, Human
tttggggttaaatgaaggtaaaataagggtttgcattgtagcaggcacattggcagttaaaaagaagagatggaagaggtgaaagatatcatgaagaaagcttgattgctctgaaggtggggatgggatggcggaggacagcagtagttgaagtctttagaacaagctgagttgagatgacagcagcatgtctgggtgaaagtggccaccagattattgaatatgtactggaaattaggaaagataaagcagaaacccagttttcagtcattcacatggaggtgatagttgaagttgtatrtgcttcagcattcatgcttcatgaagatgctgaagtttctgaaagagaagaagatatgttgccttttgggggctgcccacatgggatagagatggggaatacagtattcagaaagaaaagaagcagaccccatgagcattgcctatttttgttataaatttttattggacaggatccatgttgtccatcttacaagacatttcattgaatcaagtacacatgcattcaattatttcaaaacctgtgatctttattattttattttattttagactagtcaggtgcagtagtgagaagggg

SEQ ID NO: 105897 - DNA, 601 bp, Human
gaaatactgtgcttttaagtcccctcttactcttgaaatttggttctcatgagttaccatcatgtcatatctatctaaagcaccatagactgcacatgggaaaatagtatttgtgcttcttgatgatgtgtggctctgaattatatatttttgtctttgagaggaaattctactttcttcttcagatttgagtataaatcaagtaaagaagaatcttctaaataatatcagaatcagaacacatattcatgccattgtatatttaaaaaattattaatctgacattctcatactgttaacrcaaaatgaagtttctatttaaccttcctatttttgaataaaattatttaataaacatttttaattcttcaactgtctggcttagcggttacctctgtccaagtcatatatgatctctactcgacaggatggcctggtgaagtggttgttttttaaactgcactgctttctgaagcttaacaggatgcaggaaattactctatggggtgtggaaaggatttaattcataccccttcaagataatgaaagcagaatgcaggaaataacctcatgaggttaactgaaataccagtccccacag

SEQ ID NO: 105898 - DNA, 601 bp, Human
gatttgttctttttgcttagtcttgctttggctatgcaggctcttttggttccataggaattttaggatttttttcccccctagttctgtgaagaatgatggtggtattttgatgggaattgcattgaatttgtagattgcttttggcagtatggccattttcacaatatttattctacccatccgtgagcatgagatgtgtttccatttgtttgtgtcatctgtgatttctttcagcagtggttcatagttttccttgtagaaatttttcacctccttggttagttatgttcctaagtattttttttttttgcacctgttgcaaaaagcgttgagttcttgatttgattctcagcttggtcattgttggtgtatagcagtgctgttgattttgtgtcctgaaactttactgaatccagtaaagatgtcatagatggcttttattactttaagatatgccccttctgtgccagttttgcttattgacttgtgtatgttaaaccatccctgcatccctagtatgaaacccacttgatcatggtgtattatcttttgatatgctgttggattcggtcacctgttattttgttgaggatttctg

SEQ ID NO: 105899 - DNA, 601 bp, Human
ctgtgctcatcatgggtattggtctgtagtttacttttgttatatcctttcctggttttggtattagggtgatactggcttcatagaatgatttaggaaggattctttcttactctgtcatttggaatggtaaaataagattggtactagttcttctttgaatgcttgatagaattcggctctgaattcatctggtcttggactttttttttattagcagtttttaaaattactgtttcagtctcgctgcttgttattggtccatgcagagtttttatttcttcctcatttaacctaggcrggttgtatatttccaggaatttatccatctcctctagattttctagtatatttttccacccctttactttatgtgagtccttacatgttaggtgagtgtgttgaagacagcagatacttggtggatttttaaccattctgccattctgtatattttaagtggaacatttaggccatttatattcaacgttaatattgagatgtgaggtactattttattaatcattgtgttagttgttgcctgaatactttttttttcattgtgctgttgttttatgggccctgtgagatttatgattta

SEQ ID NO: 105900 - DNA, 601 bp, Human
ctagtgaggccagggaagttttcctcaattattttctcaaatatgttttccagacttttagatttctcttcttcctcaagaacaccacttattcttaggtttggctgtttagcgtaatctcaaattttttggaggctttgttcatttttgttttttgattttttttttaatttgtctttgttcgattggattaattctgtcacctaggctggaatgtggtggcgtggtcttggctcactgcaacctctgcctcctgggctcacctcagcctccttagtttctgggactacaggtgcacacyaccatgtcctattaatttttctttttttttttttttttttttttttgtagagacggggtttcaccatgttgcccaggctggttttgaactgggctcaagcgatctgcccacctcagcctcccaaagttctgggattacaggcatcagctaccacatctgacccagaggcaaaccattttacgtctcagaatgcagtcttgtcaggatgagattattaggacgaattttagaccagtgttaagcacacagcagacactcagtttttgttagtccttgcacgtgtattaatacaggggtgtg

SEQ ID NO: 105901 - DNA, 601 bp, Human
ctggccttcttctgagtctcaaaatgacttaataaaatgctggccggacacgttggctcatgcctgtaatcccagcactttgggaggccgaggcgggcagatcatgaggtcaggagatcaagaccatcctggctaacacggtgaaaccctgtctctggtaataccacaaaaaattagccgggcgtggtggcgggcgcctgtagtcccagctactcaggaggctgaggcaggagaatggcgtgaacccaggaggtggagcttgcagtgagccgagatcgcgctgctgcactccagcctgggyaacagggcaagtctccgtctgaaaaataaataaataaataaataaaaataaaatgcttcctcaggcacagtttagggaatgtgagagcctcctgataatcatggaagagttgttttacccgggttctgattggtcattaccacatccagtcactgtggtgagcgagaatgacctgagtcaaatgcctatcactaagttcatctgggggctggagggagggttgcagagagtcagccccacccagtccacgtggttgctatacatgggaagaagtagaatgactgactacagtattcatga

SEQ ID NO: 105902 - DNA, 601 bp, Human
tggccttcttctgagtctcaaaatgacttaataaaatgctggccggacacgttggctcatgcctgtaatcccagcactttgggaggccgaggcgggcagatcatgaggtcaggagatcaagaccatcctggctaacacggtgaaaccctgtctctggtaataccacaaaaaattagccgggcgtggtggcgggcgcctgtagtcccagctactcaggaggctgaggcaggagaatggcgtgaacccaggaggtggagcttgcagtgagccgagatcgcgctgctgcactccagcctgggcracagggcaagtctccgtctgaaaaataaataaataaataaataaaaataaaatgcttcctcaggcacagtttagggaatgtgagagcctcctgataatcatggaagagttgttttacccgggttctgattggtcattaccacatccagtcactgtggtgagcgagaatgacctgagtcaaatgcctatcactaagttcatctgggggctggagggagggttgcagagagtcagccccacccagtccacgtggttgctatacatgggaagaagtagaatgactgactacagtattcatgaa

SEQ ID NO: 105903 - DNA, 601 bp, Human
aggcacagtttagggaatgtgagagcctcctgataatcatggaagagttgttttacccgggttctgattggtcattaccacatccagtcactgtggtgagcgagaatgacctgagtcaaatgcctatcactaagttcatctgggggctggagggagggttgcagagagtcagccccacccagtccacgtggttgctatacatgggaagaagtagaatgactgactacagtattcatgaaaacaggatggtttcatacgtattttatatctcaactagtacccaaaagtattatatacatagagcatatatcacaatgtgcatttttcctcatttcattaagggagatggaaggttctgttagggaaagtttaggaataagatgattaaagtgagataaatcagaaatatttaataaggacctcagtgaagctgaagaaacagactcagtagaagtagagccataaggaagaagtacgtggtgaaaacggggcattagaaatgagtgctgaataagctgcagttaagaagctgctctgatacctagttcactactcagaacttagtggtagcagtgcctttgctctcacaagagtgaatgaa

SEQ ID NO: 105904 - DNA, 601 bp, Human
gctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactagtaagttgaacctttcttcaacttcattctttaaaacacatattttatacatagtcaatctgtagcttcctttggaattttctgtgccaccgtagaatctacacctattcctaataaatatttccattcaaaattagtatttgaagagacaagtctrtttcaaatacacaaaaatcagattatggaaatttgcttaacagttacttaaaattaaagctaaatacgaacgtggttggaactggaggttattgtgttaagtgaaataagccaggcacagaaagatagatactgcaaggtctcactcatgtgggacctaaaaaaattggtcttgtggagatagagaatagaatgatagcagaggctgggaagggtgtgtgggtgggagacgggatgaagagcggttgattcgtgggtaaaaacatacacttagatacaataaatatacccctgtatttga

SEQ ID NO: 105905 - DNA, 601 bp, Human
caagcaagggcatgatgcctccactagtaagttgaacctttcttcaacttcattctttaaaacacatattttatacatagtcaatctgtagcttcctttggaattttctgtgccaccgtagaatctacacctattcctaataaatatttccattcaaaattagtatttgaagagacaagtctatttcaaatacacaaaaatcagattatggaaatttgcttaacagttacttaaaattaaagctaaatacgaacgtggttggaactggaggttattgtgttaagtgaaataagccaggcayagaaagatagatactgcaaggtctcactcatgtgggacctaaaaaaattggtcttgtggagatagagaatagaatgatagcagaggctgggaagggtgtgtgggtgggagacgggatgaagagcggttgattcgtgggtaaaaacatacacttagatacaataaatatacccctgtatttgataggagagaagggtgactatagttagcaacattgcagatggagtatatttcagagtagctagaaaagaggacttgaaatgttcccaacaaatagaaaggataaatactcaaggtaata

SEQ ID NO: 105906 - DNA, 601 bp, Human
gagtatatttcagagtagctagaaaagaggacttgaaatgttcccaacaaatagaaaggataaatactcaaggtaatagatgccccaaacaccctgacctggatcattacgcattctatgaatgtaacaaatattcacatgtaccccattaatatgtaacacctttcgaatcaggttttttttttttttttttgagtcgttttaaggagtgaaatttagtagccaagaaagaaggaaggaaggaaggagaaaacagctccctccaacagagacagagggaggggggattcaaacaaagagraaacccctcgaatgagtttttaaaaagtaaaatacagagagattattatgtttaattttaattttaccaggctagaagcattaaccatgacttatttattctctgtactttgtatactttcattaatcaattaaacatgcttttctgtgagagaagcactaaactatttgttagaaaattctacataccaggcagggtacagtggctcacacctgtaatcccagcactttgggatgccagggcgggcggatcacctgaggtcaggagttcaagaccagcctggccaacatggtgaaaccc

SEQ ID NO: 105907 - DNA, 601 bp, Human
taccaggcagggtacagtggctcacacctgtaatcccagcactttgggatgccagggcgggcggatcacctgaggtcaggagttcaagaccagcctggccaacatggtgaaaccccatctctactaaaaatacgaaaattagccgggcgtggtggcgcgtgcctgtaatcccagctactcaggaggctgaggcaggagaatcgtttgaacccaagaggtggaggttgcagtgagccgagatcacaccactgcactccagcctgggtgacagagcaagactctgtctcaagaaaaaaaaaaraaaaaattctgcataccacagaactattgtaggatagggaagaaagcacacaaacttgagtgagttattctccaattaattttatttgcttattccttctcaaataacctatttaactgtataaagaatgcaggtagcctctattccactccttgatgacggctttagggttctagtctcatttgtttttgagtcttaagtctgtttgtaaagaacaggagaatctatttatcgcccttagcttcctgtagaaaaaaaactagaatatataatcaagttttaaaacttcttagtttagca

SEQ ID NO: 105908 - DNA, 601 bp, Human
gaactattgtaggatagggaagaaagcacacaaacttgagtgagttattctccaattaattttatttgcttattccttctcaaataacctatttaactgtataaagaatgcaggtagcctctattccactccttgatgacggctttagggttctagtctcatttgtttttgagtcttaagtctgtttgtaaagaacaggagaatctatttatcgcccttagcttcctgtagaaaaaaaactagaatatataatcaagttttaaaacttcttagtttagcaactgtttgactactaccatamtaaatgatatgccaggtgttctctctgctgagcagttgctaaactcaccattagagtttttgctaagtgaaagtgatgctgtcaggcttagataataattccactttggtataatgctttatagattccatagcaccttcatgtgtatattgtctcatttaattctcaattagcctgtgtcattgcaaggtagagatgtggaaactgagttaaaggttattacttgtccaagatagttcaaaatagagctaggaccaaatctctaagtcttacagtccaggtcaaaaaacaagtactttt

SEQ ID NO: 105909 - DNA, 601 bp, Human
aactattgtaggatagggaagaaagcacacaaacttgagtgagttattctccaattaattttatttgcttattccttctcaaataacctatttaactgtataaagaatgcaggtagcctctattccactccttgatgacggctttagggttctagtctcatttgtttttgagtcttaagtctgtttgtaaagaacaggagaatctatttatcgcccttagcttcctgtagaaaaaaaactagaatatataatcaagttttaaaacttcttagtttagcaactgtttgactactaccatacwaaatgatatgccaggtgttctctctgctgagcagttgctaaactcaccattagagtttttgctaagtgaaagtgatgctgtcaggcttagataataattccactttggtataatgctttatagattccatagcaccttcatgtgtatattgtctcatttaattctcaattagcctgtgtcattgcaaggtagagatgtggaaactgagttaaaggttattacttgtccaagatagttcaaaatagagctaggaccaaatctctaagtcttacagtccaggtcaaaaaacaagtacttttt

SEQ ID NO: 105910 - DNA, 601 bp, Human
accttgacagttttgaggagtactagtcaggtatttttatagaatgtctctagttaagatttgtctgatgtttttctcatgcttatactgtggttgttggtttgactgaggtaggccatagaattaagatgccgttttcatcacatcatatcaagagtgcctactacatttattatcccttatctgatactcaggaccagaagtattccagatttcagattttttcaagttttggaatatttcccttatactaataagtagaacatcccaaatccaaaaatctgaaatccaaaatgatccratgagtactacatgcgagtgtcatgttggtgctcaacaggttttagatcttggagcatttcagatttcagattttcagatttgggatgaccaacctgtatcgtcataactattgctgatgttcatttggtcacctggctgatgtttaacaggtatttaccaggtttcttttctgtgaagttactctttctcccgcttttcatactgtagcctttgggtaggaaattaccatgttcagcccacacttttaaggagtggggagttaaggcttcactttcttaagagaaggatatctacataa

SEQ ID NO: 105911 - DNA, 601 bp, Human
ttggaatatttcccttatactaataagtagaacatcccaaatccaaaaatctgaaatccaaaatgatccaatgagtactacatgcgagtgtcatgttggtgctcaacaggttttagatcttggagcatttcagatttcagattttcagatttgggatgaccaacctgtatcgtcataactattgctgatgttcatttggtcacctggctgatgtttaacaggtatttaccaggtttcttttctgtgaagttactctttctcccgcttttcatactgtagcctttgggtaggaaattaccawgttcagcccacacttttaaggagtggggagttaaggcttcactttcttaagagaaggatatctacataaattatttggaattcttctgcacgggagatttatctcttctctctcatttattcaaccatttatttctatcaatatggactcgtgggcatttattttaatactttggtttataatacaataccacgtttttctgttgctttgttctagcttcagcttttgagggctatctacttgattcctatgtccctttgatatatccttatttttgtgggtttttttttttcaggggga

SEQ ID NO: 105912 - DNA, 601 bp, Human
ttgggtaggaaattaccatgttcagcccacacttttaaggagtggggagttaaggcttcactttcttaagagaaggatatctacataaattatttggaattcttctgcacgggagatttatctcttctctctcatttattcaaccatttatttctatcaatatggactcgtgggcatttattttaatactttggtttataatacaataccacgtttttctgttgctttgttctagcttcagcttttgagggctatctacttgattcctatgtccctttgatatatccttatttttgtgggtttttttttttcagggggagcaggcgcttttttattttccggcactataatatattctaggcttatcttgtgtattttctgccccagtcctagaatcaggcatttctccaaggaacattatttttatggagaatgaaagaaaccaagatccgagtgctttccctctttttaattgctccaaaaggtatctgactatgtaaggcaaaaatagtaactgtattttgtttctgtagcacatgtaaaaataaaatatatgacaacaaaagatgggagggaggaattgactctacacatgatgtaa

SEQ ID NO: 105913 - DNA, 601 bp, Human
ctacttggtaggctgaggcaggagaatcacttgaacccgggaggcggaggttgcagtgagccaagatcatgctattgcgctccagcctgggcaacaagagtgaaactccgtctcaaaaaaaaaaaaaagaaaaatgctgcttacaagaaatccactttaaatataaagacatagataaaagaagggagaaaatttaccattgcaaacaccaaaaagaaagctaaagcagacctattaatttcagacaatataagcttcacaacaaggaagagtatcagcgataaggagggacgtgacatastccactttccaagaaataactgtctttaatgtgtatgcacctaacagcaaccttcaaaatacataaagtgaagactgatagaactaaaaggtgagtagaaaaatccacaattgtagttggagacttctatatccctctcagtaactgatagaacaagtaggcagaaaaatcagtaaggatctagatgatttgagcaacactcgaccaacatgacctaagagacatttatagaacacatcactcgacaacagcagaacacacacttttcacaagtgcacatggaacattcaccaagatcac

SEQ ID NO: 105914 - DNA, 601 bp, Human
cacagtctctttcagaaaaaattaggagagaacactttccaacttatttttttaggtcagcattaccccggtgcaaaaccaaagtaagccaacacaagaaaaaaagtctacaaatccatattcctcatgaactctagacacaaaaatcctcagtaaaaagtaagtaaattgagcaatatataaaaaggataatacatcaagaccaagttggttttatcccaggaatgcaaggctgagtctacatttgaaaattcattagtataatcagtatattaacaattgaacatctattcatcatttaaaaaaaaaatctcaatgaactagtaatagaaaggaacttaataaagagcatctacaaaaaatatacagctaaaatacttcataaggggaaagcattcagtcttctagcatttggagctaggtaatgatatttttttttctcaccagtcatatttaccatggtagtaaaagtcctagccagtacagttaggcaaaaataaatgaataaaatgcatatatatcgggaagagagaaattaaacttcctctattcataggagatagattctttcatgtagaaaagtgtaaagaaattataaaaa

SEQ ID NO: 105915 - DNA, 601 bp, Human
catttaaaaaaaaaatctcaatgaactagtaatagaaaggaacttaataaagagcatctacaaaaaatatacagctaaaatacttcataaggggaaagcattcagtcttctagcatttggagctaggtaatgatatttttttttctcaccagtcatatttaccatggtagtaaaagtcctagccagtacagttaggcaaaaataaatgaataaaatgcatatatatcgggaagagagaaattaaacttcctctattcataggagatagattctttcatgtagaaaagtgtaaagaaattayaaaaaaaactcctcggaccaatcagtgagtttagcaaggttgcagggtacaaagttaatatataaaaatcgattatatgccagcagtgaacaattggagtttgaaattaaaaaaaaaaaatgatagcaccccaaataaaggaaggaaaagaaacatctaggtaaaattctgacaaaatatgtacagtctgtatgttgaagactgcaaaacactgatgaaagaaatgaaagaagacctagatgaatagatagatacatcatgttaatggatttcaagactcagtattgtcaagatgtcatt

SEQ ID NO: 105916 - DNA, 601 bp, Human
ctagcatttggagctaggtaatgatatttttttttctcaccagtcatatttaccatggtagtaaaagtcctagccagtacagttaggcaaaaataaatgaataaaatgcatatatatcgggaagagagaaattaaacttcctctattcataggagatagattctttcatgtagaaaagtgtaaagaaattataaaaaaaactcctcggaccaatcagtgagtttagcaaggttgcagggtacaaagttaatatataaaaatcgattatatgccagcagtgaacaattggagtttgaaattwaaaaaaaaaaatgatagcaccccaaataaaggaaggaaaagaaacatctaggtaaaattctgacaaaatatgtacagtctgtatgttgaagactgcaaaacactgatgaaagaaatgaaagaagacctagatgaatagatagatacatcatgttaatggatttcaagactcagtattgtcaagatgtcatttcttcccagattgatctgtagattaaacacaatttcaaaatcccagcaagctcttttgtagttactaacaagctgattctaaaatatataggtaaagacgaactacaat

SEQ ID NO: 105917 - DNA, 601 bp, Human
gtaatgatatttttttttctcaccagtcatatttaccatggtagtaaaagtcctagccagtacagttaggcaaaaataaatgaataaaatgcatatatatcgggaagagagaaattaaacttcctctattcataggagatagattctttcatgtagaaaagtgtaaagaaattataaaaaaaactcctcggaccaatcagtgagtttagcaaggttgcagggtacaaagttaatatataaaaatcgattatatgccagcagtgaacaattggagtttgaaattaaaaaaaaaaaatgatarcaccccaaataaaggaaggaaaagaaacatctaggtaaaattctgacaaaatatgtacagtctgtatgttgaagactgcaaaacactgatgaaagaaatgaaagaagacctagatgaatagatagatacatcatgttaatggatttcaagactcagtattgtcaagatgtcatttcttcccagattgatctgtagattaaacacaatttcaaaatcccagcaagctcttttgtagttactaacaagctgattctaaaatatataggtaaagacgaactacaatagctagaatgattttaa

SEQ ID NO: 105918 - DNA, 601 bp, Human
aaaattctgacaaaatatgtacagtctgtatgttgaagactgcaaaacactgatgaaagaaatgaaagaagacctagatgaatagatagatacatcatgttaatggatttcaagactcagtattgtcaagatgtcatttcttcccagattgatctgtagattaaacacaatttcaaaatcccagcaagctcttttgtagttactaacaagctgattctaaaatatataggtaaagacgaactacaatagctagaatgattttaagaaggaacaaaattttaaaaaaatactactactaccygatttcaagacctactacaaagctatagtaatccagaaagtgtgatattgacaaaaggatgggcacatagatcagtggacaaaacggctcagaaaatttacacctatacgtatatattcagctgggtttttggcagaggtagtaaggcaattcaacagagaaaggatggtggttacaacgaatggtgttgaaacaattctacatccatacacaaaacaaaaacaacccaaagtctgaaaataactcaaactttattaaaaaattaactaaaattggattatagacccaaatttaaaacag

SEQ ID NO: 105919 - DNA, 601 bp, Human
tattgacaaaaggatgggcacatagatcagtggacaaaacggctcagaaaatttacacctatacgtatatattcagctgggtttttggcagaggtagtaaggcaattcaacagagaaaggatggtggttacaacgaatggtgttgaaacaattctacatccatacacaaaacaaaaacaacccaaagtctgaaaataactcaaactttattaaaaaattaactaaaattggattatagacccaaatttaaaacaggaaactgaaatttagaggagaaaatccaacacaaaaagcaggatcyataaagaaaaaactgatgtattggaggttgaacttaagttttgctctgtgaaaggcactgttcagagagtataggacaacctacagattagaagaaggtatttgcaagtcacatatccaataaagagtttgtatccagaatattttaagaattcttaaaacccaacagtaagaaaacatttttaaaagggcacaagatctgaacagatacttcaaaaagaagatacatggatggcaaataagtgtatgaaaatatgctcaatattatcaggcttagggaattgaaaattaaaacctaatg

SEQ ID NO: 105920 - DNA, 601 bp, Human
ttattaaaaaattaactaaaattggattatagacccaaatttaaaacaggaaactgaaatttagaggagaaaatccaacacaaaaagcaggatccataaagaaaaaactgatgtattggaggttgaacttaagttttgctctgtgaaaggcactgttcagagagtataggacaacctacagattagaagaaggtatttgcaagtcacatatccaataaagagtttgtatccagaatattttaagaattcttaaaacccaacagtaagaaaacatttttaaaagggcacaagatctgaacasatacttcaaaaagaagatacatggatggcaaataagtgtatgaaaatatgctcaatattatcaggcttagggaattgaaaattaaaacctaatgagatataactgcacatctagtaaaatggctaaaatttaagaaaacgcaacggctgggcgcggtggctcacacctgtaatcccagcactttgggaggctgaggcaggcagataacctgaggttgggagttcgagaccagcctgatcaacatggagaaaccccatctctactaaaaatacaaaattagccaggggtggtggcgcatgc

SEQ ID NO: 105921 - DNA, 601 bp, Human
ggcactgttcagagagtataggacaacctacagattagaagaaggtatttgcaagtcacatatccaataaagagtttgtatccagaatattttaagaattcttaaaacccaacagtaagaaaacatttttaaaagggcacaagatctgaacagatacttcaaaaagaagatacatggatggcaaataagtgtatgaaaatatgctcaatattatcaggcttagggaattgaaaattaaaacctaatgagatataactgcacatctagtaaaatggctaaaatttaagaaaacgcaacggcygggcgcggtggctcacacctgtaatcccagcactttgggaggctgaggcaggcagataacctgaggttgggagttcgagaccagcctgatcaacatggagaaaccccatctctactaaaaatacaaaattagccaggggtggtggcgcatgcctgtaatcccagctactcaggaggctgaggcaggagaatcgcttgaacccaggaggcaaaggttgcagtgagccaagatcataccattgcactccagcctgggcaacaagagtgaaactctgtctcaaaaaaaaaaacaaaaacgcaa

SEQ ID NO: 105922 - DNA, 601 bp, Human
actgttcagagagtataggacaacctacagattagaagaaggtatttgcaagtcacatatccaataaagagtttgtatccagaatattttaagaattcttaaaacccaacagtaagaaaacatttttaaaagggcacaagatctgaacagatacttcaaaaagaagatacatggatggcaaataagtgtatgaaaatatgctcaatattatcaggcttagggaattgaaaattaaaacctaatgagatataactgcacatctagtaaaatggctaaaatttaagaaaacgcaacggctggkcgcggtggctcacacctgtaatcccagcactttgggaggctgaggcaggcagataacctgaggttgggagttcgagaccagcctgatcaacatggagaaaccccatctctactaaaaatacaaaattagccaggggtggtggcgcatgcctgtaatcccagctactcaggaggctgaggcaggagaatcgcttgaacccaggaggcaaaggttgcagtgagccaagatcataccattgcactccagcctgggcaacaagagtgaaactctgtctcaaaaaaaaaaacaaaaacgcaaaaa

SEQ ID NO: 105923 - DNA, 512 bp, Human
aacctggtctaagtaactttggaaacttttgactggatactgtaaggttagagaccaacgaaattgtagcaaatcactgtgctctagatggtaaattcatccctcacatacacaaacacaaagggttgaacatataaataaatataaaatgtaaataaacaaatggacattgtagataaaggcagccaggtttctcatggttggaggagaaagttgcagataacccagggggttgggggtggggtctagaatgagcctgtgtttcagggttatagttgaaggattcagtaagagtttataggtgtgtgtgtgtgtttgtgtgtgtgtgtgtgtgtgtatatatatataatttttatatttttagtggagactaatttttgtatttttagtagagacggggtttcgccatgttggccaggctggtctcaaactcctgagctcaacatctgccccctcagcctcccgaagtgctgggttacgagcatgagccactgtgcccagccagacacata

SEQ ID NO: 105924 - DNA, 497 bp, Human
actttggaaacttttgactggatactgtaaggttagagaccaacgaaattgtagcaaatcactgtgctctagatggtaaattcatccctcacatacacaaacacaaagggttgaacatataaataaatataaaatgtaaataaacaaatggacattgtagataaaggcagccaggtttctcatggttggaggagaaagttgcagataacccagggggttgggggtggggtctagaatgagcctgtgtttcagggttatagttgaaggattcagtaagagtttatatgtgtgtgtgtgtgtgtgtgtgtgtgtgtgtgtgtgtatatatatataatttttatatttttagtggagactaatttttgtatttttagtagagacggggtttcgccatgttggccaggctggtctcaaactcctgagctcaacatctgccccctcagcctcccgaagtgctgggttacgagcatgagccactgtgcccagccagacacata

SEQ ID NO: 105925 - DNA, 496 bp, Human
ctttggaaacttttgactggatactgtaaggttagagaccaacgaaattgtagcaaatcactgtgctctagatggtaaattcatccctcacatacacaaacacaaagggttgaacatataaataaatataaaatgtaaataaacaaatggacattgtagataaaggcagccaggtttctcatggttggaggagaaagttgcagataacccagggggttgggggtggggtctagaatgagcctgtgtttcagggttatagttgaaggattcagtaagagtttatatgtgtgtgtgtgtgttggtgtgtgtgtgtgtgtgtgtatatatatataatttttatatttttagtggagactaatttttgtatttttagtagagacggggtttcgccatgttggccaggctggtctcaaactcctgagctcaacatctgccccctcagcctcccgaagtgctgggttacgagcatgagccactgtgcccagccagacacata

SEQ ID NO: 105926 - DNA, 475 bp, Human
tactgtaaggttagagaccaacgaaattgtagcaaatcactgtgctctagatggtaaattcatccctcacatacacaaacacaaagggttgaacatataaataaatataaaatgtaaataaacaaatggacattgtagataaaggcagccaggtttctcatggttggaggagaaagttgcagataacccagggggttgggggtggggtctagaatgagcctgtgtttcagggttatagttgaaggattcagtaagagtttatatgtgtgtgtgtgtgtttgtgtgtgtgtgtgtgtgtgtrtatatatataatttttatatttttagtggagactaatttttgtatttttagtagagacggggtttcgccatgttggccaggctggtctcaaactcctgagctcaacatctgccccctcagcctcccgaagtgctgggttacgagcatgagccactgtgcccagccagacacata

SEQ ID NO: 105927 - DNA, 458 bp, Human
ccaacgaaattgtagcaaatcactgtgctctagatggtaaattcatccctcacatacacaaacacaaagggttgaacatataaataaatataaaatgtaaataaacaaatggacattgtagataaaggcagccaggtttctcatggttggaggagaaagttgcagataacccagggggttgggggtggggtctagaatgagcctgtgtttcagggttatagttgaaggattcagtaagagtttatatgtgtgtgtgtgtgtttgtgtgtgtgtgtgtgtgtgtatatatatataatttttrtatttttagtggagactaatttttgtatttttagtagagacggggtttcgccatgttggccaggctggtctcaaactcctgagctcaacatctgccccctcagcctcccgaagtgctgggttacgagcatgagccactgtgcccagccagacacata

SEQ ID NO: 105928 - DNA, 601 bp, Human
gtacgtatgtgtctggctggcacagtggctcgtgctgtaatcccagcacttcgggaggctgaggcgggcagatgttgagctcaggagtttgagaccagcctggccaacatggcgaaaccccgtctctactaaaaatacaaaaattagtcgagtgtggtaggatgcccccatagtccccagctacttgggaggctgaggtgagaggatcgcttgagcccaggaagtcgaggctgcagtggcctatgattgtaccactgcactccagcctggctgacacagcgagaccctgtcacacacacamaaaaaaggtacagttgtgtgtacatatgaattagtatacatcatatatttcctagctctgtttgctgagaggtctgtgaggcaatagcatccagtaactgaacatacctggtgctcagattttagtttcagaacaccattttctaatacaaggactcagggctgcttggaaaaaaatggtttgttgtagagctggggcagggaaacgggatgagccggggttgtcagaggttaagaaagtgcgtatcaaaagtcacgggagctggcctttcaaaagagtttccagtggccaaaactagaa

SEQ ID NO: 105929 - DNA, 601 bp, Human
gggaggctgaggtgagaggatcgcttgagcccaggaagtcgaggctgcagtggcctatgattgtaccactgcactccagcctggctgacacagcgagaccctgtcacacacacaaaaaaaaggtacagttgtgtgtacatatgaattagtatacatcatatatttcctagctctgtttgctgagaggtctgtgaggcaatagcatccagtaactgaacatacctggtgctcagattttagtttcagaacaccattttctaatacaaggactcagggctgcttggaaaaaaatggtttgttrtagagctggggcagggaaacgggatgagccggggttgtcagaggttaagaaagtgcgtatcaaaagtcacgggagctggcctttcaaaagagtttccagtggccaaaactagaacaatttgagtaacaaaataacaatagtattggattatagcccagggaataaaaaacattgagtccattactgatataaataaatgatagaataaataaggggaaaaagggacaactcttccttagaaaataactaattaataaatgtagaaagaatgagagagagtaaatcagcattagaacacca

SEQ ID NO: 105930 - DNA, 601 bp, Human
acaccattttctaatacaaggactcagggctgcttggaaaaaaatggtttgttgtagagctggggcagggaaacgggatgagccggggttgtcagaggttaagaaagtgcgtatcaaaagtcacgggagctggcctttcaaaagagtttccagtggccaaaactagaacaatttgagtaacaaaataacaatagtattggattatagcccagggaataaaaaacattgagtccattactgatataaataaatgatagaataaataaggggaaaaagggacaactcttccttagaaaataaytaattaataaatgtagaaagaatgagagagagtaaatcagcattagaacaccacagtacaatggtaattgttgcaggcaaagtcagtggataaatgctaacataagtgggcaaaaagtttaagtaaaaagctattttgctttgtctcagaatgtctcttccccaatattcatttcttacaaagggaaaaattagagaattagaaataagagaatcctggaaaacactgccttaaccggaggatcaaggttaacatcaccagtaatgggacataaagacaacatgtgccttccaatatgac

SEQ ID NO: 105931 - DNA, 601 bp, Human
tggtttgttgtagagctggggcagggaaacgggatgagccggggttgtcagaggttaagaaagtgcgtatcaaaagtcacgggagctggcctttcaaaagagtttccagtggccaaaactagaacaatttgagtaacaaaataacaatagtattggattatagcccagggaataaaaaacattgagtccattactgatataaataaatgatagaataaataaggggaaaaagggacaactcttccttagaaaataactaattaataaatgtagaaagaatgagagagagtaaatcagcatkagaacaccacagtacaatggtaattgttgcaggcaaagtcagtggataaatgctaacataagtgggcaaaaagtttaagtaaaaagctattttgctttgtctcagaatgtctcttccccaatattcatttcttacaaagggaaaaattagagaattagaaataagagaatcctggaaaacactgccttaaccggaggatcaaggttaacatcaccagtaatgggacataaagacaacatgtgccttccaatatgacatgctaagaaagccatgtctctttgtggtattcttgcaaaaatc

SEQ ID NO: 105932 - DNA, 601 bp, Human
ccagtggccaaaactagaacaatttgagtaacaaaataacaatagtattggattatagcccagggaataaaaaacattgagtccattactgatataaataaatgatagaataaataaggggaaaaagggacaactcttccttagaaaataactaattaataaatgtagaaagaatgagagagagtaaatcagcattagaacaccacagtacaatggtaattgttgcaggcaaagtcagtggataaatgctaacataagtgggcaaaaagtttaagtaaaaagctattttgctttgtctcaraatgtctcttccccaatattcatttcttacaaagggaaaaattagagaattagaaataagagaatcctggaaaacactgccttaaccggaggatcaaggttaacatcaccagtaatgggacataaagacaacatgtgccttccaatatgacatgctaagaaagccatgtctctttgtggtattcttgcaaaaatccatgcccttctatctgattatgaatgaaaatcagacccaaattgagagacattctataagataactgatcagcactctttcaaaacaagttgtcaaggtcatgca

SEQ ID NO: 105933 - DNA, 601 bp, Human
aagttgtcaaggtcatgaaaaggaaagactgaggaactgtcacagagcagaggagacgaaggagatgtgagaactaaaggcttgtgggatccaggatctgatcctgggtcaggaaaaaggacatcagttgaaagactggtgaaatccaagtaaagtccaaagctttaattggtgctgtattatttttattagtttcgacaactgcattgtatttccttgtgatgttaacaatgtggaaagctgagtgagatgtgagggagctctctttgtaaatgctgtctaaaattatttcagaataaawagtttaaaatatatacatacatacataacaaagaaatacaccccaaaagggagccaagaaaaaatggcatttaggatggtcccatagctcacctttcaggtactggatatgcaatacttgctactgtctttcagaaataaactctacaaaatgtcatgtagggtacagaaatgtttacaagaattgttagtaaactgccaatttagagacaaactccatttaagcattttagcaattgcttaataaagttatgtctgattgttaggagagcatgaaggatctccatggaaaactcaaaat

SEQ ID NO: 105934 - DNA, 601 bp, Human
taaagatatctataacaaaacagttgaatagcatcttgcccacattggagatagcagttgtagatcaagtgattgtttttcagagtaagtaatcggtcccacctactttacacacaccatttacagagaaaccttcttccagattagggcttcatgtatcagtggcacttacaatgacacttttcacagactgacagagaagcttaacttactcaagtaaaacaagtaaaaactgattagactgtttctagcatgttaatattttctaaatgttatggagaaaaggagcaaaaatgtttctttttttttttttttttggacggagtctcactctgtcacccaggctggagtgcagtggcgtgatctcagctcactgtaacctctgccgcccgggttcaagcaattctcctgcctcagtctcctgagtagctgggattataggcacctgccaccgcacctggctaatttttgtagttttagtagagacaaggtttcaccatcttggccaggctggtcttgaactcctgacgtgagccaccgtgcccagccttatttcttttctttacatgacttatgaattcatttctccttcagtctcatt

SEQ ID NO: 105935 - DNA, 601 bp, Human; identical to SEQ ID NO: 32738

SEQ ID NO: 105936 - DNA, 601 bp, Human; identical to SEQ ID NO: 32739

SEQ ID NO: 105937 - DNA, 601 bp, Human; identical to SEQ ID NO: 32740

SEQ ID NO: 105938 - DNA, 601 bp, Human; identical to SEQ ID NO: 32741

SEQ ID NO: 105939 - DNA, 601 bp, Human; identical to SEQ ID NO: 32742

SEQ ID NO: 105940 - DNA, 601 bp, Human; identical to SEQ ID NO: 32743

SEQ ID NO: 105941 - DNA, 601 bp, Human; identical to SEQ ID NO: 32744

SEQ ID NO: 105942 - DNA, 601 bp, Human; identical to SEQ ID NO: 32745

SEQ ID NO: 105943 - DNA, 601 bp, Human; identical to SEQ ID NO: 32746

SEQ ID NO: 105944 - DNA, 601 bp, Human; identical to SEQ ID NO: 32747

SEQ ID NO: 105945 - DNA, 601 bp, Human; identical to SEQ ID NO: 32748

SEQ ID NO: 105946 - DNA, 601 bp, Human; identical to SEQ ID NO: 32749

SEQ ID NO: 105947 - DNA, 601 bp, Human; identical to SEQ ID NO: 32750

SEQ ID NO: 105948 - DNA, 601 bp, Human; identical to SEQ ID NO: 32751

SEQ ID NO: 105949 - DNA, 601 bp, Human; identical to SEQ ID NO: 32752

SEQ ID NO: 105950 - DNA, 601 bp, Human; identical to SEQ ID NO: 32753

SEQ ID NO: 105951 - DNA, 601 bp, Human; identical to SEQ ID NO: 32754

SEQ ID NO: 105952 - DNA, 601 bp, Human; identical to SEQ ID NO: 32755

SEQ ID NO: 105953 - DNA, 601 bp, Human; identical to SEQ ID NO: 32756

SEQ ID NO: 105954 - DNA, 601 bp, Human; identical to SEQ ID NO: 32757

SEQ ID NO: 105955 - DNA, 601 bp, Human; identical to SEQ ID NO: 32758

SEQ ID NO: 105956 - DNA, 601 bp, Human; identical to SEQ ID NO: 32759

SEQ ID NO: 105957 - DNA, 601 bp, Human; identical to SEQ ID NO: 32760

SEQ ID NO: 105958 - DNA, 601 bp, Human; identical to SEQ ID NO: 82578

SEQ ID NO: 105959 - DNA, 601 bp, Human; identical to SEQ ID NO: 82579

SEQ ID NO: 105960 - DNA, 601 bp, Human; identical to SEQ ID NO: 82580

SEQ ID NO: 105961 - DNA, 601 bp, Human; identical to SEQ ID NO: 82581

SEQ ID NO: 105962 - DNA, 601 bp, Human; identical to SEQ ID NO: 82582

SEQ ID NO: 105963 - DNA, 601 bp, Human; identical to SEQ ID NO: 82583

SEQ ID NO: 105964 - DNA, 601 bp, Human; identical to SEQ ID NO: 82584

SEQ ID NO: 105965 - DNA, 601 bp, Human; identical to SEQ ID NO: 82585

SEQ ID NO: 105966 - DNA, 601 bp, Human; identical to SEQ ID NO: 82586

SEQ ID NO: 105967 - DNA, 601 bp, Human; identical to SEQ ID NO: 82587

SEQ ID NO: 105968 - DNA, 601 bp, Human; identical to SEQ ID NO: 82588

SEQ ID NO: 105969 - DNA, 601 bp, Human; identical to SEQ ID NO: 82589

SEQ ID NO: 105970 - DNA, 601 bp, Human; identical to SEQ ID NO: 82590

SEQ ID NO: 105971 - DNA, 601 bp, Human; identical to SEQ ID NO: 82591

SEQ ID NO: 105972 - DNA, 601 bp, Human
ccggcggggctgaggtgaaagacaaaagggggcgggtaagggaagcgtaagatccccgcccgacccaagggtctgcccccgggctgcgccccttggagtcctcgagcgcgcccaccagtcactaccggccagcagccgccgggtccccaccctgcaaagtttctcccacgcacctacagtacggaccccgacgatcgccgcccctagaagggaggagagaggactgaccccacccccaagtcggcccgcccgccccatccccaccaaggtccgcgccggcggcggtcgagatactagggcyagacccgccacctgtcggctcgtcgtatcgcctgctccgcgctctagccaccgccggtccgaggtccccgtcagctacaaccccactcccaaggcgaggcgcggagctcctagccggttcgcagaggaggcggggacccagctgtcccgccgagcgtggaaaggaccgggtgtgagcgagcgccttaccttggaggagcttgtaggggacgaggcgtagggctgggatccggctcccaggtgtgccgaagctggcgcgcgctcttccgccgcgcggaaagtgccgcggcaaactcgcggt

SEQ ID NO: 105973 - DNA, 601 bp, Human
gggtgaagggacaaagagggcacggaattgaattagcatgagcaaacatttttttaaagatcctaacatgctatcaatgtgctgctcaagttaagaaccactgcatgtcggtacttaatatactatacaaacaattatgtatacatgtacatatgtgagaacatatgtaaaaatatacaagtactgaaaagtttaagactcaggtcaagattctcatcctcaatagcttctcccagcccaatcatctcccccttttaaacacacactatttccaataaatagttacatgcttcattaagayggcttttaaactgttaactcagtacttaaattttttcatgtaattatgccttatccttcttcctagattatagccttgctccttgagaatatacactgccgtgttcttattttctccactgcttaaggatagtgtctttaacaggtatgtaatacacatttgactgatctgataaacacacacaaaaattactggcaagaagtatgccacgtccaaattacccagttcaggtgaattactaccaaaaaatagaaaatgtaaaaatttagaaaaaaggatatttttcttaaaactcttagt

SEQ ID NO: 105974 - DNA, 601 bp, Human
cttctcttccccattttcccatagggctgtggtgagaattaaatgcactaatgtatgtcaagtgcttagaacagtgcctggcacttaataagcacaccataaatgtcatctactttaattatgtaattattatttttatgagaaatgacatcccagctcagacaactcagtacaaatcctgataatattaaaatttcaatttactttaccagtgagctcaaacatttaggaaagctgggctaatagcccaggttttacactaaacagtctcagtgtttacactatatctaccccattcacraatcaaattttctccaactctgagtcattattagtttctctcctgactcatcacacagaaaggtagacagtctggagcataatgggaataacaaaaggcatttcttaatccacctggatttataaagtttactaagtggaacttgtcctatatataatgttcaataaacatactaaataattatgacctaacctgtgttcacttaaaagtgctttctatatgttaaatgctcctttatcttccctttcaccaacacgagttcaaactatggagtaggtgtcatgaccccatcttgataga

SEQ ID NO: 105975 - DNA, 601 bp, Human
ctcccacctgtaatccaagcactttgggaggctgaggcgggtagatcacttgaggctggaagtttgagagcagcctggccaacatggcgaaacaccatctctactaaaaatacaaaaattagccaggcatggtggtgcacacctgcagtcccagctacttgggagactgacgcaggagaattgcttgaacccgggaggtggaggctgcagtgagctgagatcacaccacatgccactgtactccagcctgggcaacagagcaagactccacctcaaaaaaaaaagaaagaaagaaaaaaasaaagaaaatagtataaacaggccactagcttgataatgattttaaataagaattttaatgccagtgtttatatattcatttgttctcaaaattttccattaaagtctcacttcatctatgttctataaatagggctatttttaaattccatagtcatatactaacaatttaacactaaaatattctttgtatttcttaaactaggtatacagtatgtaatacactgaagtgtagtaagatggtttattacgcacaagactgtgagtgcaaactatctctaatctacttctcactacatgt

SEQ ID NO: 105976 - DNA, 601 bp, Human
tactgaaaggaaagctaaaatttagggaccagaggttctaagaacataatgaaaaataaagatgaaaatataaaagcacttaagagcacaccgtgtgaatactaaaaaaccactgaactgtacactttaaaagggtaaattttattgtatgtgaattatatctcaatttttaaaaaaggaaaaaaagcacagagaaaatgtcaaaccctaatatttgccaataattttatacttataaaacattatatcaaccttgctattaaatggcataattattttctggcacacatcataggtgctaaaaaaaaaatgcagaaataataaatagcatagataggcttggtacggtagctcccacctgtaatccaagcactttgggaggctgaggcgggtagatcacttgaggctggaagtttgagagcagcctggccaacatggcgaaacaccatctctactaaaaatacaaaaattagccaggcatggtggtgcacacctgcagtcccagctacttgggagactgacgcaggagaattgcttgaacccgggaggtggaggctgcagtgagctgagatcacaccacatgccactgtactccagcctg

SEQ ID NO: 105977 - DNA, 601 bp, Human
ccactttttttttaggggtttttttttttcattatttccctagttgacagaccaccttcttaatcctacatgtcaagcactgagctaagtattaaggatactaaaatagactgtcaaggaaaacctagcttaaaaaggaaaaatattagccaggcacagtagcacgaacctctagtcccagctacgctggaggctgaggcaggagaattgcttaagcctaggagtttgagtctagcctgggcaaaaagcaagaccttagcacttaaaaaaaaaaaaaaaaaaaaaggaaagaaaacattayattcaaatactaattttaaattccactacagcctaaagttgtttggtggtgttttaaactttaattcaacaaaatggaaagtactagacaacataattgaaatctcttttctctaatcaatttaccatctaaaatattccaccaatttcaagattaaatcccttcactaggagaatcatgtggctagatttaatcaaaacaggaaaggttttaatcaatattctgtactagaaacatagcccttatgtgtagttagcgtagaagtagcttctctaaattcaaatatatggctataggttt

SEQ ID NO: 105978 - DNA, 601 bp, Human
gaaaaaataattcctgagacagcaaatgttacaaagggagtaatttacaaaatatcaaggtaatagcaatcactgtaactgaacctttcttataactacacgaatttatcaatagatactctctagtatcaaatattaaaacttcagttcacaataaaaaaaaggctatcataagctgaacttcaaattttaagtgtacttcaagattttgtgattttaaagcaaaaccttagaagaaaacacaatttataaatgaaataatttccatatcagaatatgtttgccactttttttttagggktttttttttttcattatttccctagttgacagaccaccttcttaatcctacatgtcaagcactgagctaagtattaaggatactaaaatagactgtcaaggaaaacctagcttaaaaaggaaaaatattagccaggcacagtagcacgaacctctagtcccagctacgctggaggctgaggcaggagaattgcttaagcctaggagtttgagtctagcctgggcaaaaagcaagaccttagcacttaaaaaaaaaaaaaaaaaaaaaggaaagaaaacattacattcaaatactaatttt

SEQ ID NO: 105979 - DNA, 601 bp, Human
aaaaggctggttggttggttgaattgtatcctcaaagattacagaattaggtaatgaaagcttaaaaaaccaaattatcaaatctgttactgaaatcaaaataaaatccaaagagcaatatactttaccaggagaatgtctatcttatgtgtcactattatacatcattttttcttggggaaaaaaaaaatgcaatgaataagaataaaaattcttcatagaaaaatcattaggtttcaaaatgccaaaaatatctcattcaattcattctgaaaagtccatctgacattagaaaaaatawttcctgagacagcaaatgttacaaagggagtaatttacaaaatatcaaggtaatagcaatcactgtaactgaacctttcttataactacacgaatttatcaatagatactctctagtatcaaatattaaaacttcagttcacaataaaaaaaaggctatcataagctgaacttcaaattttaagtgtacttcaagattttgtgattttaaagcaaaaccttagaagaaaacacaatttataaatgaaataatttccatatcagaatatgtttgccactttttttttaggggttttttttt

SEQ ID NO: 105980 - DNA, 601 bp, Human
aatcacaaggaaataattaaaatgattctatggtaacatgttgtcattaaaaacaaaaaatagctatcctttgagaatgagaacctcttacatggcagatattttgagtaaatgcttttaatttatttaattctaagcctaaagataggcagttcaatctccattatactaatgagagcctgtccacctacctaattttacacaacaagtaactatcttactccaaaattcatcaacttcattttttgtgtaatgggaaaataatgaatgcataaggtgttcagtagcataaggcttgctaccttggtgtggccaaagaacaccagttacttactctgtattctaaggttttgtacatgggatatggagatttttattggtgctttgcctccttctcctatcttgtctatggttttaagtgttgatgcacacatttcaggactatttctttatcttctctgtcgtttaggaatacacctgacagaaatgggtgccacttttgacttacagtttacaccttaatcagaattacctgggaagattttttaaatgtagattcatcagtcctgtcatagattcattaaagttcccttcgtgattc

SEQ ID NO: 105981 - DNA, 601 bp, Human
aaaatagagtgctgatagaaggtatctaacccagatccgggatcaagaaagatttccggagtgatatctaatagagataagcaaatgtgggatagaactccttcaggcaaagggtagtaaatctcaagatctgaagatgaaggaaagcatatcacatctgaggtatcaaggtatccttccaagaatatgaaggatagaatatttgagaggtgagacagaacgggcagagggagcaaagacgaaaacacgaagaatgctgtaaaccaccttaaatatattttggacttgtcctaaagaaaasagaaaactgtatgaatagatttgtgttttgaaaactagttctaactgcaggataaagagcagactagaggcagataaattaattaggatctactatagtgattcaactggttgatactggtagcctgaactagtgtggtagtaatgagaatgggagagaagtagatgaatctgagcaatatctagaactaaaattgacaacatacggtgaatggatgcgtaacatgggggtgaggcggggaaatatggaagacatatgtcaattcagaacatttgtggcaatgacttggaaaaactaggt

SEQ ID NO: 105982 - DNA, 601 bp, Human
aggaaaccacccccataatcctatcacttccctctctctaaacatggtgattacaattcgaaatgagatttgggtggggacacagagccaaaccatatcaccaccccagagggagttaccacttgggtactggggattgccagcagttaaatgccctttattctttattctgttcaataacaatcaaggaattgaaggaattctttcagctcgctaagctgccaggtattgctgtggtactctataggaaaagttaaggaaataagagaaagtataaatttgcttaggtgtagcatctctwttagttttctaatgcattgcctggaggcttgttaagaatagaatgtcaggcctttaaacaaatcccagtctctttaaacaaaatctgcagcttaacaagagcctcaggtgattcgtatgcacattaaagtctgaggagtactggtctttagggaccacagctgccaacctgacagccccaattagctccaggccgccactctccaaacatttaggctttacaaagaatgtgtgaaagcagctcaaaatctaaatatgaaatgacaatttctcaaattccagactaaaaagagagaggact

SEQ ID NO: 105983 - DNA, 601 bp, Human
aacacactggttcaaaagatagcttttttttttgtaccctgtccaaaagcaatgagatgctccttcccataaatcaaacaaccaaagctctgggagagctggcttcccttcttcacatgggaagctgttcataaagcctagttctcgtagagacttaccacctgtattagtccgttttcacactgctacaaagaactgcccagtttataatagctgggtaattataagtaagaggtttaattgactcacagttccacatggctgtggaggcctcaggaaacttacaatcatggaggaaggygaagcaggcaccttcttcaaaaggtggcaggagagtgtgagcatgtagagaactaccatttataaaaccatcagatctcgtgagaattcactatcacgagaacaacacggaggaaaccacccccataatcctatcacttccctctctctaaacatggtgattacaattcgaaatgagatttgggtggggacacagagccaaaccatatcaccaccccagagggagttaccacttgggtactggggattgccagcagttaaatgccctttattctttattctgttcaataacaatcaagga

SEQ ID NO: 105984 - DNA, 601 bp, Human
aaaataaattaatattccaactgtaagaaattctgtttttgtgtttgtttttttatttgtttgtttgtttttttgagacagagtctcgctgttgttgcccgggctggagtgcaatggcatgatctcagctcactgcaacctccacctcccacgttccagcaattctcctgcctcagccttccaagttgcttagattacacgaccacactcagctaatttttgtatttttagtagagacagggtttcaccatgttggccaggctggtcttgaactcctgaccccaggtgatccaccggcctyggcttcccaaagtactgggattacaggcgtgagccactgcacccagcccaaaaaatcctgtttcaattcattttgaaactcttacctgatctacttttaaaaaatgggagctttctactaaaaagcaggatatgtttttaaattgctgcaatttcaattttcttaaatatttttcagtgaatgtttgcagtgttttgtttgtttgttttgaggcagagtttcgctcttgttgcccaggctggagtgcaatggcacgatctcagctcactgcaacctccactgcccaggttcaagcgattc

SEQ ID NO: 105985 - DNA, 601 bp, Human
aagctttcccttacaagcctgaatcctcaataccagatcttcatcttccgtatctcagctcagcctctccaaatacagctgcctcatcaggtatttcagtttagatctggccagatgatcaggctattcccctatctagtctgggccacaaaagactcaagtgacattaagaaaaatcaaagaagatgagccaggcctggtagctcatgcctgtaattatctggaggctaagtggggaggattgctcgagcctaggagttcaaagccatcctgggctcacaaaaaaatggcgggggctggrggggtggggccaggtgggaatttcgatgcttaaattccttggtctcttctgtagtagatgtctaaaccatttgtaagccgatagaaggcaacggtacaatcagtattttaaatctaggccatgaaagaaaaagaagcaagccagtatctaccaagctaccaatgaatgaagtgttagatacacataatggaatactattcagccttaaaaaggaaattctgatacatgctgtaacatagatgcacctttgaagacattatgctagaggaaataagccattcacaagaggacaaatatgta

SEQ ID NO: 105986 - DNA, 601 bp, Human
cctgctgtatagcctggtagggtctgcagcccagggtttgagaacccctgagttaaatttccatatccataagataatgtagtgtgcaaccatttaaaacaatgaggttagatctataatgtattggctacttcacaattaaagtatatttaaagcatttcattttatgacacattttaagcaaattttgttagaattcttgcaatatctgctgagctgcaaaggaaggctacacgctacattgacactgtaccttgttatcaacaaaactgctagttattaaatttttggttttttattyccaatgggtgcatgctcaaatattggaccttcagactcatctgtatattgccaaaggactgtacatgaggattcatattccatataaacatctcagtatattgggcaaaacttactaaaatacatcaaaggatctttgatctactaaaccaggagttggcaaatgttttctctgtaaaaacagatagtaaatattataggctttgtggaccataggtctctgttgttgtagaccaaaatctatcggtcacagacaatatatgaacaggtgtggctgtgttccagtaaaactttccttact

SEQ ID NO: 105987 - DNA, 601 bp, Human
tcagttgtttagaagggaaaatattccttcagtacaaatgtgcttattatgtggtttctcttctttgtaattgaaattttagatttgtttaaattgccaaaatcccgtatcattgggttttgctttattttaaaaggacccaaagttcttgatctcatttcaggaggacagaacaagacttttataagaaagacagaaaacaaaatgtctacataaaacaagttaattttgtctcaactttgacatttactgaaaaatgctcttgtgcagcgtcttttaaagaatgataatcatatgcctytctcattacatagtttgcatcaaattatatgcctaacaattacaaccatgaagtattcatttacatacctctcttcagtgttcaaaacacgttactgttgagccagtcacctaagtggaagatttaaataggacactagaaggtaaacattccatttctctctacctcagttgttttcctattccctttatcaaataattggtaaagagtgctgtgcttcagaaagttttaaataaacaaaaactttcgtcaatgattcttttttaaaaaaatctgtgagcaaagatagaaagcttcctg

SEQ ID NO: 105988 - DNA, 601 bp, Human
tacctacttagaggtcatatctgcaaatctccaaatacagttcatattgggggctagggtttcaacatatgaatttgagagagacaaaacttagtccattaacaacataatagctgatcttattggaaccaaaaataaaacacttggaacctggaatgcaaaacatcgtttctgttaacagcaagctactgttgaggtaacagtaaagtcatttctacattaggattaacaactcaaagaaaaaacaaaaccataccagctcttcatttgagactaaaattaattactataataggaattyttttaaattgtttaaggcttaagacagtgtccttatttttggttcctgctatattcttatataccaatcaattcacatttcgtattacaaaggcaaatcttgctttcaggcaatttttgcaccctattttctatactatgtaacaagaaccaccatttatcttttactcactagtaccttcaatgtgtgtggcatatagtagctacttaataaatatcagagggaggaaagaaaagaaggtagggaggaaggaggaaactaagttagatatttaccaatttatatagtacccttaacttt

SEQ ID NO: 105989 - DNA, 508 bp, Human
tttgggaggccaaggcaggcagatcccttgagctcaggagtttgagaccagcccaggcaacatgacaaaactctgtctctataaaaaataccaaaattagccgggtatggtggtgtgcgcctgtagtcccagccacttgggaggctgaggtaggaggatcacttgggccctggaagtccaggatgaggctgcagtgagccgtgatcaygccactgcactccagcctgggtgccagagcaagaccctgtctttaaaaaataaaaataaaaatctgaatacacatatccctggcatgtaaaagagaaaggacttaggagaagactgattagttgggaacacagggatacatattaaagaaactatgtcctataatagtttgatgcgtaaggatcttggatgagagcttgtgagttatgtgtctgtgtatctgagagtttgaagttaagggaaataactaaattgtatattctgttacattggcggtggttacatactaaagaaaatgaac

SEQ ID NO: 105990 - DNA, 601 bp, Human
aagaagtctcaaatcaatgatcaaggctttcatcttaaaaagctataaaaagggcaaattaaacccaaaataaatggaagaaaatgaaaataagagcaaaatacaataaaacaaaatagaaaaaataatgaaaccaaaagtgggttcttagaagtaatagataaaattagtaaacctcttggcagtctgaacaaaaaagacagaaaatcactattataagtaaaaataaatgatattctatgatattaaaagattaagaaaaattatgaaaaactttgtgccactaatatatatatatatwttttttttgagacagtctcagtcacccaggctggagtgcagtggtgtaatctcggctcactgcaacctctgcctcccgggttcaagcaattctcatgcctcagcctcccaaatagctggaactacaggtgagcaccactgcacttggctaatttttgtatttttagtataagagacggggtttcgtcatgttgcccaggctggtcttgaactcctggcctcaagcaatctatctgccttggcctcccaaagggctgggattacaggtgtgggccaccatgtgtggcttatgccagtaaat

SEQ ID NO: 105991 - DNA, 601 bp, Human
tgatactgtagctactgttattgctgagtctaaactgttcttgactctaactaacccaggagactagtatcttttgccagcatacacaagctaacgtgttagccagcaagtggggtatgatctcaaagccattacagtttttgacaaaagtgaggactcgaaaggcatagagggaacataaataatagataacccaagaagtttagacttctcactccatagcttggaatgatgttacaatgctatacagttccttgggataaggaatgatcaaaattctttttgggaagaacctggaaayagcaatgcagagaacaggaacaagaccaaaagtgaaaagactagttaagtgactagttaaatgacataggcaattgtatcctatgaaaaatgatatatcataggtggaaacagagtcagtgaaagaaatctggtatgggacaccaaagtgttaagaaattagtccttattagaaaaaaaaaatctctctcaggactttcaaaaactttctcaaatcactagacaatatcttgtttaatgacaacataccagcaaaatttaaagtaaaatcagactcaagacattgatgtccactattaac

SEQ ID NO: 105992 - DNA, 601 bp, Human
cattcaataagtaaactacgtctaccttaaacaaggcattctgcagaaggtaacaaaggatgcattaaagaaatggaatttataatctagtaggaaagataatacatatatatagatagatagataacttagtgataaaggcccagtttctagctttatattctatgagcatataaaggaagagtatttttacctggagagttagaaaagactataaaaaatcttgtaatttaaagaatggctacaatttggaattgcagatatataaaaaaagagaattacacatgtaacagcatattgraaaagcttacaagagaaggctgctaaaaaacagaagcaacactagaaattatctaactctacactttctacataagaaaaacaaaatagaaacaaatctctatccattatacacatcatgggctgggttatccgttccttgcaactgaatacattcctaaccaatacactgccctaaaggtttctgcatgagaactcacaccccctccagacaaaaacaaataaacaaacaaaaacaaaaacaaaaaaaaccacacacctctttgtagagacactaaggaactgatcacagcaaagtata

SEQ ID NO: 105993 - DNA, 601 bp, Human
tcagcaggagcaaacagaggccctacagaacagcctatcaaaggatgcacaagccggaaaagggtgaagagagtgttcatgcttacggtgagcccaacatgtgatgtcagaacccacttatggtaaggaaggcataagtaggaggaaaggaggcaatgggagatatattactacatacaactcaagaggcataattgaaaaattgccattaaaatagatagtgacttcctggtatttttaaatactcacctgtagcagataggaactgcctggatctagtaagtttacagcttcattctgwatagtgttctgttgtgtaattgcatcttctcgtttccgctctttctgccctgcttcatcatcttcgtactcatctaagcactgaaagaaaaaaagagtttccattttatttctactattaatagactgtttcgataatatgtgaaaatatattgatagtattaaagaaatatttgtgcattcagaaattagtttgcataataaaagtatttttctttcagcaatatgtacatttaattcctataaattatctgcttaaaacttgtacttccatatccacaccactgccaacaaatctttt

SEQ ID NO: 105994 - DNA, 601 bp, Human
acataaaatacaaaattagctgggtgaagtggcgtgtgcctgtagtcccagctactcgggaggctgaagtgggtggactgcttgaactcaagaggcagaggttgcagtgagctgagatcacactactatactccagcctgtgcaacagagcaagaccctgtctcaaaaaaaaaaaaaaaaaaaagtttttcccctggtagtttcacaaacggtatttgcattaacattttacaaagagcttcttttattaaattccctaatattaccctatatgaactaaactaaggcgtatgatgtctgwctacacatgcatgagaaaaaatgccagaatctccaaaataaagttctaaaacatcacacatcatttctctcacatctgtctcattttggttatatttgaaatatctcagaacatgccacatcagcttgattgcccagattgccttttactgaaatgaagtcagcaaaattgctaaatgagagcaacccttactagatttactaatttgtgggttactggtatatcaactgaaattgtatgaataacttggcaacaaacactatttctgaggcttgaaatagactttttctgtaatatggt

SEQ ID NO: 105995 - DNA, 601 bp, Human
aactcttatctctacataaaatacaaaattagctgggtgaagtggcgtgtgcctgtagtcccagctactcgggaggctgaagtgggtggactgcttgaactcaagaggcagaggttgcagtgagctgagatcacactactatactccagcctgtgcaacagagcaagaccctgtctcaaaaaaaaaaaaaaaaaaaagtttttcccctggtagtttcacaaacggtatttgcattaacattttacaaagagcttcttttattaaattccctaatattaccctatatgaactaaactaaggygtatgatgtctgactacacatgcatgagaaaaaatgccagaatctccaaaataaagttctaaaacatcacacatcatttctctcacatctgtctcattttggttatatttgaaatatctcagaacatgccacatcagcttgattgcccagattgccttttactgaaatgaagtcagcaaaattgctaaatgagagcaacccttactagatttactaatttgtgggttactggtatatcaactgaaattgtatgaataacttggcaacaaacactatttctgaggcttgaaatagactttt

SEQ ID NO: 105996 - DNA, 601 bp, Human
acgaaagtcaattcaagttttaaaatacagcataattagactgagcacataacagactcaaggctaaaaatgtacattcttatttgtgagaaaaattaagtatttaattcataatttataagagcatacattcaaatgaatcttctgggtgtttgaacctcctaatgactttcagagttatttctagctatataaaatttatatatatatatttatataaatcttatagatatttatatataaatcttatagatatttatatataaaacttatagatatttatatataaatcttatacagkatatattatatatatttatatataatatataatttatataaaatatatataatttcttggaagttatttggtttactgaaaatattttctattttcagttatatatatataaaaaataagttattaggtttactgaaaatattttcttacatgtgatgccaaatttctatcttttactctattctcccttttcttcattcccattagtcagcagacaccttcactaagaaacatctattctctagtcattgctataacttgctgacagattaatgaaaataacaaactgttgatataaag

SEQ ID NO: 105997 - DNA, 601 bp, Human
gttgttgcagttagggaatatcatacatattcatttctggtatattaaatatagtgaattatcctaaagagatcaaatatatctggctgctcaaatttcaccacctgagagctagacaagtccagaaaacactctccaaatatagtttattatatacagtagaaacagctaaaattatacattcctcattatcatcttaacatgggtgtcctaaacagccaggcatagtaccctgcacctttgaactattcaatatttgacatataatgtgtgtatatacagatacattcttttttttttaaaaaaaaagccttcaactaagcaatatgaaaaatttctgtgtagtaagaataggggtcacacaaaaacttgtacatgaatgttcacagcgtattgcctattatatgtataatatttcatataggcaaaaagtgtaaagaatctaacattatgttactccaaatggtaaaacataatatagtatatcctgcaaacttcaatatggaatcatcttgaaaaaattatgcttagcaaatgacgagacacaaaaagccacatgcttggccaggtgcagtggctcacgcctgtaatcccagcactt

SEQ ID NO: 105998 - DNA, 601 bp, Human
agttgttgcagttagggaatatcatacatattcatttctggtatattaaatatagtgaattatcctaaagagatcaaatatatctggctgctcaaatttcaccacctgagagctagacaagtccagaaaacactctccaaatatagtttattatatacagtagaaacagctaaaattatacattcctcattatcatcttaacatgggtgtcctaaacagccaggcatagtaccctgcacctttgaactattcaatatttgacatataatgtgtgtatatacagatacattctttttttttwaaaaaaaaagccttcaactaagcaatatgaaaaatttctgtgtagtaagaataggggtcacacaaaaacttgtacatgaatgttcacagcgtattgcctattatatgtataatatttcatataggcaaaaagtgtaaagaatctaacattatgttactccaaatggtaaaacataatatagtatatcctgcaaacttcaatatggaatcatcttgaaaaaattatgcttagcaaatgacgagacacaaaaagccacatgcttggccaggtgcagtggctcacgcctgtaatcccagcact

SEQ ID NO: 105999 - DNA, 601 bp, Human
tctctcttcctttaaatacaaacatacacataagcacatacaccaacaactaaaaatcaaaatcaactcccattatattaaactctcataactctttattaaaattgatacatatttattatagaaaatacaaatgagtgtcaccagtaattccactaacccagagataatgtccattaacattttataacatattagtaaatgtttagccttctggatcagattccttttaaaaatcttatgaaaaatatatatctcctcccagaaaaataaacattatcttcttttacaaagaattctrgcagtttatcacatgaatagttctcagataatattttatatatactttttgtatcatacttttttgtaatatgttctctcctccattttacataaacaggtaataattttcttatgtaattatttttctatagcatcattttaatggctgcattataactgtttatagcaatatattatagtttttaatctatctcgttaaaaatttaagttgttgcagttagggaatatcatacatattcatttctggtatattaaatatagtgaattatcctaaagagatcaaatatatctggctgct

SEQ ID NO: 106000 - DNA, 601 bp, Human
tatctctcttcctttaaatacaaacatacacataagcacatacaccaacaactaaaaatcaaaatcaactcccattatattaaactctcataactctttattaaaattgatacatatttattatagaaaatacaaatgagtgtcaccagtaattccactaacccagagataatgtccattaacattttataacatattagtaaatgtttagccttctggatcagattccttttaaaaatcttatgaaaaatatatatctcctcccagaaaaataaacattatcttcttttacaaagaattytggcagtttatcacatgaatagttctcagataatattttatatatactttttgtatcatacttttttgtaatatgttctctcctccattttacataaacaggtaataattttcttatgtaattatttttctatagcatcattttaatggctgcattataactgtttatagcaatatattatagtttttaatctatctcgttaaaaatttaagttgttgcagttagggaatatcatacatattcatttctggtatattaaatatagtgaattatcctaaagagatcaaatatatctggctg

SEQ ID NO: 106001 - DNA, 601 bp, Human
tcaaatattcagaagtacaggatatattctgaaattcccaaataaccaacaactacttaactggcttccatccttttagtatctttcactgccccattctcttcaccctccaacactcccactcctcgtaacagctccttgctctgtgtagggtttatctctcttcctttaaatacaaacatacacataagcacatacaccaacaactaaaaatcaaaatcaactcccattatattaaactctcataactctttattaaaattgatacatatttattatagaaaatacaaatgagtgtcaycagtaattccactaacccagagataatgtccattaacattttataacatattagtaaatgtttagccttctggatcagattccttttaaaaatcttatgaaaaatatatatctcctcccagaaaaataaacattatcttcttttacaaagaattctggcagtttatcacatgaatagttctcagataatattttatatatactttttgtatcatacttttttgtaatatgttctctcctccattttacataaacaggtaataattttcttatgtaattatttttctatagcatcatttta

SEQ ID NO: 106002 - DNA, 601 bp, Human
tctattgagcttaaaaaaattaacattccccaaggacatatggttatagtagcaacttatttgtaactgtagaagttaatcattattcccacacaatgaaaaaaatgtaaaagtaccattaattctttcgaccaatatctactgaataggtgttaagtaacgaacactgttctggatactgaagacgtaacagcaaacacaaacatggactctgcccttcatagagcttttggttaaaagggaatataactaataataaagcaagatgatcagtaaaataaggtcagtgatggatactatgagaactacgataggacagatctcccagattatcttttttttttttttttttgagatggggtctcactcttgtcacccagactggagtgcagtggtgcaatcacagctcactgtggcttcggcttcctgggctcaagagatcctcccacctcagcttcctgagtagctgggactacacgtatgtggccaccacaccgggcaaattattttgtatttcttttttcagagacggggtttcaccatgttgcccaggctggtctcaaactcttgggctcaagcgatccacccacctcggcctccc

SEQ ID NO: 106003 - DNA, 601 bp, Human
tcttaggttttcttgtctttctcttactacttcctggtagatacaattaaaaaccagtaattaggaagtaattgtttatttataatcttcctaagtggcatatatctccccaatttggtaaaatatcttacatacatgaagatttccaatgaatcccttaagacatttggtgaaggaacaaagatcccaccacaaaaggaatcagagaatgcacaggagatattaggatgctcctgagtaaagctatgtttatacaagtctttaacaaaactaatgtaatagactcaatgatttaacctcgtgtgtgtgtgtgtgtgtgtgtgtgtgtatgtatgtatggcagtgtttcactcttgtcacccaggctggagtgcaatggcaccttggctcactgcaacctccacctcctgggttcaagcgattctcctgcctcagcctcccaagtagctggaattacaggtgcatgccaccatgcctgggtaattttcatatttttagtacagatggggctttgccatgttgcccaggctggtctcgaactcctgacctcaagtgatctgcccgcctcagcctaccaaagtgctgggattacaagcgtgag

SEQ ID NO: 106004 - DNA, 601 bp, Human
tgtcacgcaagagaaaaattttaggtagttttcgtcccttcacatcaatccacacaaccagtacactcaccagagacaaccactctgttttcagaccgcctggatggggggccatagcgacctcggggagctccgccacctccacccccgccgccgcctcggcctgttccacggccgcttcgaggaaactccacccgcagacggtacccatcgtaatcatagccgtcgcgaccatacaccgcgtcttccgcgtctctgcgggatcgcagaaagtaaaagggatgagaaacaccaggaggaraagctcgctcagttgggaaccagcaaaccccccgcacatgcgcacccaacgtggaagagcccacatgcgccgcataataggaatggcccctcccccacccagaaacacgccaggctcccaaccactacaccagccctcagcgcctcagtttcccgctccagcctgcgaatgggctccggggacgtccaaggcgaggcgccagagaagccacatcaactcagctccttactcgactcctgcatgggcgatacagtctcgccccaacctctctaagagcccccgcttccccgttctctatgt

SEQ ID NO: 106005 - DNA, 601 bp, Human
gctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtscacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttg

SEQ ID NO: 106006 - DNA, 601 bp, Human
acatgaaaactacgtgaaagttcgtggaggataatgtaaattttacactacattcaaaagaatctcttccttttccatctgtttctttcaaaataccctcccagatggctttcccatgaggcaatctggattaactcagcctcatatccttccttcaacagcactttgaggggttacattcagaatcgcttttgaggtggtaaaaattttagcacaactaaatattttacatctaaagaaaagggctcagcagtgtgtaaacagacctacgtttttctttctggccccatcactgggctamttaatttctctttgctctatttatccatctaggaaatgggataataataatgccttttcccttactcccaagaacattacaagagatgcataattatataaattccaggtagcattattacattctgacttatttttgactgttaagtttttcatttccagagatttatagtctcaaaaattctagaatcctgatttattccaaagtacttcctctttgacgtcaagtgttttcattgaatgttttttaaggcaggaattttttagctggaggaaattttctagtaattgctccatccta

SEQ ID NO: 106007 - DNA, 601 bp, Human
acctacgtttttctttctggccccatcactgggctaattaatttctctttgctctatttatccatctaggaaatgggataataataatgccttttcccttactcccaagaacattacaagagatgcataattatataaattccaggtagcattattacattctgacttatttttgactgttaagtttttcatttccagagatttatagtctcaaaaattctagaatcctgatttattccaaagtacttcctctttgacgtcaagtgttttcattgaatgttttttaaggcaggaatttttwagctggaggaaattttctagtaattgctccatcctactgttagggctaaagcattcagaatcatcttcctagcatttatgtcacacgtatacagaattacaaaggctctgtggtgaagtatcctcatactgcccaatgctgaagtctcctcagaacttcaagaatggcccttgttgaacctggggtacaaagcagcagagtttattctgaggagacaaattcagaattatgataaatctcagcacctgcatacgcacttgtgtttgtgtatacaagtacatgcatctagagagaaatgaa

SEQ ID NO: 106008 - DNA, 601 bp, Human
tcctttcatctgaacattcctgaagccccattccaacaggtaagccttcttgaccaaagagtggctgtttagccttcccaccctgccactagaccctaatgagatgtgtgcaactcttggctacagttttcatctccttattacttcaaggctcctcttgggagctacacaagctcaaaggtcctttgaccattaggtgacaaatgagaagcaattttttaaaaacatgtcaaggtaaaagctattgtctataacacacggccatgtctttttttctttttttttctttttatttgagacrgagtcttgctctgtcgcccaggctggagtgcagtggcaccatctcggctcactgcaagctctgcttcctgggttcacagcattctcctgccgcagcctcccaagtagctgggacttcaggtgcccgccaccacgcctggctaattttttgtatttttagtagagatggggtttcaccgtgttagccaggatggtctcgatctcctgacctcgtgatccgcctgcctaggcctcccaaagtgctgggattacaggcgtaagccaccatacctggccccatccatgtcttttaagttattaa

SEQ ID NO: 106009 - DNA, 601 bp, Human
gacaaatgagaagcaattttttaaaaacatgtcaaggtaaaagctattgtctataacacacggccatgtctttttttctttttttttctttttatttgagacggagtcttgctctgtcgcccaggctggagtgcagtggcaccatctcggctcactgcaagctctgcttcctgggttcacagcattctcctgccgcagcctcccaagtagctgggacttcaggtgcccgccaccacgcctggctaattttttgtatttttagtagagatggggtttcaccgtgttagccaggatggtctcratctcctgacctcgtgatccgcctgcctaggcctcccaaagtgctgggattacaggcgtaagccaccatacctggccccatccatgtcttttaagttattaaagatgatcgaagctcaggggtccctaccaactcctcagttacagaaacaggactctttggggatgtcggagccagctgcttattctccatgtcacctgtttctgttccctctttgcaccacagaagcaccctgtgttaagtctggccgaaccatgacacttaggagagctgagaatgggttttccaacctcattcctg

SEQ ID NO: 106010 - DNA, 601 bp, Human; identical to SEQ ID NO: 27706

SEQ ID NO: 106011 - DNA, 601 bp, Human; identical to SEQ ID NO: 27707

SEQ ID NO: 106012 - DNA, 601 bp, Human; identical to SEQ ID NO: 27708

SEQ ID NO: 106013 - DNA, 601 bp, Human
taacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaayagatcaaggagggagacactcacaagtcattttgttgcaccccttgcacacatcttggcacacatgtacataaagtgtgttttacatatcatactccttcaatcaactgccctgagctcgcctttcagattttgacatttaattctacagagacaatcttagaagaaacatgaagaacaagctgtagctccaaactacagaatttttacttcaggctagcacctacaaagtttgtaagggaagtaactaatgcactagtcgtctttgaagtaacattggaaagagatccggaagattgat

SEQ ID NO: 106014 - DNA, 601 bp, Human; identical to SEQ ID NO: 74660

SEQ ID NO: 106015 - DNA, 601 bp, Human; identical to SEQ ID NO: 74661

SEQ ID NO: 106016 - DNA, 601 bp, Human; identical to SEQ ID NO: 74662

SEQ ID NO: 106017 - DNA, 601 bp, Human; identical to SEQ ID NO: 74663

SEQ ID NO: 106018 - DNA, 601 bp, Human; identical to SEQ ID NO: 74664

SEQ ID NO: 106019 - DNA, 601 bp, Human; identical to SEQ ID NO: 74665

SEQ ID NO: 106020 - DNA, 601 bp, Human; identical to SEQ ID NO: 74666

SEQ ID NO: 106021 - DNA, 601 bp, Human; identical to SEQ ID NO: 74667

SEQ ID NO: 106022 - DNA, 601 bp, Human; identical to SEQ ID NO: 74668

SEQ ID NO: 106023 - DNA, 601 bp, Human; identical to SEQ ID NO: 74669

SEQ ID NO: 106024 - DNA, 601 bp, Human; identical to SEQ ID NO: 74670

SEQ ID NO: 106025 - DNA, 601 bp, Human; identical to SEQ ID NO: 74671

SEQ ID NO: 106026 - DNA, 601 bp, Human; identical to SEQ ID NO: 74672

SEQ ID NO: 106027 - DNA, 601 bp, Human; identical to SEQ ID NO: 74673

SEQ ID NO: 106028 - DNA, 601 bp, Human; identical to SEQ ID NO: 74674

SEQ ID NO: 106029 - DNA, 601 bp, Human; identical to SEQ ID NO: 74675

SEQ ID NO: 106030 - DNA, 601 bp, Human; identical to SEQ ID NO: 74676

SEQ ID NO: 106031 - DNA, 601 bp, Human; identical to SEQ ID NO: 74677

SEQ ID NO: 106032 - DNA, 601 bp, Human; identical to SEQ ID NO: 74678

SEQ ID NO: 106033 - DNA, 601 bp, Human; identical to SEQ ID NO: 74679

SEQ ID NO: 106034 - DNA, 601 bp, Human; identical to SEQ ID NO: 74680

SEQ ID NO: 106035 - DNA, 601 bp, Human; identical to SEQ ID NO: 74681

SEQ ID NO: 106036 - DNA, 601 bp, Human; identical to SEQ ID NO: 74682

SEQ ID NO: 106037 - DNA, 601 bp, Human; identical to SEQ ID NO: 74683

SEQ ID NO: 106038 - DNA, 601 bp, Human; identical to SEQ ID NO: 74684

SEQ ID NO: 106039 - DNA, 601 bp, Human; identical to SEQ ID NO: 74685

SEQ ID NO: 106040 - DNA, 601 bp, Human; identical to SEQ ID NO: 74686

SEQ ID NO: 106041 - DNA, 601 bp, Human; identical to SEQ ID NO: 74687

SEQ ID NO: 106042 - DNA, 601 bp, Human; identical to SEQ ID NO: 74688

SEQ ID NO: 106043 - DNA, 601 bp, Human; identical to SEQ ID NO: 74689

SEQ ID NO: 106044 - DNA, 601 bp, Human; identical to SEQ ID NO: 74690

SEQ ID NO: 106045 - DNA, 601 bp, Human; identical to SEQ ID NO: 74691

SEQ ID NO: 106046 - DNA, 601 bp, Human; identical to SEQ ID NO: 74692

SEQ ID NO: 106047 - DNA, 601 bp, Human; identical to SEQ ID NO: 74693

SEQ ID NO: 106048 - DNA, 601 bp, Human; identical to SEQ ID NO: 74694

SEQ ID NO: 106049 - DNA, 601 bp, Human; identical to SEQ ID NO: 74695

SEQ ID NO: 106050 - DNA, 601 bp, Human; identical to SEQ ID NO: 74696

SEQ ID NO: 106051 - DNA, 601 bp, Human; identical to SEQ ID NO: 74697

SEQ ID NO: 106052 - DNA, 601 bp, Human; identical to SEQ ID NO: 74698

SEQ ID NO: 106053 - DNA, 601 bp, Human; identical to SEQ ID NO: 74699

SEQ ID NO: 106054 - DNA, 601 bp, Human; identical to SEQ ID NO: 74700

SEQ ID NO: 106055 - DNA, 601 bp, Human; identical to SEQ ID NO: 74701

SEQ ID NO: 106056 - DNA, 601 bp, Human; identical to SEQ ID NO: 74702

SEQ ID NO: 106057 - DNA, 601 bp, Human; identical to SEQ ID NO: 74703

SEQ ID NO: 106058 - DNA, 601 bp, Human; identical to SEQ ID NO: 74704

SEQ ID NO: 106059 - DNA, 601 bp, Human; identical to SEQ ID NO: 74705

SEQ ID NO: 106060 - DNA, 601 bp, Human; identical to SEQ ID NO: 74706

SEQ ID NO: 106061 - DNA, 601 bp, Human; identical to SEQ ID NO: 74707

SEQ ID NO: 106062 - DNA, 601 bp, Human; identical to SEQ ID NO: 74708

SEQ ID NO: 106063 - DNA, 601 bp, Human; identical to SEQ ID NO: 74709

SEQ ID NO: 106064 - DNA, 601 bp, Human; identical to SEQ ID NO: 74710

SEQ ID NO: 106065 - DNA, 601 bp, Human; identical to SEQ ID NO: 74711

SEQ ID NO: 106066 - DNA, 601 bp, Human; identical to SEQ ID NO: 74712

SEQ ID NO: 106067 - DNA, 601 bp, Human; identical to SEQ ID NO: 74713

SEQ ID NO: 106068 - DNA, 601 bp, Human; identical to SEQ ID NO: 74714

SEQ ID NO: 106069 - DNA, 601 bp, Human; identical to SEQ ID NO: 74715

SEQ ID NO: 106070 - DNA, 601 bp, Human; identical to SEQ ID NO: 74716

SEQ ID NO: 106071 - DNA, 601 bp, Human; identical to SEQ ID NO: 74717

SEQ ID NO: 106072 - DNA, 601 bp, Human; identical to SEQ ID NO: 74718

SEQ ID NO: 106073 - DNA, 601 bp, Human; identical to SEQ ID NO: 74719

SEQ ID NO: 106074 - DNA, 601 bp, Human; identical to SEQ ID NO: 74720

SEQ ID NO: 106075 - DNA, 601 bp, Human; identical to SEQ ID NO: 74721

SEQ ID NO: 106076 - DNA, 601 bp, Human; identical to SEQ ID NO: 74722

SEQ ID NO: 106077 - DNA, 601 bp, Human; identical to SEQ ID NO: 74723

SEQ ID NO: 106078 - DNA, 601 bp, Human; identical to SEQ ID NO: 74724

SEQ ID NO: 106079 - DNA, 601 bp, Human; identical to SEQ ID NO: 74725

SEQ ID NO: 106080 - DNA, 601 bp, Human; identical to SEQ ID NO: 74726

SEQ ID NO: 106081 - DNA, 601 bp, Human; identical to SEQ ID NO: 74727

SEQ ID NO: 106082 - DNA, 601 bp, Human; identical to SEQ ID NO: 74728

SEQ ID NO: 106083 - DNA, 601 bp, Human; identical to SEQ ID NO: 74729

SEQ ID NO: 106084 - DNA, 601 bp, Human; identical to SEQ ID NO: 74730

SEQ ID NO: 106085 - DNA, 601 bp, Human; identical to SEQ ID NO: 74731

SEQ ID NO: 106086 - DNA, 601 bp, Human; identical to SEQ ID NO: 74732

SEQ ID NO: 106087 - DNA, 601 bp, Human; identical to SEQ ID NO: 74733

SEQ ID NO: 106088 - DNA, 601 bp, Human; identical to SEQ ID NO: 74734

SEQ ID NO: 106089 - DNA, 601 bp, Human; identical to SEQ ID NO: 74735

SEQ ID NO: 106090 - DNA, 601 bp, Human; identical to SEQ ID NO: 74736

SEQ ID NO: 106091 - DNA, 601 bp, Human; identical to SEQ ID NO: 74737

SEQ ID NO: 106092 - DNA, 601 bp, Human; identical to SEQ ID NO: 74738

SEQ ID NO: 106093 - DNA, 601 bp, Human; identical to SEQ ID NO: 74739

SEQ ID NO: 106094 - DNA, 601 bp, Human; identical to SEQ ID NO: 74740

SEQ ID NO: 106095 - DNA, 601 bp, Human; identical to SEQ ID NO: 74741

SEQ ID NO: 106096 - DNA, 601 bp, Human; identical to SEQ ID NO: 74742

SEQ ID NO: 106097 - DNA, 601 bp, Human; identical to SEQ ID NO: 74743

SEQ ID NO: 106098 - DNA, 601 bp, Human; identical to SEQ ID NO: 74744

SEQ ID NO: 106099 - DNA, 601 bp, Human; identical to SEQ ID NO: 74745

SEQ ID NO: 106100 - DNA, 601 bp, Human; identical to SEQ ID NO: 74746

SEQ ID NO: 106101 - DNA, 601 bp, Human; identical to SEQ ID NO: 74747

SEQ ID NO: 106102 - DNA, 601 bp, Human; identical to SEQ ID NO: 74748

SEQ ID NO: 106103 - DNA, 601 bp, Human; identical to SEQ ID NO: 74749

SEQ ID NO: 106104 - DNA, 601 bp, Human; identical to SEQ ID NO: 74750

SEQ ID NO: 106105 - DNA, 601 bp, Human; identical to SEQ ID NO: 74751

SEQ ID NO: 106106 - DNA, 601 bp, Human; identical to SEQ ID NO: 74752

SEQ ID NO: 106107 - DNA, 601 bp, Human; identical to SEQ ID NO: 74753

SEQ ID NO: 106108 - DNA, 601 bp, Human; identical to SEQ ID NO: 74754

SEQ ID NO: 106109 - DNA, 601 bp, Human; identical to SEQ ID NO: 74755

SEQ ID NO: 106110 - DNA, 601 bp, Human; identical to SEQ ID NO: 74756

SEQ ID NO: 106111 - DNA, 601 bp, Human; identical to SEQ ID NO: 74757

SEQ ID NO: 106112 - DNA, 601 bp, Human; identical to SEQ ID NO: 74758

SEQ ID NO: 106113 - DNA, 601 bp, Human; identical to SEQ ID NO: 74759

SEQ ID NO: 106114 - DNA, 601 bp, Human; identical to SEQ ID NO: 74760

SEQ ID NO: 106115 - DNA, 601 bp, Human; identical to SEQ ID NO: 74761

SEQ ID NO: 106116 - DNA, 601 bp, Human; identical to SEQ ID NO: 74762

SEQ ID NO: 106117 - DNA, 601 bp, Human; identical to SEQ ID NO: 74763

SEQ ID NO: 106118 - DNA, 601 bp, Human; identical to SEQ ID NO: 74764

SEQ ID NO: 106119 - DNA, 601 bp, Human; identical to SEQ ID NO: 74765

SEQ ID NO: 106120 - DNA, 601 bp, Human; identical to SEQ ID NO: 74766

SEQ ID NO: 106121 - DNA, 601 bp, Human; identical to SEQ ID NO: 74767

SEQ ID NO: 106122 - DNA, 601 bp, Human; identical to SEQ ID NO: 74768

SEQ ID NO: 106123 - DNA, 601 bp, Human; identical to SEQ ID NO: 74769

SEQ ID NO: 106124 - DNA, 601 bp, Human; identical to SEQ ID NO: 74770

SEQ ID NO: 106125 - DNA, 601 bp, Human; identical to SEQ ID NO: 74771

SEQ ID NO: 106126 - DNA, 601 bp, Human; identical to SEQ ID NO: 74772

SEQ ID NO: 106127 - DNA, 601 bp, Human; identical to SEQ ID NO: 74773

SEQ ID NO: 106128 - DNA, 601 bp, Human; identical to SEQ ID NO: 74774

SEQ ID NO: 106129 - DNA, 601 bp, Human; identical to SEQ ID NO: 74775

SEQ ID NO: 106130 - DNA, 601 bp, Human; identical to SEQ ID NO: 74776

SEQ ID NO: 106131 - DNA, 601 bp, Human; identical to SEQ ID NO: 74777

SEQ ID NO: 106132 - DNA, 601 bp, Human; identical to SEQ ID NO: 74778

SEQ ID NO: 106133 - DNA, 601 bp, Human; identical to SEQ ID NO: 74779

SEQ ID NO: 106134 - DNA, 601 bp, Human; identical to SEQ ID NO: 74780

SEQ ID NO: 106135 - DNA, 601 bp, Human; identical to SEQ ID NO: 74781

SEQ ID NO: 106136 - DNA, 601 bp, Human; identical to SEQ ID NO: 74782

SEQ ID NO: 106137 - DNA, 601 bp, Human; identical to SEQ ID NO: 74783

SEQ ID NO: 106138 - DNA, 601 bp, Human; identical to SEQ ID NO: 74784

SEQ ID NO: 106139 - DNA, 601 bp, Human; identical to SEQ ID NO: 74785

SEQ ID NO: 106140 - DNA, 601 bp, Human; identical to SEQ ID NO: 74786

SEQ ID NO: 106141 - DNA, 601 bp, Human; identical to SEQ ID NO: 74787

SEQ ID NO: 106142 - DNA, 601 bp, Human; identical to SEQ ID NO: 74788

SEQ ID NO: 106143 - DNA, 601 bp, Human; identical to SEQ ID NO: 74789

SEQ ID NO: 106144 - DNA, 601 bp, Human; identical to SEQ ID NO: 74790

SEQ ID NO: 106145 - DNA, 601 bp, Human; identical to SEQ ID NO: 74791

SEQ ID NO: 106146 - DNA, 601 bp, Human; identical to SEQ ID NO: 74792

SEQ ID NO: 106147 - DNA, 601 bp, Human; identical to SEQ ID NO: 74793

SEQ ID NO: 106148 - DNA, 601 bp, Human; identical to SEQ ID NO: 74794

SEQ ID NO: 106149 - DNA, 601 bp, Human; identical to SEQ ID NO: 74795

SEQ ID NO: 106150 - DNA, 601 bp, Human; identical to SEQ ID NO: 74796

SEQ ID NO: 106151 - DNA, 601 bp, Human; identical to SEQ ID NO: 74797

SEQ ID NO: 106152 - DNA, 601 bp, Human; identical to SEQ ID NO: 74798

SEQ ID NO: 106153 - DNA, 601 bp, Human; identical to SEQ ID NO: 74799

SEQ ID NO: 106154 - DNA, 601 bp, Human; identical to SEQ ID NO: 74800

SEQ ID NO: 106155 - DNA, 601 bp, Human; identical to SEQ ID NO: 74801

SEQ ID NO: 106156 - DNA, 601 bp, Human; identical to SEQ ID NO: 74802

SEQ ID NO: 106157 - DNA, 601 bp, Human; identical to SEQ ID NO: 74803

SEQ ID NO: 106158 - DNA, 601 bp, Human; identical to SEQ ID NO: 74804

SEQ ID NO: 106159 - DNA, 601 bp, Human; identical to SEQ ID NO: 74805

SEQ ID NO: 106160 - DNA, 601 bp, Human; identical to SEQ ID NO: 74806

SEQ ID NO: 106161 - DNA, 601 bp, Human; identical to SEQ ID NO: 74807

SEQ ID NO: 106162 - DNA, 601 bp, Human; identical to SEQ ID NO: 74808

SEQ ID NO: 106163 - DNA, 601 bp, Human; identical to SEQ ID NO: 74809

SEQ ID NO: 106164 - DNA, 601 bp, Human; identical to SEQ ID NO: 74810

SEQ ID NO: 106165 - DNA, 601 bp, Human; identical to SEQ ID NO: 74811

SEQ ID NO: 106166 - DNA, 601 bp, Human; identical to SEQ ID NO: 74812

SEQ ID NO: 106167 - DNA, 601 bp, Human; identical to SEQ ID NO: 74813

SEQ ID NO: 106168 - DNA, 601 bp, Human; identical to SEQ ID NO: 74814

SEQ ID NO: 106169 - DNA, 601 bp, Human; identical to SEQ ID NO: 74815

SEQ ID NO: 106170 - DNA, 601 bp, Human; identical to SEQ ID NO: 74816

SEQ ID NO: 106171 - DNA, 601 bp, Human; identical to SEQ ID NO: 74817

SEQ ID NO: 106172 - DNA, 601 bp, Human; identical to SEQ ID NO: 74818

SEQ ID NO: 106173 - DNA, 601 bp, Human; identical to SEQ ID NO: 74819

SEQ ID NO: 106174 - DNA, 601 bp, Human; identical to SEQ ID NO: 74820

SEQ ID NO: 106175 - DNA, 601 bp, Human; identical to SEQ ID NO: 74821

SEQ ID NO: 106176 - DNA, 601 bp, Human; identical to SEQ ID NO: 74822

SEQ ID NO: 106177 - DNA, 601 bp, Human; identical to SEQ ID NO: 74823

SEQ ID NO: 106178 - DNA, 601 bp, Human; identical to SEQ ID NO: 74824

SEQ ID NO: 106179 - DNA, 601 bp, Human; identical to SEQ ID NO: 74825

SEQ ID NO: 106180 - DNA, 601 bp, Human; identical to SEQ ID NO: 74826

SEQ ID NO: 106181 - DNA, 601 bp, Human; identical to SEQ ID NO: 74827

SEQ ID NO: 106182 - DNA, 601 bp, Human; identical to SEQ ID NO: 74828

SEQ ID NO: 106183 - DNA, 601 bp, Human; identical to SEQ ID NO: 74829

SEQ ID NO: 106184 - DNA, 601 bp, Human; identical to SEQ ID NO: 74830

SEQ ID NO: 106185 - DNA, 601 bp, Human; identical to SEQ ID NO: 74831

SEQ ID NO: 106186 - DNA, 601 bp, Human; identical to SEQ ID NO: 74832

SEQ ID NO: 106187 - DNA, 601 bp, Human; identical to SEQ ID NO: 74833

SEQ ID NO: 106188 - DNA, 601 bp, Human; identical to SEQ ID NO: 74834

SEQ ID NO: 106189 - DNA, 601 bp, Human; identical to SEQ ID NO: 74835

SEQ ID NO: 106190 - DNA, 601 bp, Human; identical to SEQ ID NO: 74836

SEQ ID NO: 106191 - DNA, 601 bp, Human; identical to SEQ ID NO: 74837

SEQ ID NO: 106192 - DNA, 601 bp, Human; identical to SEQ ID NO: 74838

SEQ ID NO: 106193 - DNA, 601 bp, Human; identical to SEQ ID NO: 74839

SEQ ID NO: 106194 - DNA, 601 bp, Human; identical to SEQ ID NO: 74840

SEQ ID NO: 106195 - DNA, 601 bp, Human; identical to SEQ ID NO: 74841

SEQ ID NO: 106196 - DNA, 601 bp, Human; identical to SEQ ID NO: 74842

SEQ ID NO: 106197 - DNA, 601 bp, Human; identical to SEQ ID NO: 74843

SEQ ID NO: 106198 - DNA, 601 bp, Human; identical to SEQ ID NO: 74844

SEQ ID NO: 106199 - DNA, 601 bp, Human; identical to SEQ ID NO: 74845

SEQ ID NO: 106200 - DNA, 601 bp, Human; identical to SEQ ID NO: 74846

SEQ ID NO: 106201 - DNA, 601 bp, Human; identical to SEQ ID NO: 74847

SEQ ID NO: 106202 - DNA, 601 bp, Human; identical to SEQ ID NO: 74848

SEQ ID NO: 106203 - DNA, 601 bp, Human; identical to SEQ ID NO: 74849

SEQ ID NO: 106204 - DNA, 601 bp, Human; identical to SEQ ID NO: 74850

SEQ ID NO: 106205 - DNA, 601 bp, Human; identical to SEQ ID NO: 74851

SEQ ID NO: 106206 - DNA, 601 bp, Human; identical to SEQ ID NO: 74852

SEQ ID NO: 106207 - DNA, 601 bp, Human; identical to SEQ ID NO: 74853

SEQ ID NO: 106208 - DNA, 601 bp, Human; identical to SEQ ID NO: 74854

SEQ ID NO: 106209 - DNA, 601 bp, Human; identical to SEQ ID NO: 74855

SEQ ID NO: 106210 - DNA, 601 bp, Human; identical to SEQ ID NO: 74856

SEQ ID NO: 106211 - DNA, 601 bp, Human; identical to SEQ ID NO: 74857

SEQ ID NO: 106212 - DNA, 601 bp, Human; identical to SEQ ID NO: 74858

SEQ ID NO: 106213 - DNA, 601 bp, Human; identical to SEQ ID NO: 74660

SEQ ID NO: 106214 - DNA, 601 bp, Human; identical to SEQ ID NO: 74661

SEQ ID NO: 106215 - DNA, 601 bp, Human; identical to SEQ ID NO: 74662

SEQ ID NO: 106216 - DNA, 601 bp, Human; identical to SEQ ID NO: 74663

SEQ ID NO: 106217 - DNA, 601 bp, Human; identical to SEQ ID NO: 74664

SEQ ID NO: 106218 - DNA, 601 bp, Human; identical to SEQ ID NO: 74665

SEQ ID NO: 106219 - DNA, 601 bp, Human; identical to SEQ ID NO: 74666

SEQ ID NO: 106220 - DNA, 601 bp, Human; identical to SEQ ID NO: 74667

SEQ ID NO: 106221 - DNA, 601 bp, Human; identical to SEQ ID NO: 74668

SEQ ID NO: 106222 - DNA, 601 bp, Human; identical to SEQ ID NO: 74669

SEQ ID NO: 106223 - DNA, 601 bp, Human; identical to SEQ ID NO: 74670

SEQ ID NO: 106224 - DNA, 601 bp, Human; identical to SEQ ID NO: 74671

SEQ ID NO: 106225 - DNA, 601 bp, Human; identical to SEQ ID NO: 74672

SEQ ID NO: 106226 - DNA, 601 bp, Human; identical to SEQ ID NO: 74673

SEQ ID NO: 106227 - DNA, 601 bp, Human; identical to SEQ ID NO: 74674

SEQ ID NO: 106228 - DNA, 601 bp, Human; identical to SEQ ID NO: 74675

SEQ ID NO: 106229 - DNA, 601 bp, Human; identical to SEQ ID NO: 74676

SEQ ID NO: 106230 - DNA, 601 bp, Human; identical to SEQ ID NO: 74677

SEQ ID NO: 106231 - DNA, 601 bp, Human; identical to SEQ ID NO: 74678

SEQ ID NO: 106232 - DNA, 601 bp, Human; identical to SEQ ID NO: 74679

SEQ ID NO: 106233 - DNA, 601 bp, Human; identical to SEQ ID NO: 74680

SEQ ID NO: 106234 - DNA, 601 bp, Human; identical to SEQ ID NO: 74681

SEQ ID NO: 106235 - DNA, 601 bp, Human; identical to SEQ ID NO: 74682

SEQ ID NO: 106236 - DNA, 601 bp, Human; identical to SEQ ID NO: 74683

SEQ ID NO: 106237 - DNA, 601 bp, Human; identical to SEQ ID NO: 74684

SEQ ID NO: 106238 - DNA, 601 bp, Human; identical to SEQ ID NO: 74685

SEQ ID NO: 106239 - DNA, 601 bp, Human; identical to SEQ ID NO: 74686

SEQ ID NO: 106240 - DNA, 601 bp, Human; identical to SEQ ID NO: 74687

SEQ ID NO: 106241 - DNA, 601 bp, Human; identical to SEQ ID NO: 74688

SEQ ID NO: 106242 - DNA, 601 bp, Human; identical to SEQ ID NO: 74689

SEQ ID NO: 106243 - DNA, 601 bp, Human; identical to SEQ ID NO: 74690

SEQ ID NO: 106244 - DNA, 601 bp, Human; identical to SEQ ID NO: 74691

SEQ ID NO: 106245 - DNA, 601 bp, Human; identical to SEQ ID NO: 74692

SEQ ID NO: 106246 - DNA, 601 bp, Human; identical to SEQ ID NO: 74693

SEQ ID NO: 106247 - DNA, 601 bp, Human; identical to SEQ ID NO: 74694

SEQ ID NO: 106248 - DNA, 601 bp, Human; identical to SEQ ID NO: 74695

SEQ ID NO: 106249 - DNA, 601 bp, Human; identical to SEQ ID NO: 74696

SEQ ID NO: 106250 - DNA, 601 bp, Human; identical to SEQ ID NO: 74697

SEQ ID NO: 106251 - DNA, 601 bp, Human; identical to SEQ ID NO: 74698

SEQ ID NO: 106252 - DNA, 601 bp, Human; identical to SEQ ID NO: 74699

SEQ ID NO: 106253 - DNA, 601 bp, Human; identical to SEQ ID NO: 74700

SEQ ID NO: 106254 - DNA, 601 bp, Human; identical to SEQ ID NO: 74701

SEQ ID NO: 106255 - DNA, 601 bp, Human; identical to SEQ ID NO: 74702

SEQ ID NO: 106256 - DNA, 601 bp, Human; identical to SEQ ID NO: 74703

SEQ ID NO: 106257 - DNA, 601 bp, Human; identical to SEQ ID NO: 74704

SEQ ID NO: 106258 - DNA, 601 bp, Human; identical to SEQ ID NO: 74705

SEQ ID NO: 106259 - DNA, 601 bp, Human; identical to SEQ ID NO: 74706

SEQ ID NO: 106260 - DNA, 601 bp, Human; identical to SEQ ID NO: 74707

SEQ ID NO: 106261 - DNA, 601 bp, Human; identical to SEQ ID NO: 74708

SEQ ID NO: 106262 - DNA, 601 bp, Human; identical to SEQ ID NO: 74709

SEQ ID NO: 106263 - DNA, 601 bp, Human; identical to SEQ ID NO: 74710

SEQ ID NO: 106264 - DNA, 601 bp, Human; identical to SEQ ID NO: 74711

SEQ ID NO: 106265 - DNA, 601 bp, Human; identical to SEQ ID NO: 74712

SEQ ID NO: 106266 - DNA, 601 bp, Human; identical to SEQ ID NO: 74713

SEQ ID NO: 106267 - DNA, 601 bp, Human; identical to SEQ ID NO: 74714

SEQ ID NO: 106268 - DNA, 601 bp, Human; identical to SEQ ID NO: 74715

SEQ ID NO: 106269 - DNA, 601 bp, Human; identical to SEQ ID NO: 74716

SEQ ID NO: 106270 - DNA, 601 bp, Human; identical to SEQ ID NO: 74717

SEQ ID NO: 106271 - DNA, 601 bp, Human; identical to SEQ ID NO: 74718

SEQ ID NO: 106272 - DNA, 601 bp, Human; identical to SEQ ID NO: 74719

SEQ ID NO: 106273 - DNA, 601 bp, Human; identical to SEQ ID NO: 74720

SEQ ID NO: 106274 - DNA, 601 bp, Human; identical to SEQ ID NO: 74721

SEQ ID NO: 106275 - DNA, 601 bp, Human; identical to SEQ ID NO: 74722

SEQ ID NO: 106276 - DNA, 601 bp, Human; identical to SEQ ID NO: 74723

SEQ ID NO: 106277 - DNA, 601 bp, Human; identical to SEQ ID NO: 74724

SEQ ID NO: 106278 - DNA, 601 bp, Human; identical to SEQ ID NO: 74725

SEQ ID NO: 106279 - DNA, 601 bp, Human; identical to SEQ ID NO: 74726

SEQ ID NO: 106280 - DNA, 601 bp, Human; identical to SEQ ID NO: 74727

SEQ ID NO: 106281 - DNA, 601 bp, Human; identical to SEQ ID NO: 74728

SEQ ID NO: 106282 - DNA, 601 bp, Human; identical to SEQ ID NO: 74729

SEQ ID NO: 106283 - DNA, 601 bp, Human; identical to SEQ ID NO: 74730

SEQ ID NO: 106284 - DNA, 601 bp, Human; identical to SEQ ID NO: 74731

SEQ ID NO: 106285 - DNA, 601 bp, Human; identical to SEQ ID NO: 74732

SEQ ID NO: 106286 - DNA, 601 bp, Human; identical to SEQ ID NO: 74733

SEQ ID NO: 106287 - DNA, 601 bp, Human; identical to SEQ ID NO: 74734

SEQ ID NO: 106288 - DNA, 601 bp, Human; identical to SEQ ID NO: 74735

SEQ ID NO: 106289 - DNA, 601 bp, Human; identical to SEQ ID NO: 74736

SEQ ID NO: 106290 - DNA, 601 bp, Human; identical to SEQ ID NO: 74737

SEQ ID NO: 106291 - DNA, 601 bp, Human; identical to SEQ ID NO: 74738

SEQ ID NO: 106292 - DNA, 601 bp, Human; identical to SEQ ID NO: 74739

SEQ ID NO: 106293 - DNA, 601 bp, Human; identical to SEQ ID NO: 74740

SEQ ID NO: 106294 - DNA, 601 bp, Human; identical to SEQ ID NO: 74741

SEQ ID NO: 106295 - DNA, 601 bp, Human; identical to SEQ ID NO: 74742

SEQ ID NO: 106296 - DNA, 601 bp, Human; identical to SEQ ID NO: 74743

SEQ ID NO: 106297 - DNA, 601 bp, Human; identical to SEQ ID NO: 74744

SEQ ID NO: 106298 - DNA, 601 bp, Human; identical to SEQ ID NO: 74745

SEQ ID NO: 106299 - DNA, 601 bp, Human; identical to SEQ ID NO: 74746

SEQ ID NO: 106300 - DNA, 601 bp, Human; identical to SEQ ID NO: 74747

SEQ ID NO: 106301 - DNA, 601 bp, Human; identical to SEQ ID NO: 74748

SEQ ID NO: 106302 - DNA, 601 bp, Human; identical to SEQ ID NO: 74749

SEQ ID NO: 106303 - DNA, 601 bp, Human; identical to SEQ ID NO: 74750

SEQ ID NO: 106304 - DNA, 601 bp, Human; identical to SEQ ID NO: 74751

SEQ ID NO: 106305 - DNA, 601 bp, Human; identical to SEQ ID NO: 74752

SEQ ID NO: 106306 - DNA, 601 bp, Human; identical to SEQ ID NO: 74753

SEQ ID NO: 106307 - DNA, 601 bp, Human; identical to SEQ ID NO: 74754

SEQ ID NO: 106308 - DNA, 601 bp, Human; identical to SEQ ID NO: 74755

SEQ ID NO: 106309 - DNA, 601 bp, Human; identical to SEQ ID NO: 74756

SEQ ID NO: 106310 - DNA, 601 bp, Human; identical to SEQ ID NO: 74757

SEQ ID NO: 106311 - DNA, 601 bp, Human; identical to SEQ ID NO: 74758

SEQ ID NO: 106312 - DNA, 601 bp, Human; identical to SEQ ID NO: 74759

SEQ ID NO: 106313 - DNA, 601 bp, Human; identical to SEQ ID NO: 74760

SEQ ID NO: 106314 - DNA, 601 bp, Human; identical to SEQ ID NO: 74761

SEQ ID NO: 106315 - DNA, 601 bp, Human; identical to SEQ ID NO: 74762

SEQ ID NO: 106316 - DNA, 601 bp, Human; identical to SEQ ID NO: 74763

SEQ ID NO: 106317 - DNA, 601 bp, Human; identical to SEQ ID NO: 74764

SEQ ID NO: 106318 - DNA, 601 bp, Human; identical to SEQ ID NO: 74765

SEQ ID NO: 106319 - DNA, 601 bp, Human; identical to SEQ ID NO: 74766

SEQ ID NO: 106320 - DNA, 601 bp, Human; identical to SEQ ID NO: 74767

SEQ ID NO: 106321 - DNA, 601 bp, Human; identical to SEQ ID NO: 74768

SEQ ID NO: 106322 - DNA, 601 bp, Human; identical to SEQ ID NO: 74769

SEQ ID NO: 106323 - DNA, 601 bp, Human; identical to SEQ ID NO: 74770

SEQ ID NO: 106324 - DNA, 601 bp, Human; identical to SEQ ID NO: 74771

SEQ ID NO: 106325 - DNA, 601 bp, Human; identical to SEQ ID NO: 74772

SEQ ID NO: 106326 - DNA, 601 bp, Human; identical to SEQ ID NO: 74773

SEQ ID NO: 106327 - DNA, 601 bp, Human; identical to SEQ ID NO: 74774

SEQ ID NO: 106328 - DNA, 601 bp, Human; identical to SEQ ID NO: 74775

SEQ ID NO: 106329 - DNA, 601 bp, Human; identical to SEQ ID NO: 74776

SEQ ID NO: 106330 - DNA, 601 bp, Human; identical to SEQ ID NO: 74777

SEQ ID NO: 106331 - DNA, 601 bp, Human; identical to SEQ ID NO: 74778

SEQ ID NO: 106332 - DNA, 601 bp, Human; identical to SEQ ID NO: 74779

SEQ ID NO: 106333 - DNA, 601 bp, Human; identical to SEQ ID NO: 74780

SEQ ID NO: 106334 - DNA, 601 bp, Human; identical to SEQ ID NO: 74781

SEQ ID NO: 106335 - DNA, 601 bp, Human; identical to SEQ ID NO: 74782

SEQ ID NO: 106336 - DNA, 601 bp, Human; identical to SEQ ID NO: 74783

SEQ ID NO: 106337 - DNA, 601 bp, Human; identical to SEQ ID NO: 74784

SEQ ID NO: 106338 - DNA, 601 bp, Human; identical to SEQ ID NO: 74785

SEQ ID NO: 106339 - DNA, 601 bp, Human; identical to SEQ ID NO: 74786

SEQ ID NO: 106340 - DNA, 601 bp, Human; identical to SEQ ID NO: 74787

SEQ ID NO: 106341 - DNA, 601 bp, Human; identical to SEQ ID NO: 74788

SEQ ID NO: 106342 - DNA, 601 bp, Human; identical to SEQ ID NO: 74789

SEQ ID NO: 106343 - DNA, 601 bp, Human; identical to SEQ ID NO: 74790

SEQ ID NO: 106344 - DNA, 601 bp, Human; identical to SEQ ID NO: 74791

SEQ ID NO: 106345 - DNA, 601 bp, Human; identical to SEQ ID NO: 74792

SEQ ID NO: 106346 - DNA, 601 bp, Human; identical to SEQ ID NO: 74793

SEQ ID NO: 106347 - DNA, 601 bp, Human; identical to SEQ ID NO: 74794

SEQ ID NO: 106348 - DNA, 601 bp, Human; identical to SEQ ID NO: 74795

SEQ ID NO: 106349 - DNA, 601 bp, Human; identical to SEQ ID NO: 74796

SEQ ID NO: 106350 - DNA, 601 bp, Human; identical to SEQ ID NO: 74797

SEQ ID NO: 106351 - DNA, 601 bp, Human; identical to SEQ ID NO: 74798

SEQ ID NO: 106352 - DNA, 601 bp, Human; identical to SEQ ID NO: 74799

SEQ ID NO: 106353 - DNA, 601 bp, Human; identical to SEQ ID NO: 74800

SEQ ID NO: 106354 - DNA, 601 bp, Human; identical to SEQ ID NO: 74801

SEQ ID NO: 106355 - DNA, 601 bp, Human; identical to SEQ ID NO: 74802

SEQ ID NO: 106356 - DNA, 601 bp, Human; identical to SEQ ID NO: 74803

SEQ ID NO: 106357 - DNA, 601 bp, Human; identical to SEQ ID NO: 74804

SEQ ID NO: 106358 - DNA, 601 bp, Human; identical to SEQ ID NO: 74805

SEQ ID NO: 106359 - DNA, 601 bp, Human; identical to SEQ ID NO: 74806

SEQ ID NO: 106360 - DNA, 601 bp, Human; identical to SEQ ID NO: 74807

SEQ ID NO: 106361 - DNA, 601 bp, Human; identical to SEQ ID NO: 74808

SEQ ID NO: 106362 - DNA, 601 bp, Human; identical to SEQ ID NO: 74809

SEQ ID NO: 106363 - DNA, 601 bp, Human; identical to SEQ ID NO: 74810

SEQ ID NO: 106364 - DNA, 601 bp, Human; identical to SEQ ID NO: 74811

SEQ ID NO: 106365 - DNA, 601 bp, Human; identical to SEQ ID NO: 74812

SEQ ID NO: 106366 - DNA, 601 bp, Human; identical to SEQ ID NO: 74813

SEQ ID NO: 106367 - DNA, 601 bp, Human; identical to SEQ ID NO: 74814

SEQ ID NO: 106368 - DNA, 601 bp, Human; identical to SEQ ID NO: 74815

SEQ ID NO: 106369 - DNA, 601 bp, Human; identical to SEQ ID NO: 74816

SEQ ID NO: 106370 - DNA, 601 bp, Human; identical to SEQ ID NO: 74817

SEQ ID NO: 106371 - DNA, 601 bp, Human; identical to SEQ ID NO: 74818

SEQ ID NO: 106372 - DNA, 601 bp, Human; identical to SEQ ID NO: 74819

SEQ ID NO: 106373 - DNA, 601 bp, Human; identical to SEQ ID NO: 74820

SEQ ID NO: 106374 - DNA, 601 bp, Human; identical to SEQ ID NO: 74821

SEQ ID NO: 106375 - DNA, 601 bp, Human; identical to SEQ ID NO: 74822

SEQ ID NO: 106376 - DNA, 601 bp, Human; identical to SEQ ID NO: 74823

SEQ ID NO: 106377 - DNA, 601 bp, Human; identical to SEQ ID NO: 74824

SEQ ID NO: 106378 - DNA, 601 bp, Human; identical to SEQ ID NO: 74825

SEQ ID NO: 106379 - DNA, 601 bp, Human; identical to SEQ ID NO: 74826

SEQ ID NO: 106380 - DNA, 601 bp, Human; identical to SEQ ID NO: 74827

SEQ ID NO: 106381 - DNA, 601 bp, Human; identical to SEQ ID NO: 74828

SEQ ID NO: 106382 - DNA, 601 bp, Human; identical to SEQ ID NO: 74829

SEQ ID NO: 106383 - DNA, 601 bp, Human; identical to SEQ ID NO: 74830

SEQ ID NO: 106384 - DNA, 601 bp, Human; identical to SEQ ID NO: 74831

SEQ ID NO: 106385 - DNA, 601 bp, Human; identical to SEQ ID NO: 74832

SEQ ID NO: 106386 - DNA, 601 bp, Human; identical to SEQ ID NO: 74833

SEQ ID NO: 106387 - DNA, 601 bp, Human; identical to SEQ ID NO: 74834

SEQ ID NO: 106388 - DNA, 601 bp, Human; identical to SEQ ID NO: 74835

SEQ ID NO: 106389 - DNA, 601 bp, Human; identical to SEQ ID NO: 74836

SEQ ID NO: 106390 - DNA, 601 bp, Human; identical to SEQ ID NO: 74837

SEQ ID NO: 106391 - DNA, 601 bp, Human; identical to SEQ ID NO: 74838

SEQ ID NO: 106392 - DNA, 601 bp, Human; identical to SEQ ID NO: 74839

SEQ ID NO: 106393 - DNA, 601 bp, Human; identical to SEQ ID NO: 74840

SEQ ID NO: 106394 - DNA, 601 bp, Human; identical to SEQ ID NO: 74841

SEQ ID NO: 106395 - DNA, 601 bp, Human; identical to SEQ ID NO: 74842

SEQ ID NO: 106396 - DNA, 601 bp, Human; identical to SEQ ID NO: 74843

SEQ ID NO: 106397 - DNA, 601 bp, Human; identical to SEQ ID NO: 74844

SEQ ID NO: 106398 - DNA, 601 bp, Human; identical to SEQ ID NO: 74845

SEQ ID NO: 106399 - DNA, 601 bp, Human; identical to SEQ ID NO: 74846

SEQ ID NO: 106400 - DNA, 601 bp, Human; identical to SEQ ID NO: 74847

SEQ ID NO: 106401 - DNA, 601 bp, Human; identical to SEQ ID NO: 74848

SEQ ID NO: 106402 - DNA, 601 bp, Human; identical to SEQ ID NO: 74849

SEQ ID NO: 106403 - DNA, 601 bp, Human; identical to SEQ ID NO: 74850

SEQ ID NO: 106404 - DNA, 601 bp, Human; identical to SEQ ID NO: 74851

SEQ ID NO: 106405 - DNA, 601 bp, Human; identical to SEQ ID NO: 74852

SEQ ID NO: 106406 - DNA, 601 bp, Human; identical to SEQ ID NO: 74853

SEQ ID NO: 106407 - DNA, 601 bp, Human; identical to SEQ ID NO: 74854

SEQ ID NO: 106408 - DNA, 601 bp, Human; identical to SEQ ID NO: 74855

SEQ ID NO: 106409 - DNA, 601 bp, Human; identical to SEQ ID NO: 74856

SEQ ID NO: 106410 - DNA, 601 bp, Human; identical to SEQ ID NO: 74857

SEQ ID NO: 106411 - DNA, 601 bp, Human; identical to SEQ ID NO: 74858

SEQ ID NO: 106412 - DNA, 601 bp, Human; identical to SEQ ID NO: 74660

SEQ ID NO: 106413 - DNA, 601 bp, Human; identical to SEQ ID NO: 74661

SEQ ID NO: 106414 - DNA, 601 bp, Human; identical to SEQ ID NO: 74662

SEQ ID NO: 106415 - DNA, 601 bp, Human; identical to SEQ ID NO: 74663

SEQ ID NO: 106416 - DNA, 601 bp, Human; identical to SEQ ID NO: 74664

SEQ ID NO: 106417 - DNA, 601 bp, Human; identical to SEQ ID NO: 74665

SEQ ID NO: 106418 - DNA, 601 bp, Human; identical to SEQ ID NO: 74666

SEQ ID NO: 106419 - DNA, 601 bp, Human; identical to SEQ ID NO: 74667

SEQ ID NO: 106420 - DNA, 601 bp, Human; identical to SEQ ID NO: 74668

SEQ ID NO: 106421 - DNA, 601 bp, Human; identical to SEQ ID NO: 74669

SEQ ID NO: 106422 - DNA, 601 bp, Human; identical to SEQ ID NO: 74670

SEQ ID NO: 106423 - DNA, 601 bp, Human; identical to SEQ ID NO: 74671

SEQ ID NO: 106424 - DNA, 601 bp, Human; identical to SEQ ID NO: 74672

SEQ ID NO: 106425 - DNA, 601 bp, Human; identical to SEQ ID NO: 74673

SEQ ID NO: 106426 - DNA, 601 bp, Human; identical to SEQ ID NO: 74674

SEQ ID NO: 106427 - DNA, 601 bp, Human; identical to SEQ ID NO: 74675

SEQ ID NO: 106428 - DNA, 601 bp, Human; identical to SEQ ID NO: 74676

SEQ ID NO: 106429 - DNA, 601 bp, Human; identical to SEQ ID NO: 74677

SEQ ID NO: 106430 - DNA, 601 bp, Human; identical to SEQ ID NO: 74678

SEQ ID NO: 106431 - DNA, 601 bp, Human; identical to SEQ ID NO: 74679

SEQ ID NO: 106432 - DNA, 601 bp, Human; identical to SEQ ID NO: 74680

SEQ ID NO: 106433 - DNA, 601 bp, Human; identical to SEQ ID NO: 74681

SEQ ID NO: 106434 - DNA, 601 bp, Human; identical to SEQ ID NO: 74682

SEQ ID NO: 106435 - DNA, 601 bp, Human; identical to SEQ ID NO: 74683

SEQ ID NO: 106436 - DNA, 601 bp, Human; identical to SEQ ID NO: 74684

SEQ ID NO: 106437 - DNA, 601 bp, Human; identical to SEQ ID NO: 74685

SEQ ID NO: 106438 - DNA, 601 bp, Human; identical to SEQ ID NO: 74686

SEQ ID NO: 106439 - DNA, 601 bp, Human; identical to SEQ ID NO: 74687

SEQ ID NO: 106440 - DNA, 601 bp, Human; identical to SEQ ID NO: 74688

SEQ ID NO: 106441 - DNA, 601 bp, Human; identical to SEQ ID NO: 74689

SEQ ID NO: 106442 - DNA, 601 bp, Human; identical to SEQ ID NO: 74690

SEQ ID NO: 106443 - DNA, 601 bp, Human; identical to SEQ ID NO: 74691

SEQ ID NO: 106444 - DNA, 601 bp, Human; identical to SEQ ID NO: 74692

SEQ ID NO: 106445 - DNA, 601 bp, Human; identical to SEQ ID NO: 74693

SEQ ID NO: 106446 - DNA, 601 bp, Human; identical to SEQ ID NO: 74694

SEQ ID NO: 106447 - DNA, 601 bp, Human; identical to SEQ ID NO: 74695

SEQ ID NO: 106448 - DNA, 601 bp, Human; identical to SEQ ID NO: 74696

SEQ ID NO: 106449 - DNA, 601 bp, Human; identical to SEQ ID NO: 74697

SEQ ID NO: 106450 - DNA, 601 bp, Human; identical to SEQ ID NO: 74698

SEQ ID NO: 106451 - DNA, 601 bp, Human; identical to SEQ ID NO: 74699

SEQ ID NO: 106452 - DNA, 601 bp, Human; identical to SEQ ID NO: 74700

SEQ ID NO: 106453 - DNA, 601 bp, Human; identical to SEQ ID NO: 74701

SEQ ID NO: 106454 - DNA, 601 bp, Human; identical to SEQ ID NO: 74702

SEQ ID NO: 106455 - DNA, 601 bp, Human; identical to SEQ ID NO: 74703

SEQ ID NO: 106456 - DNA, 601 bp, Human; identical to SEQ ID NO: 74704

SEQ ID NO: 106457 - DNA, 601 bp, Human; identical to SEQ ID NO: 74705

SEQ ID NO: 106458 - DNA, 601 bp, Human; identical to SEQ ID NO: 74706

SEQ ID NO: 106459 - DNA, 601 bp, Human; identical to SEQ ID NO: 74707

SEQ ID NO: 106460 - DNA, 601 bp, Human; identical to SEQ ID NO: 74708

SEQ ID NO: 106461 - DNA, 601 bp, Human; identical to SEQ ID NO: 74709

SEQ ID NO: 106462 - DNA, 601 bp, Human; identical to SEQ ID NO: 74710

SEQ ID NO: 106463 - DNA, 601 bp, Human; identical to SEQ ID NO: 74711

SEQ ID NO: 106464 - DNA, 601 bp, Human; identical to SEQ ID NO: 74712

SEQ ID NO: 106465 - DNA, 601 bp, Human; identical to SEQ ID NO: 74713

SEQ ID NO: 106466 - DNA, 601 bp, Human; identical to SEQ ID NO: 74714

SEQ ID NO: 106467 - DNA, 601 bp, Human; identical to SEQ ID NO: 74715

SEQ ID NO: 106468 - DNA, 601 bp, Human; identical to SEQ ID NO: 74716

SEQ ID NO: 106469 - DNA, 601 bp, Human; identical to SEQ ID NO: 74717

SEQ ID NO: 106470 - DNA, 601 bp, Human; identical to SEQ ID NO: 74718

SEQ ID NO: 106471 - DNA, 601 bp, Human; identical to SEQ ID NO: 74719

SEQ ID NO: 106472 - DNA, 601 bp, Human; identical to SEQ ID NO: 74720

SEQ ID NO: 106473 - DNA, 601 bp, Human; identical to SEQ ID NO: 74721

SEQ ID NO: 106474 - DNA, 601 bp, Human; identical to SEQ ID NO: 74722

SEQ ID NO: 106475 - DNA, 601 bp, Human; identical to SEQ ID NO: 74723

SEQ ID NO: 106476 - DNA, 601 bp, Human; identical to SEQ ID NO: 74724

SEQ ID NO: 106477 - DNA, 601 bp, Human; identical to SEQ ID NO: 74725

SEQ ID NO: 106478 - DNA, 601 bp, Human; identical to SEQ ID NO: 74726

SEQ ID NO: 106479 - DNA, 601 bp, Human; identical to SEQ ID NO: 74727

SEQ ID NO: 106480 - DNA, 601 bp, Human; identical to SEQ ID NO: 74728

SEQ ID NO: 106481 - DNA, 601 bp, Human; identical to SEQ ID NO: 74729

SEQ ID NO: 106482 - DNA, 601 bp, Human; identical to SEQ ID NO: 74730

SEQ ID NO: 106483 - DNA, 601 bp, Human; identical to SEQ ID NO: 74731

SEQ ID NO: 106484 - DNA, 601 bp, Human; identical to SEQ ID NO: 74732

SEQ ID NO: 106485 - DNA, 601 bp, Human; identical to SEQ ID NO: 74733

SEQ ID NO: 106486 - DNA, 601 bp, Human; identical to SEQ ID NO: 74734

SEQ ID NO: 106487 - DNA, 601 bp, Human; identical to SEQ ID NO: 74735

SEQ ID NO: 106488 - DNA, 601 bp, Human; identical to SEQ ID NO: 74736

SEQ ID NO: 106489 - DNA, 601 bp, Human; identical to SEQ ID NO: 74737

SEQ ID NO: 106490 - DNA, 601 bp, Human; identical to SEQ ID NO: 74738

SEQ ID NO: 106491 - DNA, 601 bp, Human; identical to SEQ ID NO: 74739

SEQ ID NO: 106492 - DNA, 601 bp, Human; identical to SEQ ID NO: 74740

SEQ ID NO: 106493 - DNA, 601 bp, Human; identical to SEQ ID NO: 74741

SEQ ID NO: 106494 - DNA, 601 bp, Human; identical to SEQ ID NO: 74742

SEQ ID NO: 106495 - DNA, 601 bp, Human; identical to SEQ ID NO: 74743

SEQ ID NO: 106496 - DNA, 601 bp, Human; identical to SEQ ID NO: 74744

SEQ ID NO: 106497 - DNA, 601 bp, Human; identical to SEQ ID NO: 74745

SEQ ID NO: 106498 - DNA, 601 bp, Human; identical to SEQ ID NO: 74746

SEQ ID NO: 106499 - DNA, 601 bp, Human; identical to SEQ ID NO: 74747

SEQ ID NO: 106500 - DNA, 601 bp, Human; identical to SEQ ID NO: 74748

SEQ ID NO: 106501 - DNA, 601 bp, Human; identical to SEQ ID NO: 74749

SEQ ID NO: 106502 - DNA, 601 bp, Human; identical to SEQ ID NO: 74750

SEQ ID NO: 106503 - DNA, 601 bp, Human; identical to SEQ ID NO: 74751

SEQ ID NO: 106504 - DNA, 601 bp, Human; identical to SEQ ID NO: 74752

SEQ ID NO: 106505 - DNA, 601 bp, Human; identical to SEQ ID NO: 74753

SEQ ID NO: 106506 - DNA, 601 bp, Human; identical to SEQ ID NO: 74754

SEQ ID NO: 106507 - DNA, 601 bp, Human; identical to SEQ ID NO: 74755

SEQ ID NO: 106508 - DNA, 601 bp, Human; identical to SEQ ID NO: 74756

SEQ ID NO: 106509 - DNA, 601 bp, Human; identical to SEQ ID NO: 74757

SEQ ID NO: 106510 - DNA, 601 bp, Human; identical to SEQ ID NO: 74758

SEQ ID NO: 106511 - DNA, 601 bp, Human; identical to SEQ ID NO: 74759

SEQ ID NO: 106512 - DNA, 601 bp, Human; identical to SEQ ID NO: 74760

SEQ ID NO: 106513 - DNA, 601 bp, Human; identical to SEQ ID NO: 74761

SEQ ID NO: 106514 - DNA, 601 bp, Human; identical to SEQ ID NO: 74762

SEQ ID NO: 106515 - DNA, 601 bp, Human; identical to SEQ ID NO: 74763

SEQ ID NO: 106516 - DNA, 601 bp, Human; identical to SEQ ID NO: 74764

SEQ ID NO: 106517 - DNA, 601 bp, Human; identical to SEQ ID NO: 74765

SEQ ID NO: 106518 - DNA, 601 bp, Human; identical to SEQ ID NO: 74766

SEQ ID NO: 106519 - DNA, 601 bp, Human; identical to SEQ ID NO: 74767

SEQ ID NO: 106520 - DNA, 601 bp, Human; identical to SEQ ID NO: 74768

SEQ ID NO: 106521 - DNA, 601 bp, Human; identical to SEQ ID NO: 74769

SEQ ID NO: 106522 - DNA, 601 bp, Human; identical to SEQ ID NO: 74770

SEQ ID NO: 106523 - DNA, 601 bp, Human; identical to SEQ ID NO: 74771

SEQ ID NO: 106524 - DNA, 601 bp, Human; identical to SEQ ID NO: 74772

SEQ ID NO: 106525 - DNA, 601 bp, Human; identical to SEQ ID NO: 74773

SEQ ID NO: 106526 - DNA, 601 bp, Human; identical to SEQ ID NO: 74774

SEQ ID NO: 106527 - DNA, 601 bp, Human; identical to SEQ ID NO: 74775

SEQ ID NO: 106528 - DNA, 601 bp, Human; identical to SEQ ID NO: 74776

SEQ ID NO: 106529 - DNA, 601 bp, Human; identical to SEQ ID NO: 74777

SEQ ID NO: 106530 - DNA, 601 bp, Human; identical to SEQ ID NO: 74778

SEQ ID NO: 106531 - DNA, 601 bp, Human; identical to SEQ ID NO: 74779

SEQ ID NO: 106532 - DNA, 601 bp, Human; identical to SEQ ID NO: 74780

SEQ ID NO: 106533 - DNA, 601 bp, Human; identical to SEQ ID NO: 74781

SEQ ID NO: 106534 - DNA, 601 bp, Human; identical to SEQ ID NO: 74782

SEQ ID NO: 106535 - DNA, 601 bp, Human; identical to SEQ ID NO: 74783

SEQ ID NO: 106536 - DNA, 601 bp, Human; identical to SEQ ID NO: 74784

SEQ ID NO: 106537 - DNA, 601 bp, Human; identical to SEQ ID NO: 74785

SEQ ID NO: 106538 - DNA, 601 bp, Human; identical to SEQ ID NO: 74786

SEQ ID NO: 106539 - DNA, 601 bp, Human; identical to SEQ ID NO: 74787

SEQ ID NO: 106540 - DNA, 601 bp, Human; identical to SEQ ID NO: 74788

SEQ ID NO: 106541 - DNA, 601 bp, Human; identical to SEQ ID NO: 74789

SEQ ID NO: 106542 - DNA, 601 bp, Human; identical to SEQ ID NO: 74790

SEQ ID NO: 106543 - DNA, 601 bp, Human; identical to SEQ ID NO: 74791

SEQ ID NO: 106544 - DNA, 601 bp, Human; identical to SEQ ID NO: 74792

SEQ ID NO: 106545 - DNA, 601 bp, Human; identical to SEQ ID NO: 74793

SEQ ID NO: 106546 - DNA, 601 bp, Human; identical to SEQ ID NO: 74794

SEQ ID NO: 106547 - DNA, 601 bp, Human; identical to SEQ ID NO: 74795

SEQ ID NO: 106548 - DNA, 601 bp, Human; identical to SEQ ID NO: 74796

SEQ ID NO: 106549 - DNA, 601 bp, Human; identical to SEQ ID NO: 74797

SEQ ID NO: 106550 - DNA, 601 bp, Human; identical to SEQ ID NO: 74798

SEQ ID NO: 106551 - DNA, 601 bp, Human; identical to SEQ ID NO: 74799

SEQ ID NO: 106552 - DNA, 601 bp, Human; identical to SEQ ID NO: 74800

SEQ ID NO: 106553 - DNA, 601 bp, Human; identical to SEQ ID NO: 74801

SEQ ID NO: 106554 - DNA, 601 bp, Human; identical to SEQ ID NO: 74802

SEQ ID NO: 106555 - DNA, 601 bp, Human; identical to SEQ ID NO: 74803

SEQ ID NO: 106556 - DNA, 601 bp, Human; identical to SEQ ID NO: 74804

SEQ ID NO: 106557 - DNA, 601 bp, Human; identical to SEQ ID NO: 74805

SEQ ID NO: 106558 - DNA, 601 bp, Human; identical to SEQ ID NO: 74806

SEQ ID NO: 106559 - DNA, 601 bp, Human; identical to SEQ ID NO: 74807

SEQ ID NO: 106560 - DNA, 601 bp, Human; identical to SEQ ID NO: 74808

SEQ ID NO: 106561 - DNA, 601 bp, Human; identical to SEQ ID NO: 74809

SEQ ID NO: 106562 - DNA, 601 bp, Human; identical to SEQ ID NO: 74810

SEQ ID NO: 106563 - DNA, 601 bp, Human; identical to SEQ ID NO: 74811

SEQ ID NO: 106564 - DNA, 601 bp, Human; identical to SEQ ID NO: 74812

SEQ ID NO: 106565 - DNA, 601 bp, Human; identical to SEQ ID NO: 74813

SEQ ID NO: 106566 - DNA, 601 bp, Human; identical to SEQ ID NO: 74814

SEQ ID NO: 106567 - DNA, 601 bp, Human; identical to SEQ ID NO: 74815

SEQ ID NO: 106568 - DNA, 601 bp, Human; identical to SEQ ID NO: 74816

SEQ ID NO: 106569 - DNA, 601 bp, Human; identical to SEQ ID NO: 74817

SEQ ID NO: 106570 - DNA, 601 bp, Human; identical to SEQ ID NO: 74818

SEQ ID NO: 106571 - DNA, 601 bp, Human; identical to SEQ ID NO: 74819

SEQ ID NO: 106572 - DNA, 601 bp, Human; identical to SEQ ID NO: 74820

SEQ ID NO: 106573 - DNA, 601 bp, Human; identical to SEQ ID NO: 74821

SEQ ID NO: 106574 - DNA, 601 bp, Human; identical to SEQ ID NO: 74822

SEQ ID NO: 106575 - DNA, 601 bp, Human; identical to SEQ ID NO: 74823

SEQ ID NO: 106576 - DNA, 601 bp, Human; identical to SEQ ID NO: 74824

SEQ ID NO: 106577 - DNA, 601 bp, Human; identical to SEQ ID NO: 74825

SEQ ID NO: 106578 - DNA, 601 bp, Human; identical to SEQ ID NO: 74826

SEQ ID NO: 106579 - DNA, 601 bp, Human; identical to SEQ ID NO: 74827

SEQ ID NO: 106580 - DNA, 601 bp, Human; identical to SEQ ID NO: 74828

SEQ ID NO: 106581 - DNA, 601 bp, Human; identical to SEQ ID NO: 74829

SEQ ID NO: 106582 - DNA, 601 bp, Human; identical to SEQ ID NO: 74830

SEQ ID NO: 106583 - DNA, 601 bp, Human; identical to SEQ ID NO: 74831

SEQ ID NO: 106584 - DNA, 601 bp, Human; identical to SEQ ID NO: 74832

SEQ ID NO: 106585 - DNA, 601 bp, Human; identical to SEQ ID NO: 74833

SEQ ID NO: 106586 - DNA, 601 bp, Human; identical to SEQ ID NO: 74834

SEQ ID NO: 106587 - DNA, 601 bp, Human; identical to SEQ ID NO: 74835

SEQ ID NO: 106588 - DNA, 601 bp, Human; identical to SEQ ID NO: 74836

SEQ ID NO: 106589 - DNA, 601 bp, Human; identical to SEQ ID NO: 74837

SEQ ID NO: 106590 - DNA, 601 bp, Human; identical to SEQ ID NO: 74838

SEQ ID NO: 106591 - DNA, 601 bp, Human; identical to SEQ ID NO: 74839

SEQ ID NO: 106592 - DNA, 601 bp, Human; identical to SEQ ID NO: 74840

SEQ ID NO: 106593 - DNA, 601 bp, Human; identical to SEQ ID NO: 74841

SEQ ID NO: 106594 - DNA, 601 bp, Human; identical to SEQ ID NO: 74842

SEQ ID NO: 106595 - DNA, 601 bp, Human; identical to SEQ ID NO: 74843

SEQ ID NO: 106596 - DNA, 601 bp, Human; identical to SEQ ID NO: 74844

SEQ ID NO: 106597 - DNA, 601 bp, Human; identical to SEQ ID NO: 74845

SEQ ID NO: 106598 - DNA, 601 bp, Human; identical to SEQ ID NO: 74846

SEQ ID NO: 106599 - DNA, 601 bp, Human; identical to SEQ ID NO: 74847

SEQ ID NO: 106600 - DNA, 601 bp, Human; identical to SEQ ID NO: 74848

SEQ ID NO: 106601 - DNA, 601 bp, Human; identical to SEQ ID NO: 74849

SEQ ID NO: 106602 - DNA, 601 bp, Human; identical to SEQ ID NO: 74850

SEQ ID NO: 106603 - DNA, 601 bp, Human; identical to SEQ ID NO: 74851

SEQ ID NO: 106604 - DNA, 601 bp, Human; identical to SEQ ID NO: 74852

SEQ ID NO: 106605 - DNA, 601 bp, Human; identical to SEQ ID NO: 74853

SEQ ID NO: 106606 - DNA, 601 bp, Human; identical to SEQ ID NO: 74854

SEQ ID NO: 106607 - DNA, 601 bp, Human; identical to SEQ ID NO: 74855

SEQ ID NO: 106608 - DNA, 601 bp, Human; identical to SEQ ID NO: 74856

SEQ ID NO: 106609 - DNA, 601 bp, Human; identical to SEQ ID NO: 74857

SEQ ID NO: 106610 - DNA, 601 bp, Human; identical to SEQ ID NO: 74858

SEQ ID NO: 106611 - DNA, 601 bp, Human; identical to SEQ ID NO: 74660

SEQ ID NO: 106612 - DNA, 601 bp, Human; identical to SEQ ID NO: 74661

SEQ ID NO: 106613 - DNA, 601 bp, Human; identical to SEQ ID NO: 74662

SEQ ID NO: 106614 - DNA, 601 bp, Human; identical to SEQ ID NO: 74663

SEQ ID NO: 106615 - DNA, 601 bp, Human; identical to SEQ ID NO: 74664

SEQ ID NO: 106616 - DNA, 601 bp, Human; identical to SEQ ID NO: 74665

SEQ ID NO: 106617 - DNA, 601 bp, Human; identical to SEQ ID NO: 74666

SEQ ID NO: 106618 - DNA, 601 bp, Human; identical to SEQ ID NO: 74667

SEQ ID NO: 106619 - DNA, 601 bp, Human; identical to SEQ ID NO: 74668

SEQ ID NO: 106620 - DNA, 601 bp, Human; identical to SEQ ID NO: 74669

SEQ ID NO: 106621 - DNA, 601 bp, Human; identical to SEQ ID NO: 74670

SEQ ID NO: 106622 - DNA, 601 bp, Human; identical to SEQ ID NO: 74671

SEQ ID NO: 106623 - DNA, 601 bp, Human; identical to SEQ ID NO: 74672

SEQ ID NO: 106624 - DNA, 601 bp, Human; identical to SEQ ID NO: 74673

SEQ ID NO: 106625 - DNA, 601 bp, Human; identical to SEQ ID NO: 74674

SEQ ID NO: 106626 - DNA, 601 bp, Human; identical to SEQ ID NO: 74675

SEQ ID NO: 106627 - DNA, 601 bp, Human; identical to SEQ ID NO: 74676

SEQ ID NO: 106628 - DNA, 601 bp, Human; identical to SEQ ID NO: 74677

SEQ ID NO: 106629 - DNA, 601 bp, Human; identical to SEQ ID NO: 74678

SEQ ID NO: 106630 - DNA, 601 bp, Human; identical to SEQ ID NO: 74679

SEQ ID NO: 106631 - DNA, 601 bp, Human; identical to SEQ ID NO: 74680

SEQ ID NO: 106632 - DNA, 601 bp, Human; identical to SEQ ID NO: 74681

SEQ ID NO: 106633 - DNA, 601 bp, Human; identical to SEQ ID NO: 74682

SEQ ID NO: 106634 - DNA, 601 bp, Human; identical to SEQ ID NO: 74683

SEQ ID NO: 106635 - DNA, 601 bp, Human; identical to SEQ ID NO: 74684

SEQ ID NO: 106636 - DNA, 601 bp, Human; identical to SEQ ID NO: 74685

SEQ ID NO: 106637 - DNA, 601 bp, Human; identical to SEQ ID NO: 74686

SEQ ID NO: 106638 - DNA, 601 bp, Human; identical to SEQ ID NO: 74687

SEQ ID NO: 106639 - DNA, 601 bp, Human; identical to SEQ ID NO: 74688

SEQ ID NO: 106640 - DNA, 601 bp, Human; identical to SEQ ID NO: 74689

SEQ ID NO: 106641 - DNA, 601 bp, Human; identical to SEQ ID NO: 74690

SEQ ID NO: 106642 - DNA, 601 bp, Human; identical to SEQ ID NO: 74691

SEQ ID NO: 106643 - DNA, 601 bp, Human; identical to SEQ ID NO: 74692

SEQ ID NO: 106644 - DNA, 601 bp, Human; identical to SEQ ID NO: 74693

SEQ ID NO: 106645 - DNA, 601 bp, Human; identical to SEQ ID NO: 74694

SEQ ID NO: 106646 - DNA, 601 bp, Human; identical to SEQ ID NO: 74695

SEQ ID NO: 106647 - DNA, 601 bp, Human; identical to SEQ ID NO: 74696

SEQ ID NO: 106648 - DNA, 601 bp, Human; identical to SEQ ID NO: 74697

SEQ ID NO: 106649 - DNA, 601 bp, Human; identical to SEQ ID NO: 74698

SEQ ID NO: 106650 - DNA, 601 bp, Human; identical to SEQ ID NO: 74699

SEQ ID NO: 106651 - DNA, 601 bp, Human; identical to SEQ ID NO: 74700

SEQ ID NO: 106652 - DNA, 601 bp, Human; identical to SEQ ID NO: 74701

SEQ ID NO: 106653 - DNA, 601 bp, Human; identical to SEQ ID NO: 74702

SEQ ID NO: 106654 - DNA, 601 bp, Human; identical to SEQ ID NO: 74703

SEQ ID NO: 106655 - DNA, 601 bp, Human; identical to SEQ ID NO: 74704

SEQ ID NO: 106656 - DNA, 601 bp, Human; identical to SEQ ID NO: 74705

SEQ ID NO: 106657 - DNA, 601 bp, Human; identical to SEQ ID NO: 74706

SEQ ID NO: 106658 - DNA, 601 bp, Human; identical to SEQ ID NO: 74707

SEQ ID NO: 106659 - DNA, 601 bp, Human; identical to SEQ ID NO: 74708

SEQ ID NO: 106660 - DNA, 601 bp, Human; identical to SEQ ID NO: 74709

SEQ ID NO: 106661 - DNA, 601 bp, Human; identical to SEQ ID NO: 74710

SEQ ID NO: 106662 - DNA, 601 bp, Human; identical to SEQ ID NO: 74711

SEQ ID NO: 106663 - DNA, 601 bp, Human; identical to SEQ ID NO: 74712

SEQ ID NO: 106664 - DNA, 601 bp, Human; identical to SEQ ID NO: 74713

SEQ ID NO: 106665 - DNA, 601 bp, Human; identical to SEQ ID NO: 74714

SEQ ID NO: 106666 - DNA, 601 bp, Human; identical to SEQ ID NO: 74715

SEQ ID NO: 106667 - DNA, 601 bp, Human; identical to SEQ ID NO: 74716

SEQ ID NO: 106668 - DNA, 601 bp, Human; identical to SEQ ID NO: 74717

SEQ ID NO: 106669 - DNA, 601 bp, Human; identical to SEQ ID NO: 74718

SEQ ID NO: 106670 - DNA, 601 bp, Human; identical to SEQ ID NO: 74719

SEQ ID NO: 106671 - DNA, 601 bp, Human; identical to SEQ ID NO: 74720

SEQ ID NO: 106672 - DNA, 601 bp, Human; identical to SEQ ID NO: 74721

SEQ ID NO: 106673 - DNA, 601 bp, Human; identical to SEQ ID NO: 74722

SEQ ID NO: 106674 - DNA, 601 bp, Human; identical to SEQ ID NO: 74723

SEQ ID NO: 106675 - DNA, 601 bp, Human; identical to SEQ ID NO: 74724

SEQ ID NO: 106676 - DNA, 601 bp, Human; identical to SEQ ID NO: 74725

SEQ ID NO: 106677 - DNA, 601 bp, Human; identical to SEQ ID NO: 74726

SEQ ID NO: 106678 - DNA, 601 bp, Human; identical to SEQ ID NO: 74727

SEQ ID NO: 106679 - DNA, 601 bp, Human; identical to SEQ ID NO: 74728

SEQ ID NO: 106680 - DNA, 601 bp, Human; identical to SEQ ID NO: 74729

SEQ ID NO: 106681 - DNA, 601 bp, Human; identical to SEQ ID NO: 74730

SEQ ID NO: 106682 - DNA, 601 bp, Human; identical to SEQ ID NO: 74731

SEQ ID NO: 106683 - DNA, 601 bp, Human; identical to SEQ ID NO: 74732

SEQ ID NO: 106684 - DNA, 601 bp, Human; identical to SEQ ID NO: 74733

SEQ ID NO: 106685 - DNA, 601 bp, Human; identical to SEQ ID NO: 74734

SEQ ID NO: 106686 - DNA, 601 bp, Human; identical to SEQ ID NO: 74735

SEQ ID NO: 106687 - DNA, 601 bp, Human; identical to SEQ ID NO: 74736

SEQ ID NO: 106688 - DNA, 601 bp, Human; identical to SEQ ID NO: 74737

SEQ ID NO: 106689 - DNA, 601 bp, Human; identical to SEQ ID NO: 74738

SEQ ID NO: 106690 - DNA, 601 bp, Human; identical to SEQ ID NO: 74739

SEQ ID NO: 106691 - DNA, 601 bp, Human; identical to SEQ ID NO: 74740

SEQ ID NO: 106692 - DNA, 601 bp, Human; identical to SEQ ID NO: 74741

SEQ ID NO: 106693 - DNA, 601 bp, Human; identical to SEQ ID NO: 74742

SEQ ID NO: 106694 - DNA, 601 bp, Human; identical to SEQ ID NO: 74743

SEQ ID NO: 106695 - DNA, 601 bp, Human; identical to SEQ ID NO: 74744

SEQ ID NO: 106696 - DNA, 601 bp, Human; identical to SEQ ID NO: 74745

SEQ ID NO: 106697 - DNA, 601 bp, Human; identical to SEQ ID NO: 74746

SEQ ID NO: 106698 - DNA, 601 bp, Human; identical to SEQ ID NO: 74747

SEQ ID NO: 106699 - DNA, 601 bp, Human; identical to SEQ ID NO: 74748

SEQ ID NO: 106700 - DNA, 601 bp, Human; identical to SEQ ID NO: 74749

SEQ ID NO: 106701 - DNA, 601 bp, Human; identical to SEQ ID NO: 74750

SEQ ID NO: 106702 - DNA, 601 bp, Human; identical to SEQ ID NO: 74751

SEQ ID NO: 106703 - DNA, 601 bp, Human; identical to SEQ ID NO: 74752

SEQ ID NO: 106704 - DNA, 601 bp, Human; identical to SEQ ID NO: 74753

SEQ ID NO: 106705 - DNA, 601 bp, Human; identical to SEQ ID NO: 74754

SEQ ID NO: 106706 - DNA, 601 bp, Human; identical to SEQ ID NO: 74755

SEQ ID NO: 106707 - DNA, 601 bp, Human; identical to SEQ ID NO: 74756

SEQ ID NO: 106708 - DNA, 601 bp, Human; identical to SEQ ID NO: 74757

SEQ ID NO: 106709 - DNA, 601 bp, Human; identical to SEQ ID NO: 74758

SEQ ID NO: 106710 - DNA, 601 bp, Human; identical to SEQ ID NO: 74759

SEQ ID NO: 106711 - DNA, 601 bp, Human; identical to SEQ ID NO: 74760

SEQ ID NO: 106712 - DNA, 601 bp, Human; identical to SEQ ID NO: 74761

SEQ ID NO: 106713 - DNA, 601 bp, Human; identical to SEQ ID NO: 74762

SEQ ID NO: 106714 - DNA, 601 bp, Human; identical to SEQ ID NO: 74763

SEQ ID NO: 106715 - DNA, 601 bp, Human; identical to SEQ ID NO: 74764

SEQ ID NO: 106716 - DNA, 601 bp, Human; identical to SEQ ID NO: 74765

SEQ ID NO: 106717 - DNA, 601 bp, Human; identical to SEQ ID NO: 74766

SEQ ID NO: 106718 - DNA, 601 bp, Human; identical to SEQ ID NO: 74767

SEQ ID NO: 106719 - DNA, 601 bp, Human; identical to SEQ ID NO: 74768

SEQ ID NO: 106720 - DNA, 601 bp, Human; identical to SEQ ID NO: 74769

SEQ ID NO: 106721 - DNA, 601 bp, Human; identical to SEQ ID NO: 74770

SEQ ID NO: 106722 - DNA, 601 bp, Human; identical to SEQ ID NO: 74771

SEQ ID NO: 106723 - DNA, 601 bp, Human; identical to SEQ ID NO: 74772

SEQ ID NO: 106724 - DNA, 601 bp, Human; identical to SEQ ID NO: 74773

SEQ ID NO: 106725 - DNA, 601 bp, Human; identical to SEQ ID NO: 74774

SEQ ID NO: 106726 - DNA, 601 bp, Human; identical to SEQ ID NO: 74775

SEQ ID NO: 106727 - DNA, 601 bp, Human; identical to SEQ ID NO: 74776

SEQ ID NO: 106728 - DNA, 601 bp, Human; identical to SEQ ID NO: 74777

SEQ ID NO: 106729 - DNA, 601 bp, Human; identical to SEQ ID NO: 74778

SEQ ID NO: 106730 - DNA, 601 bp, Human; identical to SEQ ID NO: 74779

SEQ ID NO: 106731 - DNA, 601 bp, Human; identical to SEQ ID NO: 74780

SEQ ID NO: 106732 - DNA, 601 bp, Human; identical to SEQ ID NO: 74781

SEQ ID NO: 106733 - DNA, 601 bp, Human; identical to SEQ ID NO: 74782

SEQ ID NO: 106734 - DNA, 601 bp, Human; identical to SEQ ID NO: 74783

SEQ ID NO: 106735 - DNA, 601 bp, Human; identical to SEQ ID NO: 74784

SEQ ID NO: 106736 - DNA, 601 bp, Human; identical to SEQ ID NO: 74785

SEQ ID NO: 106737 - DNA, 601 bp, Human; identical to SEQ ID NO: 74786

SEQ ID NO: 106738 - DNA, 601 bp, Human; identical to SEQ ID NO: 74787

SEQ ID NO: 106739 - DNA, 601 bp, Human; identical to SEQ ID NO: 74788

SEQ ID NO: 106740 - DNA, 601 bp, Human; identical to SEQ ID NO: 74789

SEQ ID NO: 106741 - DNA, 601 bp, Human; identical to SEQ ID NO: 74790

SEQ ID NO: 106742 - DNA, 601 bp, Human; identical to SEQ ID NO: 74791

SEQ ID NO: 106743 - DNA, 601 bp, Human; identical to SEQ ID NO: 74792

SEQ ID NO: 106744 - DNA, 601 bp, Human; identical to SEQ ID NO: 74793

SEQ ID NO: 106745 - DNA, 601 bp, Human; identical to SEQ ID NO: 74794

SEQ ID NO: 106746 - DNA, 601 bp, Human; identical to SEQ ID NO: 74795

SEQ ID NO: 106747 - DNA, 601 bp, Human; identical to SEQ ID NO: 74796

SEQ ID NO: 106748 - DNA, 601 bp, Human; identical to SEQ ID NO: 74797

SEQ ID NO: 106749 - DNA, 601 bp, Human; identical to SEQ ID NO: 74798

SEQ ID NO: 106750 - DNA, 601 bp, Human; identical to SEQ ID NO: 74799

SEQ ID NO: 106751 - DNA, 601 bp, Human; identical to SEQ ID NO: 74800

SEQ ID NO: 106752 - DNA, 601 bp, Human; identical to SEQ ID NO: 74801

SEQ ID NO: 106753 - DNA, 601 bp, Human; identical to SEQ ID NO: 74802

SEQ ID NO: 106754 - DNA, 601 bp, Human; identical to SEQ ID NO: 74803

SEQ ID NO: 106755 - DNA, 601 bp, Human; identical to SEQ ID NO: 74804

SEQ ID NO: 106756 - DNA, 601 bp, Human; identical to SEQ ID NO: 74805

SEQ ID NO: 106757 - DNA, 601 bp, Human; identical to SEQ ID NO: 74806

SEQ ID NO: 106758 - DNA, 601 bp, Human; identical to SEQ ID NO: 74807

SEQ ID NO: 106759 - DNA, 601 bp, Human; identical to SEQ ID NO: 74808

SEQ ID NO: 106760 - DNA, 601 bp, Human; identical to SEQ ID NO: 74809

SEQ ID NO: 106761 - DNA, 601 bp, Human; identical to SEQ ID NO: 74810

SEQ ID NO: 106762 - DNA, 601 bp, Human; identical to SEQ ID NO: 74811

SEQ ID NO: 106763 - DNA, 601 bp, Human; identical to SEQ ID NO: 74812

SEQ ID NO: 106764 - DNA, 601 bp, Human; identical to SEQ ID NO: 74813

SEQ ID NO: 106765 - DNA, 601 bp, Human; identical to SEQ ID NO: 74814

SEQ ID NO: 106766 - DNA, 601 bp, Human; identical to SEQ ID NO: 74815

SEQ ID NO: 106767 - DNA, 601 bp, Human; identical to SEQ ID NO: 74816

SEQ ID NO: 106768 - DNA, 601 bp, Human; identical to SEQ ID NO: 74817

SEQ ID NO: 106769 - DNA, 601 bp, Human; identical to SEQ ID NO: 74818

SEQ ID NO: 106770 - DNA, 601 bp, Human; identical to SEQ ID NO: 74819

SEQ ID NO: 106771 - DNA, 601 bp, Human; identical to SEQ ID NO: 74820

SEQ ID NO: 106772 - DNA, 601 bp, Human; identical to SEQ ID NO: 74821

SEQ ID NO: 106773 - DNA, 601 bp, Human; identical to SEQ ID NO: 74822

SEQ ID NO: 106774 - DNA, 601 bp, Human; identical to SEQ ID NO: 74823

SEQ ID NO: 106775 - DNA, 601 bp, Human; identical to SEQ ID NO: 74824

SEQ ID NO: 106776 - DNA, 601 bp, Human; identical to SEQ ID NO: 74825

SEQ ID NO: 106777 - DNA, 601 bp, Human; identical to SEQ ID NO: 74826

SEQ ID NO: 106778 - DNA, 601 bp, Human; identical to SEQ ID NO: 74827

SEQ ID NO: 106779 - DNA, 601 bp, Human; identical to SEQ ID NO: 74828

SEQ ID NO: 106780 - DNA, 601 bp, Human; identical to SEQ ID NO: 74829

SEQ ID NO: 106781 - DNA, 601 bp, Human; identical to SEQ ID NO: 74830

SEQ ID NO: 106782 - DNA, 601 bp, Human; identical to SEQ ID NO: 74831

SEQ ID NO: 106783 - DNA, 601 bp, Human; identical to SEQ ID NO: 74832

SEQ ID NO: 106784 - DNA, 601 bp, Human; identical to SEQ ID NO: 74833

SEQ ID NO: 106785 - DNA, 601 bp, Human; identical to SEQ ID NO: 74834

SEQ ID NO: 106786 - DNA, 601 bp, Human; identical to SEQ ID NO: 74835

SEQ ID NO: 106787 - DNA, 601 bp, Human; identical to SEQ ID NO: 74836

SEQ ID NO: 106788 - DNA, 601 bp, Human; identical to SEQ ID NO: 74837

SEQ ID NO: 106789 - DNA, 601 bp, Human; identical to SEQ ID NO: 74838

SEQ ID NO: 106790 - DNA, 601 bp, Human; identical to SEQ ID NO: 74839

SEQ ID NO: 106791 - DNA, 601 bp, Human; identical to SEQ ID NO: 74840

SEQ ID NO: 106792 - DNA, 601 bp, Human; identical to SEQ ID NO: 74841

SEQ ID NO: 106793 - DNA, 601 bp, Human; identical to SEQ ID NO: 74842

SEQ ID NO: 106794 - DNA, 601 bp, Human; identical to SEQ ID NO: 74843

SEQ ID NO: 106795 - DNA, 601 bp, Human; identical to SEQ ID NO: 74844

SEQ ID NO: 106796 - DNA, 601 bp, Human; identical to SEQ ID NO: 74845

SEQ ID NO: 106797 - DNA, 601 bp, Human; identical to SEQ ID NO: 74846

SEQ ID NO: 106798 - DNA, 601 bp, Human; identical to SEQ ID NO: 74847

SEQ ID NO: 106799 - DNA, 601 bp, Human; identical to SEQ ID NO: 74848

SEQ ID NO: 106800 - DNA, 601 bp, Human; identical to SEQ ID NO: 74849

SEQ ID NO: 106801 - DNA, 601 bp, Human; identical to SEQ ID NO: 74850

SEQ ID NO: 106802 - DNA, 601 bp, Human; identical to SEQ ID NO: 74851

SEQ ID NO: 106803 - DNA, 601 bp, Human; identical to SEQ ID NO: 74852

SEQ ID NO: 106804 - DNA, 601 bp, Human; identical to SEQ ID NO: 74853

SEQ ID NO: 106805 - DNA, 601 bp, Human; identical to SEQ ID NO: 74854

SEQ ID NO: 106806 - DNA, 601 bp, Human; identical to SEQ ID NO: 74855

SEQ ID NO: 106807 - DNA, 601 bp, Human; identical to SEQ ID NO: 74856

SEQ ID NO: 106808 - DNA, 601 bp, Human; identical to SEQ ID NO: 74857

SEQ ID NO: 106809 - DNA, 601 bp, Human; identical to SEQ ID NO: 74858

SEQ ID NO: 106810 - DNA, 601 bp, Human; identical to SEQ ID NO: 74660

SEQ ID NO: 106811 - DNA, 601 bp, Human; identical to SEQ ID NO: 74661

SEQ ID NO: 106812 - DNA, 601 bp, Human; identical to SEQ ID NO: 74662

SEQ ID NO: 106813 - DNA, 601 bp, Human; identical to SEQ ID NO: 74663

SEQ ID NO: 106814 - DNA, 601 bp, Human; identical to SEQ ID NO: 74664

SEQ ID NO: 106815 - DNA, 601 bp, Human; identical to SEQ ID NO: 74665

SEQ ID NO: 106816 - DNA, 601 bp, Human; identical to SEQ ID NO: 74666

SEQ ID NO: 106817 - DNA, 601 bp, Human; identical to SEQ ID NO: 74667

SEQ ID NO: 106818 - DNA, 601 bp, Human; identical to SEQ ID NO: 74668

SEQ ID NO: 106819 - DNA, 601 bp, Human; identical to SEQ ID NO: 74669

SEQ ID NO: 106820 - DNA, 601 bp, Human; identical to SEQ ID NO: 74670

SEQ ID NO: 106821 - DNA, 601 bp, Human; identical to SEQ ID NO: 74671

SEQ ID NO: 106822 - DNA, 601 bp, Human; identical to SEQ ID NO: 74672

SEQ ID NO: 106823 - DNA, 601 bp, Human; identical to SEQ ID NO: 74673

SEQ ID NO: 106824 - DNA, 601 bp, Human; identical to SEQ ID NO: 74674

SEQ ID NO: 106825 - DNA, 601 bp, Human; identical to SEQ ID NO: 74675

SEQ ID NO: 106826 - DNA, 601 bp, Human; identical to SEQ ID NO: 74676

SEQ ID NO: 106827 - DNA, 601 bp, Human; identical to SEQ ID NO: 74677

SEQ ID NO: 106828 - DNA, 601 bp, Human; identical to SEQ ID NO: 74678

SEQ ID NO: 106829 - DNA, 601 bp, Human; identical to SEQ ID NO: 74679

SEQ ID NO: 106830 - DNA, 601 bp, Human; identical to SEQ ID NO: 74680

SEQ ID NO: 106831 - DNA, 601 bp, Human; identical to SEQ ID NO: 74681

SEQ ID NO: 106832 - DNA, 601 bp, Human; identical to SEQ ID NO: 74682

SEQ ID NO: 106833 - DNA, 601 bp, Human; identical to SEQ ID NO: 74683

SEQ ID NO: 106834 - DNA, 601 bp, Human; identical to SEQ ID NO: 74684

SEQ ID NO: 106835 - DNA, 601 bp, Human; identical to SEQ ID NO: 74685

SEQ ID NO: 106836 - DNA, 601 bp, Human; identical to SEQ ID NO: 74686

SEQ ID NO: 106837 - DNA, 601 bp, Human; identical to SEQ ID NO: 74687

SEQ ID NO: 106838 - DNA, 601 bp, Human; identical to SEQ ID NO: 74688

SEQ ID NO: 106839 - DNA, 601 bp, Human; identical to SEQ ID NO: 74689

SEQ ID NO: 106840 - DNA, 601 bp, Human; identical to SEQ ID NO: 74690

SEQ ID NO: 106841 - DNA, 601 bp, Human; identical to SEQ ID NO: 74691

SEQ ID NO: 106842 - DNA, 601 bp, Human; identical to SEQ ID NO: 74692

SEQ ID NO: 106843 - DNA, 601 bp, Human; identical to SEQ ID NO: 74693

SEQ ID NO: 106844 - DNA, 601 bp, Human; identical to SEQ ID NO: 74694

SEQ ID NO: 106845 - DNA, 601 bp, Human; identical to SEQ ID NO: 74695

SEQ ID NO: 106846 - DNA, 601 bp, Human; identical to SEQ ID NO: 74696

SEQ ID NO: 106847 - DNA, 601 bp, Human; identical to SEQ ID NO: 74697

SEQ ID NO: 106848 - DNA, 601 bp, Human; identical to SEQ ID NO: 74698

SEQ ID NO: 106849 - DNA, 601 bp, Human; identical to SEQ ID NO: 74699

SEQ ID NO: 106850 - DNA, 601 bp, Human; identical to SEQ ID NO: 74700

SEQ ID NO: 106851 - DNA, 601 bp, Human; identical to SEQ ID NO: 74701

SEQ ID NO: 106852 - DNA, 601 bp, Human; identical to SEQ ID NO: 74702

SEQ ID NO: 106853 - DNA, 601 bp, Human; identical to SEQ ID NO: 74703

SEQ ID NO: 106854 - DNA, 601 bp, Human; identical to SEQ ID NO: 74704

SEQ ID NO: 106855 - DNA, 601 bp, Human; identical to SEQ ID NO: 74705

SEQ ID NO: 106856 - DNA, 601 bp, Human; identical to SEQ ID NO: 74706

SEQ ID NO: 106857 - DNA, 601 bp, Human; identical to SEQ ID NO: 74707

SEQ ID NO: 106858 - DNA, 601 bp, Human; identical to SEQ ID NO: 74708

SEQ ID NO: 106859 - DNA, 601 bp, Human; identical to SEQ ID NO: 74709

SEQ ID NO: 106860 - DNA, 601 bp, Human; identical to SEQ ID NO: 74710

SEQ ID NO: 106861 - DNA, 601 bp, Human; identical to SEQ ID NO: 74711

SEQ ID NO: 106862 - DNA, 601 bp, Human; identical to SEQ ID NO: 74712

SEQ ID NO: 106863 - DNA, 601 bp, Human; identical to SEQ ID NO: 74713

SEQ ID NO: 106864 - DNA, 601 bp, Human; identical to SEQ ID NO: 74714

SEQ ID NO: 106865 - DNA, 601 bp, Human; identical to SEQ ID NO: 74715

SEQ ID NO: 106866 - DNA, 601 bp, Human; identical to SEQ ID NO: 74716

SEQ ID NO: 106867 - DNA, 601 bp, Human; identical to SEQ ID NO: 74717

SEQ ID NO: 106868 - DNA, 601 bp, Human; identical to SEQ ID NO: 74718

SEQ ID NO: 106869 - DNA, 601 bp, Human; identical to SEQ ID NO: 74719

SEQ ID NO: 106870 - DNA, 601 bp, Human; identical to SEQ ID NO: 74720

SEQ ID NO: 106871 - DNA, 601 bp, Human; identical to SEQ ID NO: 74721

SEQ ID NO: 106872 - DNA, 601 bp, Human; identical to SEQ ID NO: 74722

SEQ ID NO: 106873 - DNA, 601 bp, Human; identical to SEQ ID NO: 74723

SEQ ID NO: 106874 - DNA, 601 bp, Human; identical to SEQ ID NO: 74724

SEQ ID NO: 106875 - DNA, 601 bp, Human; identical to SEQ ID NO: 74725

SEQ ID NO: 106876 - DNA, 601 bp, Human; identical to SEQ ID NO: 74726

SEQ ID NO: 106877 - DNA, 601 bp, Human; identical to SEQ ID NO: 74727

SEQ ID NO: 106878 - DNA, 601 bp, Human; identical to SEQ ID NO: 74728

SEQ ID NO: 106879 - DNA, 601 bp, Human; identical to SEQ ID NO: 74729

SEQ ID NO: 106880 - DNA, 601 bp, Human; identical to SEQ ID NO: 74730

SEQ ID NO: 106881 - DNA, 601 bp, Human; identical to SEQ ID NO: 74731

SEQ ID NO: 106882 - DNA, 601 bp, Human; identical to SEQ ID NO: 74732

SEQ ID NO: 106883 - DNA, 601 bp, Human; identical to SEQ ID NO: 74733

SEQ ID NO: 106884 - DNA, 601 bp, Human; identical to SEQ ID NO: 74734

SEQ ID NO: 106885 - DNA, 601 bp, Human; identical to SEQ ID NO: 74735

SEQ ID NO: 106886 - DNA, 601 bp, Human; identical to SEQ ID NO: 74736

SEQ ID NO: 106887 - DNA, 601 bp, Human; identical to SEQ ID NO: 74737

SEQ ID NO: 106888 - DNA, 601 bp, Human; identical to SEQ ID NO: 74738

SEQ ID NO: 106889 - DNA, 601 bp, Human; identical to SEQ ID NO: 74739

SEQ ID NO: 106890 - DNA, 601 bp, Human; identical to SEQ ID NO: 74740

SEQ ID NO: 106891 - DNA, 601 bp, Human; identical to SEQ ID NO: 74741

SEQ ID NO: 106892 - DNA, 601 bp, Human; identical to SEQ ID NO: 74742

SEQ ID NO: 106893 - DNA, 601 bp, Human; identical to SEQ ID NO: 74743

SEQ ID NO: 106894 - DNA, 601 bp, Human; identical to SEQ ID NO: 74744

SEQ ID NO: 106895 - DNA, 601 bp, Human; identical to SEQ ID NO: 74745

SEQ ID NO: 106896 - DNA, 601 bp, Human; identical to SEQ ID NO: 74746

SEQ ID NO: 106897 - DNA, 601 bp, Human; identical to SEQ ID NO: 74747

SEQ ID NO: 106898 - DNA, 601 bp, Human; identical to SEQ ID NO: 74748

SEQ ID NO: 106899 - DNA, 601 bp, Human; identical to SEQ ID NO: 74749

SEQ ID NO: 106900 - DNA, 601 bp, Human; identical to SEQ ID NO: 74750

SEQ ID NO: 106901 - DNA, 601 bp, Human; identical to SEQ ID NO: 74751

SEQ ID NO: 106902 - DNA, 601 bp, Human; identical to SEQ ID NO: 74752

SEQ ID NO: 106903 - DNA, 601 bp, Human; identical to SEQ ID NO: 74753

SEQ ID NO: 106904 - DNA, 601 bp, Human; identical to SEQ ID NO: 74754

SEQ ID NO: 106905 - DNA, 601 bp, Human; identical to SEQ ID NO: 74755

SEQ ID NO: 106906 - DNA, 601 bp, Human; identical to SEQ ID NO: 74756

SEQ ID NO: 106907 - DNA, 601 bp, Human; identical to SEQ ID NO: 74757

SEQ ID NO: 106908 - DNA, 601 bp, Human; identical to SEQ ID NO: 74758

SEQ ID NO: 106909 - DNA, 601 bp, Human; identical to SEQ ID NO: 74759

SEQ ID NO: 106910 - DNA, 601 bp, Human; identical to SEQ ID NO: 74760

SEQ ID NO: 106911 - DNA, 601 bp, Human; identical to SEQ ID NO: 74761

SEQ ID NO: 106912 - DNA, 601 bp, Human; identical to SEQ ID NO: 74762

SEQ ID NO: 106913 - DNA, 601 bp, Human; identical to SEQ ID NO: 74763

SEQ ID NO: 106914 - DNA, 601 bp, Human; identical to SEQ ID NO: 74764

SEQ ID NO: 106915 - DNA, 601 bp, Human; identical to SEQ ID NO: 74765

SEQ ID NO: 106916 - DNA, 601 bp, Human; identical to SEQ ID NO: 74766

SEQ ID NO: 106917 - DNA, 601 bp, Human; identical to SEQ ID NO: 74767

SEQ ID NO: 106918 - DNA, 601 bp, Human; identical to SEQ ID NO: 74768

SEQ ID NO: 106919 - DNA, 601 bp, Human; identical to SEQ ID NO: 74769

SEQ ID NO: 106920 - DNA, 601 bp, Human; identical to SEQ ID NO: 74770

SEQ ID NO: 106921 - DNA, 601 bp, Human; identical to SEQ ID NO: 74771

SEQ ID NO: 106922 - DNA, 601 bp, Human; identical to SEQ ID NO: 74772

SEQ ID NO: 106923 - DNA, 601 bp, Human; identical to SEQ ID NO: 74773

SEQ ID NO: 106924 - DNA, 601 bp, Human; identical to SEQ ID NO: 74774

SEQ ID NO: 106925 - DNA, 601 bp, Human; identical to SEQ ID NO: 74775

SEQ ID NO: 106926 - DNA, 601 bp, Human; identical to SEQ ID NO: 74776

SEQ ID NO: 106927 - DNA, 601 bp, Human; identical to SEQ ID NO: 74777

SEQ ID NO: 106928 - DNA, 601 bp, Human; identical to SEQ ID NO: 74778

SEQ ID NO: 106929 - DNA, 601 bp, Human; identical to SEQ ID NO: 74779

SEQ ID NO: 106930 - DNA, 601 bp, Human; identical to SEQ ID NO: 74780

SEQ ID NO: 106931 - DNA, 601 bp, Human; identical to SEQ ID NO: 74781

SEQ ID NO: 106932 - DNA, 601 bp, Human; identical to SEQ ID NO: 74782

SEQ ID NO: 106933 - DNA, 601 bp, Human; identical to SEQ ID NO: 74783

SEQ ID NO: 106934 - DNA, 601 bp, Human; identical to SEQ ID NO: 74784

SEQ ID NO: 106935 - DNA, 601 bp, Human; identical to SEQ ID NO: 74785

SEQ ID NO: 106936 - DNA, 601 bp, Human; identical to SEQ ID NO: 74786

SEQ ID NO: 106937 - DNA, 601 bp, Human; identical to SEQ ID NO: 74787

SEQ ID NO: 106938 - DNA, 601 bp, Human; identical to SEQ ID NO: 74788

SEQ ID NO: 106939 - DNA, 601 bp, Human; identical to SEQ ID NO: 74789

SEQ ID NO: 106940 - DNA, 601 bp, Human; identical to SEQ ID NO: 74790

SEQ ID NO: 106941 - DNA, 601 bp, Human; identical to SEQ ID NO: 74791

SEQ ID NO: 106942 - DNA, 601 bp, Human; identical to SEQ ID NO: 74792

SEQ ID NO: 106943 - DNA, 601 bp, Human; identical to SEQ ID NO: 74793

SEQ ID NO: 106944 - DNA, 601 bp, Human; identical to SEQ ID NO: 74794

SEQ ID NO: 106945 - DNA, 601 bp, Human; identical to SEQ ID NO: 74795

SEQ ID NO: 106946 - DNA, 601 bp, Human; identical to SEQ ID NO: 74796

SEQ ID NO: 106947 - DNA, 601 bp, Human; identical to SEQ ID NO: 74797

SEQ ID NO: 106948 - DNA, 601 bp, Human; identical to SEQ ID NO: 74798

SEQ ID NO: 106949 - DNA, 601 bp, Human; identical to SEQ ID NO: 74799

SEQ ID NO: 106950 - DNA, 601 bp, Human; identical to SEQ ID NO: 74800

SEQ ID NO: 106951 - DNA, 601 bp, Human; identical to SEQ ID NO: 74801

SEQ ID NO: 106952 - DNA, 601 bp, Human; identical to SEQ ID NO: 74802

SEQ ID NO: 106953 - DNA, 601 bp, Human; identical to SEQ ID NO: 74803

SEQ ID NO: 106954 - DNA, 601 bp, Human; identical to SEQ ID NO: 74804

SEQ ID NO: 106955 - DNA, 601 bp, Human; identical to SEQ ID NO: 74805

SEQ ID NO: 106956 - DNA, 601 bp, Human; identical to SEQ ID NO: 74806

SEQ ID NO: 106957 - DNA, 601 bp, Human; identical to SEQ ID NO: 74807

SEQ ID NO: 106958 - DNA, 601 bp, Human; identical to SEQ ID NO: 74808

SEQ ID NO: 106959 - DNA, 601 bp, Human; identical to SEQ ID NO: 74809

SEQ ID NO: 106960 - DNA, 601 bp, Human; identical to SEQ ID NO: 74810

SEQ ID NO: 106961 - DNA, 601 bp, Human; identical to SEQ ID NO: 74811

SEQ ID NO: 106962 - DNA, 601 bp, Human; identical to SEQ ID NO: 74812

SEQ ID NO: 106963 - DNA, 601 bp, Human; identical to SEQ ID NO: 74813

SEQ ID NO: 106964 - DNA, 601 bp, Human; identical to SEQ ID NO: 74814

SEQ ID NO: 106965 - DNA, 601 bp, Human; identical to SEQ ID NO: 74815

SEQ ID NO: 106966 - DNA, 601 bp, Human; identical to SEQ ID NO: 74816

SEQ ID NO: 106967 - DNA, 601 bp, Human; identical to SEQ ID NO: 74817

SEQ ID NO: 106968 - DNA, 601 bp, Human; identical to SEQ ID NO: 74818

SEQ ID NO: 106969 - DNA, 601 bp, Human; identical to SEQ ID NO: 74819

SEQ ID NO: 106970 - DNA, 601 bp, Human; identical to SEQ ID NO: 74820

SEQ ID NO: 106971 - DNA, 601 bp, Human; identical to SEQ ID NO: 74821

SEQ ID NO: 106972 - DNA, 601 bp, Human; identical to SEQ ID NO: 74822

SEQ ID NO: 106973 - DNA, 601 bp, Human; identical to SEQ ID NO: 74823

SEQ ID NO: 106974 - DNA, 601 bp, Human; identical to SEQ ID NO: 74824

SEQ ID NO: 106975 - DNA, 601 bp, Human; identical to SEQ ID NO: 74825

SEQ ID NO: 106976 - DNA, 601 bp, Human; identical to SEQ ID NO: 74826

SEQ ID NO: 106977 - DNA, 601 bp, Human; identical to SEQ ID NO: 74827

SEQ ID NO: 106978 - DNA, 601 bp, Human; identical to SEQ ID NO: 74828

SEQ ID NO: 106979 - DNA, 601 bp, Human; identical to SEQ ID NO: 74829

SEQ ID NO: 106980 - DNA, 601 bp, Human; identical to SEQ ID NO: 74830

SEQ ID NO: 106981 - DNA, 601 bp, Human; identical to SEQ ID NO: 74831

SEQ ID NO: 106982 - DNA, 601 bp, Human; identical to SEQ ID NO: 74832

SEQ ID NO: 106983 - DNA, 601 bp, Human; identical to SEQ ID NO: 74833

SEQ ID NO: 106984 - DNA, 601 bp, Human; identical to SEQ ID NO: 74834

SEQ ID NO: 106985 - DNA, 601 bp, Human; identical to SEQ ID NO: 74835

SEQ ID NO: 106986 - DNA, 601 bp, Human; identical to SEQ ID NO: 74836

SEQ ID NO: 106987 - DNA, 601 bp, Human; identical to SEQ ID NO: 74837

SEQ ID NO: 106988 - DNA, 601 bp, Human; identical to SEQ ID NO: 74838

SEQ ID NO: 106989 - DNA, 601 bp, Human; identical to SEQ ID NO: 74839

SEQ ID NO: 106990 - DNA, 601 bp, Human; identical to SEQ ID NO: 74840

SEQ ID NO: 106991 - DNA, 601 bp, Human; identical to SEQ ID NO: 74841

SEQ ID NO: 106992 - DNA, 601 bp, Human; identical to SEQ ID NO: 74842

SEQ ID NO: 106993 - DNA, 601 bp, Human; identical to SEQ ID NO: 74843

SEQ ID NO: 106994 - DNA, 601 bp, Human; identical to SEQ ID NO: 74844

SEQ ID NO: 106995 - DNA, 601 bp, Human; identical to SEQ ID NO: 74845

SEQ ID NO: 106996 - DNA, 601 bp, Human; identical to SEQ ID NO: 74846

SEQ ID NO: 106997 - DNA, 601 bp, Human; identical to SEQ ID NO: 74847

SEQ ID NO: 106998 - DNA, 601 bp, Human; identical to SEQ ID NO: 74848

SEQ ID NO: 106999 - DNA, 601 bp, Human; identical to SEQ ID NO: 74849

SEQ ID NO: 107000 - DNA, 601 bp, Human; identical to SEQ ID NO: 74850

SEQ ID NO: 107001 - DNA, 601 bp, Human; identical to SEQ ID NO: 74851

SEQ ID NO: 107002 - DNA, 601 bp, Human; identical to SEQ ID NO: 74852

SEQ ID NO: 107003 - DNA, 601 bp, Human; identical to SEQ ID NO: 74853

SEQ ID NO: 107004 - DNA, 601 bp, Human; identical to SEQ ID NO: 74854

SEQ ID NO: 107005 - DNA, 601 bp, Human; identical to SEQ ID NO: 74855

SEQ ID NO: 107006 - DNA, 601 bp, Human; identical to SEQ ID NO: 74856

SEQ ID NO: 107007 - DNA, 601 bp, Human; identical to SEQ ID NO: 74857

SEQ ID NO: 107008 - DNA, 601 bp, Human; identical to SEQ ID NO: 74858

SEQ ID NO: 107009 - DNA, 601 bp, Human; identical to SEQ ID NO: 74817

SEQ ID NO: 107010 - DNA, 601 bp, Human; identical to SEQ ID NO: 74818

SEQ ID NO: 107011 - DNA, 601 bp, Human; identical to SEQ ID NO: 74819

SEQ ID NO: 107012 - DNA, 601 bp, Human; identical to SEQ ID NO: 74820

SEQ ID NO: 107013 - DNA, 601 bp, Human; identical to SEQ ID NO: 74821

SEQ ID NO: 107014 - DNA, 601 bp, Human; identical to SEQ ID NO: 74822

SEQ ID NO: 107015 - DNA, 601 bp, Human; identical to SEQ ID NO: 74823

SEQ ID NO: 107016 - DNA, 601 bp, Human; identical to SEQ ID NO: 74824

SEQ ID NO: 107017 - DNA, 601 bp, Human; identical to SEQ ID NO: 74825

SEQ ID NO: 107018 - DNA, 601 bp, Human; identical to SEQ ID NO: 74826

SEQ ID NO: 107019 - DNA, 601 bp, Human; identical to SEQ ID NO: 74827

SEQ ID NO: 107020 - DNA, 601 bp, Human; identical to SEQ ID NO: 74828

SEQ ID NO: 107021 - DNA, 601 bp, Human; identical to SEQ ID NO: 74829

SEQ ID NO: 107022 - DNA, 601 bp, Human; identical to SEQ ID NO: 74830

SEQ ID NO: 107023 - DNA, 601 bp, Human; identical to SEQ ID NO: 74831

SEQ ID NO: 107024 - DNA, 601 bp, Human; identical to SEQ ID NO: 74832

SEQ ID NO: 107025 - DNA, 601 bp, Human; identical to SEQ ID NO: 74833

SEQ ID NO: 107026 - DNA, 601 bp, Human; identical to SEQ ID NO: 74834

SEQ ID NO: 107027 - DNA, 601 bp, Human; identical to SEQ ID NO: 74835

SEQ ID NO: 107028 - DNA, 601 bp, Human; identical to SEQ ID NO: 74836

SEQ ID NO: 107029 - DNA, 601 bp, Human; identical to SEQ ID NO: 74837

SEQ ID NO: 107030 - DNA, 601 bp, Human; identical to SEQ ID NO: 74838

SEQ ID NO: 107031 - DNA, 601 bp, Human; identical to SEQ ID NO: 74839

SEQ ID NO: 107032 - DNA, 601 bp, Human; identical to SEQ ID NO: 74840

SEQ ID NO: 107033 - DNA, 601 bp, Human; identical to SEQ ID NO: 74841

SEQ ID NO: 107034 - DNA, 601 bp, Human; identical to SEQ ID NO: 74842

SEQ ID NO: 107035 - DNA, 601 bp, Human; identical to SEQ ID NO: 74843

SEQ ID NO: 107036 - DNA, 601 bp, Human; identical to SEQ ID NO: 74844

SEQ ID NO: 107037 - DNA, 601 bp, Human; identical to SEQ ID NO: 74845

SEQ ID NO: 107038 - DNA, 601 bp, Human; identical to SEQ ID NO: 74846

SEQ ID NO: 107039 - DNA, 601 bp, Human; identical to SEQ ID NO: 74847

SEQ ID NO: 107040 - DNA, 601 bp, Human; identical to SEQ ID NO: 74848

SEQ ID NO: 107041 - DNA, 601 bp, Human; identical to SEQ ID NO: 74849

SEQ ID NO: 107042 - DNA, 601 bp, Human; identical to SEQ ID NO: 74850

SEQ ID NO: 107043 - DNA, 601 bp, Human; identical to SEQ ID NO: 74851

SEQ ID NO: 107044 - DNA, 601 bp, Human; identical to SEQ ID NO: 74852

SEQ ID NO: 107045 - DNA, 601 bp, Human; identical to SEQ ID NO: 74853

SEQ ID NO: 107046 - DNA, 601 bp, Human; identical to SEQ ID NO: 74854

SEQ ID NO: 107047 - DNA, 601 bp, Human; identical to SEQ ID NO: 74855

SEQ ID NO: 107048 - DNA, 601 bp, Human; identical to SEQ ID NO: 74856

SEQ ID NO: 107049 - DNA, 601 bp, Human; identical to SEQ ID NO: 74857

SEQ ID NO: 107050 - DNA, 601 bp, Human; identical to SEQ ID NO: 74858

SEQ ID NO: 107051 - DNA, 601 bp, Human; identical to SEQ ID NO: 74817

SEQ ID NO: 107052 - DNA, 601 bp, Human; identical to SEQ ID NO: 74818

SEQ ID NO: 107053 - DNA, 601 bp, Human; identical to SEQ ID NO: 74819

SEQ ID NO: 107054 - DNA, 601 bp, Human; identical to SEQ ID NO: 74820

SEQ ID NO: 107055 - DNA, 601 bp, Human; identical to SEQ ID NO: 74821

SEQ ID NO: 107056 - DNA, 601 bp, Human; identical to SEQ ID NO: 74822

SEQ ID NO: 107057 - DNA, 601 bp, Human; identical to SEQ ID NO: 74823

SEQ ID NO: 107058 - DNA, 601 bp, Human; identical to SEQ ID NO: 74824

SEQ ID NO: 107059 - DNA, 601 bp, Human; identical to SEQ ID NO: 74825

SEQ ID NO: 107060 - DNA, 601 bp, Human; identical to SEQ ID NO: 74826

SEQ ID NO: 107061 - DNA, 601 bp, Human; identical to SEQ ID NO: 74827

SEQ ID NO: 107062 - DNA, 601 bp, Human; identical to SEQ ID NO: 74828

SEQ ID NO: 107063 - DNA, 601 bp, Human; identical to SEQ ID NO: 74829

SEQ ID NO: 107064 - DNA, 601 bp, Human; identical to SEQ ID NO: 74830

SEQ ID NO: 107065 - DNA, 601 bp, Human; identical to SEQ ID NO: 74831

SEQ ID NO: 107066 - DNA, 601 bp, Human; identical to SEQ ID NO: 74832

SEQ ID NO: 107067 - DNA, 601 bp, Human; identical to SEQ ID NO: 74833

SEQ ID NO: 107068 - DNA, 601 bp, Human; identical to SEQ ID NO: 74834

SEQ ID NO: 107069 - DNA, 601 bp, Human; identical to SEQ ID NO: 74835

SEQ ID NO: 107070 - DNA, 601 bp, Human; identical to SEQ ID NO: 74836

SEQ ID NO: 107071 - DNA, 601 bp, Human; identical to SEQ ID NO: 74837

SEQ ID NO: 107072 - DNA, 601 bp, Human; identical to SEQ ID NO: 74838

SEQ ID NO: 107073 - DNA, 601 bp, Human; identical to SEQ ID NO: 74839

SEQ ID NO: 107074 - DNA, 601 bp, Human; identical to SEQ ID NO: 74840

SEQ ID NO: 107075 - DNA, 601 bp, Human; identical to SEQ ID NO: 74841

SEQ ID NO: 107076 - DNA, 601 bp, Human; identical to SEQ ID NO: 74842

SEQ ID NO: 107077 - DNA, 601 bp, Human; identical to SEQ ID NO: 74843

SEQ ID NO: 107078 - DNA, 601 bp, Human; identical to SEQ ID NO: 74844

SEQ ID NO: 107079 - DNA, 601 bp, Human; identical to SEQ ID NO: 74845

SEQ ID NO: 107080 - DNA, 601 bp, Human; identical to SEQ ID NO: 74846

SEQ ID NO: 107081 - DNA, 601 bp, Human; identical to SEQ ID NO: 74847

SEQ ID NO: 107082 - DNA, 601 bp, Human; identical to SEQ ID NO: 74848

SEQ ID NO: 107083 - DNA, 601 bp, Human; identical to SEQ ID NO: 74849

SEQ ID NO: 107084 - DNA, 601 bp, Human; identical to SEQ ID NO: 74850

SEQ ID NO: 107085 - DNA, 601 bp, Human; identical to SEQ ID NO: 74851

SEQ ID NO: 107086 - DNA, 601 bp, Human; identical to SEQ ID NO: 74852

SEQ ID NO: 107087 - DNA, 601 bp, Human; identical to SEQ ID NO: 74853

SEQ ID NO: 107088 - DNA, 601 bp, Human; identical to SEQ ID NO: 74854

SEQ ID NO: 107089 - DNA, 601 bp, Human; identical to SEQ ID NO: 74855

SEQ ID NO: 107090 - DNA, 601 bp, Human; identical to SEQ ID NO: 74856

SEQ ID NO: 107091 - DNA, 601 bp, Human; identical to SEQ ID NO: 74857

SEQ ID NO: 107092 - DNA, 601 bp, Human; identical to SEQ ID NO: 74858

SEQ ID NO: 107093 - DNA, 601 bp, Human; identical to SEQ ID NO: 74817

SEQ ID NO: 107094 - DNA, 601 bp, Human; identical to SEQ ID NO: 74818

SEQ ID NO: 107095 - DNA, 601 bp, Human; identical to SEQ ID NO: 74819

SEQ ID NO: 107096 - DNA, 601 bp, Human; identical to SEQ ID NO: 74820

SEQ ID NO: 107097 - DNA, 601 bp, Human; identical to SEQ ID NO: 74821

SEQ ID NO: 107098 - DNA, 601 bp, Human; identical to SEQ ID NO: 74822

SEQ ID NO: 107099 - DNA, 601 bp, Human; identical to SEQ ID NO: 74823

SEQ ID NO: 107100 - DNA, 601 bp, Human; identical to SEQ ID NO: 74824

SEQ ID NO: 107101 - DNA, 601 bp, Human; identical to SEQ ID NO: 74825

SEQ ID NO: 107102 - DNA, 601 bp, Human; identical to SEQ ID NO: 74826

SEQ ID NO: 107103 - DNA, 601 bp, Human; identical to SEQ ID NO: 74827

SEQ ID NO: 107104 - DNA, 601 bp, Human; identical to SEQ ID NO: 74828

SEQ ID NO: 107105 - DNA, 601 bp, Human; identical to SEQ ID NO: 74829

SEQ ID NO: 107106 - DNA, 601 bp, Human; identical to SEQ ID NO: 74830

SEQ ID NO: 107107 - DNA, 601 bp, Human; identical to SEQ ID NO: 74831

SEQ ID NO: 107108 - DNA, 601 bp, Human; identical to SEQ ID NO: 74832

SEQ ID NO: 107109 - DNA, 601 bp, Human; identical to SEQ ID NO: 74833

SEQ ID NO: 107110 - DNA, 601 bp, Human; identical to SEQ ID NO: 74834

SEQ ID NO: 107111 - DNA, 601 bp, Human; identical to SEQ ID NO: 74835

SEQ ID NO: 107112 - DNA, 601 bp, Human; identical to SEQ ID NO: 74836

SEQ ID NO: 107113 - DNA, 601 bp, Human; identical to SEQ ID NO: 74837

SEQ ID NO: 107114 - DNA, 601 bp, Human; identical to SEQ ID NO: 74838

SEQ ID NO: 107115 - DNA, 601 bp, Human; identical to SEQ ID NO: 74839

SEQ ID NO: 107116 - DNA, 601 bp, Human; identical to SEQ ID NO: 74840

SEQ ID NO: 107117 - DNA, 601 bp, Human; identical to SEQ ID NO: 74841

SEQ ID NO: 107118 - DNA, 601 bp, Human; identical to SEQ ID NO: 74842

SEQ ID NO: 107119 - DNA, 601 bp, Human; identical to SEQ ID NO: 74843

SEQ ID NO: 107120 - DNA, 601 bp, Human; identical to SEQ ID NO: 74844

SEQ ID NO: 107121 - DNA, 601 bp, Human; identical to SEQ ID NO: 74845

SEQ ID NO: 107122 - DNA, 601 bp, Human; identical to SEQ ID NO: 74846

SEQ ID NO: 107123 - DNA, 601 bp, Human; identical to SEQ ID NO: 74847

SEQ ID NO: 107124 - DNA, 601 bp, Human; identical to SEQ ID NO: 74848

SEQ ID NO: 107125 - DNA, 601 bp, Human; identical to SEQ ID NO: 74849

SEQ ID NO: 107126 - DNA, 601 bp, Human; identical to SEQ ID NO: 74850

SEQ ID NO: 107127 - DNA, 601 bp, Human; identical to SEQ ID NO: 74851

SEQ ID NO: 107128 - DNA, 601 bp, Human; identical to SEQ ID NO: 74852

SEQ ID NO: 107129 - DNA, 601 bp, Human; identical to SEQ ID NO: 74853

SEQ ID NO: 107130 - DNA, 601 bp, Human; identical to SEQ ID NO: 74854

SEQ ID NO: 107131 - DNA, 601 bp, Human; identical to SEQ ID NO: 74855

SEQ ID NO: 107132 - DNA, 601 bp, Human; identical to SEQ ID NO: 74856

SEQ ID NO: 107133 - DNA, 601 bp, Human; identical to SEQ ID NO: 74857

SEQ ID NO: 107134 - DNA, 601 bp, Human; identical to SEQ ID NO: 74858

SEQ ID NO: 107135 - DNA, 601 bp, Human; identical to SEQ ID NO: 74817

SEQ ID NO: 107136 - DNA, 601 bp, Human; identical to SEQ ID NO: 74818

SEQ ID NO: 107137 - DNA, 601 bp, Human; identical to SEQ ID NO: 74819

SEQ ID NO: 107138 - DNA, 601 bp, Human; identical to SEQ ID NO: 74820

SEQ ID NO: 107139 - DNA, 601 bp, Human; identical to SEQ ID NO: 74821

SEQ ID NO: 107140 - DNA, 601 bp, Human; identical to SEQ ID NO: 74822

SEQ ID NO: 107141 - DNA, 601 bp, Human; identical to SEQ ID NO: 74823

SEQ ID NO: 107142 - DNA, 601 bp, Human; identical to SEQ ID NO: 74824

SEQ ID NO: 107143 - DNA, 601 bp, Human; identical to SEQ ID NO: 74825

SEQ ID NO: 107144 - DNA, 601 bp, Human; identical to SEQ ID NO: 74826

SEQ ID NO: 107145 - DNA, 601 bp, Human; identical to SEQ ID NO: 74827

SEQ ID NO: 107146 - DNA, 601 bp, Human; identical to SEQ ID NO: 74828

SEQ ID NO: 107147 - DNA, 601 bp, Human; identical to SEQ ID NO: 74829

SEQ ID NO: 107148 - DNA, 601 bp, Human; identical to SEQ ID NO: 74830

SEQ ID NO: 107149 - DNA, 601 bp, Human; identical to SEQ ID NO: 74831

SEQ ID NO: 107150 - DNA, 601 bp, Human; identical to SEQ ID NO: 74832

SEQ ID NO: 107151 - DNA, 601 bp, Human; identical to SEQ ID NO: 74833

SEQ ID NO: 107152 - DNA, 601 bp, Human; identical to SEQ ID NO: 74834

SEQ ID NO: 107153 - DNA, 601 bp, Human; identical to SEQ ID NO: 74835

SEQ ID NO: 107154 - DNA, 601 bp, Human; identical to SEQ ID NO: 74836

SEQ ID NO: 107155 - DNA, 601 bp, Human; identical to SEQ ID NO: 74837

SEQ ID NO: 107156 - DNA, 601 bp, Human; identical to SEQ ID NO: 74838

SEQ ID NO: 107157 - DNA, 601 bp, Human; identical to SEQ ID NO: 74839

SEQ ID NO: 107158 - DNA, 601 bp, Human; identical to SEQ ID NO: 74840

SEQ ID NO: 107159 - DNA, 601 bp, Human; identical to SEQ ID NO: 74841

SEQ ID NO: 107160 - DNA, 601 bp, Human; identical to SEQ ID NO: 74842

SEQ ID NO: 107161 - DNA, 601 bp, Human; identical to SEQ ID NO: 74843

SEQ ID NO: 107162 - DNA, 601 bp, Human; identical to SEQ ID NO: 74844

SEQ ID NO: 107163 - DNA, 601 bp, Human; identical to SEQ ID NO: 74845

SEQ ID NO: 107164 - DNA, 601 bp, Human; identical to SEQ ID NO: 74846

SEQ ID NO: 107165 - DNA, 601 bp, Human; identical to SEQ ID NO: 74847

SEQ ID NO: 107166 - DNA, 601 bp, Human; identical to SEQ ID NO: 74848

SEQ ID NO: 107167 - DNA, 601 bp, Human; identical to SEQ ID NO: 74849

SEQ ID NO: 107168 - DNA, 601 bp, Human; identical to SEQ ID NO: 74850

SEQ ID NO: 107169 - DNA, 601 bp, Human; identical to SEQ ID NO: 74851

SEQ ID NO: 107170 - DNA, 601 bp, Human; identical to SEQ ID NO: 74852

SEQ ID NO: 107171 - DNA, 601 bp, Human; identical to SEQ ID NO: 74853

SEQ ID NO: 107172 - DNA, 601 bp, Human; identical to SEQ ID NO: 74854

SEQ ID NO: 107173 - DNA, 601 bp, Human; identical to SEQ ID NO: 74855

SEQ ID NO: 107174 - DNA, 601 bp, Human; identical to SEQ ID NO: 74856

SEQ ID NO: 107175 - DNA, 601 bp, Human; identical to SEQ ID NO: 74857

SEQ ID NO: 107176 - DNA, 601 bp, Human; identical to SEQ ID NO: 74858

SEQ ID NO: 107177 - DNA, 601 bp, Human; identical to SEQ ID NO: 74817

SEQ ID NO: 107178 - DNA, 601 bp, Human; identical to SEQ ID NO: 74818

SEQ ID NO: 107179 - DNA, 601 bp, Human; identical to SEQ ID NO: 74819

SEQ ID NO: 107180 - DNA, 601 bp, Human; identical to SEQ ID NO: 74820

SEQ ID NO: 107181 - DNA, 601 bp, Human; identical to SEQ ID NO: 74821

SEQ ID NO: 107182 - DNA, 601 bp, Human; identical to SEQ ID NO: 74822

SEQ ID NO: 107183 - DNA, 601 bp, Human; identical to SEQ ID NO: 74823

SEQ ID NO: 107184 - DNA, 601 bp, Human; identical to SEQ ID NO: 74824

SEQ ID NO: 107185 - DNA, 601 bp, Human; identical to SEQ ID NO: 74825

SEQ ID NO: 107186 - DNA, 601 bp, Human; identical to SEQ ID NO: 74826

SEQ ID NO: 107187 - DNA, 601 bp, Human; identical to SEQ ID NO: 74827

SEQ ID NO: 107188 - DNA, 601 bp, Human; identical to SEQ ID NO: 74828

SEQ ID NO: 107189 - DNA, 601 bp, Human; identical to SEQ ID NO: 74829

SEQ ID NO: 107190 - DNA, 601 bp, Human; identical to SEQ ID NO: 74830

SEQ ID NO: 107191 - DNA, 601 bp, Human; identical to SEQ ID NO: 74831

SEQ ID NO: 107192 - DNA, 601 bp, Human; identical to SEQ ID NO: 74832

SEQ ID NO: 107193 - DNA, 601 bp, Human; identical to SEQ ID NO: 74833

SEQ ID NO: 107194 - DNA, 601 bp, Human; identical to SEQ ID NO: 74834

SEQ ID NO: 107195 - DNA, 601 bp, Human; identical to SEQ ID NO: 74835

SEQ ID NO: 107196 - DNA, 601 bp, Human; identical to SEQ ID NO: 74836

SEQ ID NO: 107197 - DNA, 601 bp, Human; identical to SEQ ID NO: 74837

SEQ ID NO: 107198 - DNA, 601 bp, Human; identical to SEQ ID NO: 74838

SEQ ID NO: 107199 - DNA, 601 bp, Human; identical to SEQ ID NO: 74839

SEQ ID NO: 107200 - DNA, 601 bp, Human; identical to SEQ ID NO: 74840

SEQ ID NO: 107201 - DNA, 601 bp, Human; identical to SEQ ID NO: 74841

SEQ ID NO: 107202 - DNA, 601 bp, Human; identical to SEQ ID NO: 74842

SEQ ID NO: 107203 - DNA, 601 bp, Human; identical to SEQ ID NO: 74843

SEQ ID NO: 107204 - DNA, 601 bp, Human; identical to SEQ ID NO: 74844

SEQ ID NO: 107205 - DNA, 601 bp, Human; identical to SEQ ID NO: 74845

SEQ ID NO: 107206 - DNA, 601 bp, Human; identical to SEQ ID NO: 74846

SEQ ID NO: 107207 - DNA, 601 bp, Human; identical to SEQ ID NO: 74847

SEQ ID NO: 107208 - DNA, 601 bp, Human; identical to SEQ ID NO: 74848

SEQ ID NO: 107209 - DNA, 601 bp, Human; identical to SEQ ID NO: 74849

SEQ ID NO: 107210 - DNA, 601 bp, Human; identical to SEQ ID NO: 74850

SEQ ID NO: 107211 - DNA, 601 bp, Human; identical to SEQ ID NO: 74851

SEQ ID NO: 107212 - DNA, 601 bp, Human; identical to SEQ ID NO: 74852

SEQ ID NO: 107213 - DNA, 601 bp, Human; identical to SEQ ID NO: 74853

SEQ ID NO: 107214 - DNA, 601 bp, Human; identical to SEQ ID NO: 74854

SEQ ID NO: 107215 - DNA, 601 bp, Human; identical to SEQ ID NO: 74855

SEQ ID NO: 107216 - DNA, 601 bp, Human; identical to SEQ ID NO: 74856

SEQ ID NO: 107217 - DNA, 601 bp, Human; identical to SEQ ID NO: 74857

SEQ ID NO: 107218 - DNA, 601 bp, Human; identical to SEQ ID NO: 74858

SEQ ID NO: 107219 - DNA, 601 bp, Human; identical to SEQ ID NO: 74817

SEQ ID NO: 107220 - DNA, 601 bp, Human; identical to SEQ ID NO: 74818

SEQ ID NO: 107221 - DNA, 601 bp, Human; identical to SEQ ID NO: 74819

SEQ ID NO: 107222 - DNA, 601 bp, Human; identical to SEQ ID NO: 74820

SEQ ID NO: 107223 - DNA, 601 bp, Human; identical to SEQ ID NO: 74821

SEQ ID NO: 107224 - DNA, 601 bp, Human; identical to SEQ ID NO: 74822

SEQ ID NO: 107225 - DNA, 601 bp, Human; identical to SEQ ID NO: 74823

SEQ ID NO: 107226 - DNA, 601 bp, Human; identical to SEQ ID NO: 74824

SEQ ID NO: 107227 - DNA, 601 bp, Human; identical to SEQ ID NO: 74825

SEQ ID NO: 107228 - DNA, 601 bp, Human; identical to SEQ ID NO: 74826

SEQ ID NO: 107229 - DNA, 601 bp, Human; identical to SEQ ID NO: 74827

SEQ ID NO: 107230 - DNA, 601 bp, Human; identical to SEQ ID NO: 74828

SEQ ID NO: 107231 - DNA, 601 bp, Human; identical to SEQ ID NO: 74829

SEQ ID NO: 107232 - DNA, 601 bp, Human; identical to SEQ ID NO: 74830

SEQ ID NO: 107233 - DNA, 601 bp, Human; identical to SEQ ID NO: 74831

SEQ ID NO: 107234 - DNA, 601 bp, Human; identical to SEQ ID NO: 74832

SEQ ID NO: 107235 - DNA, 601 bp, Human; identical to SEQ ID NO: 74833

SEQ ID NO: 107236 - DNA, 601 bp, Human; identical to SEQ ID NO: 74834

SEQ ID NO: 107237 - DNA, 601 bp, Human; identical to SEQ ID NO: 74835

SEQ ID NO: 107238 - DNA, 601 bp, Human; identical to SEQ ID NO: 74836

SEQ ID NO: 107239 - DNA, 601 bp, Human; identical to SEQ ID NO: 74837

SEQ ID NO: 107240 - DNA, 601 bp, Human; identical to SEQ ID NO: 74838

SEQ ID NO: 107241 - DNA, 601 bp, Human; identical to SEQ ID NO: 74839

SEQ ID NO: 107242 - DNA, 601 bp, Human; identical to SEQ ID NO: 74840

SEQ ID NO: 107243 - DNA, 601 bp, Human; identical to SEQ ID NO: 74841

SEQ ID NO: 107244 - DNA, 601 bp, Human; identical to SEQ ID NO: 74842

SEQ ID NO: 107245 - DNA, 601 bp, Human; identical to SEQ ID NO: 74843

SEQ ID NO: 107246 - DNA, 601 bp, Human; identical to SEQ ID NO: 74844

SEQ ID NO: 107247 - DNA, 601 bp, Human; identical to SEQ ID NO: 74845

SEQ ID NO: 107248 - DNA, 601 bp, Human; identical to SEQ ID NO: 74846

SEQ ID NO: 107249 - DNA, 601 bp, Human; identical to SEQ ID NO: 74847

SEQ ID NO: 107250 - DNA, 601 bp, Human; identical to SEQ ID NO: 74848

SEQ ID NO: 107251 - DNA, 601 bp, Human; identical to SEQ ID NO: 74849

SEQ ID NO: 107252 - DNA, 601 bp, Human; identical to SEQ ID NO: 74850

SEQ ID NO: 107253 - DNA, 601 bp, Human; identical to SEQ ID NO: 74851

SEQ ID NO: 107254 - DNA, 601 bp, Human; identical to SEQ ID NO: 74852

SEQ ID NO: 107255 - DNA, 601 bp, Human; identical to SEQ ID NO: 74853

SEQ ID NO: 107256 - DNA, 601 bp, Human; identical to SEQ ID NO: 74854

SEQ ID NO: 107257 - DNA, 601 bp, Human; identical to SEQ ID NO: 74855

SEQ ID NO: 107258 - DNA, 601 bp, Human; identical to SEQ ID NO: 74856

SEQ ID NO: 107259 - DNA, 601 bp, Human; identical to SEQ ID NO: 74857

SEQ ID NO: 107260 - DNA, 601 bp, Human; identical to SEQ ID NO: 74858

SEQ ID NO: 107261 - DNA, 601 bp, Human
ggaatgtcaacaggcaggggcagcactgcagagatttcatcatggtctcccaggccctcaggctcctctgccttctgcttgggcttcagggctgcctggctgcaggtgcgtccggggaggttttctccataaacttggtggaagggcagtgggcaaatccaggagccagcccgggcttcccaaaccccgcccttgctccggacacccccatccaccaggagggttttctggcggctcctgttcaatttctttccttctagaaaccagcatccaggcacaggaggggaggcccttcttggtrgcccaggctttggcgggattatttttcaaagaactttaggagtgggtggtgctttcctggcccccatgggcccctgcctgtgaggtcggacaagcgcagggagtctggggcctctcagagtgcaggaagtgcgcacagggtgctcccaggctggggagcacaggtaggggacggtgcgtgggggatggcgcctggggcatgggggatggggtgtgggaaacggcatgtggggcgtaggggatggggtgtggaggatcgggggtggggatggcgtgtggggtgtgggggatgggccgtggg

SEQ ID NO: 107262 - DNA, 601 bp, Human
tggacacttttaccatccccattggactttcactttcccccaggctcccatcagctgctcggaagagtggtcaccctggaggccactgcccaccagccaggcaccccccaaatgcaaccgcagccagcactgccagccactggcaaggctgttcagacatgtggctcctctgatccacgccttgtcctttggatcagtccacggagcaggtggtgccaagctcaggctctgtcacccacagctcagtgccaccttccaggcagaacaccactgctgacccagggcatggccaccccggggrctggctctcgctgacccccagaagcccctctcagggtgtccccttcctgtccccagacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacaggtgaccaggcttcatgtcccagtcccagatgacaccagtccctgtcccactacggattatcttactggacaaaagacgggtgggagtggcttcacatctactg

SEQ ID NO: 107263 - DNA, 601 bp, Human
ttcagacatgtggctcctctgatccacgccttgtcctttggatcagtccacggagcaggtggtgccaagctcaggctctgtcacccacagctcagtgccaccttccaggcagaacaccactgctgacccagggcatggccaccccgggggctggctctcgctgacccccagaagcccctctcagggtgtccccttcctgtccccagacaaggatgaccagctgatctgtgtgaacgagaacggcggctgtgagcagtactgcagtgaccacacgggcaccaagcgctcctgtcggtgccaygaggggtactctctgctggcagacggggtgtcctgcacacccacaggtgaccaggcttcatgtcccagtcccagatgacaccagtccctgtcccactacggattatcttactggacaaaagacgggtgggagtggcttcacatctactgagcactaactatgcactgaccaattgtgaggtgggatctgggcaccaagggtggcacaggccagagcgacagtgactaggatgggcaccctgggggcaatccctgaatggcctcaggccccctgccaattctaggcagaccaggggagcca

SEQ ID NO: 107264 - DNA, 601 bp, Human
ctgtgtctcaaagaggcggacgtgcccaccctggccacacagcctgggactcagcctgccacctcctcgggcttcctttctggcccaagaccttgattgaagcagatcaaaactaagcatgggatcaaaacaacacagtttgattcatctttaggtagaatttcattcaccttctactaaagtcaaacaacacatcttctccctgaaaagtgagcagagggcggttttaagacgtaagccctctgtttcctccaaaaccagccctgaccattgtctcctcagccagccacttcttcaaggrcctctcatggccgggccccaccagtcaggcccagccgaggccctgccttccaccacccctgggccctgggagctcctgctcctgggggcctcccatagcctcggcctcaaggcctctcagaggatgggtgtttctgaatctttcctagtggcacgttcatccctcacaaatctctgcatctttctgacttttgttttacacagttgaatatccatgtggaaaaatacctattctagaaaaaagaaatgccagcaaaccccaaggccgaattgtggggggcaaggtgtgccccaaagggga

SEQ ID NO: 107265 - DNA, 601 bp, Human
caggattccaagccctgagggtcttgaagccttttgaatgtgaacaacagctctggaagggaaaatgggcaggtcagccccaagcccaccaggctccaagtcagcacacctagcacctccagctcgcggcacccccatgcttttagtggggcaaggaaggagaaaagaaaacgacactcactgagggtctaccctgtgcagagaaccctgcgagatgccccatccgagttgtcacgtcgtcctcacggttactctttgaggtgggatctttgcctgatctttgcaaaatcaggagcattgratcaaagctatgtgaagatcctgtgaggtgaacagtgaaatctcacagcgacatttgtattcttgggccgtgcccaagagcacgtctcggctagagaggggcacagcctcccagagccaggtctgagcagctttgcctgggagggatctgcaaagaccccaggatttcagaaagaaattgtgcaatgccagaggttccttggcatgcccgggagggcgagtcatcagagaaacaatgacagcaatgtgacttccacacctcctgtccccccgcccaggtcctgttgttggtgaatggagc

SEQ ID NO: 107266 - DNA, 601 bp, Human
gctgagcgcggcgctgcggaccctgaaggtgaggagcaacggggcctcgcgggtccgggcttcactgggcttctagccgtgccgcctctgggcggctggcgccgggagagcgctggctgggtccggctgcccccgcgccccggttccgcatcagctacaccgcttgctttcctccctcccggagttcgcgtggcagcgggctcaggaggcatccctcgttgcagctgttcctcgcggggatcctgcggagcagagaggcctagggcagaggcagttgggtgcccgcacgccctccgaggcrgctgatggctttgggcaggcatattgctcgaggtctgcttccagggccccgcggcattggctttgtcttaagctttccagggtgtctttttaggtgtccttatagtttccgtgttctgttgcctctttccagcatttttgaagggacactgtgaactgttgcttaagtagtgttagggttgtgagtttgtcttatcttttaaagtattataccatgtcaggactgccaatagattttacgtttcatttgaaagcctgttttaattgtatgacaccccagtctactgtgtaccaaatgcat

SEQ ID NO: 107267 - DNA, 601 bp, Human
gctatagtgccaataagtggcaaacaggatttagaactccagaacctgtgctcttaatcatactatgctatctacggtaagggagtgttttcctttggaactgaaaattgagacaagttttgaaggatgaagtgaccttttctaacaaacagaggagatgaatgttataggtgagagagcagtgtatgcaaaggtcctgtggccagagggaatgacaggttagaagaactgaaaaaagcctacagaggctctgatgcagagagtagatggtgttggggaagctggcaggagtcagaccatgtggctcttatagatcacattatgaggtttggtgtttgtcttagagcagtgggaagacattgatgttggaggtgggagggatgacactgacattttagattggagaggctgagaggaaggctgttactgtacttactgttgtacacttgttatacacttactgtgtaatacatacgctttgatgattcttacctggttttttccttttaatgtgttggcagagactgcatcttgtctatttctgtgttcttagtacaatgtttgacacaataggtgctgaatgtgtaacaatagagtagca

SEQ ID NO: 107268 - DNA, 601 bp, Human
taggaaagaaatttcaagaagtagttagcattcattcattcatttgtctagagatctagctctttactcagaaagtgtttgtggagcattttctaagttccaggtactatggcacgtacagaggagagaaaaagaaattaaaacatattccctaactatgtcccaggtgcagagaggctaaggaataaaagattgatgaggccaggtgtggtagctcacgcctgcaatctcaaccctttgggaggccaaagtgggaggatttcttgagctcaggagtttgagaccagcctaggcaacatartgataccacccccacccccggctatctctacaaaataaaataaaataaaataaaaattagctgggtgtggtggcacgtgcctgtggttctaggtacttgggaggctgaggagggaggatcacttgagcccaggaggtcaaggctgcagtgagctgtgatcacaccaatgtactacagcctgggtgacacagcaagaccctgtctcaaaaaaaagtctgggcacgatggctcatgcctgtaatcccagcactttgggaggccgaggcaggcagatcacctgaggtcgggagttcaagacca

SEQ ID NO: 107269 - DNA, 601 bp, Human
aatcaaggcatgagcagggccatgcttcgcctgaaggctctaggggagaatcctttcttgcctctttgagcttctggtggctgcattcattccttggcttgtggctgcatcactccagtctctgcctctgtcttcacatggctgccttctcctcctccttcttgtgcgtctttccctctcattcttttataaagacacttttcattggatttagggccatgacaagatctaggatgatttcatctcaagatccttcactttgttgtattggcaaagacactttatcacaggttccaggacrtggacacatcattttaggggctatcgttcaattcacctacacgtagtatgtgtcagacactacttagagctgggaatataattgtgactgtttctgctcccattgtggttacatttgagtaaggagactgtgctcgtataaatagaaaagttcagagagtgagaagtgctctcgaaggaaaaagataggttaatgggatagagagtggtagtggtgctgagttggggatgttacctaatgagaccatgggggacatttctgagcatgtggcatttggacaggaaactgagccagccagcc

SEQ ID NO: 107270 - DNA, 601 bp, Human
ttcgaatacttatgttaacaaagtaaagcaaagaggccaaggtgggaggatcgcttgaggccagcagttcaagaccagcctggggaaaatagtgagaaccccccagccgcccagtctctacaaaaaataaaaaaattagtggggcatggtgacatgcatccatagtcccagctattcaggaggctgaggtgggaggattgcttgaatgcaggagttcaaggctgcagtgagctatgatcctatcactacacttcagtctgggcaacatagtgagatcctgtctcaaaaaaaaaaagtacartgaagctaggtgtggtggcagggatgtgtagtctcagctacttaggaggctgaggtgggaagatcatttaagcctaggagttagaggctgccatgggctataattgtgcctgtgagtagtcactgcagtccagcctgggcaaacatagtgagacccccatctcttaaaaaaacaaaaaaagtaaaataaggtgaaattaatatattttacttaatatattcaaatattcaaagtattatttgaatatgtaaatgtaaaaattcactaatgaggtcttttacattttctgggtactaagtt

SEQ ID NO: 107271 - DNA, 601 bp, Human
atggggaagaatggcctggcggaagagtcaagggtgggatgatggagctctagagttgacatgtatagtttcctggtgcttgagcttagtacagaggcagagcccagagaatcttgagtcttgaacatctctctcaaatattaggtgttcaacttggcttttggcagacactgaagattggaatggtctctaagatcctgaagactaaatagtctatttgaaagaaaagctgtgcttccaggaaaaagccagacctaattaagtgtcttcagagaagggcatgggctctgttacaatgcaygatgaaataccgtgtcataatacatggataagaccttcacctggaattttagagatgaagcaagatgaagtaaactaatgtttactttgaccttggtgagatcattttatagctccattaacccagttttgaggatagtttcttctttgaagcagaatgcattctgataatgaatttatctcataatgagttatttagtattattcatctgaatgctactgcgggtatgttaacaacagtagttttggttttggcagaaatagtgttcagattgttctttaagatatttgccagtggatt

SEQ ID NO: 107272 - DNA, 601 bp, Human
gtggatttaccagttttaactgccacgtgaggccacatcttgcttatgaaagtaggtgctatctaatcttttttttttttttttttttgagatggagtcttgctctgtcacccagactggagtgcagtggcgtgatctcggctcactacaacctctgcctcccgggttcacgccattctcccgcctcagtctcccgagtagctgggactacaggcgcctgccaccacacccggctaattttttgtatttttcgtagagacagggtttcactgtgttagccaggatggtctcaatctcctgwccttgtgatccacctgcctcggcctctcaaagtgctgggattacaggcgtgagccactgtgcccagctggtgctatctaatcttaagaaaggatttttttccagccactgcaaacaggatttgtttccctgtttgcagtggctggaaggcatgcatccagtttgtctaaaagcctaccatttcccccgctttttgtgtaagttattgtgtgctgatgataatatatgcaagactgtgctagccatgttagacattctcatttaatcctcatagcagcattatgacctagataagtactat

SEQ ID NO: 107273 - DNA, 601 bp, Human
tgcttatgaaagtaggtgctatctaatcttttttttttttttttttttgagatggagtcttgctctgtcacccagactggagtgcagtggcgtgatctcggctcactacaacctctgcctcccgggttcacgccattctcccgcctcagtctcccgagtagctgggactacaggcgcctgccaccacacccggctaattttttgtatttttcgtagagacagggtttcactgtgttagccaggatggtctcaatctcctgaccttgtgatccacctgcctcggcctctcaaagtgctgggwttacaggcgtgagccactgtgcccagctggtgctatctaatcttaagaaaggatttttttccagccactgcaaacaggatttgtttccctgtttgcagtggctggaaggcatgcatccagtttgtctaaaagcctaccatttcccccgctttttgtgtaagttattgtgtgctgatgataatatatgcaagactgtgctagccatgttagacattctcatttaatcctcatagcagcattatgacctagataagtactattattatccccagtgtacaaatgaagaaactttctatatat

SEQ ID NO: 107274 - DNA, 601 bp, Human
tctgtcacccagactggagtgcagtggcgtgatctcggctcactacaacctctgcctcccgggttcacgccattctcccgcctcagtctcccgagtagctgggactacaggcgcctgccaccacacccggctaattttttgtatttttcgtagagacagggtttcactgtgttagccaggatggtctcaatctcctgaccttgtgatccacctgcctcggcctctcaaagtgctgggattacaggcgtgagccactgtgcccagctggtgctatctaatcttaagaaaggatttttttccrgccactgcaaacaggatttgtttccctgtttgcagtggctggaaggcatgcatccagtttgtctaaaagcctaccatttcccccgctttttgtgtaagttattgtgtgctgatgataatatatgcaagactgtgctagccatgttagacattctcatttaatcctcatagcagcattatgacctagataagtactattattatccccagtgtacaaatgaagaaactttctatatatctaggaaatgtcagagccaagatttgaatccaggtcagaatctgagtctagaccagaactctt

SEQ ID NO: 107275 - DNA, 601 bp, Human
gccacttcctatgtgccaagccattttcaggcatttcttttctatgtgtggaaaatacaggaaatcattattcctgtgggagagaaccagtggcaatatgttactggggagtcattttgcacacgctgacctctctcattttggctgtgattggctagcctttataaacagaattgattaaagttctttctcagaacctttgttgctaggaaataccttacaaagaattttggactgggcgtgtagccagtttgttacatgcttaacaaaaacaacaaacgttaaaattctgtgtagaggkccaaattagcagacttctacaaacgttttccttcatttagaaaataaactttatgttgtggctttacacaaatggtctgagtgttgacctgattcttcatttttgaccttccatgaatgtctcccaggaggaaacaggaacagagcctttatggggctcattccaaaccagttcagacttgtcgtgggaatggttcacattggtagttgttctgttatagttgtgtttgcttgtacgagttctacttcttctttttttttttttgttgagacagtgtttcgctctttttgcccaggctgg

SEQ ID NO: 107276 - DNA, 601 bp, Human
tgttacatgcttaacaaaaacaacaaacgttaaaattctgtgtagaggtccaaattagcagacttctacaaacgttttccttcatttagaaaataaactttatgttgtggctttacacaaatggtctgagtgttgacctgattcttcatttttgaccttccatgaatgtctcccaggaggaaacaggaacagagcctttatggggctcattccaaaccagttcagacttgtcgtgggaatggttcacattggtagttgttctgttatagttgtgtttgcttgtacgagttctacttcttctttttttttttttgttgagacagtgtttcgctctttttgcccaggctggagtgcaacggtacaaacttggctcactgcaacctcggctcactgcaacctccgcctcccgggttcaagcgattctcctgcctcagccatccgagtagctgggattacgggcatgcaccaccatgcccagctaattttgtatttttagtagagatggggtttctccatgttggtcaggctggtctcgaactcccaacctcaagtgatctgcccgcctcagcctcccaaagtgttgggattacaggcatgagcc

SEQ ID NO: 107277 - DNA, 601 bp, Human
ggaattgccactgtttttcttatctagaaataaaaaatttcagaaagctcttgaccaatctgtggttaaatcttataaccattacagcctcagcctgtgacctttgaaaagttaaagtccttgggactcaactttgtcataaaattggggataatactcttgtaactcacagttatgcttgaaggaatatatgagagatagtcttgatctttaatagggacacagtaataatttcccgttcacagttccttcttgttcttggtcttttacttggtaaaggttttattttataaactatatstttttgtatcttttacctccacttttatacagagattacattttttaaattaattaaataattaattaattttttctgaggagtttcgctcttgttgcccaggctggagtgcaatggcaggatctaggctcacagcaacctccacctcctgggttcaagcaattctacctcagcctcctgagtagctgggactacaggtgtgtgccaccatgccccgctaatttttttgtgtgtgtttttagtagagacgggatttcgccattttggccagtctggtcgcaaactcctgacctcaggtga

SEQ ID NO: 107278 - DNA, 601 bp, Human
attttataaactatatctttttgtatcttttacctccacttttatacagagattacattttttaaattaattaaataattaattaattttttctgaggagtttcgctcttgttgcccaggctggagtgcaatggcaggatctaggctcacagcaacctccacctcctgggttcaagcaattctacctcagcctcctgagtagctgggactacaggtgtgtgccaccatgccccgctaatttttttgtgtgtgtttttagtagagacgggatttcgccattttggccagtctggtcgcaaamtcctgacctcaggtgatccacctgccttgacctcccaaagtgctaggattacaggcatgagccatggtgcccgactctttaaaaaatagttgtacaaatttttcagttcatttaaaaatgttgctataagaacattttgtttcttatttgagtcgttatcatcttagaaagttctaagaggtggtacctgttggttgccttttgctggtttttttcctccatttttttccttctagctttaacagtgactactgggaagttctctctctgtctctgtctgtctctctgtatctctctatc

SEQ ID NO: 107279 - DNA, 601 bp, Human
tattatgttctggccactgttaaatttgaagctccttgagaccaagactctcgttttgtgtttttaaaagttctgtgtggtctgtgacatttctgaccctgctctatccttttgaatgatcagaaaggctttcttcaaatttgcttggcccctcgacaattcttgttttgcttttctggagatcgttttgatgcttttggtttctcttacataccaaggggctgtgtctgtagatatgatttcccttttgtaattatatttatggtatattgcctagaactacatttattgatcagacacrttcgctagaacctaactggaagaaatatcctgaaaaaatgttctaaagcccatcaagtatttgcaatttattttgctttcctttttttgtagcatgttctgtactattcaagacagtgcttaatggtgtcccgtaatcttggttcagtgggatatgatcctaatgaaaaagtaagtatttaaaagatattctcaacaactaaattaaacttatcatggttttactttctcgtctccacactgtgttcagtggacagatgagattttgttaaggctgtgtggtcattgatcactctagcat

SEQ ID NO: 107280 - DNA, 601 bp, Human
tgtcatcaaaatacaactgacaggaatgattatttgagaatgacatgtctgaggtatcttctgaatcatgtgctgaagtgcgcaatactgctttccagattcttttgaatctggaggcctggaggaagaaagagtctacatatcttcagttcagtagaaatacaatgtgaaacacagttgcagggtgatatggtttggctctgtccccatccaaatctcatctcgacctgtaatccccatgtgttgagggagggaggtgattggatcatgggggcagtttcttccatgtttttctcatgayagtgagttggttctcacaggatcttaagatcttacaagtgtttggaagttcctcctttgcactactctcccctgctgccttgtgaagaagggtcctgctttccttctgccatgattgtaagtttcctgaagtctccccagccatgcggaactgggagtcaattaaacctttgtttataaattacctagtcttgggtagtatcttcatagcaatgtaaaaaccaattaatacacagggcaaatgtgattttcaattttcctttttattttttatttttgagatggagtcttgctctgtcac

SEQ ID NO: 107281 - DNA, 601 bp, Human
cgcaatactgctttccagattcttttgaatctggaggcctggaggaagaaagagtctacatatcttcagttcagtagaaatacaatgtgaaacacagttgcagggtgatatggtttggctctgtccccatccaaatctcatctcgacctgtaatccccatgtgttgagggagggaggtgattggatcatgggggcagtttcttccatgtttttctcatgacagtgagttggttctcacaggatcttaagatcttacaagtgtttggaagttcctcctttgcactactctcccctgctgccytgtgaagaagggtcctgctttccttctgccatgattgtaagtttcctgaagtctccccagccatgcggaactgggagtcaattaaacctttgtttataaattacctagtcttgggtagtatcttcatagcaatgtaaaaaccaattaatacacagggcaaatgtgattttcaattttcctttttattttttatttttgagatggagtcttgctctgtcacccaggctgtagtgcagtggtgtgatcttggctcactgcaacctccacctcccaggttcaagcaattctcttgcctcagcc

SEQ ID NO: 107282 - DNA, 601 bp, Human
tgtcttatgtatgttcatgagaataaggaagatttaacttatggtagcttgcttggatcaagaccattaagtttcagttggccttaagttagtgtgagccagtacagtactgtgttgttcctgtcacactgatgtgagctggctgggctcagtggcttacgcctacagtccctgcgctctgggaggccgagacacgggattccttgagaccgagagttccatatcaacctgggtaacagagcaaaaccccgtctcttaagaaaaaaaaaagtgatcttaggtgttattaataacatagtgwttagagcttgcattgttatactctgattacattatatcatgatatttctgacatgaatacctggatgtgaactctctgactttgccactagtgaactttgtaagtgatttaaggcaagtgatttggcctcatcaagccttagttttcttatttgtaaaacggagatattatcagaactgacttcgtgggattattatgctaaatattgtcatcatagccattacctgatagatgagataatgcacagaagggattcatcacagtgcctgctgtatacaaaacgtgtcctaagtgtcggct

SEQ ID NO: 107283 - DNA, 601 bp, Human
tagttgttttttcctgagtgtcttcagggtgccttatgagtgactctccacatataggatcaagtcccagttccttgaatggcatatgagtccttccatcatctggacttttttttatcctagctttatttgctacaactctcctaagcataccatgcgcttcagtcatattgagaattccttgtagttgcttagtgctaccctcttcttccagtgtcacggcctttacacatgctgttcatgtgctcccttctctgtgtgtagcatcctgcacaaagccttattagagcatttaacacartttgttgtgtttgtgccatattttactttgaagttgccaaatgcacttgatatttacctgtaattgttgatgcagaggggcagttttaaggttgggtttaattgatttgtatgcatattcttttataggcatagcctacctggaagaatatataggagaccagtaacagtggttgccttttgggcagggacttgggtgtctcttcagtgtatccccttttgtactttaaaaattctgaattatatgcatctatgatttatttagaagaaaattttatgtatggaagattaattgatatga

SEQ ID NO: 107284 - DNA, 601 bp, Human
aggggcttggctcgggttggaggagttaagacatatatgatgtaaaggttaaaccaagacctagcaagcttttttcacttctgagattctggactttttcctgtatgttaaaatactgctctaggccgggtgtggtggctcaggcttgtaatcccagcactttgggaggccgaggcaggcggatcacctgaagtcaggagttcgaggccggcctgaccaacatggggaaaccccatctctactaaaaatacaaagaaattagccgggcttggtggtgcgcacctgtaatcccagctattargaggctgaggcaggagaatatgttgaacctgggagacggaggttactgtgagctgagatcgtaccactgcactccagcctgggcgacagagtgagactccatctcaaaaaacaaacaaacaaacaaactgctctaggttatataagagtactttttaaaaggtcatttataactctaactcttcttttagaaatataactgacactttttttctgtagttccgttgaacttaaaaataattcacaaatacagaaattaccgtgtgctaatgtgtattacatccaaattacttggaatggt

SEQ ID NO: 107285 - DNA, 601 bp, Human
atatgttctgagaaatgcatcgttaggtgaattcaatattgtgtgaccatcacagaatgtacttacacaaaccttgatgatacagcctagtacacacctatatagtatagcctattcctcctgtgctacaaacctgtgcagcacgtgactgtactaaatactgtaggcaattgtaacacaatggtaagtatttgtgtatataagtgtatctaaacacagaaaaggtacagtaaaaatatagtataaaagataaaaaatggtacacttgtatagggcacttactgtgaatggagcttgcagsactggaagctggtctggatgagtcagggagtgatcaaaggcctaggacattaccgtcactactatagacttcataaacactgtatacttaggctacacgacatttatagaaaaatagttttctttcttcaataataaattaaccttagcataccataacttttttaaattataaacttttaaattttgtctttactctttgactctttctttttttttttttttgagacagagtcttgctctgttggccaagctagagtgcagtggcgcagtcttggctcactgcaacctctgtctcccg

SEQ ID NO: 107286 - DNA, 601 bp, Human
taaacacagaaaaggtacagtaaaaatatagtataaaagataaaaaatggtacacttgtatagggcacttactgtgaatggagcttgcagcactggaagctggtctggatgagtcagggagtgatcaaaggcctaggacattaccgtcactactatagacttcataaacactgtatacttaggctacacgacatttatagaaaaatagttttctttcttcaataataaattaaccttagcataccataacttttttaaattataaacttttaaattttgtctttactctttgactctttctttttttttttttttgagacagagtcttgctctgttggccaagctagagtgcagtggcgcagtcttggctcactgcaacctctgtctcccgggttcaagccattctcctgcctcatcctctccagtagctgggattacgggcatgtgtcaccacgctcggctaatttttgtatttttagtagagacggggtttcaccatgttggccaggctggtcttgaactcctgacctcaggtaatccacctgctttggcctcccaacgtgctgggattacaagcgtgagccaccacgcccggtttact

SEQ ID NO: 107287 - DNA, 601 bp, Human
gtatagggcacttactgtgaatggagcttgcagcactggaagctggtctggatgagtcagggagtgatcaaaggcctaggacattaccgtcactactatagacttcataaacactgtatacttaggctacacgacatttatagaaaaatagttttctttcttcaataataaattaaccttagcataccataacttttttaaattataaacttttaaattttgtctttactctttgactctttctttttttttttttttgagacagagtcttgctctgttggccaagctagagtgcagtggygcagtcttggctcactgcaacctctgtctcccgggttcaagccattctcctgcctcatcctctccagtagctgggattacgggcatgtgtcaccacgctcggctaatttttgtatttttagtagagacggggtttcaccatgttggccaggctggtcttgaactcctgacctcaggtaatccacctgctttggcctcccaacgtgctgggattacaagcgtgagccaccacgcccggtttactctttgactctttcataataaaacagcataaaatgcaaacactgtataactgtacaaa

SEQ ID NO: 107288 - DNA, 601 bp, Human
cattaccgtcactactatagacttcataaacactgtatacttaggctacacgacatttatagaaaaatagttttctttcttcaataataaattaaccttagcataccataacttttttaaattataaacttttaaattttgtctttactctttgactctttctttttttttttttttgagacagagtcttgctctgttggccaagctagagtgcagtggcgcagtcttggctcactgcaacctctgtctcccgggttcaagccattctcctgcctcatcctctccagtagctgggattacrggcatgtgtcaccacgctcggctaatttttgtatttttagtagagacggggtttcaccatgttggccaggctggtcttgaactcctgacctcaggtaatccacctgctttggcctcccaacgtgctgggattacaagcgtgagccaccacgcccggtttactctttgactctttcataataaaacagcataaaatgcaaacactgtataactgtacaaaaatgttttctttatatccttattttataagcttttttctgtttttaaagttttttatttttcatttatttttgactttttg

SEQ ID NO: 107289 - DNA, 601 bp, Human
cactgcactgtagcgtgggcgaccaggcgagactatgtccaaaggaaaataaaaaggggcaaaagatctgaatagtcatttctcaaaagaagacatacaaatcacaaacaggtatatgtaaaggtgctcgacattactgatcattacggaaatgcaaatcaaaagtacaatgagataaaatcttaccccggttaaaacggcttttatccaaaagacataacgagtactggcgaggatgtagagaaagaaccctcatatgctgttggtgggaatgtaaattaatacaaccactataaagaayagtatggaggtttctcaaaaaactaaaactatcatatgatccggctgctagatgtacatctgcttctaggtgtacacctagcaccagggaaatcagtatatggaggagatatctgcactcccatgtttattgtagcatttttcacaatagccaagatttggaggcaacttaagtatccatcaacagatgaatggataaagaaaatgtacatatgtacggtaccattcagccatagaaaagaatgagatcttgtcatttgcaatagcatggatggaactggtggaggacatgttaagtgaa

SEQ ID NO: 107290 - DNA, 601 bp, Human
caatgagataaaatcttaccccggttaaaacggcttttatccaaaagacataacgagtactggcgaggatgtagagaaagaaccctcatatgctgttggtgggaatgtaaattaatacaaccactataaagaatagtatggaggtttctcaaaaaactaaaactatcatatgatccggctgctagatgtacatctgcttctaggtgtacacctagcaccagggaaatcagtatatggaggagatatctgcactcccatgtttattgtagcatttttcacaatagccaagatttggaggcarcttaagtatccatcaacagatgaatggataaagaaaatgtacatatgtacggtaccattcagccatagaaaagaatgagatcttgtcatttgcaatagcatggatggaactggtggaggacatgttaagtgaaataagccaggcacagaaagacaagttttgcatgtactcactcatttgtgggagctaaaaatgaaaacaattggactcatagagagagagtagaaggatggttaccagaggcttggcagggtgtatggagcgggaggggtggggatgattaatgagtacaagaatata

SEQ ID NO: 107291 - DNA, 601 bp, Human
cgaggatgtagagaaagaaccctcatatgctgttggtgggaatgtaaattaatacaaccactataaagaatagtatggaggtttctcaaaaaactaaaactatcatatgatccggctgctagatgtacatctgcttctaggtgtacacctagcaccagggaaatcagtatatggaggagatatctgcactcccatgtttattgtagcatttttcacaatagccaagatttggaggcaacttaagtatccatcaacagatgaatggataaagaaaatgtacatatgtacggtaccattcagscatagaaaagaatgagatcttgtcatttgcaatagcatggatggaactggtggaggacatgttaagtgaaataagccaggcacagaaagacaagttttgcatgtactcactcatttgtgggagctaaaaatgaaaacaattggactcatagagagagagtagaaggatggttaccagaggcttggcagggtgtatggagcgggaggggtggggatgattaatgagtacaagaatatagttagatggaataaataagatcttgtatttgatagcacaacagggtgactacagtctgcagta

SEQ ID NO: 107292 - DNA, 601 bp, Human
gaaaataactcattattctataatatcatgtaatatgcctaccacattcaggtttttccagttgaccccagttgtcctttttaatatttttctttgatccacagttcaatcaaggttcatgagttacatttgtttattatacctctttagtctcttaatctaaaatagtgcccctattctccctctttttttgtttgatttttattatgttggcttttagatattttggctttgtatggaatctattttctcatgaatagattcagattaaatatttgacaagactacttcataagtgatrttctttctttttttcttttttttgtgacagagtctctctcagttgcccgggctggagtgcagtggtgagattataactcactgcagcctgacttcctgggcacaagcgatcctcccaccttagtttcccaagtagttgtgactacaggtgcatgccaccacgcctggctgatttttgtattttttgtaaagatggggtttcaccatctttcccaggctggtcttgaactcctgggctcaagagatcctcttgccttggcctcccaaagtgctaggattacaggcgtgagccaccgtaccc

SEQ ID NO: 107293 - DNA, 601 bp, Human
ttctttgagaaataaagactgatctagagcagtcttaaagtcaggctttccctaggaaaacaattcatttataatgatgagattaatgtgcctgaatccaggggatgaggctatagggaagcagtataaaatactccaatgggaattggtcagggcaggagaaagcaaaatgggagttaagcctcttattaagtcatgaatttttttttatgtttcattttccaggccctaggaaagcacgcttattattctctgggaagatttgtggagaatagtttatgaagagaagacaattctagtkcaagaatgtaaccagctgggattttgattgatattgcattgtgtctgtagatcattttggagtgtatagctatctcaacgtttttaagtcttcctatccatgaacatgtgatattcttccatatttaggtcacttggatttctttcagcaatgttttgtagtttcatactactataagtgtaattagttttttaatttcaattttttaaattagttgcaagtctgtagaaatacaaatgattttcatataatgattttgattcctgtaaacttgctgaactcttttattagttctaatag

SEQ ID NO: 107294 - DNA, 601 bp, Human
gtcagtgtatcttcagttttaccttagatgtatatagagatgaaagcaacttaaatgtgaaaacctcaaacgcattttttctcctttacatgatttcagaatattttcaaactttttctgtttggaaaggagttaaggttcttaattaaacattttctttttaatttcacaaaaattgttaatggacttgtttggagctgatgcctatcactgatcctcaaataggagcaaatgactaaagtcaggcttggaaaacttttttggggtgttaactgaaaagtatcaggtgaccttttatttgtgtgtgtgtgtgtgtgtgtgtgtgtgtgtgtgtacttgagaatgttatatttcagtaacattttcttaaactgccttttcttagtaaaggatattttaagatgatggctgtcctggtccatgtttcacagttggtcttaattagatcagaaatatttccagacatttaggttgcaataggaaatctataggattcttaatttattcttacaaaaggtatttatagttgccattcttcaatattaactttccttatcaacagcaaaaagtcttacggcaaagcctctggagagtgactgca

SEQ ID NO: 107295 - DNA, 601 bp, Human
gtatcttcagttttaccttagatgtatatagagatgaaagcaacttaaatgtgaaaacctcaaacgcattttttctcctttacatgatttcagaatattttcaaactttttctgtttggaaaggagttaaggttcttaattaaacattttctttttaatttcacaaaaattgttaatggacttgtttggagctgatgcctatcactgatcctcaaataggagcaaatgactaaagtcaggcttggaaaacttttttggggtgttaactgaaaagtatcaggtgaccttttatttgtgtgtgtgtgtgtgtgtgtgtgtgtgtgtgtgtacttgagaatgttatatttcagtaacattttcttaaactgccttttcttagtaaaggatattttaagatgatggctgtcctggtccatgtttcacagttggtcttaattagatcagaaatatttccagacatttaggttgcaataggaaatctataggattcttaatttattcttacaaaaggtatttatagttgccattcttcaatattaactttccttatcaacagcaaaaagtcttacggcaaagcctctggagagtgactgcagtactg

SEQ ID NO: 107296 - DNA, 601 bp, Human
atcttcagttttaccttagatgtatatagagatgaaagcaacttaaatgtgaaaacctcaaacgcattttttctcctttacatgatttcagaatattttcaaactttttctgtttggaaaggagttaaggttcttaattaaacattttctttttaatttcacaaaaattgttaatggacttgtttggagctgatgcctatcactgatcctcaaataggagcaaatgactaaagtcaggcttggaaaacttttttggggtgttaactgaaaagtatcaggtgaccttttatttgtgtgtgtgtgtgtgtgtgtgtgtgtgtgtgtgtacttgagaatgttatatttcagtaacattttcttaaactgccttttcttagtaaaggatattttaagatgatggctgtcctggtccatgtttcacagttggtcttaattagatcagaaatatttccagacatttaggttgcaataggaaatctataggattcttaatttattcttacaaaaggtatttatagttgccattcttcaatattaactttccttatcaacagcaaaaagtcttacggcaaagcctctggagagtgactgcagtactgca

SEQ ID NO: 107297 - DNA, 601 bp, Human
tatcttcatgtatgacttattcatttgtatgttcatgtaccttgctatttaaattcaataaaaccatccagctttttttaatctgtgggaagtgacttgtggatattttcttttataaaacgttaaggagatgtcttaagactttctgaattttttgttaataacttatactgaagttactttttacttatactaaaattttaaattaagaaaaaagtgaaatattgtattaatatatctttttggttttgtttattttataatttctggtaaacttaaacaacatggttttaaagggaayttatgtatttcagtgtaattagtacctgctgttatgaaaaagcacctaatcatggatttatttttctctaagcagctatttgggaaggatcagaagtcctatcttactgaaaaagcatacatataataaaagatttgagggccgggcgtggtggctcacgcccgtaatcccagcactttgggaggccgaggcaggcggatcatgaggtcaggagatcgagaccatcctggctaacacagtgaaaccccgtctctactaaaaatacaaaaagttagccgggcgtggtggtgggtgcgtgta

SEQ ID NO: 107298 - DNA, 601 bp, Human
aataacttatactgaagttactttttacttatactaaaattttaaattaagaaaaaagtgaaatattgtattaatatatctttttggttttgtttattttataatttctggtaaacttaaacaacatggttttaaagggaatttatgtatttcagtgtaattagtacctgctgttatgaaaaagcacctaatcatggatttatttttctctaagcagctatttgggaaggatcagaagtcctatcttactgaaaaagcatacatataataaaagatttgagggccgggcgtggtggctcaygcccgtaatcccagcactttgggaggccgaggcaggcggatcatgaggtcaggagatcgagaccatcctggctaacacagtgaaaccccgtctctactaaaaatacaaaaagttagccgggcgtggtggtgggtgcgtgtagtcccagcttctcgggaggctgaggcaggagaatggcgtgaacctgagaagcagagcttgcactgagccgagatcgcgccactgcacttcagcctgggcgacagagctagactccgtctcaaaaaacaaaaaacaaaaaaaaagatttgatatacagtt

SEQ ID NO: 107299 - DNA, 601 bp, Human
cagcactttgggaggccgaggcaggcggatcatgaggtcaggagatcgagaccatcctggctaacacagtgaaaccccgtctctactaaaaatacaaaaagttagccgggcgtggtggtgggtgcgtgtagtcccagcttctcgggaggctgaggcaggagaatggcgtgaacctgagaagcagagcttgcactgagccgagatcgcgccactgcacttcagcctgggcgacagagctagactccgtctcaaaaaacaaaaaacaaaaaaaaagatttgatatacagtttaccttattctrtgttccagtgtttctaaggccatgacttaactcatttttacagcctccctcattcagactccttagtggagggaaaggacatgattattccaaataatgcctctcactcattcagaatctatggtgtactggaaaagcacataattacataaggattgaattactgttactgttttaaattgagaaaattggggcttcaagtataaagccaatcttcgggttgccaaagatcactgggctagtaagtagtggagctgagattcaaattatgtgtaacttctaagttgtactgtttccact

SEQ ID NO: 107300 - DNA, 601 bp, Human
ttaaaattgttttattttttgtactttctctacccttaccctgaaagatggcattctcttccacttctgtttctgtggttttaatcaaccctagactccaactctgttttctctctctctgtgacgtctctagttgaatgttttaccactacctcaaacccagcattacccaaactgaactttgatccttcgggcttcttgtatctgaatcctcctgcagaagcacaagatgtaggaatttatgttcaccatcattctttctttcatttctcatttccaatttatgagcaagtccttttcrtaaataattttggaatctagtcacctatcttcacttcgttattgcttctttagcaaggtcttttaaaatcttctagtgaatcttttaatcttttagactgataaaattaatttcatctggggcagtttatctaatgtgaactgtttcagtttctgaagttttgtttgatagcgaatgctttcttactctgttttggaattttagttcataggctcttttttctggtgaaagttaaaaatgtttattgctcttcatgcttcatcttctcccttccctttgcttccttgaccttcctcttcc

SEQ ID NO: 107301 - DNA, 601 bp, Human
accttctccctgaccagtagttttgtgggtgcccccccgccggcattttggattcctaatctacatccaggtcttatggtgatagtttggacacatggcagattagtcccagcagcttgttcagattttgaccctgaagctgtggttctgcctccctaggtccacagtctccaggagttgtagtgagctgtagttgcagacaatacttggtggcctcctcttcaggccaagggcagttcctctttggcctggtcttcaccagtggctctggctctcttctcagtcttgtgagaacattctygccatctgtactttgcatttggcacttcctgcttctgaggaaccagccagtggttagcattgttatgcgtttttctcctgttttgagtttgtgaaatgtttaccatttatttctgcttacctgttttcttagttttcctttctgggttttattgtcattgttgtacatttgaagtagagagagcttttgaaatatgaactcactgtgccatcctttttttgtgctaaatttattgaagtccacaaaaaccagagaaaaatgtcagatctcaaaattgtgtttttgctcaatttcaagcat

SEQ ID NO: 107302 - DNA, 601 bp, Human
gcttgttcctgctgctgctcagtggcagctgccaagttggagtagcaaagggaaaagtttagtaggcatcttttaggaagacagaatgctgtctggagatggcagtggtggatttatatctgagtcattcatctgaattggaacctgtacaaaggaaaagaggttctagctcagataaatagatataaattcattgttgctatcttcaggcattcatttatttaattagatgcactgaaaagcactctcgaggtgtggggacagggtgtggtgtatccaatggagagtttgtagaaattgttaagttgaggtacaactgcttataaatagtatttgaaaatgtcttattttgtaaacaactgagtatttagttgattgcaaatcttcctgtaaatcaatgatagattagtttagtttccgggtctatagtatattcctcaaatggatagtaggtatttttgtaaaggggactttataattaaatatagcaaagtgtcttccgtggactgtattaattaaatgttacagatccccaggctgcactgatgaaactcagctgggatgctctacatgtgatagggaaatttggtttcaaaattac

SEQ ID NO: 107303 - DNA, 601 bp, Human
actgtattaattaaatgttacagatccccaggctgcactgatgaaactcagctgggatgctctacatgtgatagggaaatttggtttcaaaattacacaacctatttgtgaaggtttcgtgtaatttttcttttcagtaagaagtgtttccatgtatcagtttttttacatttaaaaaagtaatttattttcaattgtggtaaagtatacataacataaaagtttaccattttaaccatttgttatcaaaagatgatgagatctgtggaggaaaaaatggagagctttattttctatagaraaaacttgcagactggggaggcatagttttcactagtgaaaatgttgctctaaagagaaaaaaaaaggggcttggcttaagtagggaaagttcttgccctcattctctgtgaggtctgtgcaaacgaaggattcaagcttgttcggttcagattgaaccctaatctggtgccagaagtgtctctgtcagatgttccttcgaaaggctggtgcaggggaggtttctgctgcaattcttcttggccccagtcacaggaactgttctggcttaagaacagttcttaatcaagagccgtgattt

SEQ ID NO: 107304 - DNA, 601 bp, Human
tgggagaggacaatactagggcagaatagagcttggtaatttccagaaagttagatagggctaatgtactcttaaacaggaggcctgcattgttgttcacaatgttcacctatatgtagttgtgtttgttttttaaatttttaaaaattatcctatagtaataggatacccatctttcatacccttctgtggatatcagcacatgtgtagattatgtcactactagcacaatcagaatgcagagtagttccattacccctcagactcccttgtgagtcattacccctcagactcccttgtatatcccattacgtgtcacatccttttccaccctgacactggcaaccacggatgtgtttcccatcactatagcattgtcatttccacacagcgtgtaaccttttgagactggctactttcactcagaatatgtttttgtgattcatccaaactgttgtgtgtatcaatagaatgttccttttttattaccgagtagtgttgcattgtgtggatgcacaggtttttttaaatccatttacctgttgaaggacatttgggttgtttccagcttttgacaattatgaatagaactgttgtaaac

SEQ ID NO: 107305 - DNA, 601 bp, Human
ggagaggacaatactagggcagaatagagcttggtaatttccagaaagttagatagggctaatgtactcttaaacaggaggcctgcattgttgttcacaatgttcacctatatgtagttgtgtttgttttttaaatttttaaaaattatcctatagtaataggatacccatctttcatacccttctgtggatatcagcacatgtgtagattatgtcactactagcacaatcagaatgcagagtagttccattacccctcagactcccttgtgagtcattacccctcagactcccttgtgtctcccattacgtgtcacatccttttccaccctgacactggcaaccacggatgtgtttcccatcactatagcattgtcatttccacacagcgtgtaaccttttgagactggctactttcactcagaatatgtttttgtgattcatccaaactgttgtgtgtatcaatagaatgttccttttttattaccgagtagtgttgcattgtgtggatgcacaggtttttttaaatccatttacctgttgaaggacatttgggttgtttccagcttttgacaattatgaatagaactgttgtaaacat

SEQ ID NO: 107306 - DNA, 601 bp, Human
agaggacaatactagggcagaatagagcttggtaatttccagaaagttagatagggctaatgtactcttaaacaggaggcctgcattgttgttcacaatgttcacctatatgtagttgtgtttgttttttaaatttttaaaaattatcctatagtaataggatacccatctttcatacccttctgtggatatcagcacatgtgtagattatgtcactactagcacaatcagaatgcagagtagttccattacccctcagactcccttgtgagtcattacccctcagactcccttgtgtattccattacgtgtcacatccttttccaccctgacactggcaaccacggatgtgtttcccatcactatagcattgtcatttccacacagcgtgtaaccttttgagactggctactttcactcagaatatgtttttgtgattcatccaaactgttgtgtgtatcaatagaatgttccttttttattaccgagtagtgttgcattgtgtggatgcacaggtttttttaaatccatttacctgttgaaggacatttgggttgtttccagcttttgacaattatgaatagaactgttgtaaacattt

SEQ ID NO: 107307 - DNA, 601 bp, Human
aggacaatactagggcagaatagagcttggtaatttccagaaagttagatagggctaatgtactcttaaacaggaggcctgcattgttgttcacaatgttcacctatatgtagttgtgtttgttttttaaatttttaaaaattatcctatagtaataggatacccatctttcatacccttctgtggatatcagcacatgtgtagattatgtcactactagcacaatcagaatgcagagtagttccattacccctcagactcccttgtgagtcattacccctcagactcccttgtgtatcctattacgtgtcacatccttttccaccctgacactggcaaccacggatgtgtttcccatcactatagcattgtcatttccacacagcgtgtaaccttttgagactggctactttcactcagaatatgtttttgtgattcatccaaactgttgtgtgtatcaatagaatgttccttttttattaccgagtagtgttgcattgtgtggatgcacaggtttttttaaatccatttacctgttgaaggacatttgggttgtttccagcttttgacaattatgaatagaactgttgtaaacatttgt

SEQ ID NO: 107308 - DNA, 601 bp, Human
ggacaatactagggcagaatagagcttggtaatttccagaaagttagatagggctaatgtactcttaaacaggaggcctgcattgttgttcacaatgttcacctatatgtagttgtgtttgttttttaaatttttaaaaattatcctatagtaataggatacccatctttcatacccttctgtggatatcagcacatgtgtagattatgtcactactagcacaatcagaatgcagagtagttccattacccctcagactcccttgtgagtcattacccctcagactcccttgtgtatcccgttacgtgtcacatccttttccaccctgacactggcaaccacggatgtgtttcccatcactatagcattgtcatttccacacagcgtgtaaccttttgagactggctactttcactcagaatatgtttttgtgattcatccaaactgttgtgtgtatcaatagaatgttccttttttattaccgagtagtgttgcattgtgtggatgcacaggtttttttaaatccatttacctgttgaaggacatttgggttgtttccagcttttgacaattatgaatagaactgttgtaaacatttgtg

SEQ ID NO: 107309 - DNA, 601 bp, Human
acaatactagggcagaatagagcttggtaatttccagaaagttagatagggctaatgtactcttaaacaggaggcctgcattgttgttcacaatgttcacctatatgtagttgtgtttgttttttaaatttttaaaaattatcctatagtaataggatacccatctttcatacccttctgtggatatcagcacatgtgtagattatgtcactactagcacaatcagaatgcagagtagttccattacccctcagactcccttgtgagtcattacccctcagactcccttgtgtatcccatgacgtgtcacatccttttccaccctgacactggcaaccacggatgtgtttcccatcactatagcattgtcatttccacacagcgtgtaaccttttgagactggctactttcactcagaatatgtttttgtgattcatccaaactgttgtgtgtatcaatagaatgttccttttttattaccgagtagtgttgcattgtgtggatgcacaggtttttttaaatccatttacctgttgaaggacatttgggttgtttccagcttttgacaattatgaatagaactgttgtaaacatttgtgta

SEQ ID NO: 107310 - DNA, 601 bp, Human
gttaaaattggattcctctacctttctttttctccccccatttttccaaaactgcttcagctattctggttcatttgccttttcgtatacattttagaatcagcttatgtttatgtacacacacaaaaaaaatcctgctgagattttgattagaattttgttgaatctacatcagtttgggaagaattgacattttccactgtgttgagtcttccaatccatgaacatggcatgtctcttaatttatttaggttttctttgttggtggtggtattcttagacagggtcttgctctgttgcycaggctggagtgcagttgtgtgatcatagctcactgtaggcttgaccacctgggctcaaacctcccacctcagcctcctgagtagctgggattacaggcttgtgccaccatgcccagctaggtttttaatttttttgtagagacagggtctccctatattgtcaaggctggtcctgaactcctgtgctcaagcagttctcttgctttgggattacaggtgtgagccaccatgcctagcctgtttaggtctgctttgatttctttcattagcatttcatagttttcaatatgcagatcctg

SEQ ID NO: 107311 - DNA, 601 bp, Human
ctctgaatgagagtgtataaaattgttttttttttttttttttgagatggagtttcactcttgttgcccaggctggagtgcaatggtgtgatctcggctcactgcaacctccacctcccgggttcaagtgattctcctgcctcagcatctcaagtagctggggttacaggcgtgcaccaccacgcctggctaatttttgtatttttagtagaggtggggtttctccatgttggtcaggctggtctcaaactcccaacctcaggtgatccacctgtcttggcctcccaaagtgctgggattrcaggtgtgagccacgcgcccggcctataaaattgttcagaattctccagtgaaaccatctgggcctggagatttcttcttcagaaggttttaaatgacgtattcaagttctttaatagttattggagtattcaggttatctatcttattttgagtgtgttttgttagctttgtgttttgccatttttgaggaattggttcatttcatctaaattgtccaatttatgcacatagaattattcttagaaaccttttattatccttttaatatctgcatagtttgtagtgataacctctttcc

SEQ ID NO: 107312 - DNA, 601 bp, Human
tttgttagctttgtgttttgccatttttgaggaattggttcatttcatctaaattgtccaatttatgcacatagaattattcttagaaaccttttattatccttttaatatctgcatagtttgtagtgataacctctttcctttcttattttggatgtcgtttttttcttcttttcttagtctttttagagatttatcagttttattgatgctttagaataactagcttaggttgcattgatgtcttttttctctattttctcttttaaaaattattgatatctcctctgttgtgttcttycttctactttaggtttattttgcttttctttttctggtttgtaaggtaggagcttagattattgatttgagatatatcttcttatttaatactataattttctctctaagcactctaagtgcatctaatatttttttttatatattgtgttttcatttttgttaagaatgttttctgagacttccttttttgcacataggttatttaaaattgtttaatttccaagcatttggagatttttctactgtctttctgttatttatttctaatactaattctctttgttcagagatcatattt

SEQ ID NO: 107313 - DNA, 601 bp, Human
tattgatgctttagaataactagcttaggttgcattgatgtcttttttctctattttctcttttaaaaattattgatatctcctctgttgtgttcttccttctactttaggtttattttgcttttctttttctggtttgtaaggtaggagcttagattattgatttgagatatatcttcttatttaatactataattttctctctaagcactctaagtgcatctaatatttttttttatatattgtgttttcatttttgttaagaatgttttctgagacttccttttttgcacataggttrtttaaaattgtttaatttccaagcatttggagatttttctactgtctttctgttatttatttctaatactaattctctttgttcagagatcatattttgtattattatagtttttttcagtgtgttaagttcattttctgatccaggtatgacctgttttgttgcatgtttcatgtgcacttgtaaagattgtgtcttctgttgttagacttcagtactgtataaatgtcagtgagatacaactggtttgtggtattgtccagttcctctatatccatgccaattttctactacttgtct

SEQ ID NO: 107314 - DNA, 601 bp, Human
tttttatatattgtgttttcatttttgttaagaatgttttctgagacttccttttttgcacataggttatttaaaattgtttaatttccaagcatttggagatttttctactgtctttctgttatttatttctaatactaattctctttgttcagagatcatattttgtattattatagtttttttcagtgtgttaagttcattttctgatccaggtatgacctgttttgttgcatgtttcatgtgcacttgtaaagattgtgtcttctgttgttagacttcagtactgtataaatgtcartgagatacaactggtttgtggtattgtccagttcctctatatccatgccaattttctactacttgtctttcttttgagagtcttgatgtttccaacgatgactgggttattgtctgtttctcctctcagttctgccagtttttgctttatgaagcactgttgttaggaacatacacattaaggattattgtatctttttggtgaattgaccctgttactattaggtaatgttcttctctatcccttgtaaatttctttgctctgaagcctactttttctgatactaacctaggcattcca

SEQ ID NO: 107315 - DNA, 601 bp, Human
gaggttttattaccttgctctgctgttcaaattttgtgtttgtgtccaggacgtgtaaagagcacagagagagcagaaaaaaccttggggttttacctgccctcttgagactgcagtttcactgattgaagaagaatgtttcttctctcattgttttggctcttgctggcatctatgtctgcctctggtaccacagccacaaaattacttgggggttggggcaaaaaagaatagagcaaaaggaaaaaaaatatgggaattgagatttccataatgttgtaagtatcaggagctccctttyctgccttttgagtgagatgaataggggttctcctggagttctctccatcagtgtccccatgcctactttgcatttcaggcttttccaaggtcggtcagggagatcatgggaggaaaagaaaatgataaaactcaccacttgtttatagtaatttgaattcttttcttccttgatctgcctgctactgtttgcttttccaagtctataaatacttgattcgtgcattcttttgaggtttcatagttgaattcagtgggatagttggggtggagcatgcttagtccatcttacctgcagtta

SEQ ID NO: 107316 - DNA, 601 bp, Human
tacctgccctcttgagactgcagtttcactgattgaagaagaatgtttcttctctcattgttttggctcttgctggcatctatgtctgcctctggtaccacagccacaaaattacttgggggttggggcaaaaaagaatagagcaaaaggaaaaaaaatatgggaattgagatttccataatgttgtaagtatcaggagctcccttttctgccttttgagtgagatgaataggggttctcctggagttctctccatcagtgtccccatgcctactttgcatttcaggcttttccaaggtcrgtcagggagatcatgggaggaaaagaaaatgataaaactcaccacttgtttatagtaatttgaattcttttcttccttgatctgcctgctactgtttgcttttccaagtctataaatacttgattcgtgcattcttttgaggtttcatagttgaattcagtgggatagttggggtggagcatgcttagtccatcttacctgcagttagaatggccaggggtgtttcttgaaagctacttagaaaacaaatgtgggaaggaattagcagaatgcatctttgcatcctgtatactatgttgt

SEQ ID NO: 107317 - DNA, 601 bp, Human
tgatctttttattatatacagtttttcttccagtagggcagattttttttttctctagtcttttctcttctgagggccagctgccacctcctataaggtagagtttttctaccttgtgctgtccagatgtttctttttatttgaatttatttatttactcttttacacaaaagaggcatgccaacagctgcactaagtgttctttcctaagccagccagatgtttggacttggagaaaagttagattttgaaataaaagacaggtggattatagcccttcattcaaccattcagtttttcyttgcctattgctgctgccaggtagggtgtctttaacccgtctttatagtacctcttgtcacaaatttagttccagaaattaaaggactaactcctcctgaaatctctatgagatgaaatgagccttctttttttttttttttttgagatggagtcttgctctgtctcccaggctggcgtgcagtggcatgatctcggctcatgcaacctccgcctcctgggttcaagtgattctcctacctcagcctcccgagtagttaggattacaagtgcgtgccacgacatccagctaatttttata

SEQ ID NO: 107318 - DNA, 601 bp, Human
tcatgggctcatgcaatcattctgcctcagcctcccaagcagctgggattacaggtgccagccaccatgtctggctaattaagagaaatttttttttttttttgtagagatggggcctctgtgttgcccaagctggtctggaactcctgggctcaaatgatcctcccatcttggcctccgaaagtgttgggtttacaggcatgagccaccatgcccggccccagatatttctgatgtctttaaatttcataccactgcttggtgaaaaatgactgtgctaaggaaaacttcttgagctccrtaactgcttttcatgattaccttcaatgtctgggagctaactataccaggaagcttttgagtggttgattttgctgctatttgtaatactcatctgatagtttttggtaagaaactaaacagccatataccgtaaatcaagagctgtcctgtcttttgggatcccagcaaaaatattggataatgtgggaaatggaatctgagcccagaaagccagcttttagagtttctaggaatgccatgatgtctgcatagatactaggagaaagatactcaccattaagatacataaatagaggaa

SEQ ID NO: 107319 - DNA, 601 bp, Human
ttagaaagataaatcatgttcagtgatggtgtagtgttgggaaattaatctctaatagtagtgtaagttgacctaagattttaaatgtgtagtttgtggtatttgtatttaaattaaatatttttcttatagaaatatacatatgtatgcagattggcatgtttagggaagcttattgcagcgcacaatacctgcaaattggaaccatgtccaatactaggagaatggttaaataagttatggttcatctagattactagaaatactgggtagcagttaaaaattatgaggtagaattctaaaaaaaaaaaaaactgagtgataaaattagttgtagaataaaatgtagtgtgattcagtttataccaagaaaaatcttaaacatgaaataaaactctgcacctttatttctgcatatccatatgaaaatgcttaggtaagtttggaaggacacatgcaaaactgatcatggctggataacaggaaatgggactaggagcctttaaaacggggcagggaataatggttatctggtatctatactgcttaagctttttttctttttaaccaaaggagtaactcatacattacttgggtaatt

SEQ ID NO: 107320 - DNA, 601 bp, Human
cactttgaaaatcatgtaagttatcttagaagaaaaatagtagtccactaattctaccatccaaaataaccatgaataaatatgtcttggtgctacacatgtagtttttcaaaatggaatcaaagcgaatctttaaaaaaaatcattttgttttctatgatcaaattgcctttctgggaaaggacatgccagaatgttagttttttaaaacttataaaagtatctttagatactttgaatgaaatagaaagagttctattctttttttttttagaaataggattttatctggttgtttgattttttttttttttttcagttattcaaatgaagattgatgcagttggctttcctttaaccttttagtctttcagggtaattttctttctttttttttttgagactcccaacaagtttattattttttaaattgtggtaaaatgcttataaggaaacttgccatcttaactatttttaagtgtacagttcagtggcattaagtacattcacattgttgtgcagccatcactataatctatctccagaactctcttcatattccaaactgaaactctgtacccatttaacagtaactccccat

SEQ ID NO: 107321 - DNA, 601 bp, Human
tagaaataggattttatctggttgtttgattttttttttttttttcagttattcaaatgaagattgatgcagttggctttcctttaaccttttagtctttcagggtaattttctttctttttttttttgagactcccaacaagtttattattttttaaattgtggtaaaatgcttataaggaaacttgccatcttaactatttttaagtgtacagttcagtggcattaagtacattcacattgttgtgcagccatcactataatctatctccagaactctcttcatattccaaactgaaaytctgtacccatttaacagtaactccccattccaggctcgccacagtctctggcaaccactattctactttcaggataattttcattggttagtaatgtttggataatttgattagatttggtggatactgaagactggccgggttatgtaagctgttgctactttcagccaaggagtgcatctagtccgtattacatcatccttggagtgttctacccagtgtcttgcattgaaggacatcagaaggaaaactcctgtattctcagtcgtggtaaatagtgtccacttcattacagatct

SEQ ID NO: 107322 - DNA, 601 bp, Human
ttttttcagttattcaaatgaagattgatgcagttggctttcctttaaccttttagtctttcagggtaattttctttctttttttttttgagactcccaacaagtttattattttttaaattgtggtaaaatgcttataaggaaacttgccatcttaactatttttaagtgtacagttcagtggcattaagtacattcacattgttgtgcagccatcactataatctatctccagaactctcttcatattccaaactgaaactctgtacccatttaacagtaactccccattccaggctcsccacagtctctggcaaccactattctactttcaggataattttcattggttagtaatgtttggataatttgattagatttggtggatactgaagactggccgggttatgtaagctgttgctactttcagccaaggagtgcatctagtccgtattacatcatccttggagtgttctacccagtgtcttgcattgaaggacatcagaaggaaaactcctgtattctcagtcgtggtaaatagtgtccacttcattacagatctccttgagtgataggtttcaaaatatctctaggcatgaag

SEQ ID NO: 107323 - DNA, 601 bp, Human
tgattagatttggtggatactgaagactggccgggttatgtaagctgttgctactttcagccaaggagtgcatctagtccgtattacatcatccttggagtgttctacccagtgtcttgcattgaaggacatcagaaggaaaactcctgtattctcagtcgtggtaaatagtgtccacttcattacagatctccttgagtgataggtttcaaaatatctctaggcatgaagaaacatttccaaacctgcttgtcttctctacctttctcagtatgtactagtttagaaggtattcaaaatstttcactgagaccattgagttttatgctaaatataacatctggcctagcactttttatcactcatatgcaatctatttgataaggacagggaccaaatagaatgtctttttcaatgtattttaggcatctaattgactaatatgaaattttctattaatccagagtttttaaatgcaggcataattcccccccaccccgcccgcaaagattcagtcttgctctgttgcccaggctggagtgcagtggcctgatcggctcactgcaacctctgcctcccaggttcagcaattctcctgcct

SEQ ID NO: 107324 - DNA, 601 bp, Human
ccttatgatctggtggaggagaaattgtaactgtgcaaagcagttaaaatgagattgttgggtagatgagattatatgctaaaatttgcactaactactctcagagtttagattagaggagattcatcctaaattgaagtacttgggaaagatccagtggtagatgtgaaacttggagtccatcttctataataggtggtatctgaggacaataaaacaagtgtggatttaagtttaaacaaagacttaaatgtattctttttaaaggattgtgaagtactcaatttctttcttacagaaraaaactacaatcacaattacaacaacaaaattgacagtaacaggatctgaagtggacagagggcaatagggcaatagaggagggggcatcctggtctgagggcagaagagcaacttgaggttgggggcataccaggcaacgataaccacgaggaaggccttgctttgaacacagggatatttagaagccctttgcaagcagggctgcttttccctacaattggtattattaaataattaccgaatgtatatatttggatattttatagtaagatattgacctgaaaatcccttgggcatt

SEQ ID NO: 107325 - DNA, 601 bp, Human
tacgactctataaatgataggcagaacaatcagatttgcaattttgtgtgtatttgcagatgatggtaattctttttgctgggcgcatctgttaatgcagaaatttgtctcctcaggttcatgtgaaaatggcggatgaggctgtctgtgttggcccagctcccaccagtaaaagctacctcaacatggatgccatcatggaagccattaagaaaaccagggcccaagctgtgagtctgaatgaatctatctactgcagctgtttcatatgtagtgagcagaaagctagagtttgtatttaaaaaaaaaaataggaaagaatgattgaaaatgctgttgcagttagttcatgtcacatgagttaaatgtggtcgaattcgctactggaaatcaaaggctttgtagcatctggcagtgttggttgctgatcctgcaggtggctgctggattcagctttcacaccagggagcagtttcagttcatttccaaatttgctaggaaaaaagaaatcccaattagttttgagtattaaccctttccgtgtaataagagcattttaaaaaattctgtgttataaacaggatccaaagactgtgttcaa

SEQ ID NO: 107326 - DNA, 601 bp, Human
taggcagaacaatcagatttgcaattttgtgtgtatttgcagatgatggtaattctttttgctgggcgcatctgttaatgcagaaatttgtctcctcaggttcatgtgaaaatggcggatgaggctgtctgtgttggcccagctcccaccagtaaaagctacctcaacatggatgccatcatggaagccattaagaaaaccagggcccaagctgtgagtctgaatgaatctatctactgcagctgtttcatatgtagtgagcagaaagctagagtttgtatttaaaaaaaaaaataggaargaatgattgaaaatgctgttgcagttagttcatgtcacatgagttaaatgtggtcgaattcgctactggaaatcaaaggctttgtagcatctggcagtgttggttgctgatcctgcaggtggctgctggattcagctttcacaccagggagcagtttcagttcatttccaaatttgctaggaaaaaagaaatcccaattagttttgagtattaaccctttccgtgtaataagagcattttaaaaaattctgtgttataaacaggatccaaagactgtgttcaaattccattttaataatt

SEQ ID NO: 107327 - DNA, 601 bp, Human
atttgcaattttgtgtgtatttgcagatgatggtaattctttttgctgggcgcatctgttaatgcagaaatttgtctcctcaggttcatgtgaaaatggcggatgaggctgtctgtgttggcccagctcccaccagtaaaagctacctcaacatggatgccatcatggaagccattaagaaaaccagggcccaagctgtgagtctgaatgaatctatctactgcagctgtttcatatgtagtgagcagaaagctagagtttgtatttaaaaaaaaaaataggaaagaatgattgaaaatgytgttgcagttagttcatgtcacatgagttaaatgtggtcgaattcgctactggaaatcaaaggctttgtagcatctggcagtgttggttgctgatcctgcaggtggctgctggattcagctttcacaccagggagcagtttcagttcatttccaaatttgctaggaaaaaagaaatcccaattagttttgagtattaaccctttccgtgtaataagagcattttaaaaaattctgtgttataaacaggatccaaagactgtgttcaaattccattttaataatttaaaaattacttatac

SEQ ID NO: 107328 - DNA, 601 bp, Human
tagtttgttaatgtcagtagaatgctcataatttacaaggataaatcattctctccacccccagttctgtttgaatagagtggaatccaaggaaaaaaatgatttctgatatcagaaacagtgttttttcttctattttcttttttctttttttaattatcagaactaattatatatagtgttaaaaactatgcaaagttatctctaaaactggatggaaacatccaacaccagcaattaagcctggagcgcttcaattagcgctcacatttcttttgaaagaaatgttttagtaagatgmatgtttaaataaaaagcctaattcgtgaacccatattatagatgtttacagtttattagcacagttagtgaaggtaaaacactttaaccttttaactatagcttgccaaaataaatatgtagttgagtgttgataaaatgaagttggtggaatgaaaactcttcttctctgatacagtagtttaaattcttctgtaccatgctcataaagcttagttcagctttttttttgttttgttttttgagatggagtttcgctcttgttgcccaggccagagtgcgatggcgtgatcttggctca

SEQ ID NO: 107329 - DNA, 601 bp, Human
gattacaggtgcctgccaccatgcccagctaattttgtatttttagtagagaaggggtttcaccatgttggtcaggctggtcttgaactcctgacctcaggtgatctgcctgcctcagccttctaaactgctgggattacaggcaggagccactgtgcccagcccgagttcagcatttaaaagtcgctgatacgtagctatttctggattatgatactggttcctttagaaatttgactctctttttagcagaattattttactagaagtatgttcaacactggctgatactgaagtggckaaatttatgtttggccagtctgggagagccaaaaattacttgattggatcaggctggtagattgtagcaatgtggcttgtgggtgaggatagtataaagtagttgtggatggcaaagtttggggtgaggaaggaaagaagagtagacattagaagaaaaaaaattcagagcacaaaataaaagtaaaaccacacctccattttagttcagtttgatagaaacggcttgttggtagttgccgagtattattaatgccatcaggaataaaatgtgttagctgtcctagtagtctgggttttg

SEQ ID NO: 107330 - DNA, 601 bp, Human
aatataagaggcagtttcttggaatttgattctgatcctagaaatgtgagttagaactgatcagtgtataagagaagtgtacttattcaagggctcttgaacagtaaatattaatacataaatgcactgtacattttgcttataaagcttttgcaatatgataaaattgaaagtgctttttgctttcatttctaaggtacatccaggttatggattcctttcagaaaacaaagaatttgccagatgtttggtaagttggtaatgaaccagaaactgttcatttctttttcagaaagcagtrtggtagcatggctttgtaaatgtgggtagtgatggattatagaattttaattaacccagcagttctttgaaaattgtgacaagtgaagtggttttagtctgaaactcaactgtttatttgaagagtaattataaaaacagaaaagtttacaaaatcaccattacactgaatgaatgatacctggtttattatatactgcatgatatttgaattaaagttaaaaacttcagatttttaactgtaaatatgttagggagtttagtgagttattgtagtgatttaattattttgtggcattta

SEQ ID NO: 107331 - DNA, 601 bp, Human
aacttgaaacaattattaagatcacagaattgtctatttgaaccaccttgctttgtgggtccaaaactaaggcctaaagagatatcctgagggggcaaattacatggacacatccagaggttccagtttcccaggttttatgcagcatatctacatttttttgtttatatccctttttattttttatcttccttggaattttgaccaagattctgttattataaaaactatttgaatataatacttaaatttagatgtgtatgtgtgtatatatataatgtaatgtattacatttaagtcygtatagatgagaggtcggcacactacagtccacaggacaaatgcagcctgctgcctgtttttgtcaataaaattttattgaaacacagccatgctctttcatttatgcattgtctatgctgcttttgtcctgtgacagcagagttgagtagttgtgacagagaccatttggcctatcaagcctaaaatactttttctatggtcctttatacaaaaagtttgggaactcctgctataaatgaatatccaaatccaaattatatgagtaggataagtgatgtggtgccagtattatacattt

SEQ ID NO: 107332 - DNA, 601 bp, Human
tttattgaaacacagccatgctctttcatttatgcattgtctatgctgcttttgtcctgtgacagcagagttgagtagttgtgacagagaccatttggcctatcaagcctaaaatactttttctatggtcctttatacaaaaagtttgggaactcctgctataaatgaatatccaaatccaaattatatgagtaggataagtgatgtggtgccagtattatacatttattcctatacagttaatacatttatttattttatatattatatataatattatatacagtttatgcattttttsagttattaaaaaaatgctgcctttttttttttttttttttttgagacatagccttgctctgtcacccaggctggaatgtagtggcatgatctcggctcactgcaacctctgtctcctgggttcaagctattctgcctcagcctcctgagtagctgggattacaggcacacaccaccacgcctggctaatttttgtatttttagtagagacggggtttcaccattttagtcaggctggtcttgaactcctgatgtcgtgatccgcccacctcagcttcccaaagtgctgggattacaggcg

SEQ ID NO: 107333 - DNA, 601 bp, Human
tatttcttagtattctgtgttttctttctggtttttctatgttgttttaatcatattatcataccttgtcatttcaggtaacatagcataagttatagtaattagtttcaagagaaacatatgttagaatttgtgttttgtgtttggatcctatctgtgtacttgaaagatacacgtatatgtagatggatagtgagttccatcaggatgctcagcgttgaaagcataggagggaactgtgctgagcgtgtgaggtttggcgattgtgctcttttatcttctttctttcttgagtttttarcaagataagacatgtaactactgtaaaatgagaggtaatttttaaaatagccactgggttaaccaaaaaccttttaaatagctgtggcatccagtgtgggcaagggtcacatagttttgttcctggaagtgtaaattgtttcagacctcccccggcccccagaaatttgctagtatttatcaaaatttaaaacatctatatgttctttaatttaacagttccacccttaagaatctcacttacaaagatatacttgagaaaatgttcatggtaaggtgtttcataatagcaaaatttaga

SEQ ID NO: 107334 - DNA, 601 bp, Human
ttttatatatcgcagcttaagaagggttgagaattgttactgtagtgtattttgtgtagacatcattttaatgacataaattttcttattaacattattatattttccattttggacacagacctttgattttagtatcttaaaatttttaatttttgagaatgtaaaatgctaagaaatttaagcacatgaaaacattgaaaattaggatttctttccatctttgaaccttcgaaacaagaccccaatttaagtctttagaggtcaccactgttaccttctggagcatgtgtgtctgtaggtgtgtgtgtgtgtgtgtgtgtgtgtgtgtctgtctgtctgcgtgtgctagaattttgctatcatttgttttgtaagatactcttagttgcttaagtaggacttactttttttatatgaaaagaagtggcatagaacttttcttatataagaaaacagtggtccctaggcttttaaaaataagtatggaatacctacctgcaggtaagttatttaatctttatgacaacttatgatgtattcttatttttattcttggttttatggaagagagaacaatctctgaaagtttaaataaatg

SEQ ID NO: 107335 - DNA, 601 bp, Human
ttcgaaacaagaccccaatttaagtctttagaggtcaccactgttaccttctggagcatgtgtgtctgtatgtgtgtgtgtgtgtgtgtgtgtgtgtgtgtctgtctgtctgcgtgtgctagaattttgctatcatttgttttgtaagatactcttagttgcttaagtaggacttactttttttatatgaaaagaagtggcatagaacttttcttatataagaaaacagtggtccctaggcttttaaaaataagtatggaatacctacctgcaggtaagttatttaatctttatgacaacytatgatgtattcttatttttattcttggttttatggaagagagaacaatctctgaaagtttaaataaatgccttgtccagtgtcacatagctggtaaatgagagagtatggatccgttgtttagtatatgttccagactgactctcagatgcattggaactgggctgggccgttagtggtatttgtttttgatcgatagctttagctggcatctgttcttgctgttggtggaggcttctctctttctgcttccttcccctcttccccattggtgtatcatcatagagatctaaaaagtag

SEQ ID NO: 107336 - DNA, 601 bp, Human
ttggaactgggctgggccgttagtggtatttgtttttgatcgatagctttagctggcatctgttcttgctgttggtggaggcttctctctttctgcttccttcccctcttccccattggtgtatcatcatagagatctaaaaagtagagttgtttcttttgtttttctcatcttgtaacttggatgccagtgaaggcaaatcctcacttggatttgctaacttactaagtaaggtaactgagtgagctttgctcagttaactgagtgccagagctacagcatagagatattgatgcctttwaccactcgttgatattcttaagtggaactaataaagtctccctggatttggaggagaaagttctgtgactcctttttccttttcataataattttataatatttttctagttgtgacttgtacatatgtgatgttcaaaagaattgataagaactaatgaatgcaacttcataaaacccttattatgacagaatatcttttgaaatgtttgagaacgtttcctttcctatatgttggcttaaggtcagcttttagaatatttgaagattttgaatgcgatgtggaatactaaatgctcta

SEQ ID NO: 107337 - DNA, 601 bp, Human
ttttgatcgatagctttagctggcatctgttcttgctgttggtggaggcttctctctttctgcttccttcccctcttccccattggtgtatcatcatagagatctaaaaagtagagttgtttcttttgtttttctcatcttgtaacttggatgccagtgaaggcaaatcctcacttggatttgctaacttactaagtaaggtaactgagtgagctttgctcagttaactgagtgccagagctacagcatagagatattgatgcctttaaccactcgttgatattcttaagtggaactaatraagtctccctggatttggaggagaaagttctgtgactcctttttccttttcataataattttataatatttttctagttgtgacttgtacatatgtgatgttcaaaagaattgataagaactaatgaatgcaacttcataaaacccttattatgacagaatatcttttgaaatgtttgagaacgtttcctttcctatatgttggcttaaggtcagcttttagaatatttgaagattttgaatgcgatgtggaatactaaatgctctaaagtgaatgcctgaaaaaggaaaactctccctt

SEQ ID NO: 107338 - DNA, 601 bp, Human
agctttgctcagttaactgagtgccagagctacagcatagagatattgatgcctttaaccactcgttgatattcttaagtggaactaataaagtctccctggatttggaggagaaagttctgtgactcctttttccttttcataataattttataatatttttctagttgtgacttgtacatatgtgatgttcaaaagaattgataagaactaatgaatgcaacttcataaaacccttattatgacagaatatcttttgaaatgtttgagaacgtttcctttcctatatgttggcttaagktcagcttttagaatatttgaagattttgaatgcgatgtggaatactaaatgctctaaagtgaatgcctgaaaaaggaaaactctccctttacagttagggagtcttttaaggatgtagataggtcagatacttttagggcttgtgggattttggggagtggtttcaataggaaaagtctgggatttgatgaggctgggatttttttccctttgcttgaggttaaaacagattgaagtgttacgttctagttttcctattacgctctctccttactgccctatgtatctattagctcattc

SEQ ID NO: 107339 - DNA, 601 bp, Human
taggtcagatacttttagggcttgtgggattttggggagtggtttcaataggaaaagtctgggatttgatgaggctgggatttttttccctttgcttgaggttaaaacagattgaagtgttacgttctagttttcctattacgctctctccttactgccctatgtatctattagctcattctggagtcagaatgacagctaaattctttctctgccacttagtagctgtgtgatcttggacaggttgtttaatgtcggcctctgaagattgtgttttattcttactatttgcatgatatgyatttctccatctgtgattttatgttgaaaatactgtgtgtttcttgtagccaggatgtagttgtgtcatgcttttgaaataattctgatggtctctatttttaaattgtagtgtttagactatgaagttttttcttctttagtttgccttagtgtattttcttaaatagcagctttattgagatttaattcatgtgtcatcaggctcaccctttaaaagtatacaattgagtgatttgtagtatagtcacagagttatgtaaccatcactgctatgcaatgtcagtaaaatccattaaca

SEQ ID NO: 107340 - DNA, 601 bp, Human
tcatattctagttagagctaatatgataccatttcaagtaaaatgtagaaattttgccatcctccttctcttcccatcactatcctctatgttatagttgtcatatgtatttcatctgcatgtattataaattctatgtgaaaatgttataattttgttataaacatgttgaggtgagttaggacatttctttaaattgatctgtcaaatttaaaatatagagacaaatctctagattaaatattttatttgagaatcacagaattggaatttgagacatacacatggggtcttcagtatrtccaaggaacaaagagaaggttgaaggttttattagatagaaaaaaaatgttactgattattttgaaagaaagttcattggtacttgaaaagctttgggagctggcaggctcggataggagagtggcagtggtagtttaaaaactagtcttagagtgatagcaggttgtttcagcagttactaggtaaagctggtcttagggttacagcaggctgtttcagcaactgggcctctggatagttcagttcttggagcctgtgctatgtgccctgagtgcttttttcccctgactccttgact

SEQ ID NO: 107341 - DNA, 601 bp, Human
tgttgtgaataatgctgctatgaacactggtgtataagtatctgtttgggtccctgcttttgcttctttttagtatatagctaggagaggaattgctgggtcctatggtaattctatgtttaactttttgaggttctgccctactgttttccatagtggctgtaccatttctcattcccattgttttattgtttttaataaccaccaaatcatgcctttccttaatgcaagctctgggtaattagttgactcattggatatttgtaatgtccgctttacataagtttaagaggtttaattkgacagtatcttcctaaccaatatgtttatgcttgttagtctagtgttactgccagagacctattgcacagacttgtgggagtattaatattttttcccctcacattttctttaatgaaaaatttaagaaatacagaaaagtttgaagaattgtactactacaaatgccagtagattctataattaacattttcttatttgtttttaacatatttattcatttgtgttttcctctactcatctatcaatctcattttcattttgcacgtcaacttaagttgtagataatagtacaattcac

SEQ ID NO: 107342 - DNA, 601 bp, Human
gttagtctagtgttactgccagagacctattgcacagacttgtgggagtattaatattttttcccctcacattttctttaatgaaaaatttaagaaatacagaaaagtttgaagaattgtactactacaaatgccagtagattctataattaacattttcttatttgtttttaacatatttattcatttgtgttttcctctactcatctatcaatctcattttcattttgcacgtcaacttaagttgtagataatagtacaattcactctcctgtacacttcagcatgcagtttttaaagmagagttcaggccaggtgtggtatcttacacctataatcccatcactttgggaggccgagataggaggatcacttgaggccagaagtttgagggtgtagcgagctatgaatccagcctgggtgacagagcaagaccctgtctcaaaaaaataaataagtaaataagtacaataaaaaaataaaccagagttcattattcatttacagcttttccaagaaagccttattgaaatataattgctattcaataaagtgcacatatataagaaattaattgtacacttatatgtgtacacttatg

SEQ ID NO: 107343 - DNA, 601 bp, Human
tacagaaaagtttgaagaattgtactactacaaatgccagtagattctataattaacattttcttatttgtttttaacatatttattcatttgtgttttcctctactcatctatcaatctcattttcattttgcacgtcaacttaagttgtagataatagtacaattcactctcctgtacacttcagcatgcagtttttaaagcagagttcaggccaggtgtggtatcttacacctataatcccatcactttgggaggccgagataggaggatcacttgaggccagaagtttgagggtgtrgcgagctatgaatccagcctgggtgacagagcaagaccctgtctcaaaaaaataaataagtaaataagtacaataaaaaaataaaccagagttcattattcatttacagcttttccaagaaagccttattgaaatataattgctattcaataaagtgcacatatataagaaattaattgtacacttatatgtgtacacttatgaaatcataatcacaatcagaataaagaatgtatccttcaactccaaagacttcctggtgctccttcgctggctctttcggccacttcctagccttcc

SEQ ID NO: 107344 - DNA, 601 bp, Human
agtagattctataattaacattttcttatttgtttttaacatatttattcatttgtgttttcctctactcatctatcaatctcattttcattttgcacgtcaacttaagttgtagataatagtacaattcactctcctgtacacttcagcatgcagtttttaaagcagagttcaggccaggtgtggtatcttacacctataatcccatcactttgggaggccgagataggaggatcacttgaggccagaagtttgagggtgtagcgagctatgaatccagcctgggtgacagagcaagacyctgtctcaaaaaaataaataagtaaataagtacaataaaaaaataaaccagagttcattattcatttacagcttttccaagaaagccttattgaaatataattgctattcaataaagtgcacatatataagaaattaattgtacacttatatgtgtacacttatgaaatcataatcacaatcagaataaagaatgtatccttcaactccaaagacttcctggtgctccttcgctggctctttcggccacttcctagccttcctcttcccctttaggcaactactgatctgttttcttatc

SEQ ID NO: 107345 - DNA, 601 bp, Human
ttgcatttactagaattttatataggtggaataacacaagttatgctgttttttggatttttttttcacccagcaaaattattttgaaattgatgcatgtaattgtgtcagtacttcattccctgttttgttttgttttgttttggagacagagtttcccctcttttgcccaggctagagtgcagtggcacaacttccgcctcctgggctcaagtaattcttgtgcctcagcttcccaagtagctgggattacaggtgtgcaccaccatgcccagctaatttttgtatttttagtagagaygggattttgtcatgttggccaggctggtttcgaactcctggcctcaagtgagctgcctgcctcagcctcccaaagtgctgggattacaggtgtgagccaccgtgcctagcctgcattcctttttattgctgcattcatttctttttattccattgtatgggtttaccaccatatttttagtagccattcatctgttggtggacatgtgagttgtttccagcttttaactacaactagaggtgctatgaacaagtagttatgtgggcatatgctttcatttttttttggtaaatgcctagg

SEQ ID NO: 107346 - DNA, 601 bp, Human
aaaaaatagatatatgtaatttcttgccaaactcaaggtcactgagactttcttgttttttgttttgtatttttaatgttttatagttttagatctctgatcaattttgagttaatttttatatgtggtgtgaagtagggtctaaattaatcttttttgcatgtggctattcagtttgctatacaatctcttgaagaggttatcccttcctctttgaattgccttggcacccttgcagaaaaagtaatgggacatacatgtgcgatctcggctctctgcaagctctgcctcccgggttcaygccattctcctgcctcagcctcctgagtagctgggattataggcgcccaccaccacaactggctagataatgaactcttaaaaatactttgtccacaccccctttcatttactcccatgtattactaatcctgctgaggccgtcttggtgtgacctccttcctcaccactgaccccctcttttctctctcagaacttccttactttaacaatccagttgaacacatatgccaccttattcagcagttgaatctcaacctgagagattctagtgttcattcttcagttccacacataacca

SEQ ID NO: 107347 - DNA, 601 bp, Human
tgagttaatttttatatgtggtgtgaagtagggtctaaattaatcttttttgcatgtggctattcagtttgctatacaatctcttgaagaggttatcccttcctctttgaattgccttggcacccttgcagaaaaagtaatgggacatacatgtgcgatctcggctctctgcaagctctgcctcccgggttcatgccattctcctgcctcagcctcctgagtagctgggattataggcgcccaccaccacaactggctagataatgaactcttaaaaatactttgtccacaccccctttcrtttactcccatgtattactaatcctgctgaggccgtcttggtgtgacctccttcctcaccactgaccccctcttttctctctcagaacttccttactttaacaatccagttgaacacatatgccaccttattcagcagttgaatctcaacctgagagattctagtgttcattcttcagttccacacataaccatcgtgagtaagagaggctcattcccatagaaggatgaggtttaagattgctccagtcattaacagtatacaagatgtcagatagcgttttactgggtctaagataaa

SEQ ID NO: 107348 - DNA, 601 bp, Human
tcctaagttaccattttgactcataatatgtgatatgctaatgttccaagcacagagtattcttttctgtatgtttccacttcccaacctacctatggtgtagcgcctgtctgtaccactacgtgtgtgcatgtgtacatgttcctagctttttattcagtcctttatgtgctagttgattgttgagtgcagataaaaataatgtgttgtatttcttaaccacaatatttgatttataaggaaatattttgataacagcatttatagtaatatatgctcttactgattagaatgccacaaytgatagaaaatatattggatgtaaattagttacatatttacataatctatacacaagtaacagcatattttgtcagcatagcgtacagtagccataaaataagagtgggtgatacaatagagcattggttcccagtatgttctgtggtacctggggactcttgagaccctttcagacactctgaagtaaacaattttccataatagtttttcctgctctcattctctgaggattgtgcagtagagttttccatgtaacagtagagttatatgatatatgttatcacagcagattgaatgc

SEQ ID NO: 107349 - DNA, 601 bp, Human
agctactcgggaggctgaggcaggagaatggcgtgaacacaggaggcagagcttgcagtgagcggagttctcgccactgcattccagcttgggtgacagagtgagactctgtctcaaaaaaaaaaaaaaaaaatattagctgggtgtgttggcatgcgcctctggtcccagctgcttgggaagctgaggtgggaggattgcttgagcccaggagatggaggctgcagtgagctgagattgcaccactacactccagcctgggtgacagagcaaaaccctgtctcaaaaaaaaaaaaaaaawttacctttcagtggaattatttatatacatttctacacatgagacaaacttttgaaggaagtttaatgtctttggtattcacatcaaactaatttgacatatatttttatttagttttttttaaaaacaaatattttttaggatctgttatttcctattaaattccttttacatgaaagatcataaattgatttttaaaaatgacttttaatgttaatagggctttgtcttttagacatatttgttaatgataaatttgtttctgtaatttttatgctttgtagctttaatttgggccca

SEQ ID NO: 107350 - DNA, 601 bp, Human
aaattaataactttttttgaacacttagtgtgtgccaggcactattcccacccctctgcatgtactaactcatttgctcttcctagcagccctatagacaggtactattatttctgcttttcaggcgaagaagcagaagttgctcaggatcacacagctgttagtgccagggcaaggatttgaaccccgtcattaccatgctcataactaccggactatgctacctctgaagaagagattatacagcttgttgtggcacaacacaaaaccttaaaatgttttcagctcttttttttttacycatccttattttttccccatatgactattatttattcagccttttggtatctagcttgcagaatatttcagggtcccaaagggactatataaagagctgtctgtaaaagttctgctttcctcccaaaagctagcagtgggaaaaacaggcaggagagataaggtgcaaagcacagggaggaagaaagagaatagtggaagcagcagtggtgatctgtagtggtgtctacagtgtgctggttctggttgagttggtacgggcagccatgtcagcaaccaagtcttcacttgttggaggact

SEQ ID NO: 107351 - DNA, 601 bp, Human
caacacaaaaccttaaaatgttttcagctcttttttttttacccatccttattttttccccatatgactattatttattcagccttttggtatctagcttgcagaatatttcagggtcccaaagggactatataaagagctgtctgtaaaagttctgctttcctcccaaaagctagcagtgggaaaaacaggcaggagagataaggtgcaaagcacagggaggaagaaagagaatagtggaagcagcagtggtgatctgtagtggtgtctacagtgtgctggttctggttgagttggtacrggcagccatgtcagcaaccaagtcttcacttgttggaggactcgctttttacatgctctggctgggatggttttagttactaggatgtaggggacaggaataacggcatttggtagagattcaaaacagcaaccagggatgacgagctgcagacattgatcgatatcaagtaaataataagagatagaagataaaacagctctcaggtgccagaaagcaacttggtaatggagaaatacatatcctagagaaaggtagacaagtgtatttatcctctcaggaaattacctggataagtgt

SEQ ID NO: 107352 - DNA, 601 bp, Human
atagaagataaaacagctctcaggtgccagaaagcaacttggtaatggagaaatacatatcctagagaaaggtagacaagtgtatttatcctctcaggaaattacctggataagtgtacatttctgcaaagcaaaatagagtcaagctcctgaactcctgctgcataggctggtaggtgttaatgggtgtctgaatggagaaggatgaggacttcaggtttctagtaaacttaaatgtgatatggtttggctgtgtccccacccaaatctcatcttgaattgtagctcctctaatccccaygtgttgtgggaggaacctggtggaaggtaattgaatcatggggggcaggtttctcctgtgttgttcttgtgatagtgaatcagtttcatgaaatctgatggttttataaatggcagttcccctgcacaagctctcttgcctgctgccatgtaagacatgcctttactccgccttcacttgccaccatgattgtggggcctccccagccatgtggagctgtaagtcaattaaacctttttctttataaattacccagttgtgggtatttcttcatagcagtatgaaaatggactaatacat

SEQ ID NO: 107353 - DNA, 601 bp, Human
gcaggtttctcctgtgttgttcttgtgatagtgaatcagtttcatgaaatctgatggttttataaatggcagttcccctgcacaagctctcttgcctgctgccatgtaagacatgcctttactccgccttcacttgccaccatgattgtggggcctccccagccatgtggagctgtaagtcaattaaacctttttctttataaattacccagttgtgggtatttcttcatagcagtatgaaaatggactaatacataatgattcccttgtttggaggattgtcagatactatatgaaaagyggtttcacatgtgcttaaaaaaacctgtatatgtgccttatggtgtcattatttctaatttatagatgtagaaataataatatttagagaaataaaatgctttttctaatcacatgccagtaggagatcagcaagctgggactagaactcaggttattttgattgaaattcttttttacgaagccctgagggttctaaaaagctcgagtttcactgtgaaccattgtatggaaaacttaaatgtagccagaaaccacatagagaaaataaccaggttttaaatgttttatagtataatat

SEQ ID NO: 107354 - DNA, 601 bp, Human
ttattttgatatctaagtaattggttattatgatttatttttttcttgacaagcttctgagctttgttcagtcttgtcaagtccctggtgagttttagatctctgagtctagagtttgttgatcgaattaatgaataaaccaatagattagtacattgttgatttttttttcccccaaaccttagatcctatttgctctcttaggaaactgtttgaaagtattgcaacttttagagaagttttgcaaatcttagccacatgtctactaatgttttgcacactatttttagttgatgaaatktaagcaatttatatttgtcttaactttccatctataaggtagtgagagtggtgacaggctgctctgttttgcagctagcatctttaattgatgttgaattgtggctttccgtgcacacagggttaagtgaaaaggttgcagtcatctagtgagcattttcctttaatgtgctcattagtggtggcaagtccaggtttcagcacatgtcagtaatttacatttcattgtggagaggctgcccttgttcaagagttgtttctaagcctgatgaatatatattgggaataaacagagtagaag

SEQ ID NO: 107355 - DNA, 601 bp, Human
cttgataggcctcggttcttagggatcagatgattgtgattggaatctttgtgatgattccttctgggactcattttttccatctttgcctgattggtaggtaccagcttgttctggcttttgaaagcttgcatagatcagtaaagaataactgtggaggctgtggtcagtgttgttggggatagagacaggactctgaaattgtggtgtttgggaaaatccagaaattttctttttgtagaaaaacttcatatattaaaatgaagcatttttggaacttgggatttgattacaagttacytcatgcatagatggtgtagctttagaaaactcaggcctagctgtttttagaagaaaatgttataattctttatacattttaagtttaattatttacatgtgtataaaaatttgggtttattgcaagaaggtacgttttgatattgctgtttctgtgtgtttgtatgatacatctacccatgtatctgtctacttatttatctttgtggtgctagtcaaaacttgcagcttaagagaatttgttcagaattggtggttagaatcaaaagtgagtgaatttatgacttacattattgaaaaa

SEQ ID NO: 107356 - DNA, 601 bp, Human
gggatcagatgattgtgattggaatctttgtgatgattccttctgggactcattttttccatctttgcctgattggtaggtaccagcttgttctggcttttgaaagcttgcatagatcagtaaagaataactgtggaggctgtggtcagtgttgttggggatagagacaggactctgaaattgtggtgtttgggaaaatccagaaattttctttttgtagaaaaacttcatatattaaaatgaagcatttttggaacttgggatttgattacaagttacttcatgcatagatggtgtagcwttagaaaactcaggcctagctgtttttagaagaaaatgttataattctttatacattttaagtttaattatttacatgtgtataaaaatttgggtttattgcaagaaggtacgttttgatattgctgtttctgtgtgtttgtatgatacatctacccatgtatctgtctacttatttatctttgtggtgctagtcaaaacttgcagcttaagagaatttgttcagaattggtggttagaatcaaaagtgagtgaatttatgacttacattattgaaaaacattgacaaatgtcaggactc

SEQ ID NO: 107357 - DNA, 601 bp, Human
caagtcttcaaacattctcagaactaaaaaagaccaaagaaaatattcccatcatactgattatgtttcaattttctagttactaaaaattagaacatggcactaagtagactatataaagtatgtctttaaaaattcaactgtgaaggagatcttttttttttgataatcattaatatgaaagtgaagtttctcttttccctgttataacagttctatgtagtagtagaggtagaattctgaattgaaggtggttaggacttatagcaacatttctgggatgagtttttcagtattcccrgacttcaatttaattcagggtttcttttttgctctccacttatgaatatgtgataaatattttatgtagtcgtgtacttttgctatagaaaatcagtggattatttaatttgattcaggaaatctaccctgtatggttatttcgatgttgggtagattttatttcaacttaaaacgtagaaaagatgcttaggcaaatgatctaatagttttagatacatttggtaacttgtatcttaaaccccagggccaagtttagcagtcttacacatgtttagaaaatagttgaaaaatagaaaat

SEQ ID NO: 107358 - DNA, 601 bp, Human
aattaattaaaatgtgtgggccgggcgcggtggctcatgcctgtaatcccagcactttgggaggctgaggcgggcggatcacaaggtcaggagatcgagaccatcttggctaacactgtgaaaccccatctctactaaaaatacaaaatattagctgggcgtggtggcaggcgcctgtaatcccagctactcgggaggctgaggcaggagaatggcatgaacccgggaggtggagcttgcagtgagccgagatcgtgccactgcactccagcctgggtgacagagcgagactccttctcaaaaaaaaaaaaaaaatatatatatatatatatttgtgcttgtttggatgggcttttttaatcttgaattttatagaataataaagttaagtatttgtaccttgacataccctaacacaattaagtattgcttccataaataattttgatcttataataaacataccttacatactgacgaataatattaacacaaatgtatactcccttagaggtgctcaaaatgactttcatgccacccttcatgcctgctgggttttaaggcataagagaaacagatgatttctgcattttactggaaa

SEQ ID NO: 107359 - DNA, 601 bp, Human
gtgggccgggcgcggtggctcatgcctgtaatcccagcactttgggaggctgaggcgggcggatcacaaggtcaggagatcgagaccatcttggctaacactgtgaaaccccatctctactaaaaatacaaaatattagctgggcgtggtggcaggcgcctgtaatcccagctactcgggaggctgaggcaggagaatggcatgaacccgggaggtggagcttgcagtgagccgagatcgtgccactgcactccagcctgggtgacagagcgagactccttctcaaaaaaaaaaaaaaaatatatatatatatatatttgtgcttgtttggatgggcttttttaatcttgaattttatagaataataaagttaagtatttgtaccttgacataccctaacacaattaagtattgcttccataaataattttgatcttataataaacataccttacatactgacgaataatattaacacaaatgtatactcccttagaggtgctcaaaatgactttcatgccacccttcatgcctgctgggttttaaggcataagagaaacagatgatttctgcattttactggaaaaaaaagactaaaatg

SEQ ID NO: 107360 - DNA, 601 bp, Human
gggccgggcgcggtggctcatgcctgtaatcccagcactttgggaggctgaggcgggcggatcacaaggtcaggagatcgagaccatcttggctaacactgtgaaaccccatctctactaaaaatacaaaatattagctgggcgtggtggcaggcgcctgtaatcccagctactcgggaggctgaggcaggagaatggcatgaacccgggaggtggagcttgcagtgagccgagatcgtgccactgcactccagcctgggtgacagagcgagactccttctcaaaaaaaaaaaaaaaatatatatatatatatatttgtgcttgtttggatgggcttttttaatcttgaattttatagaataataaagttaagtatttgtaccttgacataccctaacacaattaagtattgcttccataaataattttgatcttataataaacataccttacatactgacgaataatattaacacaaatgtatactcccttagaggtgctcaaaatgactttcatgccacccttcatgcctgctgggttttaaggcataagagaaacagatgatttctgcattttactggaaaaaaaagactaaaatgta

SEQ ID NO: 107361 - DNA, 601 bp, Human
taatcccagctactcgggaggctgaggcaggagaatggcatgaacccgggaggtggagcttgcagtgagccgagatcgtgccactgcactccagcctgggtgacagagcgagactccttctcaaaaaaaaaaaaaaaatatatatatatatatatttgtgcttgtttggatgggcttttttaatcttgaattttatagaataataaagttaagtatttgtaccttgacataccctaacacaattaagtattgcttccataaataattttgatcttataataaacataccttacatactgaygaataatattaacacaaatgtatactcccttagaggtgctcaaaatgactttcatgccacccttcatgcctgctgggttttaaggcataagagaaacagatgatttctgcattttactggaaaaaaaagactaaaatgtacagctagtattgaattggggtaataatctgccacttttttgcccttcaatgctgtcgtgatcttttagggaagtgaggtcatggtagacccgcttgttaatcatttctgcgttttcagctcagtttggtcatgaatacttgacttgctacctatagtctt

SEQ ID NO: 107362 - DNA, 601 bp, Human
aaaaaaaatatatatatatatatatttgtgcttgtttggatgggcttttttaatcttgaattttatagaataataaagttaagtatttgtaccttgacataccctaacacaattaagtattgcttccataaataattttgatcttataataaacataccttacatactgacgaataatattaacacaaatgtatactcccttagaggtgctcaaaatgactttcatgccacccttcatgcctgctgggttttaaggcataagagaaacagatgatttctgcattttactggaaaaaaaagwctaaaatgtacagctagtattgaattggggtaataatctgccacttttttgcccttcaatgctgtcgtgatcttttagggaagtgaggtcatggtagacccgcttgttaatcatttctgcgttttcagctcagtttggtcatgaatacttgacttgctacctatagtcttgcttctgtttgcctctttgcatgcagctccttaaattgtttaaattaccatgctttctttatcatgtgatcctgtcatctattgacaattgattggatcaaggattagtgcctgacccaaggcagacatc

SEQ ID NO: 107363 - DNA, 601 bp, Human
atcactgtaacaacagtgcatatcagactgaagaactatgtgattaagaacactttgctacataggagcagaaaaatttaaagaagaaacagtgccctagaagaagttaaattctcttgggcatccacctgtagacgtcctcactccttaatttgtcctgctgttcttagcatcatagctctctgtgaaaacaaagctatcttctaatttatactttgcaaatcatttgcttttccgtaaaccccattcttgcctattggggttaatctaataccaagatccaagattcctcttcccacartggtttattttcctcaggctggattattcagtattgaaaaacagccccataagacaacccatgggaaccattgaccattcaggtcctaagaacagttagagttagggggtaggtgtggatacagaggttgtatgtatgtggtattccagtttaaggtggccactctcttctgatttctttctcctctgattttgtctcctccgatttctttcccctggtattaattactaatacgcttctttgactttctgtctggctagtaggtgaggttacgttgcacaaatgcttaaatgaatgcat

SEQ ID NO: 107364 - DNA, 601 bp, Human
gaagataggtagtgtttaggcaggggagatgatagaggagaagaatgggacacacaggtggaggggacattccaggaaggggctgtagtgtcgggatggcagaaaaaggggtgctgcattgagccatgagctgtgacagacctttgagtgtaagagtgtaagagtaagcccggaaggcgaggggccctgggtactgggcttgaatttgtttataccattcaagctttccagaaaacccctgtgagctttgaaatgcttcaggggagcattctgtgtgaggctggctttttctgcccttttmctcaattcagcaaatggcaagaaacttggtatcatctttgcccacctttgctgttaggccgtgtgctagtctgttcttgcattgctataaagaaatgcctgagactgggtaatttataagaaaagaggtttaattggctcacgattctacaggctgtacaagaagcgtggtgtcatctgcttctgaggaggcctcaggaaacttacagtcatggtggagggcaaagaggaagcaggcacgtcttacatgaacagagcaggactaagagagagagggggaaggttataactatagtagtta

SEQ ID NO: 107365 - DNA, 601 bp, Human
gctgtagtgtcgggatggcagaaaaaggggtgctgcattgagccatgagctgtgacagacctttgagtgtaagagtgtaagagtaagcccggaaggcgaggggccctgggtactgggcttgaatttgtttataccattcaagctttccagaaaacccctgtgagctttgaaatgcttcaggggagcattctgtgtgaggctggctttttctgcccttttcctcaattcagcaaatggcaagaaacttggtatcatctttgcccacctttgctgttaggccgtgtgctagtctgttcttgcmttgctataaagaaatgcctgagactgggtaatttataagaaaagaggtttaattggctcacgattctacaggctgtacaagaagcgtggtgtcatctgcttctgaggaggcctcaggaaacttacagtcatggtggagggcaaagaggaagcaggcacgtcttacatgaacagagcaggactaagagagagagggggaaggttataactatagtagttattgcttcctgatagataatttgtttgtttctctttctcctctgctgaaatacagcctacacaaccataggagttcctgtct

SEQ ID NO: 107366 - DNA, 601 bp, Human
tgcattgagccatgagctgtgacagacctttgagtgtaagagtgtaagagtaagcccggaaggcgaggggccctgggtactgggcttgaatttgtttataccattcaagctttccagaaaacccctgtgagctttgaaatgcttcaggggagcattctgtgtgaggctggctttttctgcccttttcctcaattcagcaaatggcaagaaacttggtatcatctttgcccacctttgctgttaggccgtgtgctagtctgttcttgcattgctataaagaaatgcctgagactgggtaatytataagaaaagaggtttaattggctcacgattctacaggctgtacaagaagcgtggtgtcatctgcttctgaggaggcctcaggaaacttacagtcatggtggagggcaaagaggaagcaggcacgtcttacatgaacagagcaggactaagagagagagggggaaggttataactatagtagttattgcttcctgatagataatttgtttgtttctctttctcctctgctgaaatacagcctacacaaccataggagttcctgtctcttgattgttgctgtttcctcagtacctaggac

SEQ ID NO: 107367 - DNA, 601 bp, Human
taaagaaatgcctgagactgggtaatttataagaaaagaggtttaattggctcacgattctacaggctgtacaagaagcgtggtgtcatctgcttctgaggaggcctcaggaaacttacagtcatggtggagggcaaagaggaagcaggcacgtcttacatgaacagagcaggactaagagagagagggggaaggttataactatagtagttattgcttcctgatagataatttgtttgtttctctttctcctctgctgaaatacagcctacacaaccataggagttcctgtctcttgatkgttgctgtttcctcagtacctaggacagtgtctggctcatatatatttgtttaatgaacaaatgaataagagatgggttatttagctttaggccattcatggaaagtttaataccataaattctctgttaagtaggcagatatttataaatacagaaatggcttctaaggtgtctccgtaagatagctattcaactgttgcacgagcttatgatgactggaatcgtacgccctttcatcatatagaccagcatttggcaggctttttttctgtaaagggccagataataagtgttttagg

SEQ ID NO: 107368 - DNA, 601 bp, Human
agagagagagggggaaggttataactatagtagttattgcttcctgatagataatttgtttgtttctctttctcctctgctgaaatacagcctacacaaccataggagttcctgtctcttgattgttgctgtttcctcagtacctaggacagtgtctggctcatatatatttgtttaatgaacaaatgaataagagatgggttatttagctttaggccattcatggaaagtttaataccataaattctctgttaagtaggcagatatttataaatacagaaatggcttctaaggtgtctcygtaagatagctattcaactgttgcacgagcttatgatgactggaatcgtacgccctttcatcatatagaccagcatttggcaggctttttttctgtaaagggccagataataagtgttttaggctttgtgggccatactgtcacaaccattcaactccattctaaatactcagctcttctgttgtagtgtgaaagcagccctagactataggtaaatgaatgggtatggctgtgtttcaatacaactttcattatgaatacttaaatgggaatttcatgtaattttaacatgtcacgaag

SEQ ID NO: 107369 - DNA, 601 bp, Human
ttatagagctttctgtcttcctcatctttaatggttagaaaattcttcattgtattaactgaaatctatctgtttagaatatttacctattttttcagtagtgaaataggacatatataccgaaaaatgcacataatgtaaatgtacagctttacaaattattgtgggcacccacataatattacctaggtcaaaaagtaagacaaatgtctgcaccctagaagccctttgcatgttcccttcaaatgatgctccttcctcccatcccaggaacactgtcctaactattatgggaatcatyttcttgcttctctttatactttcacctccttaatatgcatcctatgaccctggagtttagttttgcctatttttttgaactttctatagatagaatcatatagttaaaaaaatttgctttctgtctttgtttctttctctctttttatcttttctttctttctaatattttctttttttctttcttttgacagttttgctctgtctcccaggctggagtgcagtggtatgatcatggctcactgcagcctcaccctcttgggctcaggtgattctcccacctcagcctcccgggtagctg

SEQ ID NO: 107370 - DNA, 601 bp, Human
ctccatgttggtgaggctcgtctcgaactcccgacctcaggcgatccacccgccttggcctcccaaagtgctgggattacaggcgtaagccactgtgcccggctaaatttctttcagtaacatttattagtttcctgcttagaagtattgtgcattttcactgtatttattattagaagtttgagtcttaaaaattattcagttttctctttgatttcagtcttaccattccatctagttaaaatagctttgaatcaatattttatcattctttttcagcattggttcatcattgaattargcaatcagtgtctttgtgtggcgttatacaagtatttagtaaaaatatccattagggaagggccaaaagtagagtagggctttttagttagacaaaaatggactattcaatgatctggatatggcgtttgaaacaattgtgtatctgtacaaatatatttagtttaatacacacttgtctgtgttgtccataagcacacatttgaatatggccacgagaaagattttgggtgaccatgtggataaaaaaattatttggtacagttatttctgctaatggatggggaatgtatagtaatat

SEQ ID NO: 107371 - DNA, 601 bp, Human
cttattttattgttgaaaaaaacttattttaagttcaggggtacatgtgcaagttcgttacataggtaaatgtgtgtcatgggggtggcactctttttatttcagtaaatttttgggaaacaggtggtatttgattacatgaataagttctttagtggcgatttctgagattttggtgcaccagccacccaagcagtgtacactgtacccaaggtgtagtcttttatcccccgcccccttcccaccctttcccccaagtccccaaagtccattgtatcattcctatacctttgcctcctcrtagcttagctcctacttatgggtgagaacatacgatgtttggttttccattcctgagttacttcacttagaataatggtctccactttgggaggccgaggtgggcggatcacgaggtcaagagatcgagaccaccctggccaacatggtgaaaccccgtctctactaaaaatacaaaaaatagctggatgtggtggcacatgcctgtaatcccagctacttgggaggctgaggcaggagaatcgcttgaagccgggaggtggaggttgcagtgagccgagatcgtgccactgcactccag

SEQ ID NO: 107372 - DNA, 601 bp, Human
gagcaagactctgtctcaaaaaaacaaaacaaaacaaaacaaaacaaaacaaaaacacaaagaaagaaagaaagaataatgaattccatctggattgctgcaaatgccattttttcattcctttttatggctgagtggtcgtattccatggtgtagatataccagtatttatctactcgtcaattgatgggtatttgggctggctccatatttttgcaattgcaaattgtgctgctataaacatgcatatgcaagtatcttttttgtataatgatttattttcctctgggtagacacccartaatgggattgctggatcacatggtagttctacttttagttctttaaggaatctccacactgttttccatagtggttgtactagcttacattcccaatagcagtgtaaaagtgttcccttttcaccacatccacgccaacatctaatattttttgattttttgattatggccattcttgcaggagtaaggtggtatctattgtattgtggttttgaattgcatttccctgatctttagtgagcatatattgaagtttgttggccatctgtatatcttcttttgagaattgtctgtacatg

SEQ ID NO: 107373 - DNA, 601 bp, Human
gtagttctacttttagttctttaaggaatctccacactgttttccatagtggttgtactagcttacattcccaatagcagtgtaaaagtgttcccttttcaccacatccacgccaacatctaatattttttgattttttgattatggccattcttgcaggagtaaggtggtatctattgtattgtggttttgaattgcatttccctgatctttagtgagcatatattgaagtttgttggccatctgtatatcttcttttgagaattgtctgtacatgtccttagcccactttttttttttwaattatactttaagttctggggtacatgtgcagaatgtgcagttttgttatataggtatacatgtgccatggtggtttgctgcacccatcaacccgtcagctacattaggtatttctcgtaatcctatccatctcctagccccccaccccctgacaggccccggtgtgtgatgttcccctccctgtgtccatgtcttctcattgttcaactcccacttatgagtgaaaacatgcggtgtttggttttctgatcttgtgatagtttgctgagaatgatggtttccagcttcatccatgtcc

SEQ ID NO: 107374 - DNA, 601 bp, Human
ggctgcattattattttaaatccataaaatcacacctttttcagcttaagatcatttctagactgtcctctcactaaaaataccctggaatcaatatacatgttgttagtttgaaaattctttgctaggttgaacagccatattggaaaagtaccaaatccctttagggttttgttattggtaatataaagaggacagagaatgtatttcaaattagttgtcatttcatgaggtgttgcccttcatttcttggcaggtcttaactagaatctagcctcctcttataatagttgaaaatgtstcatgactaattaatatgatacaatgagagcactgttttctgattaataaggtgggtggaccttatgaaatgttatctgaagatcacgcacgtaatctttgatggctgttattgcgttatattgacttgtgattcctgtgtgttcaacttctagtgtgaatagtaaggccaaaaattcaaaagggcttttgaagttgatttgtaattaaatagcattattaaaataaagagtcaaagcattgtcaagtgtgataaattcagtgtcaaaactgagcctttaaaaccaaaaagcgtggctgg

SEQ ID NO: 107375 - DNA, 601 bp, Human
tgcatctcagcacacgacagttgtgatttcataagcttcttaaggtttcaagtgcacagcattttaccgcagaactattactgtctcaggaatgaggcccatggaacacaggaaaattctccacccagggaggaaggctgggaggcctcagcagccaatagtggtgtgactgagactctggagtcccttcacacttgtgtcgcagcttactacgggtcacctccgtcctaagtgtcttacatttattaatcatatatcctcacagatagggaaactgaggcacacagcagccaaggaactygtccaaggccaaccaggtagtatatggtggaactggagtgaaggcaggctccacagtccctgttcttaacctttatactccactgcttctaattccttactttcttttatacaagaatataatttaaaatcctgcccaacacttgttttgtaagattctagtggcatgggaagtgaggggttacagttggtgtcagtcatatttcaaatggctgggaataggggtgataacatacacccaaggaagtcacgctggctgctacaacattgtgagaatatcattctgctgagattttacgct

SEQ ID NO: 107376 - DNA, 601 bp, Human
gttggtgttggcagctatttgtaggatgaatgaatacatgactgtgttaagcagacatcaaaggcgtataaaattgaaatctagttgttgtaagacttaaaaagagaggagatccttatagatgagtgctggttgtttgcaggatcattattattctctgatgatcaaaaaactgtttacgcatgcaccagtagtcccagctactcaggaggctgaggcgggaggatcccttgagcttgggaggcagaggttgcagtgagctgagatcacgccactgcactccatagagccagaccctgtyttaaaaagaaaagaacggtttacagatcagtgagagaggtgttttcctaaatatttaaatgtttgcttgcccatgctacttttccaaatcctaattgtccttttccccctcaaatgctccttcctttgtgaagccgtccttgattcccttgttggactctgttcaccgtgtctgatttttacctcttctagtgcactgactattcttaccgtgtattgtttttattttttggtacatgtgttgttgtttgttctactagactataaactcttgagtgtgaaaaccatgtctacttaacca

SEQ ID NO: 107377 - DNA, 601 bp, Human
aaacctgatggctggttactctccagtaatctttagcttattgaaaaagcagaggccacttgcacctgtttacaagcaggtgagatgggcctgagaaggtgattgaattgcagattcaaaacgctggtttgtgtcttagtcttatctctgtcacttcactagtctaatgactgtgggtaatttatttcatcttgaagaccctcattttactgacatgttaagtagtgatgaccatttatttcctgctgtttcttaggccccctcctttttgtgttttgaggaagagaagatataaaaaaaygcccttgagagctgtgaagtgtcatagatactacaatatcgttttagaatcaattgaagactttctaactttgtaaacaaatttgaatctgatgactgaaatgctaatctataaaatggttttttagtaataaagtgagacttaatacagtgcttttaaatagtatgaaataagtaaataaatattgtagtttttgttagtatcattatattccttgttcttttaattcatttttaaacttagaattgtttcctacagataaacaaatgtcagcttgggtccatctactacatcttattg

SEQ ID NO: 107378 - DNA, 601 bp, Human
ggtaatgctgcagaggtgagttcctgttctggctgtccatgtccaaacaagtgaaacaaatgttttcatactttgcagttgccacgttcattcattcattcattcattcattcattcattcattcatttttgagacgagtttcgctcttgttgcccaggctggaatgcaatggcatgatcttggctcactgcaacctctgcctgctggctcaagtgattctcctgcctcagccttccgagtagctgggataacaggtgcacaccaccatgcctggctattttttatatttttagtagagayggggtttcaccatgttgaccaggctggtctcaaactcctgacctcaggtaatctgcccgcctcggcctcccaaagtgctgggattacaggagtgagccaccacacccggtctgcagttgccacatttaacctttagtgctaagtaaacatttcaccatggttcactttgtacaaaatgagaatctttactgaagcatcccagccaaacataagaatgtactttacaattttttttttttttttttaagcctaaagtccctggaagaggctggcaaactggcttgagaaacacttcactgg

SEQ ID NO: 107379 - DNA, 601 bp, Human
acaattttttttttttttttttaagcctaaagtccctggaagaggctggcaaactggcttgagaaacacttcactgggcatagagctgctgaagctgctcctagtccgtgtgttgatttcactcctataagttggtggctactctgaaatagttttcaaaatttttattgtaaaataaaaggcagttacaggagaactatacaaaagaaacctatggcttaatgaactattatagggcgaactattttgaaatcatgaaataggtccagacgcagatgtttaccctgaatcctggaaagcygtgtgacccatctcagtgctaacctccggcctctctctaaacatacccattcctttggcttttatagtaatcatttttttttgcgtttaaaaataattttattgtccaaatgtgccaccttggacacaatatttaagtcttgtccatttatttttaaatttgataagtctttaaaatcttagtctgtaggctcctcttgcttccttttcttcatgacttatctgttgaagaacttgggtgtttgacttacagagtcttaccccagtcttgacttagctcactgcatggcgatgctatagc

SEQ ID NO: 107380 - DNA, 601 bp, Human
aagaaatcactatgaagtcatactgttgaaattactgtgaagtcaagttgttcctctttggtccgtggggcttaagttgactcacgggtctttttgacttgacctcataatcttctctagcttccttactatctgatctgacaggacattccaggctcatgttttacattttctgttccaactctttatttttatttatttatttatttatttttgagacagagtctcactctgtcacccaggctggagtgcagtggcgcaatcttggctcactgcaagctctgcctcccgggttcacacygttctcctgcctcagcctcctgagtaggactgctggagcctgccaccatgcctggctaattttgtttttgtatttttagtatagatggggtttcaccatgttagctagaatggtctcgatttcctgacctcgtgatccacccgccttggcctcccaaagtgctgggattacaggcgtgagccacagtgcctggccttctgttcaactctaatcagccatcttttcaaaatgccttggcttcttctaatggtatttggagatcacagttggggtactaggcatggtcattgctactgattg

SEQ ID NO: 107381 - DNA, 601 bp, Human
ccatgcctggctaattttgtttttgtatttttagtatagatggggtttcaccatgttagctagaatggtctcgatttcctgacctcgtgatccacccgccttggcctcccaaagtgctgggattacaggcgtgagccacagtgcctggccttctgttcaactctaatcagccatcttttcaaaatgccttggcttcttctaatggtatttggagatcacagttggggtactaggcatggtcattgctactgattggtcattttaagcctttttagttgcaggctaggaaaaaaaatatacrtatatattaacaggtttttaacatatacgttttatgttatatatgtatattgcttataatacaatatgttatcttaactatattatattaataaaatatataccatatggcaatatatttactatataaatatgtttaaatataatgccaaccctaacccaaaatagggtatgtatataaaacaaatttatattataataatcatactgtattaataaaatgcacataacatttttctcatatataatgtatataacaatatagaagtataattaaataaagtctacattttatgtgaga

SEQ ID NO: 107382 - DNA, 601 bp, Human
aaaattgcagaactttaacctctttgttgcctctgtgtatcttcattcttctggattcagaattctgactctcaaggataggggaaatgacagaattagagtatctcacaattgcttatttgtcttgtcctgtgctatacacagagcaatctcaggataacaatgttaataccactaccaatatgattactaaaaacattaaaaatgtatttgtacataatcttcctgtaatattaaaaaaaaagttgtactatatctatattgtcagaaaatgtggctgttatctataaggttttatatrtatatctccttagctttcatttagttttagctctacaagtaaatcccgactctttttgttgatatctcttttgtcattttagtttcctgaagctcattctctagtacaggagtgggcaaaccttttctgtaaggagccagaggggaaatatttttggctttgtaggccctatgatctctgctagtactcattcttattcttatagtgagaaagcaatcacagacagtgtaaactatgagcatggtggctacgtttcagtttcatataatttttatgtgtaatgatacagtatttaaaaaa

SEQ ID NO: 107383 - DNA, 601 bp, Human
gaccctgttccacgaaaagaacataaaattattagctcatactttctttccttgaatttcttactcaaaagagtttattattccattttcttttggtataaaatgttgctgtcaaagtctgatgattatttaaatttctcttttgtataagttacctattcctgtttttttttttttcattttcttttacttaagtaatattgctagaatttttcttggtatgttggtcatcctggaatgaatttctcctgtagtgtggtcttttaatatgtatttttagttcaagtaaattttcttgagytgtatttttaatatttgctcttttttttgctttggttctcttcaaggattcctattattcatatgttggatgttcttttttattttcaatatttctcatcttctgtattatttattcattttttatatttaaattaaatatttttattttcaatttgtctttctcataaggcattgtctgttttccttattcactcttacattctttgtagctgttttcatttctggaatgattttctttttcatttctagttgtatcctgagttctgtcatctcatttctgagcttttctaaatctgat

SEQ ID NO: 107384 - DNA, 601 bp, Human
gctcatactttctttccttgaatttcttactcaaaagagtttattattccattttcttttggtataaaatgttgctgtcaaagtctgatgattatttaaatttctcttttgtataagttacctattcctgtttttttttttttcattttcttttacttaagtaatattgctagaatttttcttggtatgttggtcatcctggaatgaatttctcctgtagtgtggtcttttaatatgtatttttagttcaagtaaattttcttgagttgtatttttaatatttgctcttttttttgctttsgttctcttcaaggattcctattattcatatgttggatgttcttttttattttcaatatttctcatcttctgtattatttattcattttttatatttaaattaaatatttttattttcaatttgtctttctcataaggcattgtctgttttccttattcactcttacattctttgtagctgttttcatttctggaatgattttctttttcatttctagttgtatcctgagttctgtcatctcatttctgagcttttctaaatctgatttatactattttatgttatgtgtcacttaaaaat

SEQ ID NO: 107385 - DNA, 601 bp, Human
attttatgttatgtgtcacttaaaaatgtcttttaacttgttttgaaatattagatgataggccaggtgcggtggctcacgcttgtaatcccagcactttgggaggccaaggtaggcggatcacgagatcaggagttcgataccagcttggccaacataatgaaactccgtctctactaaaaatacaaaaaaaattagccgggcgtggtggtgcgcgtctgtagtcccagctacttgggaggctgaggcaggagaattgcttgaacctgggaggtggaggttgcagtgagctgaggtcgcrccactgcactccagcctgggtgacagagtgagactccgtctcaaaaaaaaaaaaaaaaagaaatgagatgatagttttgatctattgtattggtatgtttttctcctgtgctttcctgccctacatggatgttactctggtccctttttctttgccttataaaaacattgtattggggccaggcatggtggctcacgcctttaatcccagaactttgggaggccgaggcgggtggatcacttgaggtcaggatttcgagaccagctcggccaacatggtgaaaccctgtctctactaaaa

SEQ ID NO: 107386 - DNA, 601 bp, Human
tgggaggtggaggttgcagtgagctgaggtcgcgccactgcactccagcctgggtgacagagtgagactccgtctcaaaaaaaaaaaaaaaaagaaatgagatgatagttttgatctattgtattggtatgtttttctcctgtgctttcctgccctacatggatgttactctggtccctttttctttgccttataaaaacattgtattggggccaggcatggtggctcacgcctttaatcccagaactttgggaggccgaggcgggtggatcacttgaggtcaggatttcgagaccagctyggccaacatggtgaaaccctgtctctactaaaaatataaaaccatattagcccggcatggtggggggtgcctgtagtcccagctacttggaggctgaggcaggagaattgcttgaacccaagaggcggagattgcaatgagccaggattgcaccgctgcactccggagtgagacttcgtatcaagacaaaaaacaaaaaaaattatgttggattttaccttgatattttatttcacttagtttaatgtgtaaaattggtttttctctacatttctttttaaagagccatgtattttaaaa

SEQ ID NO: 107387 - DNA, 601 bp, Human
catttgatagagagatactttataagcacctcttagggctgaaagggtttcttgtctagcatcctgccacttgtaacaccagcaaattctaggcatttgggttcctataatattattttagagtcctgtggacctagctatcttattattctagtgtcctcttttttttctggagacagagtctcactctgttgcccaggctggagtgcagtggtgcaatcttggctcactgcaaactctacctcccaggttcaagcaattctcctgcctcaacctccagagtagttgggattacaggcgygcaccaccatgcctagctgatttttgtatttttagtagaggccactatgttggtcaggctggtctcaaactcctgacctcaggtgatctgcctgccttggcctcccaaagtgctgggattacaggtgtgagccactgtgcccggccattctaatgtcttctttttatcaagacttctggagagtggacaaaaactaacagttgtggcactcaacttggtgctttatattattattgatggggtttaggacatgctactcccaaatttggcaccttggcatataagctgaaggatttggag

SEQ ID NO: 107388 - DNA, 601 bp, Human
ttataaaattgtgactccacatcatgctccgtaatgttcttgttataaattttgacttgtttttctccacaggcagcagaagatgtcgttttcattggacctgacacacatgctattcaagccatgggcgacaagattgaaagcaaattattagctaagaaagcagaggttaatacaatccctggctttgatggagtagtcaaggtgagaagctactttaacttttattgtatatgtcttcaagttaaacattttgtcaaaagtataagataaaatgtaactattgcttttttgggatatccacacacacacacacatatgcacgcacatacatacatgtatatatgtttaaaaaatcagtgtttttacatttatttatttatttatttgagatggagtcttgctcttgtcgcccaggctggagtgcaatgatgcaatctcggttcactgcaacctctgcctcctgggttcaagcgattctcctgcctcagcctcccgagtagctgggattgcaggtgcctgccaccatgcccagctaatttttgtatttttagtagagacagggtttcaccatgttggccaggctggtctcgaactcctg

SEQ ID NO: 107389 - DNA, 601 bp, Human
ttgttcttcctatctttgttccttaaatgggggttttattctgggtcctgagtaggacatttcctctttttattgtgctaacttgccctgggcaatcttactttttttcatggcgtcaattgccaccttttcttttttcttttactattattattattttttgagacaaggtcttgttctatcacccaggctagagtgcagtggcatagtcatggctcactgcaacgtcaacctcgtgggctcaagtgctcctcccacgtcagcttcttgaataggtgagactataggtgtgtgccaccayagctgcctacttttttatattttgtagagacgggggtctcactattttgcctagactggtctcaaattcctgggctcaagcagtccttcccctcggcctcccaaagtgctgggattacaggcatgagccactacacttggcctattgccacttttctgaccaatctcaaatgtatgtatctgttctgaacttcaggattacatatccagttgcttcttatatagctctcactacttgatgcctctgaggcaccttgaaactaacaattaaaagctgaactcatctttctcctgaaactag

SEQ ID NO: 107390 - DNA, 601 bp, Human
gctctgtagtataattttaagtcaagtagtgtgattcctccagttttgttcattttcctcaggatagctttgcctatcctgggtcttttgtggttctatataaattttaggatttttttttctatttctgtgaagattgtcattggtattttgataaggattatattgaatcggtagattgctttaggtagtatggacattttaacaatattgattcttccaacccatgaatgtagaatctctttgcatcttttgtgtccttttcaatttctcgcatcaacgttttatagttgtttttttktgtgtgtgtgtgtgtgtttttttttttagatggaacctcgctctgttgccaggctggagtgcagtggtgcaatctcggctcactgcaacctctgcctcccgggttcaagcgattctcctgcctccggctccctggtatctgggactataggcatgcaccaccacgcccaactaatttttgctttgtttttagtagagacggggttttaccatgttggccatgatggtcttgatctcctgaccttgtgatccacccacctctgcctcccaaagtgctgggattacaggcatgagccactga

SEQ ID NO: 107391 - DNA, 601 bp, Human
tatttctgtgaagattgtcattggtattttgataaggattatattgaatcggtagattgctttaggtagtatggacattttaacaatattgattcttccaacccatgaatgtagaatctctttgcatcttttgtgtccttttcaatttctcgcatcaacgttttatagttgtttttttgtgtgtgtgtgtgtgtgtttttttttttagatggaacctcgctctgttgccaggctggagtgcagtggtgcaatctcggctcactgcaacctctgcctcccgggttcaagcgattctcctgcytccggctccctggtatctgggactataggcatgcaccaccacgcccaactaatttttgctttgtttttagtagagacggggttttaccatgttggccatgatggtcttgatctcctgaccttgtgatccacccacctctgcctcccaaagtgctgggattacaggcatgagccactgaacctggcctatagttttcattgtagagacctttcacttctttggttaagtttattcctaggtattttattttattttattttattcatagctattgtaaatgggattattttcttgatatcg

SEQ ID NO: 107392 - DNA, 601 bp, Human
ctctccaaactgatactgtgccagtctatcctttgcattgtatgtatccgccatacttgacatcgttcagattcttgaaacttatgtgcttagtcatatctgcttctgtcttcattcctgattgtctcttagtcattgtttaggtcttggcttaaatgtaaattcctcacataggcattccttaactgtcttcattagattaggctctctgctgtatttttccttaggaccctacacttaactcatcacattttaaatcatttattcattcatctattcagtagatatttaccaagtgcaygcaatttgtctgacactgtttgaagtgctgttgatatagtagtgaacaaaagagactgaacatatttttatgccctcaaggagcttacactatagaaggaaacagatgataaataataaaacatatgttctatgttgaaacataagagaaaaagactgctggaaggtggggctatattcacaattttatatacaggcatgtcttcatatctacaagggattggttccaagacctaccccctcagataccaaaatttgttgatgctcaagtgccttatatgaaatggggtagtgtttgcat

SEQ ID NO: 107393 - DNA, 601 bp, Human
ggctgaggcctgagaatcccttgaacctgggaggtggaggttgcagtgagccgagatcacgccattgcactccagcctgggcaacaagagcggaactctgtctaaaaaaaacaagaatttcacaagagaatttgaatctattttaaaaattaaatacaagactgggtgcagtggcttacgcctgtaatcccagcactttgggaggccgaggtgggtggatcatgaggtcaggagttcgagaccagcctggccagcatgatgaaaccccgtctctactaaaaatagaaaaattagctgggcrtggtggtgcgcacctgtaatcccagccactcgggaggctgagtaggagaatcgctggaccacaggaggtggagcttgcagtgagccgagatcatgccactgcaccccagcctgggtgacagagcgagactccatctcaaaaaaaaaaaaattaaatagaaattctgtaactgcaaatatatgaaaataaggactttagatagacttaacattggactcaaccaagcaaaatatagtatccatgttatagcatgtatcagtttttgtgtgtgtgtgtgtgtggctgagtgatattcagttg

SEQ ID NO: 107394 - DNA, 601 bp, Human
gcacctgtaatcccagccactcgggaggctgagtaggagaatcgctggaccacaggaggtggagcttgcagtgagccgagatcatgccactgcaccccagcctgggtgacagagcgagactccatctcaaaaaaaaaaaaattaaatagaaattctgtaactgcaaatatatgaaaataaggactttagatagacttaacattggactcaaccaagcaaaatatagtatccatgttatagcatgtatcagtttttgtgtgtgtgtgtgtgtggctgagtgatattcagttgtatgaatatrcttcttaaaaaaatccacctgaggtcaggagttcaagaccagcctggccaacatggtgaaaccctgtctctactaaaaatacaaaaaaattagttgggcgtggtggcaggcacctgtaatgtcagctacttgggaggctgaggcaggagaatcgctagaaccctgggggcggaggttttttgtgtgtgtgtggctgagtgatattcaattgtatgaatataccacttaaaaaaatccatctgaggtcaggagttcaagaccagcctggccagcatggtgaaatcccgactctactaaaaa

SEQ ID NO: 107395 - DNA, 601 bp, Human
acattttctttttctggcttaaggctgttcacaagaagtgaggaaggagctggggtcacaactacttgagggcttactcctgaatgctaactgaaggtagtaagagcccaccctggaagtctgcaaggggcttatccttcgtctgctagaacaactgaattagagttacctgttttcacaggaaagattttggtaatagccttcaaaagaccgtgtccaatatttacagtttcttttttttgtttttgttttttttgagacaagagtctctttctgtcacccaggctggagtgcagtggckcaatcttggctaactgcaacctccacctcccgggttgaagcagttctcctgcctcagcctcccaagtagctgggaccacatgtctgagccaccatgcctgactaatttttttttttttttttttggtatttctagtagagactgggtttcaccatgttggccgggtcttgaactccttacttcaagtgatccacctgcctcggcctcccaaagtgttgggattacaggcatgtgccaccgcgccccgtcattcacagtttttctaaaccccactggctttctgtgcatttggggtctgaa

SEQ ID NO: 107396 - DNA, 601 bp, Human
tgactctgagagaccacagacttagtctgagccaaactcatgggagtctcctaatggcatattgaatatgttgtttgtgcacctcctgtcttgggctcacagcctaatggttggccatctctaactgcaaacctgacagtgccttgttggtttaagatttggagagactgtctctcctaggcccagacttccatggacaaagcaagtcaagacagaggaaaatactcaaggttcccaggtaaattgtgttctatttggatgatgatctgatgaaaccttctgaactcactggcttctagartcagcatgaaaatgggcttatgaaacctatgcctgtcttctttcaggtgaactttgacttatggacttagaataaaaaatgttgaggacagtatattagtaatatgggaggtttcttccaatattaaacattttcaaatgtgataagaaattcagtgggtctttattcctacagttgttgaaaaggaaattggacctctacccagtgtgactcatctcaccattgtggttggggagacccctgagggggtcgctcagtgggcctcagagaagcatgcagatgccagatctaagatcttga

SEQ ID NO: 107397 - DNA, 601 bp, Human
agccaaactcatgggagtctcctaatggcatattgaatatgttgtttgtgcacctcctgtcttgggctcacagcctaatggttggccatctctaactgcaaacctgacagtgccttgttggtttaagatttggagagactgtctctcctaggcccagacttccatggacaaagcaagtcaagacagaggaaaatactcaaggttcccaggtaaattgtgttctatttggatgatgatctgatgaaaccttctgaactcactggcttctagagtcagcatgaaaatgggcttatgaaacctwtgcctgtcttctttcaggtgaactttgacttatggacttagaataaaaaatgttgaggacagtatattagtaatatgggaggtttcttccaatattaaacattttcaaatgtgataagaaattcagtgggtctttattcctacagttgttgaaaaggaaattggacctctacccagtgtgactcatctcaccattgtggttggggagacccctgagggggtcgctcagtgggcctcagagaagcatgcagatgccagatctaagatcttgaactgtggcttttagtgggcttcgaacatg

SEQ ID NO: 107398 - DNA, 601 bp, Human
tttagtgggcttcgaacatgtgtctgtgggtaatacacttggttttgcttgttcaacaggttattttggttatcttcttaggaggctgcatctgaatttgcagcctctgttctagtaaatttggaaaatatggaaaggtagacaggagaaaagaaatctcatcttttcagtttttttccttgtatgcattagatgatttgtaacatcctattacactctcaaatgattgattctcattatctgcactaacgactatttctgaatttgtgacgccacagctgaacctgcaggttatagtttycagataagcatttacaaataatttttaaggaatgtccttttgtttccctgggaaattttttttttttttttttttttgagacggagtctcaccctggagtgcagtggtgcgatctcagctcactgcaacctctgcatcccgggttcaagcaattctcctgcctcagcctcccgagtaattgggattacagacatgaaccaccatgtccagctaattttgcatttttagtagagacagggtttcgccatattggccaggctggtctcaaactcctgacctcaagtgatccacctgccttgg

SEQ ID NO: 107399 - DNA, 601 bp, Human
ggtagagcctggtggtctgttttgacagggcactgattggtgcgtttataatccctgagctagacacaaaggttctccacatccccaccagattagctagatacagagtgtcaacacaaaggttctccaagtccccaccagagtagctagatacagagtgtcgattggtgcattcacaaaccctgagctagacacagggtgctgattggtgtatttacaatccctgagctagacataaaggttctccatgtcctcaccagactcaggagcccagctggcttcacccagtggatcccgcacyggggctgcaggtggagctgcctgccagtcccgcgccgtgcgcccgcactcctcagcccttgggtggtcgatgggactgggcaccgtggagcagggggcggcgcacatcagggaggctctggccccacaggagcccagggagggggtgggaggctcaggcatggcgggctgcaggtcccgagccctgcccggcgggaaggcagctaaggctgggcgagaaatcgagcgcagtgctggtgggctggcactgctgggtaacccagtacaccctctgcagctgctggccagggtgctaagtccc

SEQ ID NO: 107400 - DNA, 601 bp, Human
gctgcaggtggagctgcctgccagtcccgcgccgtgcgcccgcactcctcagcccttgggtggtcgatgggactgggcaccgtggagcagggggcggcgcacatcagggaggctctggccccacaggagcccagggagggggtgggaggctcaggcatggcgggctgcaggtcccgagccctgcccggcgggaaggcagctaaggctgggcgagaaatcgagcgcagtgctggtgggctggcactgctgggtaacccagtacaccctctgcagctgctggccagggtgctaagtccctcaytgcccggggccggcagggccagccggctgctccgagtgcggggcctgccaagcccacgcccacccggaactccagctggcccgcaagcgcagctagcagccctggttcccgctggcgcctctccctccacacctccgtggaagctgagggagctggctctggccttggccagcccagaaaggggctcccacagtgcaggggtgggctgatcaggtccctcaagtgctgccaaagtgggagcgccaagagcgagcgagggctgtgaggactgccagcacgctgtcacctctcacttcttca

SEQ ID NO: 107401 - DNA, 601 bp, Human
tggagcagggggcggcgcacatcagggaggctctggccccacaggagcccagggagggggtgggaggctcaggcatggcgggctgcaggtcccgagccctgcccggcgggaaggcagctaaggctgggcgagaaatcgagcgcagtgctggtgggctggcactgctgggtaacccagtacaccctctgcagctgctggccagggtgctaagtccctcattgcccggggccggcagggccagccggctgctccgagtgcggggcctgccaagcccacgcccacccggaactccagctggccygcaagcgcagctagcagccctggttcccgctggcgcctctccctccacacctccgtggaagctgagggagctggctctggccttggccagcccagaaaggggctcccacagtgcaggggtgggctgatcaggtccctcaagtgctgccaaagtgggagcgccaagagcgagcgagggctgtgaggactgccagcacgctgtcacctctcacttcttcaggaggactgcaagtattcaggcaattgactacattttgataatgctaagctcaaggcgcaggggcctatgcatataggatgg

SEQ ID NO: 107402 - DNA, 601 bp, Human
tggacacagctctaatgtcagtgaaaacatcttattgcaaaagcctggaggtgagagacagtgagaactctggaaaactgcagatttgtagtatgaggggctgcagttagaaagggagctagagagaaaattaggatccagatatgtatgggctggaatgtgatgtaacttattttgaaggctattcttgtggtttggggagcctctgaataatttcatgcagaagagttaacatgacagaattgtggcattagaaaactcattttggtttgttgtgtggaaagtaaattggagcatggcmaaacttgaagttggtagacaaattaggatcctcttctaatccaggatagaaacggtagacccctaaaataaagtattgtatgcaacaaagtagatggtgttgagaaagatagtggaagtggaatccatgggattatgtgatctgttcaatgtcaggtgtgaagtggagggaaggatcattgatgattattttactgcatttggttgtaatacctattaacacaccagtttcagaagaaatttatttaatgtcctttagttctaattgttcgttaagaggaaatagtaatacccgtttaca

SEQ ID NO: 107403 - DNA, 601 bp, Human
tagttctaattgttcgttaagaggaaatagtaatacccgtttacaccacagaacagagtatggccgtgtatttgaatgagttttgtaaattaggcagtgtagatttaaagtagtaattgtttttatcacctaattggccagactttaaaaactgtactcttgctttagcagaaggaggcaaataactaagaaagctagtgtgaaggaaatcatttaaaaaagaccctaaaaacaaaaaccaaaaaattggagacaagctgtgtctcagcaattagaaagtataacattaaacattagtgtrtttgtccctgctaaaccaagaataatcagttttcctgatgaagcctcaaaggttttatattttggaaaaaaagactcaattatttttactatgctgtttttacaatgatagaaaagtgtactaaattttagaaagcttttttttttctttgagacgaagagtgtcgctcagtcacccaggctggagtgcagtggcgcgatcttggctcactgaaaagcaccaccttccggtttcaagtgattcttgtgcctcagcctctcaagtagctgagtttacaggtgtgggctgccacacctggct

SEQ ID NO: 107404 - DNA, 601 bp, Human
tgtgaaggaaatcatttaaaaaagaccctaaaaacaaaaaccaaaaaattggagacaagctgtgtctcagcaattagaaagtataacattaaacattagtgtatttgtccctgctaaaccaagaataatcagttttcctgatgaagcctcaaaggttttatattttggaaaaaaagactcaattatttttactatgctgtttttacaatgatagaaaagtgtactaaattttagaaagcttttttttttctttgagacgaagagtgtcgctcagtcacccaggctggagtgcagtggcgcsatcttggctcactgaaaagcaccaccttccggtttcaagtgattcttgtgcctcagcctctcaagtagctgagtttacaggtgtgggctgccacacctggctaacttttgtgtttttagtagagatagggttttgccatgttgcccaggcttgtctggaactcctggtctcaagtgatccaccttcacgacctcccaaagtgctggaattgcaggcatgagccactgtgcccggccgaaagatttggaagtatattaaaacagaaagaatcttctgcctgactttgagttaactggatta

SEQ ID NO: 107405 - DNA, 601 bp, Human
tcttacctgtagtgtcttgaaacaaattattatttttttttaataaacagtcactgattcccttctagaaccagctgtaaactcctaagtggctttcatatgaatgggtagcaggattctcatccacagaatagaaaattaaggattggtaagtaggcagtagcaagtgagaaggatgtctgaatcatgaatggtggtcggcgttgacactaataccactatcaaaatgtatgggtgtttagcatctgggaagaatgattcgaatgtgcctgtctttgttgtagtgttttctgcgcttccytgtgttttgccctgttcaccagcaataccgagttcgtagatcgtctgatccagtgcattataagagaggaagtacatgttttttccagtattgtagcgccagggttagttctatgttatctaggttcagaagatgagtaatgacacaggatataacaagtaaggccaggcagggaaggtaccaacatggtagtttggggtggcgggctgcccattttctcataattactaaccttaattgagtacctactgtgggccaggtgctgttctaatgtgtttcagccttgactaatttcatctt

SEQ ID NO: 107406 - DNA, 601 bp, Human
ctaataccactatcaaaatgtatgggtgtttagcatctgggaagaatgattcgaatgtgcctgtctttgttgtagtgttttctgcgcttccttgtgttttgccctgttcaccagcaataccgagttcgtagatcgtctgatccagtgcattataagagaggaagtacatgttttttccagtattgtagcgccagggttagttctatgttatctaggttcagaagatgagtaatgacacaggatataacaagtaaggccaggcagggaaggtaccaacatggtagtttggggtggcgggctrcccattttctcataattactaaccttaattgagtacctactgtgggccaggtgctgttctaatgtgtttcagccttgactaatttcatcttcttaataaccctatgagatagatactgttattatgtccattttacagatgaggaaaccgaataccagagaggcactctagtaactcagtcacagtcacagaagcagtattggagcccaagccttctggcatagcgcctgtgttctttttttctttgagacgaagtcttgctctgtcgcccatactggagtgcagtggcactatcttggc

SEQ ID NO: 107407 - DNA, 601 bp, Human
tgttcaccagcaataccgagttcgtagatcgtctgatccagtgcattataagagaggaagtacatgttttttccagtattgtagcgccagggttagttctatgttatctaggttcagaagatgagtaatgacacaggatataacaagtaaggccaggcagggaaggtaccaacatggtagtttggggtggcgggctgcccattttctcataattactaaccttaattgagtacctactgtgggccaggtgctgttctaatgtgtttcagccttgactaatttcatcttcttaataaccctrtgagatagatactgttattatgtccattttacagatgaggaaaccgaataccagagaggcactctagtaactcagtcacagtcacagaagcagtattggagcccaagccttctggcatagcgcctgtgttctttttttctttgagacgaagtcttgctctgtcgcccatactggagtgcagtggcactatcttggctcactgcaacctccgcctcctgagtagctgggattgcaggcatgcgccaccacgcccggctaatttttttgttttttttttggtagagacggggtttcaccata

SEQ ID NO: 107408 - DNA, 601 bp, Human
ggccaggtgctgttctaatgtgtttcagccttgactaatttcatcttcttaataaccctatgagatagatactgttattatgtccattttacagatgaggaaaccgaataccagagaggcactctagtaactcagtcacagtcacagaagcagtattggagcccaagccttctggcatagcgcctgtgttctttttttctttgagacgaagtcttgctctgtcgcccatactggagtgcagtggcactatcttggctcactgcaacctccgcctcctgagtagctgggattgcaggcatgygccaccacgcccggctaatttttttgttttttttttggtagagacggggtttcaccatattggccaggctggtcttgaattcctgacctcaggtgatccgcctgcctctgcctcccaaagtgctgggattacaggcaggagccgttgtgcccagcccacacctgagctcttaactgcaaggcttggttaccccacaggccatgttctaggtattaacaaataaatgacatttgcagaaaaggcaccagatttttgttaactcttttcacgttttttctggttagtttttactaccattta

SEQ ID NO: 107409 - DNA, 601 bp, Human
ataaataaagaacaaaggctgggcgcggtggctcactcctgtaatcctagcactttgggaggctgaggtgggaggatcacttgaggtcaggagttcgaaaccagcctgccaagatggtgaaaccccatctctactaaaaatacaaaaaaaattagtcatacgtggtggtgtgtgcctataatcccagctacttgggaggctgaggcaggagaatcgtttgaacctgggaggtggaggttgcaatgagcggggatcgctccattgcactccagcctgggtaacacagtgagactctttctcaaaaaaaaaaaaaaaaaagcacaaagtatatttagtaaaataaagtttaaccttttacatttttatgaaataaagtttgatatctatacattgaaatgagctgctttcttttgttttgtattataacttaaacttgtggcttttcaatttgaaaacttattgccatgtagaatttgattttttttttttcctaatgcaacactttacttaaaaattatggagtagaactatattttttagaagagcaggttttacaaaacctaaaattcaaactctggaagttgcatgatgtggtggaaga

SEQ ID NO: 107410 - DNA, 601 bp, Human
ataatatttagtagtttattattgaaacagtaatagagattttaatgtccagtgcataataggtcctcagtaaagtatttttggatgaatgagtgacaagtgaaaagttaatttttaaggcagcttgattttatttgaaagttcatttagaagaatctaattttcatagtaagaagacttagcatgctgttaagttgaaagataagcttgctttgtggcatgctatagaagtgttggatttgtggcagtggaatttttaatttgctgtgtcagatatagatatggctttatgtatccatayacacccagctataacatgtatattcaaataagtgacaaaatatgtctaatgaatttttgaattaccttttaaaacttgcctgttagttctctcaagtgatgaactttttacaatagcagtttattttctctcatcacgttggaaagaaatgttaaaagttttcttctaggtttattataatccagtcttcatcagccatcactcttcctgtattttgttcaagaggcactaattgttcgcatttggcaggtttaacacttcctgacagagaggctattaaggggaagtattctccaataa

SEQ ID NO: 107411 - DNA, 601 bp, Human
tagtaagaagacttagcatgctgttaagttgaaagataagcttgctttgtggcatgctatagaagtgttggatttgtggcagtggaatttttaatttgctgtgtcagatatagatatggctttatgtatccatacacacccagctataacatgtatattcaaataagtgacaaaatatgtctaatgaatttttgaattaccttttaaaacttgcctgttagttctctcaagtgatgaactttttacaatagcagtttattttctctcatcacgttggaaagaaatgttaaaagttttcttytaggtttattataatccagtcttcatcagccatcactcttcctgtattttgttcaagaggcactaattgttcgcatttggcaggtttaacacttcctgacagagaggctattaaggggaagtattctccaataactgtcactggctggaacaaagaaccttccaactcaatgtgtggaaaccactaacattcttaaatgacccttttcatggattttcatccctttaagctaaagtttggagaatgtagggtcagcgaaaacagcaacgtgtaataaagcagtaaaccttgattttggaa

SEQ ID NO: 107412 - DNA, 601 bp, Human
catcactcttcctgtattttgttcaagaggcactaattgttcgcatttggcaggtttaacacttcctgacagagaggctattaaggggaagtattctccaataactgtcactggctggaacaaagaaccttccaactcaatgtgtggaaaccactaacattcttaaatgacccttttcatggattttcatccctttaagctaaagtttggagaatgtagggtcagcgaaaacagcaacgtgtaataaagcagtaaaccttgattttggaaggcatagggtgggagatatagatttatctckgacttgaaaacaattgttatttggaaaatctcattagcagatgtgactgcttggagtaaaaaaaaaaaaaacaacttaaaactgatgtcgctttcaggacccctttgaacttaacaagcacctatttgtggagcagactggctaatgaaaggaaattaaatttttctgacaacttcccctgccaacctccttattcaggggatgttattaggtactgaagaactttaaggaagattttttttattagacataagtgaaccagttataaacatccccccccgcccccttctcggaggattc

SEQ ID NO: 107413 - DNA, 601 bp, Human
acacttcctgacagagaggctattaaggggaagtattctccaataactgtcactggctggaacaaagaaccttccaactcaatgtgtggaaaccactaacattcttaaatgacccttttcatggattttcatccctttaagctaaagtttggagaatgtagggtcagcgaaaacagcaacgtgtaataaagcagtaaaccttgattttggaaggcatagggtgggagatatagatttatctctgacttgaaaacaattgttatttggaaaatctcattagcagatgtgactgcttggagtaaaaaaaaaaaaaacaacttaaaactgatgtcgctttcaggacccctttgaacttaacaagcacctatttgtggagcagactggctaatgaaaggaaattaaatttttctgacaacttcccctgccaacctccttattcaggggatgttattaggtactgaagaactttaaggaagattttttttattagacataagtgaaccagttataaacatccccccccgcccccttctcggaggattctgacatggttgctctacattttaaacgtattagcttaaaagcttaaaaaacactgggc

SEQ ID NO: 107414 - DNA, 601 bp, Human
gatgtcgctttcaggacccctttgaacttaacaagcacctatttgtggagcagactggctaatgaaaggaaattaaatttttctgacaacttcccctgccaacctccttattcaggggatgttattaggtactgaagaactttaaggaagattttttttattagacataagtgaaccagttataaacatccccccccgcccccttctcggaggattctgacatggttgctctacattttaaacgtattagcttaaaagcttaaaaaacactgggcttcacttcagcattttagtcattttytaaaaattcagtcacacttaccagctgtggtttcaaaacaatattgtcagtctttgtggtagtttagtttgtgtcactgaattacacaaacacacacacacacacacacaccccacacatacccacacacacgaaggaggcttagatttcaacattatctttattgttatttggggaaatgattcagcagtgtcctgtgttggatgtgttaggtgagggttaatgatcagtgaaattacttagattcaagggaagtttttgtcttttcatcttcttagaggtagaagtggcattggttaa

SEQ ID NO: 107415 - DNA, 601 bp, Human
caggggatgttattaggtactgaagaactttaaggaagattttttttattagacataagtgaaccagttataaacatccccccccgcccccttctcggaggattctgacatggttgctctacattttaaacgtattagcttaaaagcttaaaaaacactgggcttcacttcagcattttagtcattttctaaaaattcagtcacacttaccagctgtggtttcaaaacaatattgtcagtctttgtggtagtttagtttgtgtcactgaattacacaaacacacacacacacacacacacmccacacatacccacacacacgaaggaggcttagatttcaacattatctttattgttatttggggaaatgattcagcagtgtcctgtgttggatgtgttaggtgagggttaatgatcagtgaaattacttagattcaagggaagtttttgtcttttcatcttcttagaggtagaagtggcattggttaatatttagcaataactaatccttaaatggataaacttttaccccttactgtttaggaaggtattttctttcttttgctttttggagttttttcctccagtagttggttcgttg

SEQ ID NO: 107416 - DNA, 601 bp, Human
agaagtggcattggttaatatttagcaataactaatccttaaatggataaacttttaccccttactgtttaggaaggtattttctttcttttgctttttggagttttttcctccagtagttggttcgttgaaattaaagtttttttttaatttatgtaacaagatacaattgtagagataaaatatgtacctgaaaaaaaaaaaaaagaaagaaacaatagaaaagaaaaggtaatgcagattaccaaaaggattttttggaacaattcgtaattcctgtaggtactggaaattaactttyatatttctgcaaaatcgatcaactactcccaaacaatagagaatcaactccccctgctgacagaatctaggaaaacatgacacataatattggacagaaacaagctggctgcggacaagctttaatgacctgatttatgattcagtattgattgtaaacatctaaattctgccattaaattccggcaactgcaccaaatcattggcaattctggtagtgcttcctgccagctcatttcaactgctttgagtttcttaatataataatgatgaggtagaatttacattccacttatggtat

SEQ ID NO: 107417 - DNA, 601 bp, Human
ccggcaactgcaccaaatcattggcaattctggtagtgcttcctgccagctcatttcaactgctttgagtttcttaatataataatgatgaggtagaatttacattccacttatggtattaattttacatttctctgaatgaaaagggttagaaggtagtaaaattgaacattaaatgaatcggaggagacagtagtgcaatatatgactgccctaaagacattgtgcaatgcctcatgggattaatgttgagtctcatttcctgcttttacaggatgcagaagaagctgtcagaattgcragggaaattggtaagtccttaaattaactttggtaggatttctgtgtctttcagcagatacggttgagtcaacaggtaataagtaattcccatagagcaaataatactttaatagttttagattttgattacttgttgctctggaagaatgtatcagttgaattgccaaattctattattaaaggagactgtaaagagtaatttgaccttaactatacataactcttttgtaagatgagatcacaggctaattcaaagaaggaattgtcttaagaattctaaagattggatataagttta

SEQ ID NO: 107418 - DNA, 601 bp, Human
gtaggagtaacaagtagaccattgtgaaatggttttggattttgttgttgttgttagcattttgttgtttctgtgggggtttttttgtttgttttttacattatggctcacactggcctaaaacactgtttggaaaatgatagtttcttttgtgcaccttgtggggtgtgtgtgtgtgtgtgtgtgtgtgtgtgtgtgtgttggtctttatacgtgaggggaaaaatacactgcactattattggtctgttcacctacaatctactcaagtgatcacaggttcaagttatttattattatytttttctttgagttggagtctcgctctgtagcccaggctggagtgcagtggcgcgatctcggctcactgcaagctccgcctcccaggttcacgccattctcctgtctcagcctctggagtagctgggactacaggcgcccgccaccacgcccggctaattttttgtatatttagtagagacagggtttcaccgtgttagccaggatggtctcgatctcctgacctcgtgatccgcccgtcttggcctcccaaagtgctgggattacaggcgtgagccaccgcgcccggccggttcaagtt

SEQ ID NO: 107419 - DNA, 601 bp, Human
ctagttagaaactaaaaagttggccgggcgtggtggctgacgcctgtaatcccagcacttttggaggctgaggcgggcagatcacgagatcaagagatcaagaccaccttggccaacatggggaaaccccgtctctactaaaaatacaaaaatttgctggacctagtggtgcacacctgtagtcccagctgctcggtagcctgaagcaggagaatcgcttgaacctgggaggtggaggctgcagtgagccaagattgcaccactgcactccagtctggcgacagagcaagactccatctcaaaaaaaaaaaaaaaaccctaaaatcttgcatttttgctgctgaatctttaagcaaagaaacctaacaaaagataaaactttttctatccattttataattgtgtaaagtgatcaggaaaaataaaaggcgctaaagtcatacacttatcggcctacatattttgattctttggtgacttctgtggaaaattatgtcttttgtttattttaatggtgtatattcctttaaaaaccctagcccctgttttacccaccaatccatgcaaccacattttgaactccccccctgcccctcaacct

SEQ ID NO: 107420 - DNA, 601 bp, Human
gaaagcagtttggcgatttctgaaagaactaataatagaacaaccatttgactcagcacttccattactgggtatatacccaaaggaaaataaattattctgccaaaaagatacctgtactcatatggttatcacagtatcattcacaatagcaaatacatggaatcaacctatgcgtcccatcattggtgggttgaataaagaaaatgttgtacgtatacaccacagaatactatgcagccattaaaaagaatgaaataatgttgtttgcagcaacatggatgcagctgaaggccattawcctaagcaaattaatgcagaaacagaaaaccaagtaccacattttcacttcaagtgggagctaaacattggccacacgtggacataaacgtggaaacagtagacactggggactgctagagagaggaggggaggcaagggcagaagaactttctgttgggttctgtgctcactgtttgggtcatgggatcaacagaagcccagacctcagcatcatgccctacacccttgccacaaacctgtacacgtaccccttgaatctaaaattttaaagaaaaagataatttcagtttcacatcct

SEQ ID NO: 107421 - DNA, 601 bp, Human
caaaaattaaagtgggtcaaaaactcatataagcacggttttctccttgatttacaggggatttcaggatctttaaggttatcattaactttatgaatagcacacttaaatagttgtttaggttctggataggcataatttattgggtgactttgtttttttaaaccttattttgtcctaaggttgctacagctgtaaatactagacaacgctactacccaatggctggatatattaaggaagactccataatggaaaaactgcagcctaagacgtatgttccatgtgtacttatttgagtatttaaagtcaatgtgttactgaaatagttttagaattattgataaaatgtcatccttaagtctgcatttctaacctactgtttatggaatgctctttaagttcatacttcatcttagctgtcagtggaatggagacttcagctctttaaagaagcagcgtttgtttgtccttatttaaagaaagaaaaaatgttaaggattaccacatcaagaaaggctgagagtacactggctaaagttactcgtgctggatggaaggaagttatagagaaaaaaagtaacttagttctctcttgatt

SEQ ID NO: 107422 - DNA, 601 bp, Human
tggaatgctctttaagttcatacttcatcttagctgtcagtggaatggagacttcagctctttaaagaagcagcgtttgtttgtccttatttaaagaaagaaaaaatgttaaggattaccacatcaagaaaggctgagagtacactggctaaagttactcgtgctggatggaaggaagttatagagaaaaaaagtaacttagttctctcttgattctttttaaaaatttttaaaattctaagtttttttaaagacagggtctcactctgtcacccaggcttgagtgcagtggttttgatcrtggctcactgccgcctcagactcctggtctcaagctagcctctcacctcagcctttggagtatctaggactacaggcatgcaccaccatgcacagctaatttttaaatttttttgtaggcatggagtctcattgtgttgcccaagctggtctcaaactcctggctttaagtgatccttctgcctcagcctctcaaagtgctggaattacagccgtgagccactgcacccagcttctcttgattcttaaaagtagtgcaagtatagtacaatggaagactttgtgaagagttggtttgaga

SEQ ID NO: 107423 - DNA, 601 bp, Human
gtctcaagctagcctctcacctcagcctttggagtatctaggactacaggcatgcaccaccatgcacagctaatttttaaatttttttgtaggcatggagtctcattgtgttgcccaagctggtctcaaactcctggctttaagtgatccttctgcctcagcctctcaaagtgctggaattacagccgtgagccactgcacccagcttctcttgattcttaaaagtagtgcaagtatagtacaatggaagactttgtgaagagttggtttgagaagtgatttataaaaggaaaaataatamctttggggttcttttattcatttttccattgttgtataagactttatacatgtatgcattaatagattctctttttgaattagtaatatctttttaaatacacccagccagagatgagtatctatgttactgactatttcacttaattactaatgcttctgtatgtcttttcctgctagtctgtaagcccctttaagggaatggaccacattttattcccctttatatctctggtttgggacacagagtaaacatgtaatgtttattacagtacatgtttgatttttgcagctttttaag

SEQ ID NO: 107424 - DNA, 601 bp, Human
cccaaatttgttccaaataaccattttaaaaattaaatttatgtcaattatatctattttagaaactgctattctctaaggtacagtttggttttaaaatggttgtatatttttaaattatagtaatccttgactcatttactgatttgtctttaatattttgaaacaggaattcagtaatggaatcctcagggctaatgcactcatgtttttaagaacatgaatattcacttttcaaagaatagaatgtttaaaaattatttggtgtagtattttttctctgtaacatttaaacatcatmttttccccataagctgtaagctgatgattaactcagcaaacactagttactgtgtgctagccaatatggtgatacaaagataaaaatagctgggcatgatggctcatgcctttaattccagcactttgggtggctgaggtgggaggatcacttgagtccaggagttcgagaccagcctgggcaacacagtgagaccccatctctaaaacagataataaataaaactctggcttctatagactagagaatgcaactaactttttctttgcaattaacttgcttagttaaattcattacctt

SEQ ID NO: 107425 - DNA, 601 bp, Human
aactttttctttgcaattaacttgcttagttaaattcattacctttttttaattctccagacttgttaagtaccttctttttaatagctggcatttgtatatataaacacttacttaattggtgagcttatcacatttcattgattatcaacatctgtaccaaaaaataccacgtaaggaccagtaattaagaaattaaaacacaatatataagccattatttttggaatttttttaaattaaaatttgtatgaaagcatatttcctcatggtttctctcttcccacttatggttaattgrtaattcactgtacatgttcttataagtcattatatgaattattttttatggtaaaatctgaatagaagattaaaaccattacattgattgatgaggtaatattggtatttaaaataatgtacgtgggccaggcacagtggctcacacctataatcccagcactttggggggccgaggtgggtagatcacttgagcttaggattttgagaccagcctggacagcattttgaaatctcatctctacaaaaaatacaaaaattagccgagtgtggtggcacatgcctatggtcccagctactt

SEQ ID NO: 107426 - DNA, 601 bp, Human
ttaatagctggcatttgtatatataaacacttacttaattggtgagcttatcacatttcattgattatcaacatctgtaccaaaaaataccacgtaaggaccagtaattaagaaattaaaacacaatatataagccattatttttggaatttttttaaattaaaatttgtatgaaagcatatttcctcatggtttctctcttcccacttatggttaattgataattcactgtacatgttcttataagtcattatatgaattattttttatggtaaaatctgaatagaagattaaaaccatyacattgattgatgaggtaatattggtatttaaaataatgtacgtgggccaggcacagtggctcacacctataatcccagcactttggggggccgaggtgggtagatcacttgagcttaggattttgagaccagcctggacagcattttgaaatctcatctctacaaaaaatacaaaaattagccgagtgtggtggcacatgcctatggtcccagctacttgggaggctgaggtgggatgatcgctggagcctgggaagtcgaggctgccatgagccatgatggtgccactgcactctggc

SEQ ID NO: 107427 - DNA, 601 bp, Human
taaaaccattacattgattgatgaggtaatattggtatttaaaataatgtacgtgggccaggcacagtggctcacacctataatcccagcactttggggggccgaggtgggtagatcacttgagcttaggattttgagaccagcctggacagcattttgaaatctcatctctacaaaaaatacaaaaattagccgagtgtggtggcacatgcctatggtcccagctacttgggaggctgaggtgggatgatcgctggagcctgggaagtcgaggctgccatgagccatgatggtgccactgcactctggcctgggtgacagagaaagatcctgtcacaaaaaataaaataatatacttgatacttttcaggataaagaattgttctcaggactttaagaagactgctgatcagctaactactggtttagaacgttcagcctccacagacaagacacttttgaactcatcagctgtaatgttggtatgaaacatattggtcatgaagtacgatgaaggcaaacgtttgactttgtctctagtagctcaactttcttctcctataattatagattcttttggaagtttatacgtaacaagtta

SEQ ID NO: 107428 - DNA, 601 bp, Human
ttttgaaatctcatctctacaaaaaatacaaaaattagccgagtgtggtggcacatgcctatggtcccagctacttgggaggctgaggtgggatgatcgctggagcctgggaagtcgaggctgccatgagccatgatggtgccactgcactctggcctgggtgacagagaaagatcctgtcacaaaaaataaaataatatacttgatacttttcaggataaagaattgttctcaggactttaagaagactgctgatcagctaactactggtttagaacgttcagcctccacagacaagacwcttttgaactcatcagctgtaatgttggtatgaaacatattggtcatgaagtacgatgaaggcaaacgtttgactttgtctctagtagctcaactttcttctcctataattatagattcttttggaagtttatacgtaacaagttaacccaccctcttacttgaatctcttttgttctatgcttagacagttctcttttcttccaaggcagcctgttctacctttgactgactctgtttcaaagttcttgatatttacctgtgtgtagcttcttccctttgaaactagttattgaatcca

SEQ ID NO: 107429 - DNA, 601 bp, Human
tgaaactagttattgaatccaggttctgtgaaacatgtaaagcatgagtttttaaattttaaatgtgatttttcacttattttaatggcaaccaaaaggcctaattatgtttgttgttgttaatgttattgctgaagatagagttttaccttttatctactcctgataactttaaataatgtattaagattagaaatagaacaaactccaaaatgatattaagtttttgtgttaagatcattaatggaggccacgtgcagtggctcctgcctataatcccagcactttgggagaccaagaygggtagatcacttgaggccaggaattcaagaccagcctggccaacatggcgaaaccccatctctactaaaagtacaaaaattagctgggtgtggtgctgtggtcgtgcacacctgtaattccagttactcgcaaggctgaggcatgagaatctcttaaacctgggaggcagaagttgcagtgagcagagatagcatcactgcactccagcctgtgcaacagtgagactctgtctcaaaaaaaaaataaaaagaaaaaaaaatcattaatgggctggggaaggggagaaagcacttaatct

SEQ ID NO: 107430 - DNA, 601 bp, Human
taagatcattaatggaggccacgtgcagtggctcctgcctataatcccagcactttgggagaccaagacgggtagatcacttgaggccaggaattcaagaccagcctggccaacatggcgaaaccccatctctactaaaagtacaaaaattagctgggtgtggtgctgtggtcgtgcacacctgtaattccagttactcgcaaggctgaggcatgagaatctcttaaacctgggaggcagaagttgcagtgagcagagatagcatcactgcactccagcctgtgcaacagtgagactctgyctcaaaaaaaaaataaaaagaaaaaaaaatcattaatgggctggggaaggggagaaagcacttaatcttgctgacttttccttcaagtgtaaatcttaatggagtcaaattataatctttttttccttaagaactgtttataatttttatatgtatacatgtattgccatgataaattgttcaaggtagttttaagttgaaaaggtaattacagggcattatcccatttaaaaaaatatctttatgaaaaaaatctggaatggtctaactaaagctctaaaatatgaatggtttttatct

SEQ ID NO: 107431 - DNA, 601 bp, Human
agaatcagaaggaaagaaggggtcatggatctaagcaacaatacttaaaacttcaaaaatactaagattgtgtaatacttaacattttaattcaagtatggtttctacggttttttttttaatccacggggtcctatcaaagagaaattcagctacttaaaatgacttgtttcctgtaatgatgaaaagaaaaaaatttagtacactcatcagtggattttttttaggtcttgttgccacattatcagtagaaaatgccagtaaggccaggtgtggtggctcacacctgtaatcccagtgmtttgggaggccaaggcaggaggatcacttgaggctaggagtttgagaccagccggggcaacataatgagactttgttcctccccaccaccaaaaaaaaaattagttggacatggggctacgtgcctgtggtcattgctactcaggaggccaaggcaggaggatcccttgagcccaggagttcaaggttacagtgagctatgctcagcctactgcactccagcctgggtaaccaagtgagacctggtctcagtaaaacaaacaaaaagatatggtcttgctcacaaatagtaaaacttaaa

SEQ ID NO: 107432 - DNA, 601 bp, Human
taatacttaacattttaattcaagtatggtttctacggttttttttttaatccacggggtcctatcaaagagaaattcagctacttaaaatgacttgtttcctgtaatgatgaaaagaaaaaaatttagtacactcatcagtggattttttttaggtcttgttgccacattatcagtagaaaatgccagtaaggccaggtgtggtggctcacacctgtaatcccagtgctttgggaggccaaggcaggaggatcacttgaggctaggagtttgagaccagccggggcaacataatgagacyttgttcctccccaccaccaaaaaaaaaattagttggacatggggctacgtgcctgtggtcattgctactcaggaggccaaggcaggaggatcccttgagcccaggagttcaaggttacagtgagctatgctcagcctactgcactccagcctgggtaaccaagtgagacctggtctcagtaaaacaaacaaaaagatatggtcttgctcacaaatagtaaaacttaaagttgaaccttgtgacttattctatttatattattatctctttacctcttgtgttattttgaagagtctagaa

SEQ ID NO: 107433 - DNA, 601 bp, Human
taaccaagtgagacctggtctcagtaaaacaaacaaaaagatatggtcttgctcacaaatagtaaaacttaaagttgaaccttgtgacttattctatttatattattatctctttacctcttgtgttattttgaagagtctagaaagtaccttttactttcaaaattctacaacttctacaaaataaaaattcccaaattaagtttttgtcttgtttttttttttccaggcacttgaacacatgcagaagcaaacgatagaggaaagagaaagagttatagaagttgtggagaaacagttygaccaacttttggctttttttgattccaggttagtaacttaaaaatatggactcaatgaaactgaagtttctaacactaacttgtcattgtattcctttgtttagaatggtaatgggtaacttttaaacaagtttgtaatgggtaactttcaaacaagtttggaagttggtagtccctacagactgatctttagaactgcaaaatgaaaaataatgtgtaagcttttaaaaattttgcctatttaccttctggtgctgaagctaatggtggtttgtttgagacagggtcttgctctgttg

SEQ ID NO: 107434 - DNA, 601 bp, Human
actaacttgtcattgtattcctttgtttagaatggtaatgggtaacttttaaacaagtttgtaatgggtaactttcaaacaagtttggaagttggtagtccctacagactgatctttagaactgcaaaatgaaaaataatgtgtaagcttttaaaaattttgcctatttaccttctggtgctgaagctaatggtggtttgtttgagacagggtcttgctctgttgcccaggctggggtgcaatggtgtgataatagctcactgcagcctcaaactcctgggcttaagtgatcctgccaccycagccttcaaagtagctggaactacaagcccacaccactacatccagctaattttgtgttttttttttgttgttgttgttttgttttccgagacaagggtctcactacattgtccatgcttttcccaaactcctggcctcaagaaatcatcctgcctcagcctcctaaagtgctgggattacaggtgtacataacggtgcccagctgaagctgttaactgttaaagtaaacaagcttgagccaggtgtggtggcttacacctgtaggattacatggtgatcatcctgtctaagctcactt

SEQ ID NO: 107435 - DNA, 601 bp, Human
ctgtctaagctcactttgggaggctgagatgggggggggatctttgagctcaggagtttgagaccagtctgggcaacacagcgagactccatctgtacaaaacaaaaaaaaatcaaccaggcattgtgtgcatttctgtagtcccagctgcatgggaagctgaggtgggaggattgcttgagcccaattgttgctattgggttatagcaattctttgtatattttgaatatgaaatttttgtctatatgacttacaatattttctcccatttgtaagttgtcttttcactctctcgataawgtcctttgatccacaaaagtttttaattttatgaagtccagtttattgtttcttttgtttcttgtgcttttggtgtcatattcaagatatcactgccaaatctaacatcatgatgccttttccctgtgttttcttttaagagttttatagttctcacatttagatctttgatccatctttagttaatttttgtgtatggcataaggtaaggatccaacttcatccttttgagttggatatccagttttcccagcactatttgttgaaaagattgtcctttcccccactgaatgttcttgg

SEQ ID NO: 107436 - DNA, 601 bp, Human
gtgcttttggtgtcatattcaagatatcactgccaaatctaacatcatgatgccttttccctgtgttttcttttaagagttttatagttctcacatttagatctttgatccatctttagttaatttttgtgtatggcataaggtaaggatccaacttcatccttttgagttggatatccagttttcccagcactatttgttgaaaagattgtcctttcccccactgaatgttcttggcacccttgtcaaaaatgagctcaccatatatgtgaaggattatttctgggatttctgttttatyccgttgttctgtatgtctttccttatgctagtaccatgctgttttgactactgttgttttgtagtaagttttaaaatcagaatgtgtgagtcctacaactttgttccttttcaagattgtttctcagggtctcttaagatttcataggacttttaagatggacttttcaattttcacaaaacaatgtcattgagattttgttagggattgcattgaattgtagatcactttgtgcagtattgacatattaatgatattaagtgttccaatctatgcacatgggatgtcttctcatttatt

SEQ ID NO: 107437 - DNA, 601 bp, Human
tttttttgatggattctcgctctgtcacccaggctggagtgcagtggcgcgacctcggctcaccagaacctctgtatcccgggttcaagtgattctcctgcctcagcctcctgagtagctgggactacaggcacctgccacccgcccagctaattttttttgtatttttagtagagatggggtttcactgtgttagccaggatggtctcgatctcctgaccttgtgatccatctgcctcggcctcccaaagtgctgggattacaggtgtgagccatcacgcctggcctgattctcttttcktagtgtgactataggtttaattctaatcttgaagtcaaacttttgctttcatttttctttgttgtgtatttatctcttctcttctcctttatttccttccttctgctttgagtttagtttggtctttttctagttacttatggtatatcgttaggttgttcatttgcgagctcctttttaaatgtgagtatttacagctataaatttccctcagcattgctttcattgcatcccataaattttgtgttcttgcttcatttgccccagataatttcctaatttcccttgtgatttattctt

SEQ ID NO: 107438 - DNA, 601 bp, Human
tgccccagataatttcctaatttcccttgtgatttattctttgacccattgggatttaggagcatattgttttatttttacatgtttatgaatcttccggggtttttttcctgttatttctaggtcattccattgtagtcagaaaagataccttgtaggatttcaatctttaagtttattaagacttactaataaatgttaatgaacattaaacattagtcagcatggtcttaacatatgttctgtctcaaaatgttacatgcacacttgagaaaaatgtttatcctcatgttgttgggtrtagtgttctaaatatgtctgttgggtccaatcagtctatagtgttgtccaagtaatttattgctttattgattctacactggttgttttatccattattggaagggagatattgaagtctctaatgattattgtagacatgtctatttttccctttaattctgcaaatgtttgctttatatgttttggggttctaatattggtgcatatatgcttataattgttacattaaagtctattttgcctaaaatttgtggagccaccccagctttttaaattatcggcatgtattatctttttc

SEQ ID NO: 107439 - DNA, 601 bp, Human
aacattaaacattagtcagcatggtcttaacatatgttctgtctcaaaatgttacatgcacacttgagaaaaatgtttatcctcatgttgttgggtatagtgttctaaatatgtctgttgggtccaatcagtctatagtgttgtccaagtaatttattgctttattgattctacactggttgttttatccattattggaagggagatattgaagtctctaatgattattgtagacatgtctatttttccctttaattctgcaaatgtttgctttatatgttttggggttctaatattggtrcatatatgcttataattgttacattaaagtctattttgcctaaaatttgtggagccaccccagctttttaaattatcggcatgtattatctttttccatcctttcattttcaacctctatatgtctttagacctaaagtgaaatttttgtggcagcatatagttgggtcatattttttatccattcttcagatttgtgcctttggattagagagtttaatttatttacacttaaaatactgataaggaagtatttttgccatttggtttgttttctgtatgttttatggcttatttgttg

SEQ ID NO: 107440 - DNA, 601 bp, Human
ggctcttgatgtaacagtccttcactgagtggttgtgtgtgccctgagccttgagatcagcctgaggtcaggcttaagatcttctcagatgttttctgagcatgcatcttgcctgggcctcagtgtggctttttcaattcccctgtatatataactgcttttatatgccttaatgtcctaaagagtctgagctcagattctcctccaggccttagatggtctattgtatgtctctacttataatctcctgccttccacaaaatttgcttttctctaattatgtatacatagcttttaactrtaatacatttcagttcaatttaatgcctcatttaccatgttatatgttaattttatcaacaagtgaaagtaccctttcagatacagttcagttactgtttgcctcatttaaccatattatgtaaaattcatcaactactgaacttactcttcaagatactatagatcgactttttctataaatatttatgaaatactgcaaaataactttggaatcttaaatgaaggaaaaagaacctgtgtgaagaatttgcaagaactactgatgattatctatcaaatttaataaaggctaaaagct

SEQ ID NO: 107441 - DNA, 601 bp, Human
atctagctaagaaaatagggcagaaagggagaaaactcttgaagatagcagcacagttgcaaaatgaatctgatcgagttttctctgatcatgtagctctatcctatttcttagtgtctattgttaccttttatacatatctccaaaagtcataaacacttatttgtatccctttgagtgccccaaattgagcctgaatgcaataattaatgaaatacctaaaagatacagttttctttctaaaatcttactgttcagcaatatttgtgacaagattcacacatgaatgattttttttttwaattctagattatccggactttgcagttaacttcagatagtgaattagcacaagttagttctccacaactaaggaaccctcccaggtaagtaagtcatagttcaggagaccataacaagtataaagatgtgctggaacttaaatgtattaaaatagcaagtaataataaattgaaattttgggtcacaaatgtttactaagttagtaaccaaattaagataagtgtaatttgtgctaacttagaaagttatttaaatgtttccttttcaattcattaatgtcagcaattgatttttgttt

SEQ ID NO: 107442 - DNA, 601 bp, Human
tcagttcttactggggtaacaggacttggaaagatattttcttttcccttatctattaaaattaagtagcaagtagaaaggaggagaaaaaggaagtatgcatcttataggcagtgaatatatgggcagtgaaatagcatgctaggttcagggaatggtgtatataattccattctctatgtccccaaggatacatagatgctaagtcttaaagactttgtatgctgtctgatgatgtttgaaccttatgatccatgctgtccagtatagtagccactaatcacatgtagctatttaaatktaaacataaattaattaaaactaaatagaattaaaatccagttcctcagttccattagcccacatttcaagttctcagtagccacatgtcgttagtgactacctgtcttattctatttgtgctgctataacaaagtttaaaaagaacagatgttgtttattcttctgtaactcataaagaacaggtgtttatttgcttgcagttctggcggctgagaagcccaagatcataatgctggcagatttggtttctggtgagggccctgatctctgctttaagatagcactttgaatgctgtgt

SEQ ID NO: 107443 - DNA, 601 bp, Human
atctctgctttaagatagcactttgaatgctgtgtcctcacatggcagaaagcatggaagagcataaaagggacaaataactatcttcacaaggtggaagagcagaagagcaaaaaagggcataagctagttccctccagacttgttgtaaggcacaaatccattcatgagggcagagccctcattgcttgatcattaatttccccaaaggccccacctcttaatgtcaccacaatgggaattaagtttcaacatgaattttgaaacatttagaccaaagcactgctatattagacaatgyggcatatttctattatcaccaaaagttctgttgtacagtatagttctagggagtagaaagccactaaaaggttttaagcatgaaagtaaaaattattagattacattttttagggataattttgatggccatttgggggattatttggcgtaagaggatgacagtgaaggctgaaggatcacttaggccatcatatcagtagactcagcaactcatgagaactaaaacttaactaatagcactggatagggactgagaatagatatgacaaatgcaaaatagggaaaattaataaaactc

SEQ ID NO: 107444 - DNA, 601 bp, Human
aacgtgaggcatgaggaaaagggaagcatcatcaatggtttgttacgctttggtgactaagtcgatggattgtggtattcatcaagattaggaatacaggaagcaaagtaagttgggagggggaagatagtatgttgagtacttactgtttaccagctttctggagagaaatgtgtacagcttaattggatatgaatgctgaaacttaagagatcttggtcttgattctgggtttaggagtaatcagaatatagatgtagaaaccaccaaaagagaaataagttctttcattgtaggtggrttgtctccaatggaaatggtcccctgagaaaagcaacgcatttgttaccttagggaacaaattagtctggctcacagtattaccatttcagaagcacataggatgatgtatactctaagccaggtaaattcatataaaccaaggtcacaaaactgatgtgtagtcaaaatgccagtttgttaacttaatggataaatataattgtgaacagggactagaactgaggagctaacttgtcagaagttacttttttggtaatcttttttgaataaagggaataaaattaatcagataggttaa

SEQ ID NO: 107445 - DNA, 601 bp, Human
catgtactgattacaaatggtagttaaaccatgggtttgcacagtaagagcaggtattcaaacaggtcaaggacaataccctggaaggatactaaaatttaaagcagagaaagggtaatctgtaaaaaaaaaacttgagaaggagcagacagaagttgaaggagaacagaagtggtgttgtataagtcaaagcagaggtttatgacaccggagctgattaataatgttgcatgtctcaggtctaataagaattgttatgaaaagagacatttagattgcaaggtcgtgtacatatatatgrctctcagttgtttggacttcaacatatatcaattttacttagttaaatgtatgtcctctgttggaagaggcagataaacatgcatcattgctaaatccagttggctttgttgatcgttatttccacagtggcttcttaaacactgatctgtgaagaagctaaatccatcatggaataactaaaatataaacttcatgaaacccaatcttatctcattgtaaaatttctatacttgtagatttgatagcctaaaaactgtctggatatgtggagaaaatagaaaaatatggagtagaatgg

SEQ ID NO: 107446 - DNA, 601 bp, Human
gagaaaatagaaaaatatggagtagaatggataaataactggcagtgggtcagtggctattgaataatcatgcccaaaagattcagattaatgtccatggtgggagtttctagtgacttattcatggttgtaccatatacctctgtattcatagcttatatctctgtatttttaaacagatgttatccccaagaaaatgaaattagacagaatgttcaaaagaaatataataacaaaaaggaactttcttgttacgatacatacccaccgctagaaaagaaaaaggttgacatgtctgtcytaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagtaagttaaaatgtaaaagcagaggggaaagatcttgtatctgtaattagacacagttggtacctttttcgtccatgcatttaacagaaatataattgctgttataatcttattcct

SEQ ID NO: 107447 - DNA, 601 bp, Human
tactctcacattttccagagttaggataatttttatttttaatgcagtaatatagctaacctctgaggtataaattaatatctggtttaattagggtattttgagattttttagtgttctcacatataagccttgtataaaagatataaatagagagatgtgatttgtggacatagttttattactttctttgaattaagaacatctcttcaatctttgttgtgagatttaatataaactatcatgattacaatgttatctattttatgacatttaaatgtatcacagttgtatttgattagattttcaatgtcagtattctttccattaacatggagtgagatactacactatgtagttttatactaatagtctcctttaagaccatttttcaagatcagcttttattttcccctacccgttgtctattttattggttgactctccagaattgcattttagaaaaggacacacttctttccactgtattatcattgatgtctcaattacttaagatacctgtaataactttattcattgatacaagggatgttgccattccagtgttttgccaatttcagtacagctttttaaaaactag

SEQ ID NO: 107448 - DNA, 601 bp, Human
ggcaacatggtgaaaccctgtctctacaaaaagtacaaaaacataagtgagtgtggtggtgcacaactgtggtctcagctattcaggaggctgaggtgggaggatcacttgagcctgggaggcggaggtagcaatgagctgagatcccaccactgcactccaccctgggtaacagtgagacctcatctcaaataaatgaatgaatgagtgttttgactctggcagaaatattccccccaataaaaaaaatattttttgagacagagtcttactgtgttgcccaggctggaatgcagtggcrcgatcctggctcactgcaacctcctcaggctcaaatgattcttgtgcctcagcctccggagtagctgggattataggcacatgccacaatcctcagctaatttttgtatttttagtagagatgaggtttcaccatgtcagctaggctgatctcaaaactcctgtcctcaagcgatcctccctccttggcctcccaaagtgccgggattataggcgtgagccatcgtgcgcagccaggaatatttccaaaatttatacttctctcagatgtcaccccagttgtatgtgtttatctttttac

SEQ ID NO: 107449 - DNA, 601 bp, Human
caacatggtgaaaccctgtctctacaaaaagtacaaaaacataagtgagtgtggtggtgcacaactgtggtctcagctattcaggaggctgaggtgggaggatcacttgagcctgggaggcggaggtagcaatgagctgagatcccaccactgcactccaccctgggtaacagtgagacctcatctcaaataaatgaatgaatgagtgttttgactctggcagaaatattccccccaataaaaaaaatattttttgagacagagtcttactgtgttgcccaggctggaatgcagtggcgcratcctggctcactgcaacctcctcaggctcaaatgattcttgtgcctcagcctccggagtagctgggattataggcacatgccacaatcctcagctaatttttgtatttttagtagagatgaggtttcaccatgtcagctaggctgatctcaaaactcctgtcctcaagcgatcctccctccttggcctcccaaagtgccgggattataggcgtgagccatcgtgcgcagccaggaatatttccaaaatttatacttctctcagatgtcaccccagttgtatgtgtttatctttttaccc

SEQ ID NO: 107450 - DNA, 601 bp, Human
tgttgcccaggctggaatgcagtggcgcgatcctggctcactgcaacctcctcaggctcaaatgattcttgtgcctcagcctccggagtagctgggattataggcacatgccacaatcctcagctaatttttgtatttttagtagagatgaggtttcaccatgtcagctaggctgatctcaaaactcctgtcctcaagcgatcctccctccttggcctcccaaagtgccgggattataggcgtgagccatcgtgcgcagccaggaatatttccaaaatttatacttctctcagatgtcacyccagttgtatgtgtttatctttttaccccaccctaaatatgggcattattctttatattttctattggatagttaaaatgacccatttgttcagtttctgtcatctatctatacttgactatattcatttccactcctcctagtctttgttttttaaacaattttaccatgtaaacatttacctcattcagaaattaaatatatattaaaatattatgtgaaacttccccccatcctattcccattctattcagtgtctccatctcttccacattttctttatgcatttataaataaaca

SEQ ID NO: 107451 - DNA, 601 bp, Human
ggatagttaaaatgacccatttgttcagtttctgtcatctatctatacttgactatattcatttccactcctcctagtctttgttttttaaacaattttaccatgtaaacatttacctcattcagaaattaaatatatattaaaatattatgtgaaacttccccccatcctattcccattctattcagtgtctccatctcttccacattttctttatgcatttataaataaacacacacaaattatttttccaaacttctctctccctctctctctctatgtgtgtgtggcgggggtgtctttttttttttttttacacaaaacgtagcataccactgttttgtttttgcattccttccttaacattgtactttggagatcttttcatattagtgaagacacttggcttaagaaaattttctgactgtctttacctctactcaccccaccaaaaagcacacgcattcccctaaatgctgctcagtactttggctttgcctagacattttttcacatctgatttataagactaacctgatttataagacttgggagtcagagtggctatgagctgtattggttctataggtagagtatagat

SEQ ID NO: 107452 - DNA, 601 bp, Human
gtaatacagtagagttacagcatatacgttgactttagaatcttaactatcacatagactatgatttcatttatttagcgtattttgcaagtattatgaagtatttgcagttcaggttactaaagaattcattgttgaaagtgatccatttgttttatcaatcatttagggcttgcactacttcctggggccgacgtgcgatattcccagagttcacaatgccataagacactcttttagaggctattatggttgttcagctttcatgaattattttctaactcatggtttattaatgtgrcttaaacatttttatccaggttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtaatgaaatattagtccaagttaaaatatcaaatttatttaaataatataataacttggccaacccacataagacttgttataatatagatttttgctctaagttcatttgtagtaagcat

SEQ ID NO: 107453 - DNA, 601 bp, Human
ctacattcggaagtattcacaaataaaagacgccaaagtactggagaagaaggtgaatgaattttgcaataggagttcacaccttgatccttcagacattttggaactaggtaatgaaatattagtccaagttaaaatatcaaatttatttaaataatataataacttggccaacccacataagacttgttataatatagatttttgctctaagttcatttgtagtaagcataaaagttttaggattatttaacataaattatttaggcaaattagctaaggattaagatggaatgttggyacattttttagagtgagatatgtacagaaactccattatgtagtagggcgaatttcttttaaaactacaaaacccatgacagattatatagcctgtccccttgtctccatgaagaactgtgcctgtaagatgattcttgtgtaactccagtctcttgctcgccatgtgtgagtgttggggctagcattgagcacctgagattcaggaggcctgtggcacccattcccagcgccctacagaggataattgtaaattcagtcagtcttttaattgtgaggatatgtgaatttgccatgcttc

SEQ ID NO: 107454 - DNA, 601 bp, Human
ggagttcacaccttgatccttcagacattttggaactaggtaatgaaatattagtccaagttaaaatatcaaatttatttaaataatataataacttggccaacccacataagacttgttataatatagatttttgctctaagttcatttgtagtaagcataaaagttttaggattatttaacataaattatttaggcaaattagctaaggattaagatggaatgttggcacattttttagagtgagatatgtacagaaactccattatgtagtagggcgaatttcttttaaaactacaaracccatgacagattatatagcctgtccccttgtctccatgaagaactgtgcctgtaagatgattcttgtgtaactccagtctcttgctcgccatgtgtgagtgttggggctagcattgagcacctgagattcaggaggcctgtggcacccattcccagcgccctacagaggataattgtaaattcagtcagtcttttaattgtgaggatatgtgaatttgccatgcttcgggcttttgttacgagtatttttcttataacgttgactgaatttgattgtaccttgtaatatgaggaagct

SEQ ID NO: 107455 - DNA, 601 bp, Human
agaacagtaaatggcttcagcagacttttatccattgaaagaaagaatagttttatagaatatatacagcaggtcttcaaataacattatctcattataattttgatgagaaaaaaatcaattcctggtttgggcaaatgtctgtgttgagtttgcacattctccccgtgtctgtgtgggttttttcaggtactctggtttcctcgcacatcctaaagatgcacacgttaggttaattggtgtgtctacattgtcccagtctgagtggcagggagagagagagagagagagacaaagagtttgtgtgtgtgtgtgtgtgtgtgtgtgtgtgtgtatgtgtgtgtgtttaccctgcaatggaatggtgttctgaccaggattgtttcctgccttgtgccctgagctgcctggatgggcttcagccaccctcgactctagaataagcgggttggagaatgaataaataaatatatattatcataaaattcataaagtatttgataactatacaaatacatgacaataaatgatgcagtacaaaagcgctctgtgaatccaccttatttatgattgtttttgaactgtggtgccaggaggtact

SEQ ID NO: 107456 - DNA, 601 bp, Human
agtaaatggcttcagcagacttttatccattgaaagaaagaatagttttatagaatatatacagcaggtcttcaaataacattatctcattataattttgatgagaaaaaaatcaattcctggtttgggcaaatgtctgtgttgagtttgcacattctccccgtgtctgtgtgggttttttcaggtactctggtttcctcgcacatcctaaagatgcacacgttaggttaattggtgtgtctacattgtcccagtctgagtggcagggagagagagagagagagagacaaagagtgtgtgtgtgtgtgtgtgtgtgtgtgtgtgtgtgtatgtgtgtgtgtttaccctgcaatggaatggtgttctgaccaggattgtttcctgccttgtgccctgagctgcctggatgggcttcagccaccctcgactctagaataagcgggttggagaatgaataaataaatatatattatcataaaattcataaagtatttgataactatacaaatacatgacaataaatgatgcagtacaaaagcgctctgtgaatccaccttatttatgattgtttttgaactgtggtgccaggaggtactcctta

SEQ ID NO: 107457 - DNA, 601 bp, Human
ttgaaagaaagaatagttttatagaatatatacagcaggtcttcaaataacattatctcattataattttgatgagaaaaaaatcaattcctggtttgggcaaatgtctgtgttgagtttgcacattctccccgtgtctgtgtgggttttttcaggtactctggtttcctcgcacatcctaaagatgcacacgttaggttaattggtgtgtctacattgtcccagtctgagtggcagggagagagagagagagagagacaaagagtgtgtgtgtgtgtgtgtgtgtgtgtgtgtgtgtgtrtgtgtgtgtgtttaccctgcaatggaatggtgttctgaccaggattgtttcctgccttgtgccctgagctgcctggatgggcttcagccaccctcgactctagaataagcgggttggagaatgaataaataaatatatattatcataaaattcataaagtatttgataactatacaaatacatgacaataaatgatgcagtacaaaagcgctctgtgaatccaccttatttatgattgtttttgaactgtggtgccaggaggtactccttacaattctcactttgcaagctgtaattctt

SEQ ID NO: 107458 - DNA, 601 bp, Human
atcctgttgttattagcatatacagaggagattacacagcatctctctgtatataatcagtgatcagaatttaccagattcatttccaaaatatgtagtttaaatgggctctaagactacctgagttctcctgctacttcttctaagtagccatgtgagttgggctagattaggttttctacctagttttcctcacctatgataggaacagtaccttcgtagggttgttgtggggagtaagtgaattcaaacaaaacacagaacatttctgagctcatagtaagcattcacctgtgggcctttttttttgtttgtttgatcttcttttttcctggttgttaatttgtaatccaactggtccctacaaaggtcttcctctacagctaagtctttagttcatcttccctcttctctgaaaaccactgggtgccaataattttggcatttcacaggctacctttcattgttttactctcactcccctttacaaagagaagataattgtttcttctctcattacaaactttaatatgtgtatgtcagtgtacatgtgtacatcacaaagacagatggtcttgcttgtaagtacagtgtaattatg

SEQ ID NO: 107459 - DNA, 601 bp, Human
atttccaaaatatgtagtttaaatgggctctaagactacctgagttctcctgctacttcttctaagtagccatgtgagttgggctagattaggttttctacctagttttcctcacctatgataggaacagtaccttcgtagggttgttgtggggagtaagtgaattcaaacaaaacacagaacatttctgagctcatagtaagcattcacctgtgggcctttttttttgtttgtttgatcttcttttttcctggttgttaatttgtaatccaactggtccctacaaaggtcttcctctacwgctaagtctttagttcatcttccctcttctctgaaaaccactgggtgccaataattttggcatttcacaggctacctttcattgttttactctcactcccctttacaaagagaagataattgtttcttctctcattacaaactttaatatgtgtatgtcagtgtacatgtgtacatcacaaagacagatggtcttgcttgtaagtacagtgtaattatggtaattaatttgcctgtctctcttcctttcttgagcttcttgatggcaagacagtctcattcatctttgttcttattgctc

SEQ ID NO: 107460 - DNA, 601 bp, Human
gctacttcttctaagtagccatgtgagttgggctagattaggttttctacctagttttcctcacctatgataggaacagtaccttcgtagggttgttgtggggagtaagtgaattcaaacaaaacacagaacatttctgagctcatagtaagcattcacctgtgggcctttttttttgtttgtttgatcttcttttttcctggttgttaatttgtaatccaactggtccctacaaaggtcttcctctacagctaagtctttagttcatcttccctcttctctgaaaaccactgggtgccartaattttggcatttcacaggctacctttcattgttttactctcactcccctttacaaagagaagataattgtttcttctctcattacaaactttaatatgtgtatgtcagtgtacatgtgtacatcacaaagacagatggtcttgcttgtaagtacagtgtaattatggtaattaatttgcctgtctctcttcctttcttgagcttcttgatggcaagacagtctcattcatctttgttcttattgctcataagctggttgtcattaagtgactgctaacttagtattctttaggtgttt

SEQ ID NO: 107461 - DNA, 601 bp, Human
atgtcagtgtacatgtgtacatcacaaagacagatggtcttgcttgtaagtacagtgtaattatggtaattaatttgcctgtctctcttcctttcttgagcttcttgatggcaagacagtctcattcatctttgttcttattgctcataagctggttgtcattaagtgactgctaacttagtattctttaggtgtttatctccctatttagcttgtttctgtataacaaactatcataatatgctgtattatatctttcttatagcacttgaacacagtgctatatcatcattaaataaaygaattaagactttttcgtggtagaactaacgtgtctgtaaacttatgaagtggcttttattgataaatgtttataacgatttgtttccctcattatttaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactgggtatgatatt

SEQ ID NO: 107462 - DNA, 601 bp, Human
tctcttcctttcttgagcttcttgatggcaagacagtctcattcatctttgttcttattgctcataagctggttgtcattaagtgactgctaacttagtattctttaggtgtttatctccctatttagcttgtttctgtataacaaactatcataatatgctgtattatatctttcttatagcacttgaacacagtgctatatcatcattaaataaacgaattaagactttttcgtggtagaactaacgtgtctgtaaacttatgaagtggcttttattgataaatgtttataacgatttstttccctcattatttaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactgggtatgatattttataatatgtatccttggcctgcttagaaacattttggagggaggtggagttaaagaataaaggaaattagaggtagagagg

SEQ ID NO: 107463 - DNA, 601 bp, Human
ttcttttctttcttcttttttttgagatggagtcttgttctgtcgcccaggctggagtgcagtggcatgatctcggctcactgcaacctctgcctcccgggttcaagcagtcccctgcctcagcctcccgagtagctgggattaaaggcacctgccaccacgccccgctaatttttgtattttttgtagagacagggtttcaccatcttggccaggctggtcttgaactcctgaccttgtgagtcaccacgcccggctgccctggctgtttcctaatgtctgcggttggttcagtttgttygcagttgcgtctgtggttggtacaaacctaaatccagaacattgtaacattagcgatacttacaattaattactatggaattttactttcttgcacagaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaagtaagtaactt

SEQ ID NO: 107464 - DNA, 601 bp, Human
tatggaactagcaaagtaagtaacttattaaaacttaaatattctttgagattatagctataaatgagagtagcagattttgcctttaaaaaccatgtctgtaaagtaaaccttaacatacctgaagaagtgaaaaatattgctcttagacttttctgagtacagttgttgtctgtgaaaactggattcagataattggatttaagaaaataggctgggcagggcgtctcacaactgtaattctagcactgtgggaggccgaggagggaggattccttggggtcatgagtttgagaccagrctgggcaacatagctagacctcgtctctacaacgaaatacaaaaagaaattaaccaggcgtggtggcatgcatctgtagttccagcttctcaggtcaggagctgaggtgggaggtttgcttgagcccaggagttcgagctatgctcttgccactgtactccaggttgggtgacagagtgagacaccctgtctgtaaagaaaaacgaaaattagaaaaattagagaaattaaggtagctcaaaatataaagtatgtataaatacctaacatcttttggactcttgataactttattagcag

SEQ ID NO: 107465 - DNA, 601 bp, Human
tttttacagcgtcttttatggtaaaatatacataatataattttatagtttttaataattgttcagtgtaccattcagtgccattaaggccattaagtgttgtgcatccatttccagagctttttatttatctcaaacaaaagccctgtacctattaaacaatcacataccatttcttctcccctagtccctgataaacttctgttctactttctgtctctatgaaattgcctattctaggtacctcttaagtgaaatcatatacaatgtttccttttgtatctggcttctttcacttcamcttaatgttttcaaggttcctattatgtaggatgtatcagaatttcattcctttatatggctgaataatattccatgtatggatatactacattttgtttatccattcatctattgatggccatttggattgtttccaccttttggcctatgtgaataatgctgctatggacactggcatgaaagtatccatttgggtctctgctttcagttcctctggtatgtataatacctaggaatgattgctggattatatggtaattttatgtttaactttttgggggaactgccgaactgtttt

SEQ ID NO: 107466 - DNA, 601 bp, Human
ttgtttatccattcatctattgatggccatttggattgtttccaccttttggcctatgtgaataatgctgctatggacactggcatgaaagtatccatttgggtctctgctttcagttcctctggtatgtataatacctaggaatgattgctggattatatggtaattttatgtttaactttttgggggaactgccgaactgttttctacagcagctgcagttttacattcttaccagcaatccacaaggttccaatttctccacaccctcatgaacacttggttttttttttcttttttraataacattcttttttttattattatactttaagttctgggatacatgtgcagaacatgcaggtttgttacataggtatacatgtgccatggtggtttgctgcacccatccccatcatctacattaggtatttctcctaatgctatccctcctcttgtccccaccccacaacaggccccagtgtgtgatattcccctccctgtgtctgtgtgttctcattgtttaactcccacttatgactgagaacatgcagtgtttggttttctgttcctgtgttagtttgctgagaatgtccctgca

SEQ ID NO: 107467 - DNA, 601 bp, Human
cttgaggaattgccacaccggttgaactaatttacactcccaccaacaatgtaaaagcattcctatttctccacatcctctccagcatctgatcgcctttctgactggtgtgagatggtatctcattgtggttttgatttgcatttctctaatgaccagtgatgatgagcatgtttttcatatgtttgttggtcacagcaatgtcttcttttgaataatagcgttctttttttattattattatactttaagttttagggtacatgtgcacaatgtgcaggttagttacatatgtatacaygtgccatgctggtgcgctgcacccactaactcgtcatctagcattaggtatatctcccaatgctatccctcccccctccccccaccccaaaacagtccccagagtgtgatgttccccttcctgtgtccatgtgttctcattgttcaattcccacctatgagtaagaatatgcggtgtttggttttttgttcttgcgatagtttactgagaatgatgatttccagtttcatccatgtccctacaaaggacatgaactcatcattttttatggctgcatagtattccatggtgtatgtgtgc

SEQ ID NO: 107468 - DNA, 601 bp, Human
tagcagggacagggtttcactgtgttagccaggatggtcttgatctcctgactttgtgatccacccgcctcgacctccctaagtgctgggattacaggcgtgagccaccgcgcccggccaatagcattcttaataagtgtgaaatggtatcactttgtgattttgatctgcatttccctaatggccagtgatactgaacatctttacatgtccttatttattggccatttgtatatctttgaagaaatagccattccagtcatccatttatttttttaaatgtttaaaactttttatttgttttttattttttaaacacagggcttcactctgttgcccaggctagaatgcagtggcatgattgtaagctcactgcagcctcaatctcctaggctcaagggatcctctagcctcagcctcccatattgctagtactacaggcacataccaccacacctgtctaattattattttgtagacacagggtcttgctaggtaatccaggctggccttgaactcctgggctagagtgatcctcccaccttggcctcccaaagtgctggtattacaagcatgattcaccatgcccaaacctttgtcc

SEQ ID NO: 107469 - DNA, 601 bp, Human
gaaattacaggcatgagcctcgacactcagtctgcgtttatcttttgatttccacaaaacttaactactaatagcctactgttgattagaagccttaataatatataaacagctaacatatattttgtatatgtattcaatactgcattcttaaagtaagctagagaaaaagtgttattaaaaatcataaagagaaaatatatttactattcattaactgaacgtggatcattatacaagtcttcatgcccatcaccttcatgttgaataggctgaggaagagcagaagttggtcttgctstctcaggtctggcagaggtggaaaaaaatttgcacataattggaactgcgtagttcaaaggcgtgttccaaggctggctgtattttctcccattttgtgggttgtcttttcactttcttgatagtgtcctttgttccacaaaagtttttaattttatgaaggccaatttaattattgtttcttttgttgcttgtgcttttggtgtcatatccaagataacattatcaaatctgacatcatgatgcttcttccctatgctttcttctaagagttttataggtttagatctttgattcattt

SEQ ID NO: 107470 - DNA, 601 bp, Human
agagagagagaaggtgtgtgtatgtaatttgggggcattttctcatgtataagatcatgtcatctatgaacagagaaatgtcattgggattttaacagggattacattgaattgtaaatcactttggatagcattgacatcttaacaattttaagtcatcttatccatgaacaccggatttttttcatttagttagatcttatttaatatctttcaacagttttgtgtggttttcagcataacaatttttggcccatttgctcaagtttattcttaattcttttagatgttgttgtaaacrgaattgcttttttaaatttcctcttcaatttgctcatttactaatgtattaaaacacaactgatttttacatgtgaattttgtgtctagcaactttgctgaattaatttggtagccctaacggggtgtgtgtgtgtgtgtgtgtgtgtgtgtgtgtgtgtgtgtgtgtgtataatttggggggattttcttacatagaagatcatgtcatccatgaacagagatatttatactttttcctttctgatttggatgccttttgtctttttacctaatgcctctggctaggatttccaatatc

SEQ ID NO: 107471 - DNA, 601 bp, Human
cttaccctcccaaagtgctgggagtacagccgtgggccactgcgcctgctgcattgattttcatatgtcattatccttgcattttaaaaataaatcccactagataaaggtgtataatctttttatcataaatttgtttaacatcattgttgccttggcatccatttttaggcctaacataagttgtttaaaactgagttataccacctcatctttggcctagttaaaactttccctccccatgtggctgtttgcagtgtgggtcacttgttctacatctcactgacccaacatatcccayagctgcttaccacaataaaaccagaatcaacaccagagtcatgcaaataatttcccccctttacacatattttctttaaattagccagttcacaacccctgctggaaagccttaagaggtaatgcctgtggaccttaataaaggcagagttccacagattcactcttatctgtgattaacaaaatgctgcttttatttcatgtgttttgttttgctgcctctgtgtctcacctgactgacatacacatacctaactttcctcccagtcagcactcctggagagtggctatcttggcagga

SEQ ID NO: 107472 - DNA, 601 bp, Human
ctgctggaaagccttaagaggtaatgcctgtggaccttaataaaggcagagttccacagattcactcttatctgtgattaacaaaatgctgcttttatttcatgtgttttgttttgctgcctctgtgtctcacctgactgacatacacatacctaactttcctcccagtcagcactcctggagagtggctatcttggcaggaataaactggacacaggtcggacaagaaccacgagggcatctgctagtataaacaagtttcctgtgagacatacacttggccacaggtcaggcaagaagrcattgtcccattcaccaagataaagaagtatcctcttttgatttactgtaaacatcagtgaccacctcctctagagccttgtcggggcagagctagagttcctggccactctccagagagagacccgaagaccaagttagaagaaaacaaaatcttttaatatgctgaatttggtttattagtatttcattgaggatatttgcatcagtattgcaagggatattgatctgtaattttcttatagtgtcttcatatagctttgttatcagggtaatgcagcctcttagagttagtattcct

SEQ ID NO: 107473 - DNA, 601 bp, Human
ttaacaaaatgctgcttttatttcatgtgttttgttttgctgcctctgtgtctcacctgactgacatacacatacctaactttcctcccagtcagcactcctggagagtggctatcttggcaggaataaactggacacaggtcggacaagaaccacgagggcatctgctagtataaacaagtttcctgtgagacatacacttggccacaggtcaggcaagaaggcattgtcccattcaccaagataaagaagtatcctcttttgatttactgtaaacatcagtgaccacctcctctagagccttgtcggggcagagctagagttcctggccactctccagagagagacccgaagaccaagttagaagaaaacaaaatcttttaatatgctgaatttggtttattagtatttcattgaggatatttgcatcagtattgcaagggatattgatctgtaattttcttatagtgtcttcatatagctttgttatcagggtaatgcagcctcttagagttagtattcctccatctttttgttttttggaagaatttgagatggaatggtgttaattcttctttaaatgtttggtagaattcagcag

SEQ ID NO: 107474 - DNA, 601 bp, Human
cttacaattttttacttcttggccgggcatggtggctcacacctgttatctcagtactttggaaggccgagccaggtggatcacttgaggtcaggagtttgagaccagcctggccaacatgtcaaaaccccatctgtactaaaaatacaaaaattagccagctgtggtggtgggcacctgtagtcccagctactcgggaggctgaggcaggagaattgcttgaacccaggaggcagaagttgcagtgagctgagagtgtgccactgcattccagcctgggtgacagcaagacttcatctcaaaaaaaaaaaaaattttttttttcttaaaattggtagtattgtctgcacttttatttctgattttattaacttcagacttctctttcttttctagttattctagctaaagatttgtcaattttgctgatcttttcaaataatcaacttttggctttattgatgttctgtttctttatcctgtctcatttatttttgctctaatctttattatttcttctgctacttttgggtaattttctctttttctgttgtcttatggtatatagttaggttcttaatttgcaatattttaaaattgt

SEQ ID NO: 107475 - DNA, 601 bp, Human
ttatatttttagtagagatggggtttcaccatgttggccaggctggtctagaactcctgacctcagatgatctgcctgccttggcctcccaaagtgctgggattacaggcatgagccaccgcacctggcctttttgttttgttttgttttgtttttatttttgagatggagttttgctctgtcacccaggttggagtacagtggtgcgatcttggctcacggcaacctctgcctcccgggttcaagcaattcttctgcgtcagcctcttgagtagctgggactacaggtgcccaccaccaygcccggctaatttttgtatttttagtagagatagcttttggctatgttggccaggctgatctcaagctcctgacctcaagtgatcaccccccttggcctccccaaagtgctgggattacagtcgtaggccaccacgcccagcctggcctccaagatttctaatatgagaaactgacttataatcttcttgagtctctttgtatatgacatgttgcatctcttttgctgcttcccagattttctctttggctttgcctttttagagtttgattatgtgtcttggtgtatgattctttgggt

SEQ ID NO: 107476 - DNA, 601 bp, Human
tttggctatgttggccaggctgatctcaagctcctgacctcaagtgatcaccccccttggcctccccaaagtgctgggattacagtcgtaggccaccacgcccagcctggcctccaagatttctaatatgagaaactgacttataatcttcttgagtctctttgtatatgacatgttgcatctcttttgctgcttcccagattttctctttggctttgcctttttagagtttgattatgtgtcttggtgtatgattctttgggtttatcctatttggagtctaatagtgtcttagttcccyggagctggtgtaacaaattactgttaattgggcagcttaaacaacagaatttattgtcaacagttttggagtctagaagtatgagatcagtttgtcagaagagttgatttcttctgaggggtttgagggaaaatccatttcacctctctgctttagattttggtggcttgctggcaatcttttgtgcacctttgcctttgctgcatcaccctgatctctcccttcatcttcacatggagttctccttgtatatttgtctgtacccaaattttgccgtttttataaagacattgatcatac

SEQ ID NO: 107477 - DNA, 601 bp, Human
ttggtggcttgctggcaatcttttgtgcacctttgcctttgctgcatcaccctgatctctcccttcatcttcacatggagttctccttgtatatttgtctgtacccaaattttgccgtttttataaagacattgatcatactgaattagggcccatcctaatgacctcattttaacatgattataaagaacctgtatcgaaattaggtcatatttgagatactggagattatagctctccaacatatctttgggggaagatacaaatcaactcctaacattagacttcttggatttgtagrttcatgtctttctttaaattggggacttctaccatttttaaaaataattttttgcctctttgtctctctcttccttctatgactttcataatgtctctgttggttcacttgagccccttaggctctgtttacttctctccattcttttttctttctgcttctcagactcgatatttaaattttcctatcttcaagttcactgattatttttcttctttccactcaatgctgcttttgaacccctctattgaattttttctccttagttattatacttttgagctccagaatttccttttt

SEQ ID NO: 107478 - DNA, 601 bp, Human
ctttgggggaagatacaaatcaactcctaacattagacttcttggatttgtaggttcatgtctttctttaaattggggacttctaccatttttaaaaataattttttgcctctttgtctctctcttccttctatgactttcataatgtctctgttggttcacttgagccccttaggctctgtttacttctctccattcttttttctttctgcttctcagactcgatatttaaattttcctatcttcaagttcactgattatttttcttctttccactcaatgctgcttttgaacccctctrttgaattttttctccttagttattatacttttgagctccagaatttcctttttataatttgtatcacttgctgatattcccattttattcatacatcattttccgaattttctttagttctttgttttcccttaacccttttaacatatttaagacagttgagtatttttgatttgcattttttttctggttgcacatgtctgcataattattaaaataatttcagaaaataatgaagccgtttctttgtcatctcgcacgaagaaagttaaggacacggacacacatgaggagtttagg

SEQ ID NO: 107479 - DNA, 601 bp, Human
atcttcaagttcactgattatttttcttctttccactcaatgctgcttttgaacccctctattgaattttttctccttagttattatacttttgagctccagaatttcctttttataatttgtatcacttgctgatattcccattttattcatacatcattttccgaattttctttagttctttgttttcccttaacccttttaacatatttaagacagttgagtatttttgatttgcattttttttctggttgcacatgtctgcataattattaaaataatttcagaaaataatgaagcmgtttctttgtcatctcgcacgaagaaagttaaggacacggacacacatgaggagtttaggagtggcggtttaatatgcagaagaaagagaaaggagaacagctctgtctctagtgagagaaaggggcttctgaaagggaaagactggctggaggtggatgtgccggattttgtaggcaggtttaaggaggtggtgtctgattacatagggcccacagattggttcagtcaggtttgatgtttacatagcacgccagaaaggctggccaccccaccctaatcttattatgcaaatgggctt

SEQ ID NO: 107480 - DNA, 601 bp, Human
cttcaagttcactgattatttttcttctttccactcaatgctgcttttgaacccctctattgaattttttctccttagttattatacttttgagctccagaatttcctttttataatttgtatcacttgctgatattcccattttattcatacatcattttccgaattttctttagttctttgttttcccttaacccttttaacatatttaagacagttgagtatttttgatttgcattttttttctggttgcacatgtctgcataattattaaaataatttcagaaaataatgaagccgyttctttgtcatctcgcacgaagaaagttaaggacacggacacacatgaggagtttaggagtggcggtttaatatgcagaagaaagagaaaggagaacagctctgtctctagtgagagaaaggggcttctgaaagggaaagactggctggaggtggatgtgccggattttgtaggcaggtttaaggaggtggtgtctgattacatagggcccacagattggttcagtcaggtttgatgtttacatagcacgccagaaaggctggccaccccaccctaatcttattatgcaaatgggctttc

SEQ ID NO: 107481 - DNA, 601 bp, Human
ctgattatttttcttctttccactcaatgctgcttttgaacccctctattgaattttttctccttagttattatacttttgagctccagaatttcctttttataatttgtatcacttgctgatattcccattttattcatacatcattttccgaattttctttagttctttgttttcccttaacccttttaacatatttaagacagttgagtatttttgatttgcattttttttctggttgcacatgtctgcataattattaaaataatttcagaaaataatgaagccgtttctttgtcawctcgcacgaagaaagttaaggacacggacacacatgaggagtttaggagtggcggtttaatatgcagaagaaagagaaaggagaacagctctgtctctagtgagagaaaggggcttctgaaagggaaagactggctggaggtggatgtgccggattttgtaggcaggtttaaggaggtggtgtctgattacatagggcccacagattggttcagtcaggtttgatgtttacatagcacgccagaaaggctggccaccccaccctaatcttattatgcaaatgggctttctacttgactgg

SEQ ID NO: 107482 - DNA, 601 bp, Human
attacatagggcccacagattggttcagtcaggtttgatgtttacatagcacgccagaaaggctggccaccccaccctaatcttattatgcaaatgggctttctacttgactggcaccatcctgtgtgcttcttactgtacatgtggctggcaaggcgagaagggaggatggagccgccattttgaacaggattggcgcaactgccggcatctgtgtctgcagctcaattttataggctactctttgttagaaaatgatttgggggctgcttttcactgaaaaggaaaaccttgccgaggwctccttcctgtattctcactctctgcctaagtaatttcttttttttgtttttgttttttttttgagatggagtctcactgtgtgcccctggctagagtgcagtggcatgatcttggctgactgcaacgtgcacctcccaggttcaagcaattcttctggctcagcctcccaagtagctgggattacatgcatgcaccaccacacctgactaatgttgtatttttagtagagatggggtttcgccatgttggcctggctggtctcgaacttctgacctcaggtgatccacccgcttggcct

SEQ ID NO: 107483 - DNA, 601 bp, Human
cctgcaacctccacctcccaggttcaagcaattctcctgcctcagcctcctgaatagctgggattacaggcgcctgccaccacacctgagtaatttttgtatttttagtaaagacagagtctcaccatgttggccaggctggtcttgaactcctgacctcatgatctgcccgcctcagcttcccaaagtgctgggattacaggtgtgagccaccacgcccggccaagagagttgttttaaaagctgtagtagttcatttgttttggtacttttccaaactgtttcaaagaccattccttgycatgtatgatcactgaagtctgttgtttctttggcttgtactcagctaatgattgacagagttccttgaatgtcaggagctgaaacaaagaagagacagagaaagaggaaggcgccatctttcctagactttgtggactagctctttggtgggcacttcttcaccatttagagaggctgagcctaggaatcagcctgaggtcatagttaaagtctttttatttcttttctgggcatgcatcttgtcagggcagacatgtggctttgtaaactctaccatatatatgactgcttttgaatg

SEQ ID NO: 107484 - DNA, 601 bp, Human
gcgcctgccaccacacctgagtaatttttgtatttttagtaaagacagagtctcaccatgttggccaggctggtcttgaactcctgacctcatgatctgcccgcctcagcttcccaaagtgctgggattacaggtgtgagccaccacgcccggccaagagagttgttttaaaagctgtagtagttcatttgttttggtacttttccaaactgtttcaaagaccattccttgtcatgtatgatcactgaagtctgttgtttctttggcttgtactcagctaatgattgacagagttccttgratgtcaggagctgaaacaaagaagagacagagaaagaggaaggcgccatctttcctagactttgtggactagctctttggtgggcacttcttcaccatttagagaggctgagcctaggaatcagcctgaggtcatagttaaagtctttttatttcttttctgggcatgcatcttgtcagggcagacatgtggctttgtaaactctaccatatatatgactgcttttgaatgtcctaatttcgtaaagattctcaccccagattctcctcctggccttagatggtctattgtatgtttcta

SEQ ID NO: 107485 - DNA, 601 bp, Human
gagtaatttttgtatttttagtaaagacagagtctcaccatgttggccaggctggtcttgaactcctgacctcatgatctgcccgcctcagcttcccaaagtgctgggattacaggtgtgagccaccacgcccggccaagagagttgttttaaaagctgtagtagttcatttgttttggtacttttccaaactgtttcaaagaccattccttgtcatgtatgatcactgaagtctgttgtttctttggcttgtactcagctaatgattgacagagttccttgaatgtcaggagctgaaacraagaagagacagagaaagaggaaggcgccatctttcctagactttgtggactagctctttggtgggcacttcttcaccatttagagaggctgagcctaggaatcagcctgaggtcatagttaaagtctttttatttcttttctgggcatgcatcttgtcagggcagacatgtggctttgtaaactctaccatatatatgactgcttttgaatgtcctaatttcgtaaagattctcaccccagattctcctcctggccttagatggtctattgtatgtttctactcataaactcttccttc

SEQ ID NO: 107486 - DNA, 601 bp, Human
cttgaatgtcaggagctgaaacaaagaagagacagagaaagaggaaggcgccatctttcctagactttgtggactagctctttggtgggcacttcttcaccatttagagaggctgagcctaggaatcagcctgaggtcatagttaaagtctttttatttcttttctgggcatgcatcttgtcagggcagacatgtggctttgtaaactctaccatatatatgactgcttttgaatgtcctaatttcgtaaagattctcaccccagattctcctcctggccttagatggtctattgtatgtktctactcataaactcttccttccaagcagctgtgcttggtactcccctttgccacgtttacaagtggtccctgcagttcttcctgcctgtgttccaagttatatgaaacaaaaactagctctttgcatcagtcttgcaggtatctcccggacttaggatacatatacacagtaatttgcatataagttctggtctgttccctctggttcaggggagggaactgagaactggactgccactgcttaagaccaagaccattgtcattctgggaagagggtagggtgaggcaagtaaaaatac

SEQ ID NO: 107487 - DNA, 601 bp, Human; identical to SEQ ID NO: 107418

SEQ ID NO: 107488 - DNA, 601 bp, Human; identical to SEQ ID NO: 107419

SEQ ID NO: 107489 - DNA, 601 bp, Human; identical to SEQ ID NO: 107420

SEQ ID NO: 107490 - DNA, 601 bp, Human; identical to SEQ ID NO: 107421

SEQ ID NO: 107491 - DNA, 601 bp, Human; identical to SEQ ID NO: 107422

SEQ ID NO: 107492 - DNA, 601 bp, Human; identical to SEQ ID NO: 107423

SEQ ID NO: 107493 - DNA, 601 bp, Human; identical to SEQ ID NO: 107424

SEQ ID NO: 107494 - DNA, 601 bp, Human; identical to SEQ ID NO: 107425

SEQ ID NO: 107495 - DNA, 601 bp, Human; identical to SEQ ID NO: 107426

SEQ ID NO: 107496 - DNA, 601 bp, Human; identical to SEQ ID NO: 107427

SEQ ID NO: 107497 - DNA, 601 bp, Human; identical to SEQ ID NO: 107428

SEQ ID NO: 107498 - DNA, 601 bp, Human; identical to SEQ ID NO: 107429

SEQ ID NO: 107499 - DNA, 601 bp, Human; identical to SEQ ID NO: 107430

SEQ ID NO: 107500 - DNA, 601 bp, Human; identical to SEQ ID NO: 107431

SEQ ID NO: 107501 - DNA, 601 bp, Human; identical to SEQ ID NO: 107432

SEQ ID NO: 107502 - DNA, 601 bp, Human; identical to SEQ ID NO: 107433

SEQ ID NO: 107503 - DNA, 601 bp, Human; identical to SEQ ID NO: 107434

SEQ ID NO: 107504 - DNA, 601 bp, Human; identical to SEQ ID NO: 107435

SEQ ID NO: 107505 - DNA, 601 bp, Human; identical to SEQ ID NO: 107436

SEQ ID NO: 107506 - DNA, 601 bp, Human; identical to SEQ ID NO: 107437

SEQ ID NO: 107507 - DNA, 601 bp, Human; identical to SEQ ID NO: 107438

SEQ ID NO: 107508 - DNA, 601 bp, Human; identical to SEQ ID NO: 107439

SEQ ID NO: 107509 - DNA, 601 bp, Human; identical to SEQ ID NO: 107440

SEQ ID NO: 107510 - DNA, 601 bp, Human; identical to SEQ ID NO: 107441

SEQ ID NO: 107511 - DNA, 601 bp, Human; identical to SEQ ID NO: 107442

SEQ ID NO: 107512 - DNA, 601 bp, Human; identical to SEQ ID NO: 107443

SEQ ID NO: 107513 - DNA, 601 bp, Human; identical to SEQ ID NO: 107444

SEQ ID NO: 107514 - DNA, 601 bp, Human; identical to SEQ ID NO: 107445

SEQ ID NO: 107515 - DNA, 601 bp, Human; identical to SEQ ID NO: 107446

SEQ ID NO: 107516 - DNA, 601 bp, Human; identical to SEQ ID NO: 107447

SEQ ID NO: 107517 - DNA, 601 bp, Human; identical to SEQ ID NO: 107448

SEQ ID NO: 107518 - DNA, 601 bp, Human; identical to SEQ ID NO: 107449

SEQ ID NO: 107519 - DNA, 601 bp, Human; identical to SEQ ID NO: 107450

SEQ ID NO: 107520 - DNA, 601 bp, Human; identical to SEQ ID NO: 107451

SEQ ID NO: 107521 - DNA, 601 bp, Human; identical to SEQ ID NO: 107452

SEQ ID NO: 107522 - DNA, 601 bp, Human; identical to SEQ ID NO: 107453

SEQ ID NO: 107523 - DNA, 601 bp, Human; identical to SEQ ID NO: 107454

SEQ ID NO: 107524 - DNA, 601 bp, Human; identical to SEQ ID NO: 107455

SEQ ID NO: 107525 - DNA, 601 bp, Human; identical to SEQ ID NO: 107456

SEQ ID NO: 107526 - DNA, 601 bp, Human; identical to SEQ ID NO: 107457

SEQ ID NO: 107527 - DNA, 601 bp, Human; identical to SEQ ID NO: 107458

SEQ ID NO: 107528 - DNA, 601 bp, Human; identical to SEQ ID NO: 107459

SEQ ID NO: 107529 - DNA, 601 bp, Human; identical to SEQ ID NO: 107460

SEQ ID NO: 107530 - DNA, 601 bp, Human; identical to SEQ ID NO: 107461

SEQ ID NO: 107531 - DNA, 601 bp, Human; identical to SEQ ID NO: 107462

SEQ ID NO: 107532 - DNA, 601 bp, Human; identical to SEQ ID NO: 107463

SEQ ID NO: 107533 - DNA, 601 bp, Human; identical to SEQ ID NO: 107464

SEQ ID NO: 107534 - DNA, 601 bp, Human; identical to SEQ ID NO: 107465

SEQ ID NO: 107535 - DNA, 601 bp, Human; identical to SEQ ID NO: 107466

SEQ ID NO: 107536 - DNA, 601 bp, Human; identical to SEQ ID NO: 107467

SEQ ID NO: 107537 - DNA, 601 bp, Human; identical to SEQ ID NO: 107468

SEQ ID NO: 107538 - DNA, 601 bp, Human; identical to SEQ ID NO: 107469

SEQ ID NO: 107539 - DNA, 601 bp, Human; identical to SEQ ID NO: 107470

SEQ ID NO: 107540 - DNA, 601 bp, Human; identical to SEQ ID NO: 107471

SEQ ID NO: 107541 - DNA, 601 bp, Human; identical to SEQ ID NO: 107472

SEQ ID NO: 107542 - DNA, 601 bp, Human; identical to SEQ ID NO: 107473

SEQ ID NO: 107543 - DNA, 601 bp, Human; identical to SEQ ID NO: 107474

SEQ ID NO: 107544 - DNA, 601 bp, Human; identical to SEQ ID NO: 107475

SEQ ID NO: 107545 - DNA, 601 bp, Human; identical to SEQ ID NO: 107476

SEQ ID NO: 107546 - DNA, 601 bp, Human; identical to SEQ ID NO: 107477

SEQ ID NO: 107547 - DNA, 601 bp, Human; identical to SEQ ID NO: 107478

SEQ ID NO: 107548 - DNA, 601 bp, Human; identical to SEQ ID NO: 107479

SEQ ID NO: 107549 - DNA, 601 bp, Human; identical to SEQ ID NO: 107480

SEQ ID NO: 107550 - DNA, 601 bp, Human; identical to SEQ ID NO: 107481

SEQ ID NO: 107551 - DNA, 601 bp, Human; identical to SEQ ID NO: 107482

SEQ ID NO: 107552 - DNA, 601 bp, Human; identical to SEQ ID NO: 107483

SEQ ID NO: 107553 - DNA, 601 bp, Human; identical to SEQ ID NO: 107484

SEQ ID NO: 107554 - DNA, 601 bp, Human; identical to SEQ ID NO: 107485

SEQ ID NO: 107555 - DNA, 601 bp, Human; identical to SEQ ID NO: 107486

SEQ ID NO: 107556 - DNA, 601 bp, Human
gtgacagcaaaaatgacccaccaatggaagcagctggcttcactgctcaggtgattatcctgaaccatccgggccaaataagctctggctatgcacctgtattggattgccacacagctcacattgcatgcaagtttgctgagctgaaggaaaagattgatcgccgttctggtaaaaagctggaagatggccctaaattcttgaagtctggtgatgctgccattgctgatatggttcctggcaagcccatgtgtgttgagagcttctcagactatccacctttgggtcgctttactgttcrtgatatgagacagacacttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataataatgcaacataaaaccttcagaaggaaaggagaatgttttgtggaccactttggttttctttttcgcatgcagca

SEQ ID NO: 107557 - DNA, 601 bp, Human
ggtcgctttactgttcgtgatatgagacagacacttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataataatgcaacataaaaccttcagaaggaaaggagaatgttttgtggaccactttggttttytttttcgcatgcagcagttttaagttattagtttttaaaatcagtactttttaaatggaaacaacttgaccaaaaatttgtcacagaattttgagacccattaaaaaagtttaatgagaaaaaaaaaaaagaaatgaacaagttacttgaaaatataatttataaaaatgatacaaaaataagtagaacacctgaattgtctaattctatttaagaaatttattttatactggaaaaatcttcccgcagggaaatctccaagccaagagagatttactggggatatttctagacagttaa

SEQ ID NO: 107558 - DNA, 601 bp, Human; identical to SEQ ID NO: 107556

SEQ ID NO: 107559 - DNA, 601 bp, Human; identical to SEQ ID NO: 107557

SEQ ID NO: 107560 - DNA, 601 bp, Human; identical to SEQ ID NO: 29298

SEQ ID NO: 107561 - DNA, 601 bp, Human; identical to SEQ ID NO: 29299

SEQ ID NO: 107562 - DNA, 601 bp, Human; identical to SEQ ID NO: 29300

SEQ ID NO: 107563 - DNA, 601 bp, Human; identical to SEQ ID NO: 29301

SEQ ID NO: 107564 - DNA, 601 bp, Human; identical to SEQ ID NO: 29302

SEQ ID NO: 107565 - DNA, 601 bp, Human; identical to SEQ ID NO: 29303

SEQ ID NO: 107566 - DNA, 601 bp, Human; identical to SEQ ID NO: 29304

SEQ ID NO: 107567 - DNA, 601 bp, Human; identical to SEQ ID NO: 29305

SEQ ID NO: 107568 - DNA, 601 bp, Human; identical to SEQ ID NO: 29306

SEQ ID NO: 107569 - DNA, 601 bp, Human; identical to SEQ ID NO: 29307

SEQ ID NO: 107570 - DNA, 601 bp, Human; identical to SEQ ID NO: 29308

SEQ ID NO: 107571 - DNA, 601 bp, Human; identical to SEQ ID NO: 29309

SEQ ID NO: 107572 - DNA, 601 bp, Human; identical to SEQ ID NO: 29310

SEQ ID NO: 107573 - DNA, 601 bp, Human; identical to SEQ ID NO: 29311

SEQ ID NO: 107574 - DNA, 601 bp, Human; identical to SEQ ID NO: 29312

SEQ ID NO: 107575 - DNA, 601 bp, Human; identical to SEQ ID NO: 83495

SEQ ID NO: 107576 - DNA, 601 bp, Human; identical to SEQ ID NO: 83496

SEQ ID NO: 107577 - DNA, 601 bp, Human; identical to SEQ ID NO: 46211

SEQ ID NO: 107578 - DNA, 601 bp, Human; identical to SEQ ID NO: 46212

SEQ ID NO: 107579 - DNA, 601 bp, Human; identical to SEQ ID NO: 46213

SEQ ID NO: 107580 - DNA, 601 bp, Human; identical to SEQ ID NO: 46214

SEQ ID NO: 107581 - DNA, 601 bp, Human; identical to SEQ ID NO: 46215

SEQ ID NO: 107582 - DNA, 601 bp, Human; identical to SEQ ID NO: 46216

SEQ ID NO: 107583 - DNA, 601 bp, Human; identical to SEQ ID NO: 46217

SEQ ID NO: 107584 - DNA, 601 bp, Human; identical to SEQ ID NO: 83495

SEQ ID NO: 107585 - DNA, 601 bp, Human; identical to SEQ ID NO: 83496

SEQ ID NO: 107586 - DNA, 601 bp, Human; identical to SEQ ID NO: 46211

SEQ ID NO: 107587 - DNA, 601 bp, Human; identical to SEQ ID NO: 46212

SEQ ID NO: 107588 - DNA, 601 bp, Human; identical to SEQ ID NO: 46213

SEQ ID NO: 107589 - DNA, 601 bp, Human; identical to SEQ ID NO: 46214

SEQ ID NO: 107590 - DNA, 601 bp, Human; identical to SEQ ID NO: 46215

SEQ ID NO: 107591 - DNA, 601 bp, Human; identical to SEQ ID NO: 46216

SEQ ID NO: 107592 - DNA, 601 bp, Human; identical to SEQ ID NO: 46217

SEQ ID NO: 107593 - DNA, 601 bp, Human; identical to SEQ ID NO: 21087

SEQ ID NO: 107594 - DNA, 601 bp, Human; identical to SEQ ID NO: 21088

SEQ ID NO: 107595 - DNA, 601 bp, Human; identical to SEQ ID NO: 21089

SEQ ID NO: 107596 - DNA, 601 bp, Human; identical to SEQ ID NO: 21090

SEQ ID NO: 107597 - DNA, 601 bp, Human; identical to SEQ ID NO: 21091

SEQ ID NO: 107598 - DNA, 601 bp, Human; identical to SEQ ID NO: 21092

SEQ ID NO: 107599 - DNA, 601 bp, Human; identical to SEQ ID NO: 21093

SEQ ID NO: 107600 - DNA, 601 bp, Human; identical to SEQ ID NO: 21094

SEQ ID NO: 107601 - DNA, 601 bp, Human; identical to SEQ ID NO: 21095

SEQ ID NO: 107602 - DNA, 601 bp, Human; identical to SEQ ID NO: 21096

SEQ ID NO: 107603 - DNA, 601 bp, Human; identical to SEQ ID NO: 21097

SEQ ID NO: 107604 - DNA, 601 bp, Human; identical to SEQ ID NO: 21098

SEQ ID NO: 107605 - DNA, 601 bp, Human; identical to SEQ ID NO: 21099

SEQ ID NO: 107606 - DNA, 601 bp, Human; identical to SEQ ID NO: 21100

SEQ ID NO: 107607 - DNA, 601 bp, Human; identical to SEQ ID NO: 21101

SEQ ID NO: 107608 - DNA, 601 bp, Human; identical to SEQ ID NO: 21102

SEQ ID NO: 107609 - DNA, 601 bp, Human; identical to SEQ ID NO: 21103

SEQ ID NO: 107610 - DNA, 601 bp, Human; identical to SEQ ID NO: 21104

SEQ ID NO: 107611 - DNA, 601 bp, Human; identical to SEQ ID NO: 21105

SEQ ID NO: 107612 - DNA, 601 bp, Human; identical to SEQ ID NO: 21106

SEQ ID NO: 107613 - DNA, 601 bp, Human; identical to SEQ ID NO: 21107

SEQ ID NO: 107614 - DNA, 601 bp, Human; identical to SEQ ID NO: 21108

SEQ ID NO: 107615 - DNA, 601 bp, Human; identical to SEQ ID NO: 21109

SEQ ID NO: 107616 - DNA, 601 bp, Human; identical to SEQ ID NO: 21110

SEQ ID NO: 107617 - DNA, 601 bp, Human
gctggaatctgggaggcggaggctgaggctgcagtgagctgagatcaggccactgcactccagcctgggtgacagagcaagactccatctcaaaaaaaaaaaaaagtgtgccctcaaaagtgcaagaaacagcccagcatggtggctcatgcctgtaatcccaggactttgagaggccgaggcaggcagatcacctgaggtcaggagttcaacaacagcctggccaacacggtgaaacccaatctctactaaaaatacaaaaattagccgggtgctgtggctcacgcctgtaatctcagcrctttgggaggccaaggcgggtggatcacctgaggtcgggagttcgagaccagcctgaccaacatggagaaaccccaactctactaaaaatacagaaaccacgcacgagaccatttcattgttgggtgctgggcactagctgaagctagacaagaaggctagaaaaatagcaccaaatagatacttagaggagacagctgtggaatgctggaaaaatcaaatcaaatgacactgcacaaagacagcacagacagtaggaaagtgtaaaagcccattcccaagggttttaagcccaaaccta

SEQ ID NO: 107618 - DNA, 601 bp, Human; identical to SEQ ID NO: 21111

SEQ ID NO: 107619 - DNA, 601 bp, Human
ttacttgtataacattactgtattttacaatttctcccaacagtttcttattctccgattcattttgtttttgttccagttctgcagcgtgctataagatgattatcaaatattcagtgtagaaatatagtaaacagagtgtaataactgacaaagaaattttttttaggaacaagactatagccaggaataaaataggctagtagtagagtcaggactgtaatcttagtttaggtgttttgttttgctttatgtttccatcatatcatattgtctttcagattttcacgtcatattcatycaagtatttggaaacttggggagtggatgactccccaaagggagcagtaattaaataaatgattataatatagtgtgatgatttgtcaatgtatgctgaaatgccctccaacatgtcttgggccacttttatgttggacatttcagaaaagtactaggctctttgttcttttaaaattactttaagaaggtatattgctagaaaaaccaaccaggataatagtagaatttccaaagtctcaaaaataaaagttcttaattctgaaagtaccaggaattttaatgaggcaaaattaagttc

SEQ ID NO: 107620 - DNA, 601 bp, Human
atccaaccatgattttccctgtgaccaattgctttatttatttgtattttatctcactatgtagctctgtattttggaaagtgccttacattcttttttgaaaaaggtggggcatatattaacaaataaccaagtaagaagctaaaaagatctaagtgaaacacaggaaaggaatgcagctgagataaaacagtgtgtgcatactaatagaaatagaagaccttctaataacaattcaaggatgacttccaactgaaagtgaaaacttttctctcttcacaaaatgaaaagctaagctccrtatgttaaacacagtcccattaatctaaaggactatttcagaacaggcctttagaaattgtttcctgaccctcttctttttgatgtaataacttgtgtatacatccagataagatcacttctttatgtgtaaaatcagatttattcttaaacatacagaatagtgcagcacatatcaaatgaatacatcacaatacgtcacaacatcgataattcccatcaaagaacaaacttcctgtatctcaaaattttaacgcagtttggctttcctgccaacttactgacaaactccacataaaat

SEQ ID NO: 107621 - DNA, 601 bp, Human
atccaccatgttcaagaacatggctcagcccctcactgaccaagctaacacctgcgcttcgggtacttgacaagaaacataagttccacttgctgacatttaaccgaaacttggttaagagaaactctatttatgaaggattgccccagggacatccagcccactcaggttgcaggtttcacattatccatcattcgattaagtcatacattcagggagctgccgacccagcttctctcatcttatcccaacagtgcactgctttgactgccctgtgttctggcattttgccattggccartaacaaaatatcagggatattattttaaaagacagctctatgaaatgcctcattgtagcatttactgtaaggaagctgtcaaggctattgtttactatattacacagtgtcctctttatgagcacacataggagaaacacttccctggtcctattcctgggaacagttgtgcttctagacctctgatttggctctgtgctgcggatctcctagccaacgatgtaacagactatgcttccctatggctaagagggcaagaaaaagccttcaagtcaaaatttaccagactttacaacatgg

SEQ ID NO: 107622 - DNA, 601 bp, Human
ccacaaaaacagaatatactaaagaaaggccaagaaactcaaataatgcaccaacccacttactattattaaccagccctgcccacagtcagccctgattcttcctctgtaaggaggcagctgctcatcctaaataggcttctacaccttctgccaggggatgctgaccctaccccctcccagatgagtgtaaaagcatcacttctcagatttttttggactttgtgaacaaaatcttacaaaaacatgattctactgagtagcaaaaccaaaacaaaataacctttccatctattattacaatcatttcaaaaaacaatggtcattttagtactcacaatataagtaagaaattatctcaaaataaagtacggttctttaattgaaaaaaaatcagcattttaaaatgctcattatcatactcttgggtccttatgttaccacaaagcaatggaaaccctcatgggctggactttgggatccaccatgttcaagaacatggctcagcccctcactgaccaagctaacacctgcgcttcgggtacttgacaagaaacataagttccacttgctgacatttaaccgaaacttggttaagaga

SEQ ID NO: 107623 - DNA, 601 bp, Human
cttacttattaggaatcattttctttatgaacccactatttccctcttaattgtatattacatacattgtcaccctcgcttctcagtttccagaacggatgaatataaaaccaagacccttcatttcctgcagcatccaaggacacacgcatggcattcttctccagtaaagcaggtaatctcttgttgacagtaagatatttgttgctttttatatgcagtagctatagggaaaagacatagattaccacctttattctttgttctcctctgttaattacattcatatgttttatacatrtatcatatattcatctaacatggcttgagatgaaaattaaacaaaggagtattttcagcctccacactcaccatctttcctacttgactttctttgggttcttcctccccttcaccccaattctgcttcataatgaagtcggcataatagggaaaaaaaaacaggggacccctccgagtgattttcatctactgataaataatggctaaaactaggttttccaaaggagaccttgagtttccccaaaaccacatcctttctcaatgcctgcatagccacaaaaacagaatatactaaaga

SEQ ID NO: 107624 - DNA, 601 bp, Human
tcctgtcatgaatcacggtgtcactccattaattcaaagggcacacactatttcctaaacacagctctttttccttatgaccaagcttcctcctaattaggcaaaaaagtaaattctccttctcttttaaaagtctcagccaatattaaggttgcttaagttctttcatacaaattctagctggaagattttaaattaatctgaactttgtcttatgacttctgagcacaatttgtactataaataaacatgtttaacctagtagatactaacataaaaatcaggtattgagtaaaaactrtattttcttttttgtactttctggattatcttacttattaggaatcattttctttatgaacccactatttccctcttaattgtatattacatacattgtcaccctcgcttctcagtttccagaacggatgaatataaaaccaagacccttcatttcctgcagcatccaaggacacacgcatggcattcttctccagtaaagcaggtaatctcttgttgacagtaagatatttgttgctttttatatgcagtagctatagggaaaagacatagattaccacctttattctttgttctcctc

SEQ ID NO: 107625 - DNA, 601 bp, Human
aatcttaactattgatcccctgatgcaatacttgcaggtatttatgaaacttattcagcgctcagtgtctagcagcatttcctgagcatcgtccatgtgctaaggactatcacgcagtattttatttattacatgcaaaaatatcacactctagatcctattgactatttctcataatttattctctattttataaagtagcagaaaatatttcagcaactactaaaatttatgtgcaatacacacatattccacaacattaaaaaaattttttttttagaaacaaggtcttgctatgttkcccaggctggtcttgaacccgtgggctcaagtgattctcctgcctcagtgccccaactagtccacaacatattgtaaacatagttgtcatcaatgagcagatgccaaccttcagctcctctactccatctctattaagacttatagactgtcagcagctggcatacagccagtaaatggaatcctgtcatgaatcacggtgtcactccattaattcaaagggcacacactatttcctaaacacagctctttttccttatgaccaagcttcctcctaattaggcaaaaaagtaaattctcc

SEQ ID NO: 107626 - DNA, 601 bp, Human
ttaaaaactccaattcattcaattatttcatcacattccttccgagcttgagctcaggttttgtttgttttcatatttaattttcatggacctcctgtagacagggatactattcagtggagggctggggatgggaacaagcattgcaagaaagagcctcaaaggcacaggttgttcataaactacataatcagtccctgaacaattgagagttgattgtaatgaactatttaatgaaactaaaatgtgtatcatgctcacagcacacatcacctgatgtcaaaagaaaaaaaagtagggttttttttttaagaaatccaaccaacacaagacttaaagtgcatcacattcctgcatgccatgcttctaccaaaccttaccaaaggaagatatcaccagataatttattaaccaaattaaatccagaagcttgcatcctgtggaattgaatttgtatttcaaaattcactggaaaaattagattcacgataaagacattcctaagacaagaaatatccaaaacacatttaaaatgtaatcaaagtttcaactgaaaaaactctctcagaataattatacttttatattgcttcgaattcat

SEQ ID NO: 107627 - DNA, 601 bp, Human
ttcctttctcccagactatcgtcagcctatttattgcatttcatttgggtaacagaacatcttgttggatgttaaaacctcatcttaaaatatcatcttaaaacctcatctattgttaaatagtaaaatatcattttaaaagtcctctaaacattgcaatttcctttttctaatttaatgtgtttttaaagaaaatcagtagtagttgaaccactggttatgaagtgaccgtatttccaattgccttccacacagtcggtttatattttagaaatacgctacctattttagggaaaaaaaygagtattacaatacaattatttatgtgaccaatatagggttgtgggtgtgcttatgctttcagcaaccttaattacacacaaaagctacacagtggcaaacaaaaacggtgagctgtttcagcaaaaagcagtgtggaaagttgtttcagccatgctttctgaagcacatccagataagaactcctgtattgcacttaacaattacattgtccattttcaccaagattgagtgtttgggtggtaggttttgttttgttttggttttccagtacaactaattatttgaaatagttcattac

SEQ ID NO: 107628 - DNA, 601 bp, Human
tcactagcagctacccttcttttgaagtggcacctggtatggtgaaaagaacatcacaataggaatctaaacgccagggttctagttccaccgcagctagaaattcaacacttttttttattacactttaagttttagggtacatgtgcacaacgtgcaggtttgttacatatgtatacatgtgtcatgttggtgtgctgcacccattaactcgtcatttagcattaggtatatctcctaatgctatccctccccgctctccccaccccacaacagtccctggtgggcacacactttttcyaaaacgcaaagtctacttgctgtttgaagagtttcttttttcaagagttaaaattttctcttcatttaaagaatatctgacctttattcccttttaaaatctaccataaaagtaaagaacccaagttttcttagatcaaaattgaaaatgaaaaattaactattcaaccatgggaagatacataaagataaaaaaataaggaaagaaaaatgaaatatttatgttctctgctcatagctgtccctagtgactttgcagttcaactgcaaccaagggctttgtatacagctgaaagtacag

SEQ ID NO: 107629 - DNA, 601 bp, Human
aagattcaagctgagatttcgctgaaaataaagagggatataacatcactagcagctacccttcttttgaagtggcacctggtatggtgaaaagaacatcacaataggaatctaaacgccagggttctagttccaccgcagctagaaattcaacacttttttttattacactttaagttttagggtacatgtgcacaacgtgcaggtttgttacatatgtatacatgtgtcatgttggtgtgctgcacccattaactcgtcatttagcattaggtatatctcctaatgctatccctccccsctctccccaccccacaacagtccctggtgggcacacactttttctaaaacgcaaagtctacttgctgtttgaagagtttcttttttcaagagttaaaattttctcttcatttaaagaatatctgacctttattcccttttaaaatctaccataaaagtaaagaacccaagttttcttagatcaaaattgaaaatgaaaaattaactattcaaccatgggaagatacataaagataaaaaaataaggaaagaaaaatgaaatatttatgttctctgctcatagctgtccctagtgactttg

SEQ ID NO: 107630 - DNA, 601 bp, Human
aaaatggtattcataagtagaatctaacattaattcagtaattttcagatcctcattcttattcttgacaatgattaccttgcctaaccaagctgaataaaacttgcaagtgaaatggataaactaccaatcatgtgaaataaaaagaatattaagaagttccagggagaaaacaaaaaggtctaagaaatagtccctattctcacagaattcatacctaattagataacttagcaaatatgaaatatggtaatattttcaaaatagtgaagctcaggacgtgattcacagatggggtcargtgctttctgagaagctatgtatttaatatagaacttgagggtgaagtcattttctgccacatcctaggataagccatcacattcactctagtacacaaacatgttttttataaattgcaattccaaaagcacttctgttgattctatgtaagagccatgtaagattcaagctgagatttcgctgaaaataaagagggatataacatcactagcagctacccttcttttgaagtggcacctggtatggtgaaaagaacatcacaataggaatctaaacgccagggttctagttccaccgc

SEQ ID NO: 107631 - DNA, 601 bp, Human
agcatattcccaatccccattctccctaggaaaacacgtgctgttgcacatgacagcaaggcagctccaagtcacagagccatgtagaggcctgagtcatcatccatactctaaagtactgggagcttgatgccacattttgccagtgctgcatctgttcttccaattacatttttttctttatttcttctaaaaaacaaaaacaaaaacaaaaaaacaaaacagaatacatgtgcagaacgtgcaggtttgttacataggtatacatgtgccctgatggcttactgcacctattgacccrtcctctaagttccctcccctcaccccccaccccctgacaggctctggtgtgtgttgttcccctctctgtgtccatgtgttctcaacttccaatttcttaaagaacaactggatttggtttactatttgattctcatctgtgccatataaatcctagccaataagttactaaatataatgacatattttaactatgtccttccaattcaagaatacttttggttgcacctacattcgctgctctaagtcttgctattttactatagttgtctgtaagctttgggtcaatccgtatatttac

SEQ ID NO: 107632 - DNA, 601 bp, Human
ttccttaaagtcaataaataggccattatccctccccacgaggtcttatgccataagcacaacagaaagagtaaatgcatctgtcaccacaaaaaagtaatctatccaaatattagaaccactgcaaaagcaagcagaaaatgttatacacttgtattatcttttataagagatgagtaaatttgatcttcccatagtctcagaagtgtattaaaaattctaatgtcagctcgattcaggaaatgcagaattaggtatgaccttgtagaaatatgttttgtgtttgagccttgggcatccrattcactcatatcttaaatatattaaactaatattgctccttaaacctgatgttcatttttaaataaaaactaaaattgattcttggaaaagtgctctacagaagtaactctaattgattttttaatgtatgttattgtagcaatatccaccttctctttaagtatttttattcataactcaaattgtggggaatcaaagttatcctttcttcatgataacaatgaacagtttaatttccattattaaagttacttacattgctgaatttatttagaagacatattattatagtaaataa

SEQ ID NO: 107633 - DNA, 601 bp, Human
tcacagctatatgtaccttagggatattaattagaataactgggattatgctcatgaaaacaatgaaagaaactatattacttttttctccctctgtctcatgagaaaaatgaacacattcattccttttccacttgaacttacctctttacaccctgggttatcaagaagctctatgttgctggcatgtagtggctgccctgcattcacaggcatcaaaacaactttatctcctacaacaatctaggaagcagaaataaatcacaattgagacactgcatggatctttggtgctatattygaagctagaaataactgcacaggagtccccattattgatctgacatctggtccttttatccttcacacaaattttcatacaatcctttttctctttgaggtaaaatatcttctaataaatgatcatataaccatgtcccatagtgcctatcagtctggattcataaagctagtgtggatctttttcatattcatctcccatttcagttagagcttccttaaagtcaataaataggccattatccctccccacgaggtcttatgccataagcacaacagaaagagtaaatgcatctgtcac

SEQ ID NO: 107634 - DNA, 601 bp, Human
tgttgcaattgacagcattcacctattaatgaagaaacgttcaaagttataagactacagattccattctctaccagaaattattagttcaactagtaaaaggaaattaaagacaattttggataatgaagtatatagctcaatacaagtatctttgagagaccatccaaaaatagcaataactaatcacagctatatgtaccttagggatattaattagaataactgggattatgctcatgaaaacaatgaaagaaactatattacttttttctccctctgtctcatgagaaaaatgaayacattcattccttttccacttgaacttacctctttacaccctgggttatcaagaagctctatgttgctggcatgtagtggctgccctgcattcacaggcatcaaaacaactttatctcctacaacaatctaggaagcagaaataaatcacaattgagacactgcatggatctttggtgctatattcgaagctagaaataactgcacaggagtccccattattgatctgacatctggtccttttatccttcacacaaattttcatacaatcctttttctctttgaggtaaaatatcttcta

SEQ ID NO: 107635 - DNA, 601 bp, Human
aaaatgagagctaccacagagaagacaggcttaggaaacagtttcctttcaaattggtcacagcaatgaataggcacaagttggttcacaaaaattattctattttatgattctatcataaatgatgcctataacaataaaacaacaagcccagtgaatcttctctttttgatctaaatatttattaagtgccaaaaaacatttacatacctctatttcccagagtgctttagaactagtagcagaagtagctgattggcgcaaggtcgtacgaaggaaaatgtgctgttttttctcataytcatcacaagtcaaaaacttctcttgttccgcatgaaataatctaacaacgtccccctagcaaaaaggtcaagagacatctgaacaaacagatgtgagaagcaggtgtctctttctggttttgctactctgggcccttctactagctatttgacttttaaagcttatttaaatttatttaatgcttatttaaacatttaaaaatgtgggggggaaattcagtaaaacacttagagtaagtattaacatgtgtagtcacattctaaattatgaacaccagtgaatacataggttttgcatc

SEQ ID NO: 107636 - DNA, 601 bp, Human
gtgtgtgtgcacttgacagagaaggagagagagaaaatgagagctaccacagagaagacaggcttaggaaacagtttcctttcaaattggtcacagcaatgaataggcacaagttggttcacaaaaattattctattttatgattctatcataaatgatgcctataacaataaaacaacaagcccagtgaatcttctctttttgatctaaatatttattaagtgccaaaaaacatttacatacctctatttcccagagtgctttagaactagtagcagaagtagctgattggcgcaaggtygtacgaaggaaaatgtgctgttttttctcatattcatcacaagtcaaaaacttctcttgttccgcatgaaataatctaacaacgtccccctagcaaaaaggtcaagagacatctgaacaaacagatgtgagaagcaggtgtctctttctggttttgctactctgggcccttctactagctatttgacttttaaagcttatttaaatttatttaatgcttatttaaacatttaaaaatgtgggggggaaattcagtaaaacacttagagtaagtattaacatgtgtagtcacattctaaat

SEQ ID NO: 107637 - DNA, 601 bp, Human
ttacgtctcctaacactggttatcattcaagggcccacatttacctttgctttttcattttcctgtacttgtatgggctgtcttctgatccacttctttaaccacttctctcaaatccaaacatatccatccaagatgggcataaatattgtatcttttagatagtcattctcatgttgaaatacatattattttattataaagtattttccttttatttattctttatgttagaatttgagcattatactaattctacctattagtatataaataatattacctataaatttcattttaraatattaaagggagtgtcacaaaatatatgttttaaaattgggggcaggtgaagaatttgaaatggttgagaatcaccgctagtggtttagatgtttagtaaatctcttgttcataggcaattctgtagatcttatctcctccacatataaaaagatcctttaaggaaaaatccatagattacatttccttaattactctaccatgttccacatttaagtgatacttttaaaaagatgaatgaattcttaactatgggtctcctgattccaatagaaatggcatctacagaagaaataaa

SEQ ID NO: 107638 - DNA, 601 bp, Human
ctacctctatatttttttaatttttaaaaacagcaaaatattaagaactttatggtgtgaaaatgcatgctttaattatgtatttattttaggattgcctgttatttttcagttttgctcttatgaatgaggtagacttctgggaggtgtttcatgcagcctcgtgtattattagctttagtcatagctgttttccccagagcttctcagttccatcacctgttgatggttgtggtctccaaagtccatctgcatgctagcgactgaaattattcctcaatatgttgtggagtttcaagayagaagataagttcttttgtactatttcatctcgattctaaaccatgtcataaacttagttcttttttagtgtcatatttataaataaggctcagctcatttgcagaggcatcttacttcctcattttctgcatctcgtcggtaatttgcctaaagtattatccctactttgattatggttatctctccgtttttcagtttgttccgttattacgtctcctaacactggttatcattcaagggcccacatttacctttgctttttcattttcctgtacttgtatgggctgtcttctgatcc

SEQ ID NO: 107639 - DNA, 601 bp, Human
gctaagtgctcccctgcatcacaggggctgaaagcctcacccagcggggctctgaggacattcccgttagaatggaaagcagaggacagtagaagagagactcctctttgggctgcagtaacagtgggagcagctgactagtgcccgctcctacaaggtgcgtgggtaaggacccctcagcatgtgagcagaggcctgcaggctcagaggaggagcagtcattgcattgcttatctgcattcagataagcccatgtcccccactccacatttcctccccagcccttccaatcatgttgaaygtaatttccctcttccttgaaacacctgatgcccatgctgggtaagcacagtcctcaggcttcctcacaaagcccaactgtgacagcacacaatagagaaaagtccctcaaatctcaaatagaaataagcctaccaccgatataaactggcaatactttagtacatcagcagataaaaacattttacatcaagttatatgaaattcattacggtgagggacgtttaaatgaagtaaagacatctcaaaattattaaacaatttattcgctccctattctggtcaatgtgtcacagcattt

SEQ ID NO: 107640 - DNA, 601 bp, Human
tttgtttatcacaatgattttggagggatgctattggcatttaatatgcagtgaccaagatattatctatgctgcaatttacagggaattccagaatgtgatcaacactgtgtgtggccctcaggaccagccccaccctgctaagtgctcccctgcatcacaggggctgaaagcctcacccagcggggctctgaggacattcccgttagaatggaaagcagaggacagtagaagagagactcctctttgggctgcagtaacagtgggagcagctgactagtgcccgctcctacaaggtgcrtgggtaaggacccctcagcatgtgagcagaggcctgcaggctcagaggaggagcagtcattgcattgcttatctgcattcagataagcccatgtcccccactccacatttcctccccagcccttccaatcatgttgaacgtaatttccctcttccttgaaacacctgatgcccatgctgggtaagcacagtcctcaggcttcctcacaaagcccaactgtgacagcacacaatagagaaaagtccctcaaatctcaaatagaaataagcctaccaccgatataaactggcaatactttag

SEQ ID NO: 107641 - DNA, 601 bp, Human
cagactaagaactactctcctatacatcagtgggtctggcaagggcagtacggctccctagaggggatattctagagatttggaagggagggtgtttttgtttatcacaatgattttggagggatgctattggcatttaatatgcagtgaccaagatattatctatgctgcaatttacagggaattccagaatgtgatcaacactgtgtgtggccctcaggaccagccccaccctgctaagtgctcccctgcatcacaggggctgaaagcctcacccagcggggctctgaggacattcccrttagaatggaaagcagaggacagtagaagagagactcctctttgggctgcagtaacagtgggagcagctgactagtgcccgctcctacaaggtgcgtgggtaaggacccctcagcatgtgagcagaggcctgcaggctcagaggaggagcagtcattgcattgcttatctgcattcagataagcccatgtcccccactccacatttcctccccagcccttccaatcatgttgaacgtaatttccctcttccttgaaacacctgatgcccatgctgggtaagcacagtcctcaggcttcct

SEQ ID NO: 107642 - DNA, 601 bp, Human
acaggcgggatgggcagcagaaaagctcgggttttacactccaattcaggcatgtgagtctcaggtccaccaattactggggtatgaccacagaaaggaatttaacatctttgagccttatttcttcgtgtacaaaatgggttgattcacaggattgttgtgaagatgaaatatcataaggcatatcacaatgctaggataactttcatgactctccctcagcacattacgttctttttgctagtactgaccaccctttggctcctgctgcaaccacgaattctgtgtgttaacatacttsacttgctaatgccttttgctagactccagcaactgtcttcccatactctcataactcagataagataataattatgaaaatacttcaaagtccttgaggtcttacaaaacactccctctgtggccaaaagcccacctatccttcaaattctcacatcacatttcttccacaaatcctttgctaatcacactggccactgtgatcttgtcagtgtttgaactcttaaacctttgagggaggcagagatatctgcgagaatgtgataaaatctaatgtttgtctcaaatacacacacacaca

SEQ ID NO: 107643 - DNA, 601 bp, Human
ttgtacgtttttaccattttattgacagttttacgaagaaaacattttccttcccaatgatttgaataataaaagccacccacagtgaaagaggccactgcagatgaacccaaagctagctaggctatatgacacgggcaatgaactgatcatatctatgatgcggacattctgaaagggtgaagctaaatagaaaattttaggccacatcacatacatatgcaaatcagatgccccattccagttggccttccagtaaaacaactgcagagtttttgttgttattatcgttgttgtcttmatttgtaatactttgactaacatttacattttaaaaataatttatatgccaatccagaatactagaggcaacaatcaaatttgtgtaatgactgttcctgcaaatacgatgtcttgtggcgaacccaactgcctctttcactaattcagagtcagaaacttaataccactttatccattagtcttacctctgcagctaaatagtttccagttgcaagatgcttaaatctgaacaagctgttccactgtcctgcacccccacggcatgggtcatgatgaaccacctacaaagagagcaacg

SEQ ID NO: 107644 - DNA, 601 bp, Human
gacatccttcatatctgtctgtcaacatacttttagtggataaagaaaaagcttttgtacgtttttaccattttattgacagttttacgaagaaaacattttccttcccaatgatttgaataataaaagccacccacagtgaaagaggccactgcagatgaacccaaagctagctaggctatatgacacgggcaatgaactgatcatatctatgatgcggacattctgaaagggtgaagctaaatagaaaattttaggccacatcacatacatatgcaaatcagatgccccattccagttrgccttccagtaaaacaactgcagagtttttgttgttattatcgttgttgtcttaatttgtaatactttgactaacatttacattttaaaaataatttatatgccaatccagaatactagaggcaacaatcaaatttgtgtaatgactgttcctgcaaatacgatgtcttgtggcgaacccaactgcctctttcactaattcagagtcagaaacttaataccactttatccattagtcttacctctgcagctaaatagtttccagttgcaagatgcttaaatctgaacaagctgttccact

SEQ ID NO: 107645 - DNA, 601 bp, Human
catctggaaaagactagcttcaaaattatttttcaattagataaccaaactttaattaaaacatttgtaaaacttccatgatgttatttctacctatccttcatatcttctgacatccttcatatctgtctgtcaacatacttttagtggataaagaaaaagcttttgtacgtttttaccattttattgacagttttacgaagaaaacattttccttcccaatgatttgaataataaaagccacccacagtgaaagaggccactgcagatgaacccaaagctagctaggctatatgacacrggcaatgaactgatcatatctatgatgcggacattctgaaagggtgaagctaaatagaaaattttaggccacatcacatacatatgcaaatcagatgccccattccagttggccttccagtaaaacaactgcagagtttttgttgttattatcgttgttgtcttaatttgtaatactttgactaacatttacattttaaaaataatttatatgccaatccagaatactagaggcaacaatcaaatttgtgtaatgactgttcctgcaaatacgatgtcttgtggcgaacccaactgcctc

SEQ ID NO: 107646 - DNA, 601 bp, Human
tcaggaggctgaagcaagaggattgcttgaacctgggaggcataggttgagtgcatcacggcactccagcctgggcaacagggcaagaatctgtctcaaaaacaaaaattagtcatgccagcatcacttaccctgtgcttaccataaaccacaacttctgcaagcactttgcctaatttaattctaataagttaagagaattagaaatatatttgattatccccattttccagaagaagaaattggagtgtagtgtgattaatttgcccaatatgtctccaaatgcgtctcatatacaaakcctgaaatctccttctccccatcctctatccattcacaaaatagtcatcaaatgctaagtgcccagcacagttccatgaatggaaattttcatacatctggaaaagactagcttcaaaattatttttcaattagataaccaaactttaattaaaacatttgtaaaacttccatgatgttatttctacctatccttcatatcttctgacatccttcatatctgtctgtcaacatacttttagtggataaagaaaaagcttttgtacgtttttaccattttattgacagttttacgaagaaa

SEQ ID NO: 107647 - DNA, 601 bp, Human
ccattctgttacactagttaaaatcagtagaaaataaattcgtaactttcagttttcagatatgtgcttaatacttaattttcctcctcccactagaccataaaaaagatgttatctaaagtattaaaggtcaaagaaaaggtcctctaaatacaccagactctttaatggatgagacggcacctggcatttaaagctgcattctctagagacaggatgaaagagagtctttcaaatcttttcaaggaatgatttgctttctacttctccatttttaattaattcgtgtatatattgaagycttggatcctcactaaggttaatgaacaatttaattcttaaaaatctaatcatttgaatgcatcaaatggtacatgttttaattatagaaattaacaaagaaaactagtaatatacatgtacatcatgtcagttttctacagcacatcagtagatttgcttgaaaagtgaacaggggaaaagagccactaacataagagaattttaatcctaatttcttatcttttataggatatctagttaggcttttgtaatttttattttagacaagattctctaccttactaatgatttttgcttc

SEQ ID NO: 107648 - DNA, 601 bp, Human
tgcatcaagacatcacacgtgccccataagtgtatacgtatactatgtgtccataaaaattaaaaagtttaagaaagaaataaagacctgggcatttttagaaagcaaaatgataaacgtgtaatcattgcttctcaactgctgtcagaggctagttaccagctgttcctggactagaaatcattgtgatttggccacacctctagacactttcacaccagtaaggacaagcatcctgagacatgagcacaccaggattttgtcccaactgacatagaaaatacaaaacaccaatgtatgsatgccaggattttgaggctatgattgctattttgatattagaacactacacagagcacccattctgttacactagttaaaatcagtagaaaataaattcgtaactttcagttttcagatatgtgcttaatacttaattttcctcctcccactagaccataaaaaagatgttatctaaagtattaaaggtcaaagaaaaggtcctctaaatacaccagactctttaatggatgagacggcacctggcatttaaagctgcattctctagagacaggatgaaagagagtctttcaaatctttt

SEQ ID NO: 107649 - DNA, 601 bp, Human
cttggctcactgcaacctccacctcccaggttcaagcaattctctcccacctctgcctcccaagtagctgggattacaggcacccgccatcatgcctggctaattattgtatttttgtagagacagggcaccatgttggccaggctagtcttgaactcctgacctcaggtgatccacccgcctcagcctcctaaagtgccgggaatacagatgtgagccaccgcgcctggccaacctgggcattttttgacaagagattaataaccagaatatataaggagctaaaacaactcaacagacaaaaaaaaaaattaataatctgatttaaaaatgagtaaaagatctgaatacaaatttctcaaaagaagacatacaaatggcaaacaaatatataaaaaaatgcttaacatcattaatcatcagagaaatgccaaccaaaactacaataagatatcatctcaccccgtttaaaatgactattatccaaaagaaaggcaataacaaatgctgatgaagatgtggagaaaggggaaccctcacatggttggtaggaatgtaaattagtgcagccactatagagaacagtatggcggttcctcaa

SEQ ID NO: 107650 - DNA, 601 bp, Human
gactaatgctttgaaataaaaaacctgggctattttattttattttattttttgagacagagtcttgttcttttgcccacgctgaagtgcaatggcacgatcttggctcactgcaacctccacctcccaggttcaagcaattctctcccacctctgcctcccaagtagctgggattacaggcacccgccatcatgcctggctaattattgtatttttgtagagacagggcaccatgttggccaggctagtcttgaactcctgacctcaggtgatccacccgcctcagcctcctaaagtgcygggaatacagatgtgagccaccgcgcctggccaacctgggcattttttgacaagagattaataaccagaatatataaggagctaaaacaactcaacagacaaaaaaaaaaattaataatctgatttaaaaatgagtaaaagatctgaatacaaatttctcaaaagaagacatacaaatggcaaacaaatatataaaaaaatgcttaacatcattaatcatcagagaaatgccaaccaaaactacaataagatatcatctcaccccgtttaaaatgactattatccaaaagaaaggcaata

SEQ ID NO: 107651 - DNA, 601 bp, Human
agatattaaagagaaaactgaacaagtaaaataaatctgtgccatggagcctctatcgcctaagaataagggtacagggtaataaaacaaataattctaggaggttgtcactcaaaatatagagaacccccgtcctacttgaacgacatgactaatgctttgaaataaaaaacctgggctattttattttattttattttttgagacagagtcttgttcttttgcccacgctgaagtgcaatggcacgatcttggctcactgcaacctccacctcccaggttcaagcaattctctcccacmtctgcctcccaagtagctgggattacaggcacccgccatcatgcctggctaattattgtatttttgtagagacagggcaccatgttggccaggctagtcttgaactcctgacctcaggtgatccacccgcctcagcctcctaaagtgccgggaatacagatgtgagccaccgcgcctggccaacctgggcattttttgacaagagattaataaccagaatatataaggagctaaaacaactcaacagacaaaaaaaaaaattaataatctgatttaaaaatgagtaaaagatctgaatac

SEQ ID NO: 107652 - DNA, 601 bp, Human
atgtaagcagatttgtttctggcctgtttagtagcacttcctcctttgcgaagttctctccttccttgcttggtatttgtaattcagcccatttgattttccaggtgcttctggcttctcaggctcccagtctctccctcatcctttaaagataatttcctcatgattctaccttcaaacaccctcccactctctttctactccctaatgatcttacctgcgctctgaaaacccaaatctaacactggtcaatccccaaacttccagacgttttgaaatcttccctagtggacaatttcayccagacattttataagcataatcaaatttgaatggattatttccctcatcaatttggcacctcttctcattttccctaatttggtgaatgacatcgctagttctccaaagccagaatcctattccttaacccttaacacctgacggcttaccactgcatcagttctgtctcccaagaatgccttcaacccttcccttcctcaccattactgaagcctctcccttggttcaagtgctcaaaattactaaagcaaaaactgttgatgacctttccaaagcaatataggtcaagtaatgcaaa

SEQ ID NO: 107653 - DNA, 601 bp, Human
agctgatgtaagcagatttgtttctggcctgtttagtagcacttcctcctttgcgaagttctctccttccttgcttggtatttgtaattcagcccatttgattttccaggtgcttctggcttctcaggctcccagtctctccctcatcctttaaagataatttcctcatgattctaccttcaaacaccctcccactctctttctactccctaatgatcttacctgcgctctgaaaacccaaatctaacactggtcaatccccaaacttccagacgttttgaaatcttccctagtggacaayttcatccagacattttataagcataatcaaatttgaatggattatttccctcatcaatttggcacctcttctcattttccctaatttggtgaatgacatcgctagttctccaaagccagaatcctattccttaacccttaacacctgacggcttaccactgcatcagttctgtctcccaagaatgccttcaacccttcccttcctcaccattactgaagcctctcccttggttcaagtgctcaaaattactaaagcaaaaactgttgatgacctttccaaagcaatataggtcaagtaat

SEQ ID NO: 107654 - DNA, 601 bp, Human
gcattcttgccagctgatgtaagcagatttgtttctggcctgtttagtagcacttcctcctttgcgaagttctctccttccttgcttggtatttgtaattcagcccatttgattttccaggtgcttctggcttctcaggctcccagtctctccctcatcctttaaagataatttcctcatgattctaccttcaaacaccctcccactctctttctactccctaatgatcttacctgcgctctgaaaacccaaatctaacactggtcaatccccaaacttccagacgttttgaaatcttccytagtggacaatttcatccagacattttataagcataatcaaatttgaatggattatttccctcatcaatttggcacctcttctcattttccctaatttggtgaatgacatcgctagttctccaaagccagaatcctattccttaacccttaacacctgacggcttaccactgcatcagttctgtctcccaagaatgccttcaacccttcccttcctcaccattactgaagcctctcccttggttcaagtgctcaaaattactaaagcaaaaactgttgatgacctttccaaagcaatata

SEQ ID NO: 107655 - DNA, 601 bp, Human
cctttaatgcaaaaacagcagcatcctcaaccacctcatttttaaaaatacattttataaaaatcatctaatagggctcttaattttccctggcctgcaactctgcttccccttttcacagcagtgctatgaaaactcagtctgcacccacttctgcttcctggcttcctggtcattcctccactcctgcattctggtttccactaaaaattttccccataaagtaacaaatgattgcattcttgccagctgatgtaagcagatttgtttctggcctgtttagtagcacttcctcctttgygaagttctctccttccttgcttggtatttgtaattcagcccatttgattttccaggtgcttctggcttctcaggctcccagtctctccctcatcctttaaagataatttcctcatgattctaccttcaaacaccctcccactctctttctactccctaatgatcttacctgcgctctgaaaacccaaatctaacactggtcaatccccaaacttccagacgttttgaaatcttccctagtggacaatttcatccagacattttataagcataatcaaatttgaatggattatttccctca

SEQ ID NO: 107656 - DNA, 601 bp, Human
taaactttgcccctatatacttaccctccttaacttatctaagacatgctagttattaataatgataataataaaacactactctgcattttctctctgtttcctccccaagaaagcaaacagacttaatatttattgcatacctctcatgtacaaggtgctgtacatcccctatcttctttaattccagaataatactatataatatacattcttaactttttttacacacaaaggaactcaggtccagaggggttaaatatttgcttaaagtcagacagattgtaaacagtatgcatgrgatttttttcccactatgctaggctctgtcacactggccaatataaacaccataaactcaaaggcaattcaagaattacataatccaatttaccaggaatgcctacagcacatgaaagtaatattttaaattataaatatgtctgttaaagttggaaaggtcatgggaaaaaaggttaatactctgcaatatctagccgcactgctaggtacttccctttaatgcaaaaacagcagcatcctcaaccacctcatttttaaaaatacattttataaaaatcatctaatagggctcttaatt

SEQ ID NO: 107657 - DNA, 601 bp, Human
ctatgtcaaagcattgtagtaatcttttccagataaacatattaaataactaaactttgcccctatatacttaccctccttaacttatctaagacatgctagttattaataatgataataataaaacactactctgcattttctctctgtttcctccccaagaaagcaaacagacttaatatttattgcatacctctcatgtacaaggtgctgtacatcccctatcttctttaattccagaataatactatataatatacattcttaactttttttacacacaaaggaactcaggtccagrggggttaaatatttgcttaaagtcagacagattgtaaacagtatgcatgggatttttttcccactatgctaggctctgtcacactggccaatataaacaccataaactcaaaggcaattcaagaattacataatccaatttaccaggaatgcctacagcacatgaaagtaatattttaaattataaatatgtctgttaaagttggaaaggtcatgggaaaaaaggttaatactctgcaatatctagccgcactgctaggtacttccctttaatgcaaaaacagcagcatcctcaaccacc

SEQ ID NO: 107658 - DNA, 601 bp, Human
ttaagagtaatgtcacccaaaatgtctatttataaatcacggaagtgactggctggctgtgtgttatacctgacataggaactgcacaacagatcatgagatattattggaaggattttcagtggctccatgaggcagtgtttcctatgtcaaagcattgtagtaatcttttccagataaacatattaaataactaaactttgcccctatatacttaccctccttaacttatctaagacatgctagttattaataatgataataataaaacactactctgcattttctctctgtttcctcyccaagaaagcaaacagacttaatatttattgcatacctctcatgtacaaggtgctgtacatcccctatcttctttaattccagaataatactatataatatacattcttaactttttttacacacaaaggaactcaggtccagaggggttaaatatttgcttaaagtcagacagattgtaaacagtatgcatgggatttttttcccactatgctaggctctgtcacactggccaatataaacaccataaactcaaaggcaattcaagaattacataatccaatttaccaggaatgcctac

SEQ ID NO: 107659 - DNA, 601 bp, Human
ctgttctcctagataagcactcagcatactttgcccagttgattaagagtaatgtcacccaaaatgtctatttataaatcacggaagtgactggctggctgtgtgttatacctgacataggaactgcacaacagatcatgagatattattggaaggattttcagtggctccatgaggcagtgtttcctatgtcaaagcattgtagtaatcttttccagataaacatattaaataactaaactttgcccctatatacttaccctccttaacttatctaagacatgctagttattaataatgataataataaaacactactctgcattttctctctgtttcctccccaagaaagcaaacagacttaatatttattgcatacctctcatgtacaaggtgctgtacatcccctatcttctttaattccagaataatactatataatatacattcttaactttttttacacacaaaggaactcaggtccagaggggttaaatatttgcttaaagtcagacagattgtaaacagtatgcatgggatttttttcccactatgctaggctctgtcacactggccaatataaacaccataaactcaaagg

SEQ ID NO: 107660 - DNA, 601 bp, Human
agtgggggatttctgaaatatctcaacaggtttatggagagtaactgtggcattatccagaatcaaaggcttttaaaattctaaaatgctcaatgaactctaactgcgctatattatttaaaagaccacaatttaagttgctacacaatagcgtgagttaaactcaaatgtatagaccataaaaaaactatttcaagttattcaaaagaaacttcatttctgctttagaaaaatttatctaaagaattcagagaaataaaagcaatatatgttaaaatattctaataatccaggtcatggwtagtcttttcagctgttctcctagataagcactcagcatactttgcccagttgattaagagtaatgtcacccaaaatgtctatttataaatcacggaagtgactggctggctgtgtgttatacctgacataggaactgcacaacagatcatgagatattattggaaggattttcagtggctccatgaggcagtgtttcctatgtcaaagcattgtagtaatcttttccagataaacatattaaataactaaactttgcccctatatacttaccctccttaacttatctaagacatgctag

SEQ ID NO: 107661 - DNA, 601 bp, Human
ctgttggatatctttacattgaataagggaccatttctaacccttggttagctttactatcttgcaggataaaacttaaaccgtgttaaatcttgtatcattatcctagttcctaggtgttttccgcaattcaccaaaaaaaagatgctattcttaaatagcttgcaacatatgtgttttctctatgtgattcaactacggaatttccagcatatcaaatggtctgatttcctttggatagtgcccccttcacttccacataaataattaggcttattacatttttctgaatacctaaacmatccagttaagtgctggttaaaatagagtatcatacttgggcactgtatctataagtaaattttagatcttcttatctaatttgtgcttagatttaaggttgcagtcctttaaacttactgtgagacttagcatggtcacctacagatgttaacaattagacattacatagaaccatttctctcagatgtgcatgtatagtggaaacaatggcaaaagagatctcaatgtcccagagattgagttaatctaaattgcaaactcttagaggacaaggaccatgtgttaatcatctctgttt

SEQ ID NO: 107662 - DNA, 601 bp, Human
tttatttttgtatttttagtagagaggggggtttcaccatattggccaggctagtcttgaactcctgacctcaagtgatctgcccaccttggcctcccaaagtgctgggattacagtctagcactgagttatttctttaaaattaatccgaatccctaaactatcctgttggatatctttacattgaataagggaccatttctaacccttggttagctttactatcttgcaggataaaacttaaaccgtgttaaatcttgtatcattatcctagttcctaggtgttttccgcaattcaccaaaaaaaagatgctattcttaaatagcttgcaacatatgtgttttctctatgtgattcaactacggaatttccagcatatcaaatggtctgatttcctttggatagtgcccccttcacttccacataaataattaggcttattacatttttctgaatacctaaacaatccagttaagtgctggttaaaatagagtatcatacttgggcactgtatctataagtaaattttagatcttcttatctaatttgtgcttagatttaaggttgcagtcctttaaacttactgtgagacttagcatg

SEQ ID NO: 107663 - DNA, 601 bp, Human
ttactttgttccacattttatccataggtttctagcattgaggtttttggtttggtttggtttttgggggcgggggtggggggttggtgttttttttttcttttttttttttctccttttattttgagacagactctcactctgtcgcccaggctgtagtgcagtggtgcgatctcggctcactgcaacctccacctcctgggttcaagtgattctcctgcctcagcctcctgagtagctggggctacaggcgtgtgccaccatgcccggtttatttttgtatttttagtagagagggggrtttcaccatattggccaggctagtcttgaactcctgacctcaagtgatctgcccaccttggcctcccaaagtgctgggattacagtctagcactgagttatttctttaaaattaatccgaatccctaaactatcctgttggatatctttacattgaataagggaccatttctaacccttggttagctttactatcttgcaggataaaacttaaaccgtgttaaatcttgtatcattatcctagttcctaggtgttttccgcaattcaccaaaaaaaagatgctattcttaaatagcttgc

SEQ ID NO: 107664 - DNA, 601 bp, Human
gttcataattactttgttccacattttatccataggtttctagcattgaggtttttggtttggtttggtttttgggggcgggggtggggggttggtgttttttttttcttttttttttttctccttttattttgagacagactctcactctgtcgcccaggctgtagtgcagtggtgcgatctcggctcactgcaacctccacctcctgggttcaagtgattctcctgcctcagcctcctgagtagctggggctacaggcgtgtgccaccatgcccggtttatttttgtatttttagtagrgaggggggtttcaccatattggccaggctagtcttgaactcctgacctcaagtgatctgcccaccttggcctcccaaagtgctgggattacagtctagcactgagttatttctttaaaattaatccgaatccctaaactatcctgttggatatctttacattgaataagggaccatttctaacccttggttagctttactatcttgcaggataaaacttaaaccgtgttaaatcttgtatcattatcctagttcctaggtgttttccgcaattcaccaaaaaaaagatgctattcttaaa

SEQ ID NO: 107665 - DNA, 601 bp, Human
accgtaagtttttaagtccataatacctacttattttcttaaaagagaagctttacttttttttacaatgaaatgtgttttgatcaatttttattatatataacactgaaatcataaacatcatgtgtgtatttttaaatgattatatttatatgtttctctttccaacgactggcatttcaggacaaatctattattctgattgataagcctagaaaagaaaggagagaaaataacctttactgggtgtatatgtgtgtcaggtacaatttctatattttgatatgtaacattttattcktatgtatagggtctggtctgtatgttagtctgctgtatttatgtatacatatacatgcatacaaaccaggcccttttcacatactatggctgatacatttgagagagaactaaacatagagacatttaaaactacagccccaatagtcataaaatcctatgctattatagagtttcttgagtactgggtttttagctaattaattaaatccacaggctattgaatagtcaggaaataagtgtttactgccatctggtggaagttttgcctatctacaaacaaataagctagtgatcttta

SEQ ID NO: 107666 - DNA, 601 bp, Human
gagagaaacatcataaatacctgggcagtgaaagtcatgcttgtaccgcaatcaattaaaaaacaactgcacccctccatctaacacaatagcaagaagcagaccgtaagtttttaagtccataatacctacttattttcttaaaagagaagctttacttttttttacaatgaaatgtgttttgatcaatttttattatatataacactgaaatcataaacatcatgtgtgtatttttaaatgattatatttatatgtttctctttccaacgactggcatttcaggacaaatctattattstgattgataagcctagaaaagaaaggagagaaaataacctttactgggtgtatatgtgtgtcaggtacaatttctatattttgatatgtaacattttattcttatgtatagggtctggtctgtatgttagtctgctgtatttatgtatacatatacatgcatacaaaccaggcccttttcacatactatggctgatacatttgagagagaactaaacatagagacatttaaaactacagccccaatagtcataaaatcctatgctattatagagtttcttgagtactgggtttttagcta

SEQ ID NO: 107667 - DNA, 601 bp, Human
caattaactggccaaagaagaatataaagaagtcaggtatggtgcaaaatgatagagagagagaaacatcataaatacctgggcagtgaaagtcatgcttgtaccgcaatcaattaaaaaacaactgcacccctccatctaacacaatagcaagaagcagaccgtaagtttttaagtccataatacctacttattttcttaaaagagaagctttacttttttttacaatgaaatgtgttttgatcaatttttattatatataacactgaaatcataaacatcatgtgtgtatttttaaatrattatatttatatgtttctctttccaacgactggcatttcaggacaaatctattattctgattgataagcctagaaaagaaaggagagaaaataacctttactgggtgtatatgtgtgtcaggtacaatttctatattttgatatgtaacattttattcttatgtatagggtctggtctgtatgttagtctgctgtatttatgtatacatatacatgcatacaaaccaggcccttttcacatactatggctgatacatttgagagagaactaaacatagagacatttaaaactacagccc

SEQ ID NO: 107668 - DNA, 601 bp, Human
attttgcaaggaaacaattaaattttagataaatttattgattttgtatggcaatggcatatccaagatcaaaggcagggtccactgcagccatggcagtgagtaacagagagagaatacagagacccattactaatctttgaagacagtcttcaattaactggccaaagaagaatataaagaagtcaggtatggtgcaaaatgatagagagagagaaacatcataaatacctgggcagtgaaagtcatgcttgtaccgcaatcaattaaaaaacaactgcacccctccatctaacacaawagcaagaagcagaccgtaagtttttaagtccataatacctacttattttcttaaaagagaagctttacttttttttacaatgaaatgtgttttgatcaatttttattatatataacactgaaatcataaacatcatgtgtgtatttttaaatgattatatttatatgtttctctttccaacgactggcatttcaggacaaatctattattctgattgataagcctagaaaagaaaggagagaaaataacctttactgggtgtatatgtgtgtcaggtacaatttctatattttgatatgt

SEQ ID NO: 107669 - DNA, 601 bp, Human
ccgtttatcatgactctcaagtctttaactatgaactaagaaaaatcactattttgcaaggaaacaattaaattttagataaatttattgattttgtatggcaatggcatatccaagatcaaaggcagggtccactgcagccatggcagtgagtaacagagagagaatacagagacccattactaatctttgaagacagtcttcaattaactggccaaagaagaatataaagaagtcaggtatggtgcaaaatgatagagagagagaaacatcataaatacctgggcagtgaaagtcatgmttgtaccgcaatcaattaaaaaacaactgcacccctccatctaacacaatagcaagaagcagaccgtaagtttttaagtccataatacctacttattttcttaaaagagaagctttacttttttttacaatgaaatgtgttttgatcaatttttattatatataacactgaaatcataaacatcatgtgtgtatttttaaatgattatatttatatgtttctctttccaacgactggcatttcaggacaaatctattattctgattgataagcctagaaaagaaaggagagaaaataacc

SEQ ID NO: 107670 - DNA, 601 bp, Human
cagaatcagtagaatctgaatgtgtaaactgagagagaaaaccgtttatcatgactctcaagtctttaactatgaactaagaaaaatcactattttgcaaggaaacaattaaattttagataaatttattgattttgtatggcaatggcatatccaagatcaaaggcagggtccactgcagccatggcagtgagtaacagagagagaatacagagacccattactaatctttgaagacagtcttcaattaactggccaaagaagaatataaagaagtcaggtatggtgcaaaatgatagasagagagaaacatcataaatacctgggcagtgaaagtcatgcttgtaccgcaatcaattaaaaaacaactgcacccctccatctaacacaatagcaagaagcagaccgtaagtttttaagtccataatacctacttattttcttaaaagagaagctttacttttttttacaatgaaatgtgttttgatcaatttttattatatataacactgaaatcataaacatcatgtgtgtatttttaaatgattatatttatatgtttctctttccaacgactggcatttcaggacaaatctattat

SEQ ID NO: 107671 - DNA, 601 bp, Human
tgaaagattttgcagagacagaatcagtagaatctgaatgtgtaaactgagagagaaaaccgtttatcatgactctcaagtctttaactatgaactaagaaaaatcactattttgcaaggaaacaattaaattttagataaatttattgattttgtatggcaatggcatatccaagatcaaaggcagggtccactgcagccatggcagtgagtaacagagagagaatacagagacccattactaatctttgaagacagtcttcaattaactggccaaagaagaatataaagaagtcaggtrtggtgcaaaatgatagagagagagaaacatcataaatacctgggcagtgaaagtcatgcttgtaccgcaatcaattaaaaaacaactgcacccctccatctaacacaatagcaagaagcagaccgtaagtttttaagtccataatacctacttattttcttaaaagagaagctttacttttttttacaatgaaatgtgttttgatcaatttttattatatataacactgaaatcataaacatcatgtgtgtatttttaaatgattatatttatatgtttctctttccaacgactggcatt

SEQ ID NO: 107672 - DNA, 601 bp, Human
ctagagagtttgcatccatattcagatgatgcaaggggacagaggatgaaaaagggaaagtaactaagggcagtggtccaaggaagaggtgggtggacccaaatgaagataataatgctggaataaaaaggacaaagtggatgtgaaagattttgcagagacagaatcagtagaatctgaatgtgtaaactgagagagaaaaccgtttatcatgactctcaagtctttaactatgaactaagaaaaatcactattttgcaaggaaacaattaaattttagataaatttattgattttgtayggcaatggcatatccaagatcaaaggcagggtccactgcagccatggcagtgagtaacagagagagaatacagagacccattactaatctttgaagacagtcttcaattaactggccaaagaagaatataaagaagtcaggtatggtgcaaaatgatagagagagagaaacatcataaatacctgggcagtgaaagtcatgcttgtaccgcaatcaattaaaaaacaactgcacccctccatctaacacaatagcaagaagcagaccgtaagtttttaagtccataatacctacttattt

SEQ ID NO: 107673 - DNA, 601 bp, Human
agaagacccaccagtgtcacttacgaaatacttttttatatgcttttacaggttaattcatttaaccttacaattatactataagacaagattcttaacacagtttacagacaaggcacttggagtacatcaactgaagtgctttatgcaaagtcacaccgctggggagtggcagggtgggcaagcacaggtctgagggctccagagccacgtctttcagttcctgtagcacgctgcttccctcctgcctccataaagcagagtggtgtgatgcaagctgggaaggagggtcagcccagaycatccaggcctttaaaccgcaggctagagagtttgcatccatattcagatgatgcaaggggacagaggatgaaaaagggaaagtaactaagggcagtggtccaaggaagaggtgggtggacccaaatgaagataataatgctggaataaaaaggacaaagtggatgtgaaagattttgcagagacagaatcagtagaatctgaatgtgtaaactgagagagaaaaccgtttatcatgactctcaagtctttaactatgaactaagaaaaatcactattttgcaaggaaacaattaaattt

SEQ ID NO: 107674 - DNA, 601 bp, Human
ctaaaattttagctaaattatatccaaatgatatgcaacatgttcgaccaaggatgtaccttatggcccaagttttcactcaatacacattagaatggttattacagacacttgaaattcaatgctggaaaccatgacatatcccccactaaaacatgcacaaaaacaggaattaatgtacctaagtcaaacacaaaataaaataatttatgccctctgaaacttagatcatatattctaccccaaagacaatgttaccttctacaatcagtctttacgtatttcccctgcttaggattayccgtccctgactggctgtctggggaagtggattccagtctctgctctataaggaaacaccagcatctttaggaaaggtggcctaatgcccatggaactcagtgtcctcatctgcaaaatgagaaaaagactatgactaaaccatgactctatgtcaataaattttacatattcatatctttggcagcaaaactacagatggtgccaatcagttagattttgcctcatctgtgtctctcaggctgcaatatgattttttaaataattaacatagagagattacctcagtaaactcaataaa

SEQ ID NO: 107675 - DNA, 601 bp, Human
tccagaagaaatttattcatctattttagtcaagtttcaccatagcttttttaaaaatttatttgtcttctgcttgaaaaatttcaacttttcttttaaattaaaaaaaatccatcctaaaattttagctaaattatatccaaatgatatgcaacatgttcgaccaaggatgtaccttatggcccaagttttcactcaatacacattagaatggttattacagacacttgaaattcaatgctggaaaccatgacatatcccccactaaaacatgcacaaaaacaggaattaatgtacctamgtcaaacacaaaataaaataatttatgccctctgaaacttagatcatatattctaccccaaagacaatgttaccttctacaatcagtctttacgtatttcccctgcttaggattacccgtccctgactggctgtctggggaagtggattccagtctctgctctataaggaaacaccagcatctttaggaaaggtggcctaatgcccatggaactcagtgtcctcatctgcaaaatgagaaaaagactatgactaaaccatgactctatgtcaataaattttacatattcatatctttggc

SEQ ID NO: 107676 - DNA, 601 bp, Human
tctcagagtctttctcaacatttcctatgatatgatgcaaaatgaattttcaggaaatggtttggcattctcaggaaagtacaagtaaacatgacctctacataaaggcaacgaaataacataaagagctaaaatgatagtatagaaacaatatgtggccgggtgtggtggctcatgcatttaatcccagcactttgggaggccaaggtgggtggatcacctaagatcaggagttcgagatcatcctggccaacatggtaagaccccgtctctactaaaaattcaaaaattagctgggcawggtggcacgcacttgtaattccagctacttgggaagctgagcatgagacttgcttgaacccaggaggcagaggttgcagtgactgcactccagcctggatgacgaagtgagactctgtctcaaaataattataataataataatatataaatactaaaataacaatataaataatacaatataagagaagttatggaatttcttcatatttcaatatacatgaaaacataaatacaaaattaaagtccacattagcaccaacagcacagttacagaaaatcagcaatgcagaggatgagc

SEQ ID NO: 107677 - DNA, 601 bp, Human
ctgagttagaacaagggagattccttctcagagtctttctcaacatttcctatgatatgatgcaaaatgaattttcaggaaatggtttggcattctcaggaaagtacaagtaaacatgacctctacataaaggcaacgaaataacataaagagctaaaatgatagtatagaaacaatatgtggccgggtgtggtggctcatgcatttaatcccagcactttgggaggccaaggtgggtggatcacctaagatcaggagttcgagatcatcctggccaacatggtaagaccccgtctctacyaaaaattcaaaaattagctgggcatggtggcacgcacttgtaattccagctacttgggaagctgagcatgagacttgcttgaacccaggaggcagaggttgcagtgactgcactccagcctggatgacgaagtgagactctgtctcaaaataattataataataataatatataaatactaaaataacaatataaataatacaatataagagaagttatggaatttcttcatatttcaatatacatgaaaacataaatacaaaattaaagtccacattagcaccaacagcacagttacag

SEQ ID NO: 107678 - DNA, 601 bp, Human
acatgttatgtacacaaggaaaagaaaaacaaaacagagcaaaaaaggagctacatataagatatgtgagcaaatacatgaggactactgaaacaaacaaacacatgtcttcgggcttggagagtggcattttggggccaatctgatgacaaagatgagttctggatgtgctgagtacagacccttgcatcatctggctggttgaaatccatgactcctcactcccacttgtccttacagtctcaaagcgattcttagttgttctgaaatagttgatcactcgtaaagcaatagatgtatraggtgtgtttcttgaaacatcaagttgtccaattgaatttaatcattttaatgtgaatcaactggtgtatacaatgcacaatcccagtaaagttatcatttaaaatgtaaggttaggagtctttctcataataccacttatctagcagctctgagaattgccccttccaactcatcactaaataccaatgagggttctgaaaaaaacaaaagcaaagcaaaatgaaagcaaaaaaaatcccaatctcattaagaactaaggctgaaaaaacaacctaaattccaaatcttcaatgaactg

SEQ ID NO: 107679 - DNA, 601 bp, Human
caaggccactctgtgactgtgatggatcaagacaaaacaagaccattccctaatcatgtctaaacacagacaaaatatgaatattgtccaagccacaaaaatgactaaatatccctctcccccaactaatatgagtgactgttgcttccttagaagcctgtcctccctataggtaaaatttattaagataccaattatagaattcctcttcctgacaacattctctccacagcaaagcctcacttccttaaatcctccccaaatcaccttacacaaacacaaatcctctagtaagttcttyctaacatgctctgagatgccccacagctcctcatggcatgttcctttctcactgcataagtaataaacccaacttgttcaactacccatgtgttcctgatggtctttgggtggaggccattgacaagcttatagtaagaaccaaagaagccatgattcacactttgctttttaaacctggttactgacagcattttcctaaatcatacaaaagtaagaacccaacaatcctggggcagccatgtgaaaaccaacaagagaagagcccacccagtgcgctaaaattgaattataaatagga

SEQ ID NO: 107680 - DNA, 601 bp, Human
aaaaagaagaaaagctatcaagtctaactaaaagcttgattaacagaaagagtgaacttcaccatggatatatgatcatttatacagtttgtgctgttccatagaacctccataccctatgtagtcaaccctcggtatctgcagaggattggttccaggaccccctgcaaatacaaaaatctgctcaagtttctcatataaaattgcatagtatttgcatataacctatacatatcctcctatatactttaaattacctgtagattagtcataatatctaatacaatctaagtgccaggtwaatacttgttatactgtattgttttttaatttgtattattatattttggtgtttttgatctgtggatgtttgaatacacagatgcaaaaccactggatagggaggaagactgtattctcccactctgctcaggccaaaatcatcagctgtatcaccgaatattatgtagtagaaaggagatgcgcacagagatttaattaatttgtacaatttgaaattttgatatgatgctcttttactagaaacaacttacaaattcaaagagtttccatctgtctgatcttattttatcctcatggc

SEQ ID NO: 107681 - DNA, 601 bp, Human
gcaaatgttctataaaataggaagccatattgttagctttatggctccacattctcaattttctttgctctcaagctaggtattctggagaggaaaaaaaattaaatcaactgtctgcagttggatgtctccctgagatgacagatgagactcagtcataaacatctacagcaaaagcagacccatctgtgttgaatgcaattaaagtattgccagtaacaacggcttaaacagaagagcactctttctcacctttagaggtcaatgaagaagttgttttttcgaataaaaagaagaaaarctatcaagtctaactaaaagcttgattaacagaaagagtgaacttcaccatggatatatgatcatttatacagtttgtgctgttccatagaacctccataccctatgtagtcaaccctcggtatctgcagaggattggttccaggaccccctgcaaatacaaaaatctgctcaagtttctcatataaaattgcatagtatttgcatataacctatacatatcctcctatatactttaaattacctgtagattagtcataatatctaatacaatctaagtgccaggtaaatacttgttata

SEQ ID NO: 107682 - DNA, 601 bp, Human
catgaacctttgaaacttcaaatacggaaggcaacattttgataaatgtttctaaattacaaaaaaaaaatattaactgggcattacatagacaacgtcaggaaaactaggaaagaaaaaattagcatggtcataataaagtcagtgttactggaacccagatctgaggtgaaacagtattctgttttgggaaactgattgcatatttcacaggctggagataaactctaacagctcctttgttttcttctttagacagaaaaataattattgctctgtggcaaatgttctataaaatagkaagccatattgttagctttatggctccacattctcaattttctttgctctcaagctaggtattctggagaggaaaaaaaattaaatcaactgtctgcagttggatgtctccctgagatgacagatgagactcagtcataaacatctacagcaaaagcagacccatctgtgttgaatgcaattaaagtattgccagtaacaacggcttaaacagaagagcactctttctcacctttagaggtcaatgaagaagttgttttttcgaataaaaagaagaaaagctatcaagtctaactaaaag

SEQ ID NO: 107683 - DNA, 601 bp, Human
cttctcctgccgtcctggggcctgcaggcatccgcacagcagtcagcccctagaacaccttctctgctgactcatttgtgagtcatcaaatttttagcacagacatcacgttgcaattctgttgttgggagccagagacattctgtaagaaacgtctgcatttgcagagttggttcagacctgtgagcggccacagcagcataacgatgtgcatgcacgtgtgtttttgttcacatcctccagggctctcactactgactttatgtaaccgcacacaacactgccatttacagctgcaaayacttctcttgccgaggttccttaacaaactgctactctccaattaatttctgatagaacctttgtttctgtgttttccttatcaccttgtcactgatgaatatatagtaaaacaaggaaattcgggggtcagaatctggtactcaggaaaatttgagggtctgtcagaagctggtacaccgcccccccgccaaattctatggacacaggattttcagttatatttccacaaagttccctggttcctggaacatttctgttgatgtatataaatgcacatagaccggtggttctcaacagg

SEQ ID NO: 107684 - DNA, 601 bp, Human
gaaagaaagccacatagcctctcaagttgtacatggagaaaatgcccctacgaaaagccagctgagtcaactcaactaatggctctccttgcttctcctgccgtcctggggcctgcaggcatccgcacagcagtcagcccctagaacaccttctctgctgactcatttgtgagtcatcaaatttttagcacagacatcacgttgcaattctgttgttgggagccagagacattctgtaagaaacgtctgcatttgcagagttggttcagacctgtgagcggccacagcagcataacgatgygcatgcacgtgtgtttttgttcacatcctccagggctctcactactgactttatgtaaccgcacacaacactgccatttacagctgcaaatacttctcttgccgaggttccttaacaaactgctactctccaattaatttctgatagaacctttgtttctgtgttttccttatcaccttgtcactgatgaatatatagtaaaacaaggaaattcgggggtcagaatctggtactcaggaaaatttgagggtctgtcagaagctggtacaccgcccccccgccaaattctatggacacagg

SEQ ID NO: 107685 - DNA, 601 bp, Human
tggttttattttaattacataggataagtagaatacgctattccacccttaaatagttcacttaggttcttggaaaatagctttaatgaaaagaaaatctccatttataaagagcatataacaattgcttatgtgtgaataagagcttcaaacatgtttagaagttttttaaaacagtgctgtagccttaagcattctgctttcactcttttgcactctgttaatttgcttaataaactctcttggtagacagtctgacagtaaacttcaagcccactccttggaatgtgcccctcaagcmagcctctaatgacatctgaataacgtgtgataagtatacaatttttaatgtatgattcaagcctcaatatagaaaaaagtcaatatatctttataacatgaagacaattcagtttaaaattgtgtccttgtggcttttgtttataaactcacattgatttttttaagaaaaaagacacagaaacactagttccccacaccgaatcacagaagcgcaacgccctctctcttcagcatgaaaatacattaaggtacgacagaacttaaacaggtattaaatttaacctcagctagctctcca

SEQ ID NO: 107686 - DNA, 601 bp, Human
acactccttggtaatgtctccctgtaaaggcccaacaagagtagtcagggacctctctattttgacattctcacactgcaacaattagactgtcttccaaacacagaaaaaactcaccagttagggttaattaaaagaggtcactctgaattactcatactgtttaagacctgtggttttattttaattacataggataagtagaatacgctattccacccttaaatagttcacttaggttcttggaaaatagctttaatgaaaagaaaatctccatttataaagagcatataacaattgyttatgtgtgaataagagcttcaaacatgtttagaagttttttaaaacagtgctgtagccttaagcattctgctttcactcttttgcactctgttaatttgcttaataaactctcttggtagacagtctgacagtaaacttcaagcccactccttggaatgtgcccctcaagccagcctctaatgacatctgaataacgtgtgataagtatacaatttttaatgtatgattcaagcctcaatatagaaaaaagtcaatatatctttataacatgaagacaattcagtttaaaattgtgtcc

SEQ ID NO: 107687 - DNA, 601 bp, Human
ttaaaaggagtatgtgtcatctaatttcctgagtctcctgcaccccaatattctaatttagcctttgatacatattctccttcaaggaaaatgcaccaattgagccaaatatttaggtctatttggcaattgaaagttggcattgtggtttattcatcagtcttttgtgagtttatttagaaggagttaatcctcctgcatttatccctcttttaaaatgctaatgaaataaattttctagacttataagaaaagatcagacccaggttcctacagaatgccctcctaccctacactcctyggtaatgtctccctgtaaaggcccaacaagagtagtcagggacctctctattttgacattctcacactgcaacaattagactgtcttccaaacacagaaaaaactcaccagttagggttaattaaaagaggtcactctgaattactcatactgtttaagacctgtggttttattttaattacataggataagtagaatacgctattccacccttaaatagttcacttaggttcttggaaaatagctttaatgaaaagaaaatctccatttataaagagcatataacaattgcttatgtgt

SEQ ID NO: 107688 - DNA, 601 bp, Human
aagactgcctcggaatataaggacacagaagttatgaacaagatcagtcagttatacaaataacctaaaggatttttgtgactattacggcaatgggatttgggcacaagtggcttaagtggaatattgggaaggcacaaataaaacataatattaactaaggaagataaaatgttatcagtcatattgaaccatgtttgaataaaggcttattaacagaagatcagcatgtaacccaaataaatggagaataaaacagtttctctcaccattgcctagtgtagaagcaataaatggcttcccagtcttcttggaaaaatagcatatccttaaaaggagtatgtgtcatctaatttcctgagtctcctgcaccccaatattctaatttagcctttgatacatattctccttcaaggaaaatgcaccaattgagccaaatatttaggtctatttggcaattgaaagttggcattgtggtttattcatcagtcttttgtgagtttatttagaaggagttaatcctcctgcatttatccctcttttaaaatgctaatgaaataaattttctagacttataagaaaagatcagacccaggttcct

SEQ ID NO: 107689 - DNA, 601 bp, Human
gaagactgcctcggaatataaggacacagaagttatgaacaagatcagtcagttatacaaataacctaaaggatttttgtgactattacggcaatgggatttgggcacaagtggcttaagtggaatattgggaaggcacaaataaaacataatattaactaaggaagataaaatgttatcagtcatattgaaccatgtttgaataaaggcttattaacagaagatcagcatgtaacccaaataaatggagaataaaacagtttctctcaccattgcctagtgtagaagcaataaatggctwgccagtcttcttggaaaaatagcatatccttaaaaggagtatgtgtcatctaatttcctgagtctcctgcaccccaatattctaatttagcctttgatacatattctccttcaaggaaaatgcaccaattgagccaaatatttaggtctatttggcaattgaaagttggcattgtggtttattcatcagtcttttgtgagtttatttagaaggagttaatcctcctgcatttatccctcttttaaaatgctaatgaaataaattttctagacttataagaaaagatcagacccaggttcc

SEQ ID NO: 107690 - DNA, 601 bp, Human
agaagactgcctcggaatataaggacacagaagttatgaacaagatcagtcagttatacaaataacctaaaggatttttgtgactattacggcaatgggatttgggcacaagtggcttaagtggaatattgggaaggcacaaataaaacataatattaactaaggaagataaaatgttatcagtcatattgaaccatgtttgaataaaggcttattaacagaagatcagcatgtaacccaaataaatggagaataaaacagtttctctcaccattgcctagtgtagaagcaataaatggcwtgccagtcttcttggaaaaatagcatatccttaaaaggagtatgtgtcatctaatttcctgagtctcctgcaccccaatattctaatttagcctttgatacatattctccttcaaggaaaatgcaccaattgagccaaatatttaggtctatttggcaattgaaagttggcattgtggtttattcatcagtcttttgtgagtttatttagaaggagttaatcctcctgcatttatccctcttttaaaatgctaatgaaataaattttctagacttataagaaaagatcagacccaggttc

SEQ ID NO: 107691 - DNA, 601 bp, Human
caaagaaatattggaaaagagctttttttcctggattttggaaccctattgtagccaaaagaaagagccacaagcacactgagtgttgtaaatacatgtgagagaagactgcctcggaatataaggacacagaagttatgaacaagatcagtcagttatacaaataacctaaaggatttttgtgactattacggcaatgggatttgggcacaagtggcttaagtggaatattgggaaggcacaaataaaacataatattaactaaggaagataaaatgttatcagtcatattgaaccatgyttgaataaaggcttattaacagaagatcagcatgtaacccaaataaatggagaataaaacagtttctctcaccattgcctagtgtagaagcaataaatggcttgccagtcttcttggaaaaatagcatatccttaaaaggagtatgtgtcatctaatttcctgagtctcctgcaccccaatattctaatttagcctttgatacatattctccttcaaggaaaatgcaccaattgagccaaatatttaggtctatttggcaattgaaagttggcattgtggtttattcatcagtcttttgt

SEQ ID NO: 107692 - DNA, 601 bp, Human
cctaccccctcccagagattgttaatatcattttacttggatcaaaaagccttgctttttggcctcttctgtaaatggtgcacaaatggtagcaccgttgaaatgggaatgggcagagggaactgccagcgttcctaaacaggagcaggattgttatctgctaaagccctcacagcctcacagcaccaggtagctcccgtcatctttgacttctgtgtcttccacagagaccaaaattcagagttaaatgaaagcaggggttcagcaaactctccacaaagggtgaccctcataacagtartttcttatttgtaaatataaactctgtttattgactagaaaagggcatacttagcatactatacatcataagggagtatgggcatgtaggaaggaagaaaatgcagaaacagttagcaaataatacttctgaattttttttttaagacaaggtctcactctgttgcccaggctggagtgcagtggcacaatcaaggctcactatagtctcgctctccagggctcaagagatcctcccacctcggcctcctgggtagctgcgactacagacgtgtgccaccacacaccacatcaacaattt

SEQ ID NO: 107693 - DNA, 601 bp, Human
gtggcatctagttcaaaaagggatgcaatgtcattgccatgcgggactgaaaccaaagtatacatgatcttctcccctgcctggcgttttttctttgaagttggagggactccatctctctgttgaggaagtacaagtttatttacttttatcacgtttcttgctaaactctccaattaatcaggtgataaggtttaaatgtgcatgttatttcttccttggattgaagaggtgtctatttcacatcatccagaaacactagctctagcccgacagccattgaggtaattactgtcaacartgatgagtcccacactcctagggcggggtggcttgatctgcccacatcattaaggcactaacggtaccaatagttatggacccttccctcgttctcttaaacctatttacaaagtagtaattttgaccattccacagttaaaacaaacacagagaagagcccgtgtgttgaatcatctagatttctgaagttaaagtaagcatggcagtgtgcaggagttcatacctaactccccaggcataataatacttggagaggagcagaatcaacagcaacattccctttcaccacctgcttgct

SEQ ID NO: 107694 - DNA, 601 bp, Human
gaggaaacccacacaatgcctgcctttctgcataggtgccttcagcttcaccactgccatctgccaaggccaagcacaatactgctccatcaaggccaatttagagccatcccactaaccctaataatatgggcaagactcctcgatgcatctagagagtgcatcatagccttatggttgaaagatggacagttgtagacaaaaaagcttaactaaactagtcaaattcagcctgggcgtggtggctcatgcctgtaatctcggcattttgagaagctgaggtgggtggatccctcgagcycaggagttcaagaccagcctgcgcaatatggcaaaataccatctctacaaaaatatacaaaaattagcagagcatggtggtgcatgcctatagtcccagctactcaggagactgaggtgggaggatcacctgagtaccagaggtagaggatgcagtgagccatgattgtgcctctgcactacaccctggacaacagagtgagatcctgtctcaaaaaagataaataaatgaaaagtaaaataaaatggtcaaattcaagcaaaagaatgtaagatattgtcttaccttaagttctggcaa

SEQ ID NO: 107695 - DNA, 601 bp, Human
ctcatgctataaacaagtgtcctttttgtggcccatttagtgccatgtttttcatatttcacaataagatggcccccacatgaggtgtagaagtgccatctagtgttcctaaagcacaagaaggttgtgatgtgccttacaaagaaaatacttgtgctagatgagcttcgttcatgcatgaattatagtgctgttgaccacaagttcaatgttaatgaatcagcaacgtacattaaataaggtgtatttaaacagaagcacacatagaacaaggctatgtattcgtcaacaaaaatgttgygaccagaagctcacaggaacctaactctatatttcccctaggaacaatggttcagtatttgctaattccatgtaccatgaattttaaagattgactagatatgaactgtgagagaatgcctaagaaaggacacctagaacttcatcctactcaagtattaccgtttttagtaaatcttttataatcttttgttatttctttaacaaatatgtgtatagtgtctattaaaagaaaagcacagtaagtactctgccttcaagttgcttacagatcagtgtaaagataaggcataaatacgtc

SEQ ID NO: 107696 - DNA, 601 bp, Human
aattgactcaagatccctctgctttaaggggaaattcggaattatagactatttcaaagcatgcagcatttttacctaggtagtagttctcaaagtgtggtccctagaccagtggcatcagcattgcctgggagcttgttagaaatacaaattctgaaacttcatccccatcgactgaatcagaaactttgggggtgtggcccaacaatgagtggtttaataggttctccaggcagttctgatgcatgctaaactaagaacattgatcaaatagccaactcagctaacactgctggcagasagtagtgtagtttgtgtagtttaattgtctgcatgtgaaagtattaatgtacaatcaatcctcattatttgtggcttctgtacttgtgaattctcctgttcggtaaaatttatttgtagcccccaaatcaatattcaaggagcttttgtggtcattccagaacatacatagagtggcaaaaatttaagtggcccagtaggcacatttccaagctgaagtggaacaaggtgatgctctgccttcttgtctcagctctcatgctataaacaagtgtcctttttgtggcccatttagtgccat

SEQ ID NO: 107697 - DNA, 601 bp, Human
accaatttaaagagttactcacctcctttcattctgagttattgtgccgttttctagctttttaactgtggtcgctagtactttattggcatcattggcaaagtctaagtctcgaacttcagacagtggaacagacacgattgcgaacgcttctttatcttctttggtttggcaggttccaatctgaaatgtttttccattaagcttagttttataaacaactatacaatattctttgaagactaacacatctagtactgtttaagaaatataagacaagaatagatcatccgaacacagkaactcccacatgcatcatccactatgaaaggctgcagggacacagagatttcctgtgcccacttcctgccctgttcccaaagccccactggaaacttctccctttcacacttgccctctgcttcagtttcgacagagtagagaaaaggcactcctggattctactcctccatccatatgctgctaccattctttctggtgtctctgtagcatccttctgaatcacagctttgctgcctccaacccatttagatcagctacctaagcaactggcagacatgcatgcttgatgaaattaatt

SEQ ID NO: 107698 - DNA, 601 bp, Human
caacgtttttcactccaaaacagcagggaaagaagcaaaggaaataaaaatgcatgctctctagtcagtcctagtccaccaccttccttagaatcatcttgagaggttaagataatctccagctgtgactgaagaagagtgactcgcacaggattccagccagcaatggtggagagaccataatctgaatttttatctgtccttttcttcaaggaatatcttaatgcttagcaagggagactttttaagtgaagccaagtaaattgctgtgcatatgtaagagtgttagaaacaaagaaayagattcacaaaaggaaaagttagatcaataacaggcaaataaaaattcctatctgcacatcagaatccatttcctgccataatttagctctgatatttacttgtctatagcccataaaagtgggccagttgtttctgcttccggcctttattcatttcccctaacagggttggaggtgcgactgaatatacaatagttgttttgaaatgtaagtttgccagggaaaaaaatagaggtaagaatagagaggaagctgagaaacagctattccatttgtttgcatatttaggatttttttct

SEQ ID NO: 107699 - DNA, 601 bp, Human
cagcaacaagagatgctagaaaataattaaattttagctttaaaatacagatagaaagtaattatcaatctaacatctctataaagtatcacttaagagtaatggcaagagtgcagtggctcacgcctgtaatcccagcactttgggaggcagaggcgggcagatcacctgaggtcaggagttcaacaccagcctggccaacatggtgaaaccccatctctaccaaaaatacaaaaattagctaggtgtggtggcacacacctgtaatcccagctactcaggaggctgaggcaggagaatygcttgaacccaggaggtggagattgcagtgagccaagatcgtgccactgcactccagcctgggcgacagagcaagactctatctcaaaaaaataaaaaagaaatatgttgagagtaaattctggctgggcatggtggctcatacctgtaatcccagcactttgggaggctaaggcaggcagattacctgaggtcgggagttcgagaccatcctggctaacatggtgaaaccctgtatctactaaaaatacaaaaattagccagatgtggtggcaggtgcctataatcccaactactcggg

SEQ ID NO: 107700 - DNA, 601 bp, Human
tcaaaaaaaaaattattattattataattatttaaataaaaatttaactgaagaaggaaaattattctacatacattctaaaaatattattaatctataaggcagtatcaaaaattgatccagatactagcaaagagaactattaaaaggcaaataataaaagggaagttaagagagaaagaagaggaattaagaggatccaacatatatctcataaaagttccaaaagacagaaaggaggaaaaagacaaagaagcaatatttgcaggaaaacggctgaaaatttccaagaattgaaggmagaaataagtattcagattaaaagtataccttaagtgtcaaatgagaaaaaacaaaaataaaactcctttgtaaacacatcatggtgaaacttaagacatcaaaagcaaagaaaaataatctataaaattaccaagtcgggggaggagccaagatggccgaataggaacagctcgggtctacagctcccagcgtgagtgaagcagaagaccggtgatttctgcatttccatctgaggtaccgggttcatctcactagggagtgccagacagtgggcgcaggtcagtgggtgcagcgcacc

SEQ ID NO: 107701 - DNA, 601 bp, Human
taactctatcttttctctctgtgtcttttctttgtctcccatcatatcttttccactaaactataacctctttggtccatacacggtgatgctgtacctcacatgttcctcaagccaaaaatgttccattcctccttacataatagatccaggatgtcctggccaccaggaaccaataacaggcacatattagtactcaggacatcctcccccagtgattctaatttcatatggaagaataaagccatgttcaatacaactcaaaaatacttacaaatcatttttatgtattgcccaacayaaaatatttcatttcaaagtgaaatttcccattcctactttctatgctgtagaattataaccaaagaaccttgcccatactttacatatgaaacagtttaaaatgggggctaccctctgacctgatttttccggtaatcctgctgcgagtgtctcaggacgcggtaacagagccgcagcatgtacttgtagggtgcatatctttgatcccccagatcttcaagtctcagcatcgagccttctcctgctttctctttaaagggtgctttaagaattccaaatacctatcaggaataaaaac

SEQ ID NO: 107702 - DNA, 601 bp, Human
tccttagtagctggaactacagacacacaccaccacacccaggtatttttcgtttttgtagagatgggggcctcgctatattgcctaggctggtctagaactcctggccttgagtaatccccccaccttggcctcctaaagtgttgggattacaggcttgagccacgccacctggtttgtatttttaagataaaaatgagacttaagagaaatttcacttgcaactggcaactgttagctgtacccctagatccatctgggttccctgacctcagcagttgcaaatatcttaggggaaacrtgtcctttctagcatctatcattctcacttcatagatctctcttcacaaatacctcttcccatacaatttatgaaaatgattctcatcctacccaaaggcttccttctccaagtattcttccttggttcccaaagccaccactgggctctccctctggtgaattcccataactctatcttttctctctgtgtcttttctttgtctcccatcatatcttttccactaaactataacctctttggtccatacacggtgatgctgtacctcacatgttcctcaagccaaaaatgttccattcc

SEQ ID NO: 107703 - DNA, 601 bp, Human
aatatgaacaacactatctacttcatcttgccatcttaaaggaacccaatgaagtccggaaaaataattctagtgacagcatttggatcagcaagaagggtgtttataactaggattatattagacaatatttaaggatttgtttatatcacccctagctcttactcctattccttgccatattatttatcttctagctaatgtttttatatactcttttcagacctttcttactcttcaaacagaattgtgaagccaaaacattttaacacagtcttcctcaagcaaatctttttttctyccccaaaaatgttcaaactaccaagatgcaatagtgtgatgattcagagcctgggtttgcatactggttccattcttaaactatcaccttggacaaattacttaacctctctgtgcctctatccttcatcttaattcagtgttaactgaattaattcatgacaagtatttacaactgagcctggtacaaagtaagcacacaataaatactactaactcttcccaaataacctccaccttctaggattgacatcctaggccctagtggcttagcccaccctgcccttccagccctctccca

SEQ ID NO: 107704 - DNA, 601 bp, Human
ctgagattcaattagaacacacaacagaaagggaagaaaaataaaatataacccttaacaaatgctggggattctttattcctttatcatctatgctctaactctatgctccaaagaaacccagaaggcaggtccctaaagtgcataaacatgtacctgaaaggagtgatatgactaggtaggggtgtgtgtgtgggggggggggggtgggagggaacgggcacgtgcacgagcgcacacgtgtgtgtgtttgtgtgtgtgtacgcacacactgatccctggccaagactgagaggggagwgagaaagaaccatgtgtgccagaccttgagagacagaactgacaccaggtaagacatgtcgcccagggaacctactactgactagcagaataaccaaatccaaagtgagctggctccctgccatcccgaagcacagggctatagaaaagggaaggggccccaagtacccttccaaaggctgacagccatcaaggagggtgcacatcatgggacctgatgggcctgagggccctgggtagcctctatagacctgttaggtattttttctgttaatgtcaatctctataatacagcactgct

SEQ ID NO: 107705 - DNA, 601 bp, Human
atgatggctttgtgtattggggagccagttaagtaaagtaaatgtcttctgttattatatcattttaaggatacatattgatttatacactttcatgactactgtagtcatactctggtataaggcaaacatccaaaaatgttaataaataactaaatgaaattagaggtggtatcaaattttataaatagtaataaatagatcttcaatattaaatatatgggtgagtgttaagtcacaaatgaacttcctattaggactacaacatataggtgaagataaagaaaaacaaagtaattayagccataatgctatataatatatactacataataataataatatagaacattttaaaatgttctaaaaaatcagaaagctgctttatgcttactaccaagcattcttaactcaatagaaatgagaaaaacatttcccagctatcactgagattcaattagaacacacaacagaaagggaagaaaaataaaatataacccttaacaaatgctggggattctttattcctttatcatctatgctctaactctatgctccaaagaaacccagaaggcaggtccctaaagtgcataaacatgta

SEQ ID NO: 107706 - DNA, 601 bp, Human
aagtttgagaggtaggtcaaaagaatccttgtgagccatggtaaagggcaaagagattgtgctaaaagtaagagaaagccactggggaggttcaatcatgttattgtttgatctactccttattcatcacactaattttcctatatcccaaaccactattgttcatctcccacgttctatctacaagcagcacatctcacactgccatgggactggtgagcttctcccccttccaccatgaaaggttcttactttgattccttgggattctccctggaaatgtgtctttgtttctctgacragacaactgatagattagaaagtggttttgccttaggtaaaatttactggaatgtacctattccttgaaaatgatattggttgcacaaatctaattatatgctaagcagcatttttgtggcccttcagaatgatggctttgtgtattggggagccagttaagtaaagtaaatgtcttctgttattatatcattttaaggatacatattgatttatacactttcatgactactgtagtcatactctggtataaggcaaacatccaaaaatgttaataaataactaaatgaaattagaggtg

SEQ ID NO: 107707 - DNA, 601 bp, Human
tcacaacagaaggttcactaaaaattttctcaaaagaaaagcaagtaaatttttcaataaatagagctttttgaggaaagacatgaaaacatactggcatatacgtttttgaacttctactaaaaaattatacacctagaaataattatcagtataggtattttggaaatacctatttccaaagtgggaaaaataaatctaattaaagtaagtttttatgacacaataactttggatttcatcagtctaacagaggctaagtgggaaaaataaatctaattaaaataagcttttatgacayaataactttggatttcatcagtctaacagaggcttttcttctatctcttacttaaagtcatagccaatgatttgggcataattatagaaaagaaaatgactgcctgatatttcattcatgagacatgagatctgggttgttacctgaagatcctagatggacttggattgattccttttctgtgaataggctggaatgatctgtaagatcttttctttaaaataatggtaaaatgtcatatactttttatctttaaaaagccaccaaacagggcaatgtgattaatcactttattgatta

SEQ ID NO: 107708 - DNA, 601 bp, Human
agttagtgatgtgaaagaactctaacttttaaaagttctaaaaataaaacataaagccgcaatctccactagaaaagaataccgcatgaatcatttcaaaccttggctcccgatttctcctgagtaaactgacaaatgtttctatttcttttgctgtgatatgtttctctagtagttttctgttgttgtgcaacaaagctgtgatagtatcttctgccaaaatatcatagccaatctgggactgcatgacacagaaattcttagcaatatattcctgcaaagaagaaaggctgtcagaatrcactgccaaacagcttacaaataacaggttctattagggtcaacaacattgattaatttattcacaacagaaggttcactaaaaattttctcaaaagaaaagcaagtaaatttttcaataaatagagctttttgaggaaagacatgaaaacatactggcatatacgtttttgaacttctactaaaaaattatacacctagaaataattatcagtataggtattttggaaatacctatttccaaagtgggaaaaataaatctaattaaagtaagtttttatgacacaataactttggattt

SEQ ID NO: 107709 - DNA, 601 bp, Human
tagagccaaacttcttcatcatcaatgtcatctgaaaggatggagctctccatggggttgtctgcttgcattgagaccacccttcaaataaatagcacatacaaaaatctactaaaaagtacacttgtaaatatgacaaagaattacagtgcttacaaataatcaacaggaaaatgatgcatccattatctgggcttacttagtttgaatgagaatgtctgcattgcctggactcaacataaatttacagatgagttcttgagttacagggatagcagtggtattagacacacacagatcygacaaataatccaaaaacctggcaaaagaaaaaaattaaatggaatatgaagacaaagcattttataaaagcatcacaataaagacataatttggaatataataaaataaacttattatatgttttaatattatttccacacaacatttgtctaatgtgttgtttatctactgcatcattagaaacaaattaaacatacaattctttttatttaatataagtcttgtttcaaaaaggatgtgtttgcttctatttattttatgatattccacccacagcaccgtgacttatgtttagaaa

SEQ ID NO: 107710 - DNA, 601 bp, Human
cctagttctgacatgacttttaaaattgcctcttcatagatacctaactagtggctacagagaaccagttctcaattaatatgtgagactgggaattattgtaagattgtctataatacttaacctgtaataggtaagaacttctaagtcagctttggtgccttcttttgcctcttgagcaaggtgcctgatagctttgccatgaggttccttgttgctgtcaatccaatagagccaaacttcttcatcatcaatgtcatctgaaaggatggagctctccatggggttgtctgcttgcatkgagaccacccttcaaataaatagcacatacaaaaatctactaaaaagtacacttgtaaatatgacaaagaattacagtgcttacaaataatcaacaggaaaatgatgcatccattatctgggcttacttagtttgaatgagaatgtctgcattgcctggactcaacataaatttacagatgagttcttgagttacagggatagcagtggtattagacacacacagatctgacaaataatccaaaaacctggcaaaagaaaaaaattaaatggaatatgaagacaaagcattttataaaag

SEQ ID NO: 107711 - DNA, 601 bp, Human
attttgaatattttaaacaatactaaatatttcagctaccctagttctgacatgacttttaaaattgcctcttcatagatacctaactagtggctacagagaaccagttctcaattaatatgtgagactgggaattattgtaagattgtctataatacttaacctgtaataggtaagaacttctaagtcagctttggtgccttcttttgcctcttgagcaaggtgcctgatagctttgccatgaggttccttgttgctgtcaatccaatagagccaaacttcttcatcatcaatgtcatcygaaaggatggagctctccatggggttgtctgcttgcattgagaccacccttcaaataaatagcacatacaaaaatctactaaaaagtacacttgtaaatatgacaaagaattacagtgcttacaaataatcaacaggaaaatgatgcatccattatctgggcttacttagtttgaatgagaatgtctgcattgcctggactcaacataaatttacagatgagttcttgagttacagggatagcagtggtattagacacacacagatctgacaaataatccaaaaacctggcaaaagaaaa

SEQ ID NO: 107712 - DNA, 601 bp, Human
tgtcactacatccccaaactgaaagtatttcaattcagtttggtgaaaataaaaacatctccatagagataaaaaaaagtatccaaacattttacaaaatatgcaaaactgcctttctttattacatgcaaaaaatcttacacaaatgaaacaaaaaatcaagggaaatagtaattaatagacaattataaataaaatgttttgtactggacatcaaagcaccaaatctatcttctaaaaatggcagagaaggccgggggtggtggctcacacctgtaatcccagcactttgggaggccgrggcaggtggatcacgaggtcaggacatcgagaccatcccagctaacatggtgaaaccccgtctctactaaaaatacaaaaaattagccgggcgtggtggcaggcgcctgtagtcccagctactcgggaggctgaggcaggagaatggcgtgaacccgggaggcggagcttgcagtgagccgagatcatgccactgcactccagcctgggcgaccgagtgagactctgtctcaaaaaaaaaaaaaaaaaaagcagagaaaataataccttcatgaactaaactacccagttaccaaaacat

SEQ ID NO: 107713 - DNA, 601 bp, Human
atcaagtaacagcatcctttctctagttttgtcactacatccccaaactgaaagtatttcaattcagtttggtgaaaataaaaacatctccatagagataaaaaaaagtatccaaacattttacaaaatatgcaaaactgcctttctttattacatgcaaaaaatcttacacaaatgaaacaaaaaatcaagggaaatagtaattaatagacaattataaataaaatgttttgtactggacatcaaagcaccaaatctatcttctaaaaatggcagagaaggccgggggtggtggctcacrcctgtaatcccagcactttgggaggccggggcaggtggatcacgaggtcaggacatcgagaccatcccagctaacatggtgaaaccccgtctctactaaaaatacaaaaaattagccgggcgtggtggcaggcgcctgtagtcccagctactcgggaggctgaggcaggagaatggcgtgaacccgggaggcggagcttgcagtgagccgagatcatgccactgcactccagcctgggcgaccgagtgagactctgtctcaaaaaaaaaaaaaaaaaaagcagagaaaataataccttca

SEQ ID NO: 107714 - DNA, 601 bp, Human
gagggtgaaagagtggaaaaaaaaattgggtactgaaataaacattggcttttttattatctaaattagcacagcaatttctaaacttcctaattctttaacacctaggaattaaaatacttgcaaaagcaaccacttgaactttgatttattcaagtctagaactaaatccaagcaagactcagagtgctttaaggtacttaacaaaatttacactagaattatttacatcctaattaaacattaagtaatttaagtcagcaggatgccacttaataaatggttgcatcaattaattacyttaataaatggctattatccaagaaatttgcccagaaatctatgttccctatgctgctttgtggtcttgtggatcgcacaggacattccaagtgcgagagtctacctccaagatgtggccccagtgcacagtctccccctaccacactgtatcagagttggtccaagtaaccaacagaagtgatgacatgtcacttccaagattagattacagaagactgcaacttccatcttgtactctctctctctctctctcagatggcttgctctgaggaagccaggtaccatgtcatgaggacac

SEQ ID NO: 107715 - DNA, 601 bp, Human
tggcttggctataatgttagttgctaaagatggaatctgaccttatgaattcatctttcaaagctttagcattataaacagagatgcatgtttgtaaatccaccttattatcactcagccctgtcataggaattgtgttcatatgcacacatatattagcaggtacacaatagcaaccccttctctgtagttttgttttttatcttacttccaagtaataacaatgatattatcacatttcccaaaattcttacctccatcttgaaatttgcttaatctttcaaagtatgatgacatgggrgcctgtacaatgtctaaaatagccagaagtgttcttgttagccttaataactcactgaaactataaaatccaaagtatataagattccgagccaagtggaccaccttaataaaaaaaaaaaagcggggagggggagggtgaaagagtggaaaaaaaaattgggtactgaaataaacattggcttttttattatctaaattagcacagcaatttctaaacttcctaattctttaacacctaggaattaaaatacttgcaaaagcaaccacttgaactttgatttattcaagtctagaacta

SEQ ID NO: 107716 - DNA, 601 bp, Human
ccctttgccttaatttgtgacaattccaaagagcatcccagctccaaaactccctacaggatgagctgaggtctcagtcataactgcattgcagatgagctctgcctgcacagtcctaccttcctcacttccttacaggtacatatccaagtgcactcttcgatataccttctgcaaacaagcctctagatcagggtgtttttagggtatccaacccaagacaatcgtcataaaaactttgtattgacttatgagacaggcactgttgaaagtccattgaatatattgtatacattccctyaattcttgcaaggaaactgtgagaaggatattgttattaccatcttcatatctcagatgagaaaagaaaaatcatagagaagacaagtaccttataaatggtcaaggcaggatttgaatacagatactctaacttgaaaacccattctcttatccacttcactccacaggttcccacactggcgtggcattcactccttctctggcgtgatactttggcagccctttccttgaatctttcttttttttttttttttttttttgagatggagtctcactctgtcgtcaggctggagtacag

SEQ ID NO: 107717 - DNA, 601 bp, Human
gcatttgcactgtcccctcgcttctagttatgctgaaggtgagggatttctgtggttcaattggcttcttattgatttgtacagttttttgaaagctataaaaggaattgagatttgggcagcagcaattaattacttcagcttactgtaagttgctcatttataattcttaactaggtatttcttctttatgtctgaaattaggtttctggttttgcccttttaatactgtagtggatgttgtagtggatactattgtgctccacccatgtccccttttcaaggctgaggcccttaaggscccagctgctgggcattcttgttgctaactatttacagctgtacctctcactaggccagactcttacccaatgttacacagccccctccaggatgaagccaagtagctaatagctggctgatacaaagacacaaagggtggccccctttgccttaatttgtgacaattccaaagagcatcccagctccaaaactccctacaggatgagctgaggtctcagtcataactgcattgcagatgagctctgcctgcacagtcctaccttcctcacttccttacaggtacatatccaagtgcact

SEQ ID NO: 107718 - DNA, 601 bp, Human
tagcatttgcactgtcccctcgcttctagttatgctgaaggtgagggatttctgtggttcaattggcttcttattgatttgtacagttttttgaaagctataaaaggaattgagatttgggcagcagcaattaattacttcagcttactgtaagttgctcatttataattcttaactaggtatttcttctttatgtctgaaattaggtttctggttttgcccttttaatactgtagtggatgttgtagtggatactattgtgctccacccatgtccccttttcaaggctgaggcccttaakggcccagctgctgggcattcttgttgctaactatttacagctgtacctctcactaggccagactcttacccaatgttacacagccccctccaggatgaagccaagtagctaatagctggctgatacaaagacacaaagggtggccccctttgccttaatttgtgacaattccaaagagcatcccagctccaaaactccctacaggatgagctgaggtctcagtcataactgcattgcagatgagctctgcctgcacagtcctaccttcctcacttccttacaggtacatatccaagtgca

SEQ ID NO: 107719 - DNA, 601 bp, Human
ctagcatttgcactgtcccctcgcttctagttatgctgaaggtgagggatttctgtggttcaattggcttcttattgatttgtacagttttttgaaagctataaaaggaattgagatttgggcagcagcaattaattacttcagcttactgtaagttgctcatttataattcttaactaggtatttcttctttatgtctgaaattaggtttctggttttgcccttttaatactgtagtggatgttgtagtggatactattgtgctccacccatgtccccttttcaaggctgaggcccttawgggcccagctgctgggcattcttgttgctaactatttacagctgtacctctcactaggccagactcttacccaatgttacacagccccctccaggatgaagccaagtagctaatagctggctgatacaaagacacaaagggtggccccctttgccttaatttgtgacaattccaaagagcatcccagctccaaaactccctacaggatgagctgaggtctcagtcataactgcattgcagatgagctctgcctgcacagtcctaccttcctcacttccttacaggtacatatccaagtgc

SEQ ID NO: 107720 - DNA, 601 bp, Human
agtaactagcatttgcactgtcccctcgcttctagttatgctgaaggtgagggatttctgtggttcaattggcttcttattgatttgtacagttttttgaaagctataaaaggaattgagatttgggcagcagcaattaattacttcagcttactgtaagttgctcatttataattcttaactaggtatttcttctttatgtctgaaattaggtttctggttttgcccttttaatactgtagtggatgttgtagtggatactattgtgctccacccatgtccccttttcaaggctgaggcycttaagggcccagctgctgggcattcttgttgctaactatttacagctgtacctctcactaggccagactcttacccaatgttacacagccccctccaggatgaagccaagtagctaatagctggctgatacaaagacacaaagggtggccccctttgccttaatttgtgacaattccaaagagcatcccagctccaaaactccctacaggatgagctgaggtctcagtcataactgcattgcagatgagctctgcctgcacagtcctaccttcctcacttccttacaggtacatatcca

SEQ ID NO: 107721 - DNA, 601 bp, Human
acttctagctttctaagaataatttagtttagattgaagattgtaaaagcataacaagcagctttagtatggacatttcaagtgttatgtaccctctgggagtggtaaaaggagtctcactagtgagattcaggcagcggaattaatatagacccctgcatgtccctgctctttgattaacaactacggttcttggtctttgctttttctcattcatatgttgctcatagatttatttttataaaatgttcaatttacattaaagatgcaataatagtaaagaatattcatatacgctttycttttttctccatttgctttcgtggttcctctctgaaacccttattattctctttctgaatgtatactatatataatcatcttattatgctcttagagattaccattctggataattacaccatgtagattcaggttgtcttttatttccaaatgttctcttggattgcaattttaaatactcattctgttccattttcttgtttttcttcttcagggactccagttattcatatggtggctcttctttgcctttcttccatttcagcctctttccctctcaccctcatcacttgtttct

SEQ ID NO: 107722 - DNA, 601 bp, Human
aatgtctttaataaaatactcttcatggtgaaacactgaaggcagattgtaagcagtgagatcaaaagtcaggatcaacttctagctttctaagaataatttagtttagattgaagattgtaaaagcataacaagcagctttagtatggacatttcaagtgttatgtaccctctgggagtggtaaaaggagtctcactagtgagattcaggcagcggaattaatatagacccctgcatgtccctgctctttgattaacaactacggttcttggtctttgctttttctcattcatatgttgytcatagatttatttttataaaatgttcaatttacattaaagatgcaataatagtaaagaatattcatatacgctttccttttttctccatttgctttcgtggttcctctctgaaacccttattattctctttctgaatgtatactatatataatcatcttattatgctcttagagattaccattctggataattacaccatgtagattcaggttgtcttttatttccaaatgttctcttggattgcaattttaaatactcattctgttccattttcttgtttttcttcttcagggactcc

SEQ ID NO: 107723 - DNA, 601 bp, Human
tagatagatagatagatagatagatagatagatagatagatagacagacagacagatagataacctggctgtttctcctattatagatagatagacagatagataatctgactatttctcccaataggagaaaggagaaattttgcccatttatttattaattgtcttccctgtggctaacaactttgtttatcttgttcattacttattaccagtgactagaactgtgtctggcatgtagtaattcttcaatacattcttgttaaataaattaataaattattatcagattgctgaaagaataattaaggtatctagaagtcagtggaattcactaaaaaatatgagaattatagaaattaaatttatgtgtctttgagggcagatataaacaggacggtggagagagcaaacaaggtaacaacttttccaagaaaaaaagtactttccttaggcaaaactatggaaagagaaaaagatcagcagttgccaggggatggtgaggaggtgggagaagggttgaatatgcagagcacagagaatttttagggcagtgaaaagatgctgtacgatactataatgttagatacgtgtcattata

SEQ ID NO: 107724 - DNA, 601 bp, Human
tcatgtctctttaatctcctttaatctgaaacagtttctcagccttcgacatttttgcccacatagatattctctattctccattcagcagtcaacatgatcagatcatatcaatcccttctcaaatccctccagagattgcccaccaaacttaaaacaaaattctaccctccctcactccatcagtctccatatcattgacctactttatttttcttcacagcattatcagatgttacaggatagatagactagatagatagatagatagatagatagatagatagatagatagatagayagacagacagacagatagataacctggctgtttctcctattatagatagatagacagatagataatctgactatttctcccaataggagaaaggagaaattttgcccatttatttattaattgtcttccctgtggctaacaactttgtttatcttgttcattacttattaccagtgactagaactgtgtctggcatgtagtaattcttcaatacattcttgttaaataaattaataaattattatcagattgctgaaagaataattaaggtatctagaagtcagtggaattcactaaaaa

SEQ ID NO: 107725 - DNA, 601 bp, Human
aaaacaagtacattagcttagctaagcacagtgcaattacaaaagtcaagaaatctaactgacataatcaatattcaaatataacctgcaatccatatttctacaatccattttcaaattgtatcacttgtgccaataatatcttctatagataatatttctcctaatccaggatccagtactgaattgcatattgcatttagttgtcatgtctctttaatctcctttaatctgaaacagtttctcagccttcgacatttttgcccacatagatattctctattctccattcagcagtcarcatgatcagatcatatcaatcccttctcaaatccctccagagattgcccaccaaacttaaaacaaaattctaccctccctcactccatcagtctccatatcattgacctactttatttttcttcacagcattatcagatgttacaggatagatagactagatagatagatagatagatagatagatagatagatagatagatagatagacagacagacagatagataacctggctgtttctcctattatagatagatagacagatagataatctgactatttctcccaataggagaaagg

SEQ ID NO: 107726 - DNA, 601 bp, Human
gcgtctgacctgccaaacacatttttctgcatgtccaaccccaactgtgctggagaaaaattagtaagtgggaagtaaggataaaaaagatgtagttctagtacacaaaattttcctgacatgatatgagcatacagaactgtatcatttacttaaaggaactggtctatctagcaacaatgtttataaaaccactttcttttttttttttttttaattgtactttgcaaatgacttcccattgaagataaagtttcattaaaagagaaaaatacttacagtatgagaggagtccatatgaaaaaaaaaagaagaaaatacaatccaaatcatttagatatcaaagagccaagatgatgatacagagtattgtaatgtggtaacattgctatgactcctaacagttgatctttaaaataatatttctttttttttctctaggtactttccacaatctgggatttcctctctggcatcgacctttgtctcaccctgcaccacaggaatttttcccatgcttgacaatcctatctccatatttggagattccagaaaagtgtttcttcttgcttcttctgttaagaatttatacagtctaaca

SEQ ID NO: 107727 - DNA, 601 bp, Human
acatcctatttaagcctggcgccactgaggctggcaaaaaatggaactccaggaactgtaaagccttttccttctagatatgcctcctcttctgctctcctgcgtctgacctgccaaacacatttttctgcatgtccaaccccaactgtgctggagaaaaattagtaagtgggaagtaaggataaaaaagatgtagttctagtacacaaaattttcctgacatgatatgagcatacagaactgtatcatttacttaaaggaactggtctatctagcaacaatgtttataaaaccactttcttttttttttttttttaattgtactttgcaaatgacttcccattgaagataaagtttcattaaaagagaaaaatacttacagtatgagaggagtccatatgaaaaaaaaaagaagaaaatacaatccaaatcatttagatatcaaagagccaagatgatgatacagagtattgtaatgtggtaacattgctatgactcctaacagttgatctttaaaataatatttctttttttttctctaggtactttccacaatctgggatttcctctctggcatcgacctttgtctcaccctgcacca

SEQ ID NO: 107728 - DNA, 601 bp, Human
aagctagacgcagacccccaaccagatctaggatgaggacaacttacaatgacactgaggtgggctgctgtgtgaccaaggatgcagaagaaaaaaacttctgtaattgccactttccaagccagccatctctacaacctcaaacactcatcactggcatctaaagctacaggatttcccagaaaaaacaaatgaatgctgtgcgtgcacatcctatttaagcctggcgccactgaggctggcaaaaaatggaactccaggaactgtaaagccttttccttctagatatgcctcctcttcygctctcctgcgtctgacctgccaaacacatttttctgcatgtccaaccccaactgtgctggagaaaaattagtaagtgggaagtaaggataaaaaagatgtagttctagtacacaaaattttcctgacatgatatgagcatacagaactgtatcatttacttaaaggaactggtctatctagcaacaatgtttataaaaccactttcttttttttttttttttaattgtactttgcaaatgacttcccattgaagataaagtttcattaaaagagaaaaatacttacagtatgagaggag

SEQ ID NO: 107729 - DNA, 601 bp, Human
tacccatgctgttgtaaaagaaaaaagggctcttaattattagtagaaatagaaagctttgggttgtatatcctttagcaagtataaaacagatgtatgcttctaaaagtgaaatgtttgcaaagaatatggaaaatatccagttcatcagcttgtatgtgcatttgcttttaacttctataagtgacaaagaagaacatggcttgccataatccttctactcaaaagatcaattacactgaatggtgcctgtgcatttaaaatcactgagagcaaatcgtaagtattaggcaaagcaaaytgactcaaccacacagcctcctgggagcaagtacatttgtttgaaaacaatatttcttaagtaaatgtatagccaatgaaaggtattggattgatagtcctgaagatctgatcttctatttcactacagtgaaggccacagcagtgccagctccctgtgtctccatatgagcaagcctcaatcattttctgaacggaccacctttagggtacaaagataaaaagctgcttctgagcctagcaatttctgctgagcgtgccaactataagccattgtgacagggagcagccacagcctgga

SEQ ID NO: 107730 - DNA, 601 bp, Human
actctccagtagaataaaatatacccatgctgttgtaaaagaaaaaagggctcttaattattagtagaaatagaaagctttgggttgtatatcctttagcaagtataaaacagatgtatgcttctaaaagtgaaatgtttgcaaagaatatggaaaatatccagttcatcagcttgtatgtgcatttgcttttaacttctataagtgacaaagaagaacatggcttgccataatccttctactcaaaagatcaattacactgaatggtgcctgtgcatttaaaatcactgagagcaaatcrtaagtattaggcaaagcaaattgactcaaccacacagcctcctgggagcaagtacatttgtttgaaaacaatatttcttaagtaaatgtatagccaatgaaaggtattggattgatagtcctgaagatctgatcttctatttcactacagtgaaggccacagcagtgccagctccctgtgtctccatatgagcaagcctcaatcattttctgaacggaccacctttagggtacaaagataaaaagctgcttctgagcctagcaatttctgctgagcgtgccaactataagccattgtgac

SEQ ID NO: 107731 - DNA, 601 bp, Human
gacttcactgaaagcagagcatggacagagggaggacagacagaatcgagccatctcaagaagaataagcttgaatgcccagaggcagcatggtgctgggaagtgctaagtccagaaatcgagtttttcaagtgataaacggtaattggttgtgccttccctttgcatgtaaactttgctaacacttcttagcactgtgaactctactgcaaacttaactgctttgcagagacctgaaaagagctcagtcaggtgaaaaattcaaaagagatgaacactgggaagagtctgtaataggacrctagcttgtacgtatgtgttctttggttttgatccttatactaaacccttttctattctttctgatcccccatttccacatacacactttttcatggtctcacctcacactcggttaagtctttatttttctccctttctttctttccttttttttttttttttttttggtaagatactctgagtatatccagtggactagggcttctggtttcaggacattcaagctggtgtcttacaaagaacaatcatagctattaatcagaagataagcttcacagatattttctaaaaaggttgt

SEQ ID NO: 107732 - DNA, 601 bp, Human
atcctctcccagagtctgcttcctgaggaacacaactggcaatacgtaattctagagttgccgagaattgtggtcattgctgctgttatttaaaaatcagtgcaaggatttcaagatgttatgagaagtacatgctcatctgatacaatacacacagacacaaagggacaagaaggaaacctaccactgtggatgggattatacccatgttcctgccttttcttagagtctaaagcttcccttgacttgagtgtgtgatttggatggccagaaggtgtagggagaaaggaaccacatatgkaagatgggtaagtgtggggaacatggtacataatggagataagatagttctttcagaaacaaagggacttcactgaaagcagagcatggacagagggaggacagacagaatcgagccatctcaagaagaataagcttgaatgcccagaggcagcatggtgctgggaagtgctaagtccagaaatcgagtttttcaagtgataaacggtaattggttgtgccttccctttgcatgtaaactttgctaacacttcttagcactgtgaactctactgcaaacttaactgctttgcagagacct

SEQ ID NO: 107733 - DNA, 601 bp, Human
cacccagtctatggtatttttgttacagtagcccaggccgactaagacaactagtctgaagacaggtacttcaagcacggtcactcacccattccagagctgcctacggggacataaaggctcagccccctcaccctaatggagacagccctgaagacatcccaacttcaacctcccagaagcctccactaaactgcatcacaacccaacttctccctttctcaatcttgctttccctcccattctactggtgttgatcctaagagctctccctaataagtcttcttcatgctaatcctcycccagagtctgcttcctgaggaacacaactggcaatacgtaattctagagttgccgagaattgtggtcattgctgctgttatttaaaaatcagtgcaaggatttcaagatgttatgagaagtacatgctcatctgatacaatacacacagacacaaagggacaagaaggaaacctaccactgtggatgggattatacccatgttcctgccttttcttagagtctaaagcttcccttgacttgagtgtgtgatttggatggccagaaggtgtagggagaaaggaaccacatatggaagatg

SEQ ID NO: 107734 - DNA, 601 bp, Human
tgcaattgaaacttttctgagacaagccaaacaaccattcacaaaggagtgattctttgtttaaaaaaaaaaaaaatctctctttaatatgacctgaaaaataacttccagccaaatcaaaactctttcgtagatatgtactacgttgtgctgaactttcttgggaaacttggaaaaagtagaaaagagtctttgcacatgaggaagtcaactgtgtataaagaaagcaataaaataataatagaaagaatatcaactgtaaagctgtaggtttttttttttaaagaagagagaaaaagagaaagaaacctgaattcaaaatttccagcaagctacatacaagctgtatgatcttaggcaaagtatataagctgttgaaaagcttatttcctggacacaatcaggaccataatatccgacacgctggactgcaataaggattaacaataaaaatatgcaaaagacctagaggtgtgctaggtattctatataagtaatagatacctttacatagaaatcccttgcctgatgtgtagcctggcatccgttacatagttattctccccctactttactatgtgcatttgatttttaaaaggaa

SEQ ID NO: 107735 - DNA, 601 bp, Human
ttgcaattgaaacttttctgagacaagccaaacaaccattcacaaaggagtgattctttgtttaaaaaaaaaaaaaatctctctttaatatgacctgaaaaataacttccagccaaatcaaaactctttcgtagatatgtactacgttgtgctgaactttcttgggaaacttggaaaaagtagaaaagagtctttgcacatgaggaagtcaactgtgtataaagaaagcaataaaataataatagaaagaatatcaactgtaaagctgtaggtttttttttttaaagaagagagaaaaagaaaaagaaacctgaattcaaaatttccagcaagctacatacaagctgtatgatcttaggcaaagtatataagctgttgaaaagcttatttcctggacacaatcaggaccataatatccgacacgctggactgcaataaggattaacaataaaaatatgcaaaagacctagaggtgtgctaggtattctatataagtaatagatacctttacatagaaatcccttgcctgatgtgtagcctggcatccgttacatagttattctccccctactttactatgtgcatttgatttttaaaagga

SEQ ID NO: 107736 - DNA, 601 bp, Human
ttatttcaggaaaggaagaggaatacttagcttcaagagatctttagctggtaaaacttttaagacttgcaattgaaacttttctgagacaagccaaacaaccattcacaaaggagtgattctttgtttaaaaaaaaaaaaaatctctctttaatatgacctgaaaaataacttccagccaaatcaaaactctttcgtagatatgtactacgttgtgctgaactttcttgggaaacttggaaaaagtagaaaagagtctttgcacatgaggaagtcaactgtgtataaagaaagcaataamataataatagaaagaatatcaactgtaaagctgtaggtttttttttttaaagaagagagaaaaagaaaaagaaacctgaattcaaaatttccagcaagctacatacaagctgtatgatcttaggcaaagtatataagctgttgaaaagcttatttcctggacacaatcaggaccataatatccgacacgctggactgcaataaggattaacaataaaaatatgcaaaagacctagaggtgtgctaggtattctatataagtaatagatacctttacatagaaatcccttgcctgatgtgt

SEQ ID NO: 107737 - DNA, 601 bp, Human
ataacatgaaacaagggaggatggctaatatagtgaatgactctaccaaattccaaaactacacaaataggaagaaaataacaggttaaatccaacatggtaaattcaaaatataaaaggtgctacatgcttagggccaaagaaaaccaactcaagtacatgatgtgggaaaatgtgatgtaaaagaaaacaaattagaattttagttgagttcaagtttagtaggaatcaatactatgtcattgttaacaaaacactcattttcacctaggctacattataaaagggttcagaatgaggygaatgtagccatctttgcttctgtgccagtcaaatcagtgataaattagattgagtcataagaggaactgctacaggaattgcataggactatacagagaggaggggggacgcaggtgatgtgctagccattttcaagcacagaaagacctgacatgtggaagggatgttgtatttctgtgcagctcaacaagcaacagaagtaaggctgcttgctggaagtgagagggaagtctacatataggataaccaaacaaaaaagacctaataattagagctatgaaaaataagaaaggcctac

SEQ ID NO: 107738 - DNA, 601 bp, Human
gtttaataaagaatacttaatggaagaagcagataatatgatacctaattttcttcattctaaataaaacaccactgaatacagtgtattaatagactgcttacagattccaaatttacaagggcttagaaatagaacaaaacaaaaaccaaccaaaagcatgtaaccaaagtgtagtaatgttattatccatcttttattgaatatcaagtagactacttagaagaaaactgttttacatcccacacactaaagaagtgttattcaaaggattaactgaaaaagcaattcatataaaatwgtggctgtgttctgcatcttattttggatttcatcactgtcaaatattgacaaagtcatttcaatattccaaatctcaagatttcaatttgcaaaactgatcttcaatgattaatagttggtaatggaagtaataaatgaatgtacatgctgttttcataagtgaaatgtaatttacttacagtgaaatgcactgatcataaatgaaaggtttgagcagttctcataaaggcatataccatacgaaccacatgcaaaccagttactgaaaatttccatcaccctagaaagctctcttgtg

SEQ ID NO: 107739 - DNA, 601 bp, Human
taattatgttccattatagtggtcaccaccttactaatgaatatgtggtttcatcatataattatagttcataatgtcttataatacggcatgatcgaaacacaatattgactctaaatggagatgtccttcagaagagtgtttaataaagaatacttaatggaagaagcagataatatgatacctaattttcttcattctaaataaaacaccactgaatacagtgtattaatagactgcttacagattccaaatttacaagggcttagaaatagaacaaaacaaaaaccaaccaaaagcrtgtaaccaaagtgtagtaatgttattatccatcttttattgaatatcaagtagactacttagaagaaaactgttttacatcccacacactaaagaagtgttattcaaaggattaactgaaaaagcaattcatataaaatagtggctgtgttctgcatcttattttggatttcatcactgtcaaatattgacaaagtcatttcaatattccaaatctcaagatttcaatttgcaaaactgatcttcaatgattaatagttggtaatggaagtaataaatgaatgtacatgctgttttcata

SEQ ID NO: 107740 - DNA, 601 bp, Human
ttgctttgttctttgattgttccagtgagccaagctcctactgcccatttcaggaaagtgaaaagcaataaggaattaaccaacctaacactacagctgtgctgaccataatttaattttgccctattcagaaataattttactgtggtgatcacactattgggttcaacaaccactagcagctacatgaatttatagcaggtgtaagagatttaacagaatattgattgaaatttacttaagtctgctggtatttattttatttaaagttatatttattctctctttttattagaaatgsttttctcttatgaacacataagaaaatgataatttgaattttcttgttgtttagatatcagacatttctgaaacattctcagcatttataagagataacagacacatttgattctaagagttttgtgaataattgttcacagtcatttaattgttctatgactactaaaatcagctcaatgttttatcataatagaggccaaaaatggataatccaaaaactattattttccctgaaacatatttttaatagttggatttgaataaatgcatctgctgttataataactcatctgaaacc

SEQ ID NO: 107741 - DNA, 601 bp, Human
tccccctgcttgctacatggactgcagggaggcacatctggttgttggcaatgattttgagccatcgatatttaaccactacctttatctgagacttgattcaagtatgtatacgtgtttgcctccaagagatgctttctcactactaatacagaacaggctcctttgttattcttacccctgattcacacacaaatccttggcacccacagtgtctgcatcttatttagatttgcatggaaaacaatcctttaatccaaatgattactacacagaaagttagcccagacaattctttccyccaaatatagatcctgtcaccaaggaattaaaatccagaggccagatccatagtaatttgtaacacatgtcgtcaatgaaatgggagggttcactcagtcataccacattctcagatgcctgtggcacgtggtcgccacaaacctcacttgacatttccatgtatggccagctcagaggcctcaaattaaaaatgctacattttctggatttgcttggtggtgatgagaagtgctaaaattgtgaaccattacagcttgaaaaacatgaagtcagacactgcataaatcacagccatgca

SEQ ID NO: 107742 - DNA, 601 bp, Human
acctcaaagcaccccacaattgttagatatgatcattagtatatttaatgggaatggacaaatgtgattcatatgttaaatagcgtctgtgtgatattttttaccaggtttgtcattaacttaaaaaaataaaattatattgatagcatttcagaatatttacacagtgatttggaacaaaaagggtaagaagttaaatcaataagcaaaattacatctttgtcacctagcttctgttaggcaacacacctgcaaaatctcaatgatcttcagcttggtgtccatcacagtcacatcctcrtgctcggtggggctcccttgcttgctcgggtggatgctgggtggcacatccggcacgctcatggggaagatggagcctctactgagtaccatctgggtcatcatctctcccaccccatgaatggttctcatcacattgtttcctggcatgagaaaatgccgtaagtcaacacacacaacccctggagatcatgtaactataaaactcagttagtcacaaccacactgaaaagcagccaggaaaaggattcaggataagacagaatagcataagcattgtttgggctctttctttacagat

SEQ ID NO: 107743 - DNA, 601 bp, Human
gggtgtttaaaatcctattttttaaagtaaaggataaatcataaacaaatgaaactaactttcagttgacaatgtttacatgcagcattgtattccataaatacaatcaaaattaaaactttcatttctctaatacgcctaatcaggaaaaacaagtggaaagtagaaagaaaggaggaaagggaaggataaaaacaaaggcagagaaaaagaattaagagagggccaggaagagagagagagaatgagagagaaatgaaaagagagaggctgagagagatacacaaagtgatgggggggwaaaaaaaaaagaagacccagggggaagagaggagctggcacaaggcacaggaccttgaagtccttgtagcaccaaggagtagggctacaaagaaattcctgaagagccattccaagaaagacacattcagaaacagtactcagacacatacgcacggtggagccggcccagacacagggatagaaaatcagagtgaatagcggttcaaggagacgctgcagaaatgaatcagccccggactgctgagccgtagaagctccatctcatccttttttagctgttggagattgtttttctaat

SEQ ID NO: 107744 - DNA, 601 bp, Human
tacattttaagatatcctctctcaggggcagtggctcatggctgtaatcccagcactttgggaggctgagacaaagggatcgcttgacctcacgaattcaagaccagcctgggcaacatggcgaagtcccatctctacaaaaacacaacaaattagccaggcatggtggtgcgtgcctgtaatcccagctaccatggatgctgaggtgggagaacatttgaacccacgacctcaaggctgcagtgagccaagactgtgccactgcatttctgcctgggtgacacagcaagaccctgtctcaaaaaaaaaaaaaatcctccaagttccagtttaaattcttttttaacgcagctttcactggttccccagtcacaatctgaatcaatctccctcctttcctccctccctccctttctctgtcctcgtctgtctcagtctctctctttctctttctctttttctctctctctctctctcctcccccgacccacccagcctttgctagacttttatgctttttatggacacatcctccatgtcagctgtactcagctggttaattcaccagacatgcgttaaacaaggcattgaggaaggcact

SEQ ID NO: 107745 - DNA, 601 bp, Human
cattttactgaacattttacagagtgccattgtctctgggaggagactgttggaggtgtgaccctcattcttacacagtagggcaataattcagctacaatagtatgactgtgactataccatgatcagtcctaaagccaggttctaaaaggacagtttaagtaacagcatctatacaccatggattttcctcactggtgtttgtgtttccttgagtttgggttgctgtcattgttctcattcatggatgcacggacagaaactaagtacctagcaaggctccagactgtgctaggtgccmcagggaatgcaaacacgtgaagcctactgccctcaaaaagccaatagtcgagttgggaaaaaaatatagcactgttagcataattaggaaactattgagagctaaatcatgtggtctaaatacaacagaaatcaaagaagaaaaagctgggatgtgctgcagatcaaaggagaggtttttacataggtaccatctgtccctgtctgcctgagagaggccctgtttaaccttttgtttcagcataattattaatggtgcccctacattctcaaaagtgtcgtatttggacagtaaacaatg

SEQ ID NO: 107746 - DNA, 601 bp, Human
tccttcttatatattgacagcatatatgagatcctataatccagtctgacactcaggataaactataagaaacattaagaacaacataaatttctttcattagcatagtatttaaaaatgcaattcacaacacaccaataacagtggaagtaccaacctttcaaaggaactagttagaagcttttaacaccagttgccacatgtttgtcagcaatgactaagcaagggaattcatttctactagctaatgtcagtaaaatcccaaagcaatttttggaaagaacatttgactccctatgaytgctctctgaatattccagctagaggcatcgtgggggtctggatgaagaggtaatgatgacgtcattttactgaacattttacagagtgccattgtctctgggaggagactgttggaggtgtgaccctcattcttacacagtagggcaataattcagctacaatagtatgactgtgactataccatgatcagtcctaaagccaggttctaaaaggacagtttaagtaacagcatctatacaccatggattttcctcactggtgtttgtgtttccttgagtttgggttgctgtcattgttc

SEQ ID NO: 107747 - DNA, 601 bp, Human
cgaccttccaggctcaagcaatcctcctgcctcagcctcctgagtagctgggaccaaaggcacgcgcctccactactggctaatttttttgtatttttttgtagagacagggtttcgccatgttgcccagtctggtctcaaactcctgggctcaaccaatccgcccccttcggcctcccaaagtgttgggattacaggcgtgagccaccatacctggccaaggtaacatgtttaaatgataaaatacaccacttatttctcatctccaaagcgtaaaaagaaacacagtaagatataaaartggaaaaataattctccccagaaaggtatcccttactggtacaaaaaaaggaaagagatcaggtagagagaaagggttttctggggtgcccctagactttccctctggtactttactgacacttaaaactcatgtttccagaagccaggcctctgggagtcaataatttttatgctactgtcaatgcaaccgccagcaagacttcctggttctgccatatcattcctggaaatagccctttggggttctacacttctgagaagcagaaaaacaacaccattgcaaaggtgccagaagaga

SEQ ID NO: 107748 - DNA, 601 bp, Human
gtggcacaacttcaactcactgcagcgtcgaccttccaggctcaagcaatcctcctgcctcagcctcctgagtagctgggaccaaaggcacgcgcctccactactggctaatttttttgtatttttttgtagagacagggtttcgccatgttgcccagtctggtctcaaactcctgggctcaaccaatccgcccccttcggcctcccaaagtgttgggattacaggcgtgagccaccatacctggccaaggtaacatgtttaaatgataaaatacaccacttatttctcatctccaaagcrtaaaaagaaacacagtaagatataaaagtggaaaaataattctccccagaaaggtatcccttactggtacaaaaaaaggaaagagatcaggtagagagaaagggttttctggggtgcccctagactttccctctggtactttactgacacttaaaactcatgtttccagaagccaggcctctgggagtcaataatttttatgctactgtcaatgcaaccgccagcaagacttcctggttctgccatatcattcctggaaatagccctttggggttctacacttctgagaagcagaaaaac

SEQ ID NO: 107749 - DNA, 601 bp, Human
aaatgggaggataattctttaaagaatcaaaatatacatacaattagccttgttattatatggttatttccaaacaccatggtctttttacctaagcttactattactaaaattccgtccctttttcttgtgggaaagggcatttttttttctatgtgaaccaatcatgattccttactgtcccacaccactaacattttgaagataactttactaagataacatggggctttttgtgtgtttgtttgttattgaaacagggtcttgttctgttgcccaggctggagtgcagtggcacaasttcaactcactgcagcgtcgaccttccaggctcaagcaatcctcctgcctcagcctcctgagtagctgggaccaaaggcacgcgcctccactactggctaatttttttgtatttttttgtagagacagggtttcgccatgttgcccagtctggtctcaaactcctgggctcaaccaatccgcccccttcggcctcccaaagtgttgggattacaggcgtgagccaccatacctggccaaggtaacatgtttaaatgataaaatacaccacttatttctcatctccaaagcgtaaaaagaa

SEQ ID NO: 107750 - DNA, 601 bp, Human
tcctgtcatctgcaacaacatggatggaactggaggtcattatgttaaatgaaattagccaggcacagaaagacaaacttctcatgttctcactcatttgtggaagctaaaaattaaaacaattgaactcatggcgatagacagtagaataagagttaccagaggctgggaaaggtagtggggtgggcggagtggggatgattaatggttacaaaaatatagtatgacagaatgagtaagatctagtatacagagtgactatagtcaataataatttgttgtacattttttaataactaartgactataattggattatttgtaacacaaaagataaatgcttgaggtgatgcatacctcatttatcctgatatgattattacacattgtatacctgcatcaaaatactccatataccccacaaatatatacatcaactatgtacccacaaaaattaaaaattaaaaaaatttaagtcaattaacagtttgaaaaaaatcacaatatagttccactaagacatcaatgtaattttttaatgtaaactatgttttaaactaatgtattgctgtaatcaaaaatatgtctaaaagatcagaaa

SEQ ID NO: 107751 - DNA, 601 bp, Human
acaaactagtactataatataaaaactaaactaaatgttcactagagataaaaatcctctttttgtgcccctaattcttgattcttgtttgtctttccaatgacaacaacaaaaactgcaataagatgcttagtgtagtcgtccccactaccctacccaactctatctgtggttttactttttgtggtttcagttgcccatggtcaaccatggtcctaaaatatgaaatggaaaacttcagaaataaataattcacgagttctaaattttgtgtcatcctgcctgtcccatttgggacatraatcatccctttgccagcatctccacgctgtacgtgttcccccatcattagtcacttagtagccgtatcagtcatcaggtgactgctgcagggtcacagagcttgttcaggtaacccttactttacttaataatggccccaaagtgcaagagtggtgatgctggcatattgttataattgttttattattagttatgttgttaatctcttagtatgcctaatttatatattaaattttatcatacgcatgtatatataggaaaaaacacagtgtatacagggtttggtactagctgtggt

SEQ ID NO: 107752 - DNA, 601 bp, Human
agacaggcatttacaaaactttttgtattaacaattatgatgttggtactagtgtgctttatctaagcatgactactaaagcagtatttaacattttttaagtggttataggtacttagtgaaatgtgaaaacagcaactaattaacacactaaaaaagccaatacaacagaagatgacagtcactctttagatttttggtattttcatactggcaataaagcatattggtcttccatttagatacttttatatattatataaggatatgcataatgataggaatgaattactgcttggcaaaaaaatggccacagcaaaagggtccacaaaaattcacctctccctacaggtctcagtttagggtccactccttttttctccttccactccttcctattttcttgattgctgaattatagaatttaccgtggaaatgacaaagagtgaaacactagatagatgaggtaagaagtggtagaaattgataagagctaaacaaagtgccagtttacggagttaattgacaacttagcaaatgaaaattttgtgctctgttgctcagaacagaatttttctttatgaacaattttgattgtaga

SEQ ID NO: 107753 - DNA, 601 bp, Human
agggtttcctcatttaatctttacagcaattccaggagctaagtaccatgatgatgtccatttgatagtcaataaaaataaaacttagagaatgaaaataagttgctcgaagtcacacatataccaagtggcaaattctggggtgtctgattccaaaacccatgctaataacctacacattgtccttcctatgatgcactttattacctggcattcagcaagcattcccacccctcacggtccctctgtatcacagagctggtttctcaaattcccctatagctgaagttctaaattcaattcaacttctgccaatgagataaactcatgtggaacttaaaagccaaaagggaaataaagggcatctacttgtggctgcgagggccgcaaaggaaatcccagtagacgtcagtgtgcaatgaagcccacgttccagtattttgtcccaaacttccaaagcatttcagaagcattttgattaattatctcttgctctgttttcacgtttcacttcacaatattttgggtactccaacaaataacaaaagctaaggcaggtaaacccatcaaaacggcttatatgcctgcagattaaaaaaca

SEQ ID NO: 107754 - DNA, 601 bp, Human
cagggtggtgtatcctagcttgggcgacatcttttacttaatctaaactaatcctgtactccactggtgtagagttttaacatctggccctgttctggccaaagagacatgaaataaggtgagggatgtctaggaaaggtttccttgcccctaaacaggagacccagaaatagatactccttcttgatgttgtcgtgcacagatgtgatatctagaatgctactgccatgatgccgtcaggagaaagactggtttcaaaactaagccagctgatccatgatgacaacactgaggcaaggawttaaagctggagtcttacttcttgacttgttggtaagtaatatgtcattttattgtatatattttcatgttgttcatattttcccactgaagccatattaactgacacacttaccacgtgcatagggtttcctcatttaatctttacagcaattccaggagctaagtaccatgatgatgtccatttgatagtcaataaaaataaaacttagagaatgaaaataagttgctcgaagtcacacatataccaagtggcaaattctggggtgtctgattccaaaacccatgctaataacctaca

SEQ ID NO: 107755 - DNA, 601 bp, Human
tatcacatagggaactggaggtgattatccctacaattatcttgtaactctaaaatttcataattccatatccaccatagtaaacaacacagtgtgttacacataaaaacaataattacaacaaacactgactgaatgctaatgttgaaaaacactgttggttgctaaccaacattctttcttattcttccctgctagaagaatccagttttgttcggccatctatcgttctcccaggtaattcagggtggtgtatcctagcttgggcgacatcttttacttaatctaaactaatcctgtrctccactggtgtagagttttaacatctggccctgttctggccaaagagacatgaaataaggtgagggatgtctaggaaaggtttccttgcccctaaacaggagacccagaaatagatactccttcttgatgttgtcgtgcacagatgtgatatctagaatgctactgccatgatgccgtcaggagaaagactggtttcaaaactaagccagctgatccatgatgacaacactgaggcaaggaattaaagctggagtcttacttcttgacttgttggtaagtaatatgtcattttattgta

SEQ ID NO: 107756 - DNA, 601 bp, Human
ctcaggtggtactgaatttccagctacagaagtttgctttgtttaaagaaataatgtcactcaggtgagatatttagagatagagaacacatatatcacatagggaactggaggtgattatccctacaattatcttgtaactctaaaatttcataattccatatccaccatagtaaacaacacagtgtgttacacataaaaacaataattacaacaaacactgactgaatgctaatgttgaaaaacactgttggttgctaaccaacattctttcttattcttccctgctagaagaatccarttttgttcggccatctatcgttctcccaggtaattcagggtggtgtatcctagcttgggcgacatcttttacttaatctaaactaatcctgtactccactggtgtagagttttaacatctggccctgttctggccaaagagacatgaaataaggtgagggatgtctaggaaaggtttccttgcccctaaacaggagacccagaaatagatactccttcttgatgttgtcgtgcacagatgtgatatctagaatgctactgccatgatgccgtcaggagaaagactggtttcaaaactaag

SEQ ID NO: 107757 - DNA, 601 bp, Human
agacagggatgcccattattaccacttctattttaccttgtacttgaaaatactacaaacacagtaaagcaagaaaaaaaagaaataaaatatcatgttcaagtttgaacttatagcattacctgacttgaagtgaatgaatatttttaaccttattagtaagtacacatgaatcggtaggacttaactatttgcctgtgtagaatttagctttatctaaactggaataggaagtaaaatggcaaataaacattaaaaaactcaacctcataactaattcagcaaaatgaaaatcacagcrgagataatatatcaagtgtactcaatcatcaaaagtgggaaagtgagaaaaacacccatcataaggatagggagctagaagaacactcatacactagtggagggaaaacaactggcattgtctggtagaggggaacatactgcatgtgttactcctatgtagatatcccaaaaaatctcccaaacatgtgcaccaggtgacatacaacagctttcacagcagcactgcttgtagtagcaaattttcttttaaaacaccaaaaccgggaagagcccaaatgtccatccacagctaactgga

SEQ ID NO: 107758 - DNA, 601 bp, Human
ttataaccattaaaaaattgaatcagtagtcaaagtctttccccaatgtaaatatcatgtccagacagttttgcagacaggttttaccaaacatttatgaacagatccttctaatgttacacaaagaaaaaggaatattctatagctcattttatgggactagtgtaacctcaatactactgcttgataggaacagtgaaagaaagaaagaaaagaaaagaggaaagaaaagaagaaaaggaaagaaaaaagaaaagaaaggagggacggagggagggaaggaaggagggaaggaaggagrgaaggaaggagagaaggaaggagggaaggaggaagggagggagggagggaaggaaggacagaaggagggagggagggaaggaaggagggaaggaaagaggaaaggaaggagggaaggaaggaaggaaggaaaaattacaggctaatttcactggcaacagagatgtaaaattctacagaaagtattagtaaacagaatctagcaatgtaaaaacaaatcaccaagatattttaaatctagaatgcaaagttactacggtagaagttctatttaagatttatgtcatttaggtgaacagat

SEQ ID NO: 107759 - DNA, 601 bp, Human
agtcagaagttataaacaaattttcaactgtgcgggagggtagcacccctgaccatcccccaaacactgttcaagggtaaactgtacataaaactctggaaagattgagctggatagagctagagaaaagaagagagccatagcaaaacatacaaagaatgaaaaagggatacaaagctatgaatacagcagaaatttaaaagatagcaaaagaatatgaacaaatttatgccaataaattcgaagatttcaatatatggctagaaaaatgcacaacaaattaactcaaaatggaaaattkgaatgaatttataaccattaaaaaattgaatcagtagtcaaagtctttccccaatgtaaatatcatgtccagacagttttgcagacaggttttaccaaacatttatgaacagatccttctaatgttacacaaagaaaaaggaatattctatagctcattttatgggactagtgtaacctcaatactactgcttgataggaacagtgaaagaaagaaagaaaagaaaagaggaaagaaaagaagaaaaggaaagaaaaaagaaaagaaaggagggacggagggagggaaggaaggagggaa

SEQ ID NO: 107760 - DNA, 601 bp, Human
ctacataattcacacaacacagaaaatatatgttaattgactgtctgtgttatcagtaaggcttccagtcaacagtaggctattagtacttaagttttgagggagtcagaagttataaacaaattttcaactgtgcgggagggtagcacccctgaccatcccccaaacactgttcaagggtaaactgtacataaaactctggaaagattgagctggatagagctagagaaaagaagagagccatagcaaaacatacaaagaatgaaaaagggatacaaagctatgaatacagcagaaattyaaaagatagcaaaagaatatgaacaaatttatgccaataaattcgaagatttcaatatatggctagaaaaatgcacaacaaattaactcaaaatggaaaatttgaatgaatttataaccattaaaaaattgaatcagtagtcaaagtctttccccaatgtaaatatcatgtccagacagttttgcagacaggttttaccaaacatttatgaacagatccttctaatgttacacaaagaaaaaggaatattctatagctcattttatgggactagtgtaacctcaatactactgcttgata

SEQ ID NO: 107761 - DNA, 601 bp, Human
agagtatagtaggataagtataataaaatagcaaacaaatccagaatctcaacaaacccaaaacagactatatttaagagatgagtaaaattcaggtgaccttgaacaacatgaatttgaactgtgcaggtccacttatacacagattttcttttacctctgccccccttcagacagcaagaccaaccctccctcttcctcctcctcctgaatctactcaacatgaagatgatgaggatgaagacctttatgatgatccaattccatttaatagagagtaaatatattttcttttccttaygattttcttaacattttcttttctctagcttattttattgtaaaaatacactacataattcacacaacacagaaaatatatgttaattgactgtctgtgttatcagtaaggcttccagtcaacagtaggctattagtacttaagttttgagggagtcagaagttataaacaaattttcaactgtgcgggagggtagcacccctgaccatcccccaaacactgttcaagggtaaactgtacataaaactctggaaagattgagctggatagagctagagaaaagaagagagccatagcaaa

SEQ ID NO: 107762 - DNA, 601 bp, Human
actacaggcacccaccaccacacccagctaattttttgtatttttagtagagatggggtttcactgtgttagccaggatggtctcgatctcctgaccttgtgatccacccacctcagcctcccaaagtgcagggattacaggcatgagccaccgtgcccggccgcatgtggaaatttaaaaactcacttccaagtaattctaagagaaagaactcacaatggaaaaatttttagtatctaatattgaaaaataataaaaatatcatttgtcaaaactcagggaatgcagctcctttgaagraaattataccaccaattttttttaaatcgaaaagtctgtcaacataaaacgatagagtatagtaggataagtataataaaatagcaaacaaatccagaatctcaacaaacccaaaacagactatatttaagagatgagtaaaattcaggtgaccttgaacaacatgaatttgaactgtgcaggtccacttatacacagattttcttttacctctgccccccttcagacagcaagaccaaccctccctcttcctcctcctcctgaatctactcaacatgaagatgatgaggatgaagacct

SEQ ID NO: 107763 - DNA, 601 bp, Human
aaaatgtcaacaaatctctctcacttattgatatgtcaagaaaataaaaatattattaaatatagtatttaaacagaattaataagcttgatttgccagtcatctattaagaatcctacacccattcacattcttctcaagccacaatggacaattacaaaacctggatgtacaataggtcaaaaagcaaacctcaatgaattttggagaaatgatatcataataactaaattatctggtcacaagttaattaagaattcaattaacaaaaaaggtaaattttgcctatgcatgtggaaatttatttatttatttttattttattttattttattttatttgagacagagtctcactctgttgcccaagctggagtgcagtggtgcaatctcggctcactgcaagctccgcctcccgggttcacgccattctcctgcctcagcctcccgagtagctgggactacaggcacccaccaccacacccagctaattttttgtatttttagtagagatggggtttcactgtgttagccaggatggtctcgatctcctgaccttgtgatccacccacctcagcctcccaaagtgcagggattacagg

SEQ ID NO: 107764 - DNA, 601 bp, Human
tcaacagcagcaatggaagccagaagacatgggataaaataatcagaagtgaggggaaataattcacagttaataaattcttttgttctgcagtaaaaatataataatttcaaatttacaggcatctaatgacatagtctcaaaacacatggagtaaaaactaatagaaatgcaaggggaaattgataaacataccattgtagtggaaaatgtcaacaaatctctctcacttattgatatgtcaagaaaataaaaatattattaaatatagtatttaaacagaattaataagcttgatttsccagtcatctattaagaatcctacacccattcacattcttctcaagccacaatggacaattacaaaacctggatgtacaataggtcaaaaagcaaacctcaatgaattttggagaaatgatatcataataactaaattatctggtcacaagttaattaagaattcaattaacaaaaaaggtaaattttgcctatgcatgtggaaatttatttatttatttttattttattttattttattttatttgagacagagtctcactctgttgcccaagctggagtgcagtggtgcaatctcggc

SEQ ID NO: 107765 - DNA, 601 bp, Human
ggaaatgaacagatatgtactatatagtaatatattcactaataaagtttaacatgaacttaattggagtttcaaagttaaagtaccactatttaacagagcaaacttctcaacagcagcaatggaagccagaagacatgggataaaataatcagaagtgaggggaaataattcacagttaataaattcttttgttctgcagtaaaaatataataatttcaaatttacaggcatctaatgacatagtctcaaaacacatggagtaaaaactaatagaaatgcaaggggaaattgataaacrtaccattgtagtggaaaatgtcaacaaatctctctcacttattgatatgtcaagaaaataaaaatattattaaatatagtatttaaacagaattaataagcttgatttgccagtcatctattaagaatcctacacccattcacattcttctcaagccacaatggacaattacaaaacctggatgtacaataggtcaaaaagcaaacctcaatgaattttggagaaatgatatcataataactaaattatctggtcacaagttaattaagaattcaattaacaaaaaaggtaaattttgcc

SEQ ID NO: 107766 - DNA, 601 bp, Human
tagactcattgttggctctgacggcatcagtccatacctaataagctggattctgagttttgctatatcatacacagacacacacacacacacacacacacacggcaaaaaggaaacaaaatccagatcccatgcaagatggaaggtctgatcagagaccctggcatagagtcaggaatacctaagggtgatacccacaatgataaaccagggaaagacatggcccacagaagagcaaaagggcacctatcttggccttggtgctcatcaaaagcaaaagaggggaaaaaattctcttgargctcccatatacaagacaagctcactttcactcaagactggggaccagaatgtccaatctaaaggggtcccaaaagacccaagccaaaaggtatgttcaatatggttacagaatgtagtgtcccacagtgcttcacagaggcaaataaaatctcaataaggccttaactacagacctcagagaaattccacatacaaagttccaaagcatgtgggttcatgacaataaaaaatcacggaacacctgaagtaaatacaacccaaagactttggcaagaatggccaacttaaaactgcaaag

SEQ ID NO: 107767 - DNA, 601 bp, Human
aaggagaaattcaagtgtgcacaaaggcaagttagcatgaaaacaacgggactgaaatgtacactttacacagcatttgaaagaaagattttactctggagaaacatgacagttcattaagtgtgaccattcatgttgccccaaacccagcataggtttgaacaggtattattgagacaaatacacaggctcaaaacaaagagctgtctcttgttaagaatggtcaaacagaaaatgacaaagtgcagagaaatccctcctgtataaaatctaaaaatgattgataaaatatttaaaacayctctttatagtagcaaggccagaaaccctgaaaatacataaaattttcagagcaataatcaagcactagactcattgttggctctgacggcatcagtccatacctaataagctggattctgagttttgctatatcatacacagacacacacacacacacacacacacacggcaaaaaggaaacaaaatccagatcccatgcaagatggaaggtctgatcagagaccctggcatagagtcaggaatacctaagggtgatacccacaatgataaaccagggaaagacatggcccacagaaga

SEQ ID NO: 107768 - DNA, 601 bp, Human
tacttctcttattattcttgaatacatgctaactcctcccagtccttcagaataggcctatgcgcagaatctggagtgaggccttctttcagtcatcaggcccacgctggcctctcctttttctgtactacatagttcagtatttaatcaactactttgtcaccctattttttgggtgttcatgaagtgtgttcgttcgttgagggcaagtagaatatgagatttgagtccagatatctaactttaagaacggaaaggagaaattcaagtgtgcacaaaggcaagttagcatgaaaacaaygggactgaaatgtacactttacacagcatttgaaagaaagattttactctggagaaacatgacagttcattaagtgtgaccattcatgttgccccaaacccagcataggtttgaacaggtattattgagacaaatacacaggctcaaaacaaagagctgtctcttgttaagaatggtcaaacagaaaatgacaaagtgcagagaaatccctcctgtataaaatctaaaaatgattgataaaatatttaaaacatctctttatagtagcaaggccagaaaccctgaaaatacataaaattt

SEQ ID NO: 107769 - DNA, 601 bp, Human
gtcagactaaattttccaaaatagtatgctcacctctctacccaagaatcttcacaggctcccagtttccagtcattgcaaatacaaatcgcttattcttgaactttacttctcttattattcttgaatacatgctaactcctcccagtccttcagaataggcctatgcgcagaatctggagtgaggccttctttcagtcatcaggcccacgctggcctctcctttttctgtactacatagttcagtatttaatcaactactttgtcaccctattttttgggtgttcatgaagtgtgttcrttcgttgagggcaagtagaatatgagatttgagtccagatatctaactttaagaacggaaaggagaaattcaagtgtgcacaaaggcaagttagcatgaaaacaacgggactgaaatgtacactttacacagcatttgaaagaaagattttactctggagaaacatgacagttcattaagtgtgaccattcatgttgccccaaacccagcataggtttgaacaggtattattgagacaaatacacaggctcaaaacaaagagctgtctcttgttaagaatggtcaaacagaaaatgacaa

SEQ ID NO: 107770 - DNA, 601 bp, Human
agctgttttagaacaatgctgatggtgctgtgtttacagcctttgtaagatttactaaacaacaaaggagtattgttcgtattggcctgctagtgtgtgtgctgcctgctactggctgtttccattgatactgtgatatatttcatcctgtttacaatacattgccactatctttggctgctgggttattgcataatacagattatttggctgtatataaattagtaacttcacagtttctcatttttgttccccttatattaattcattatataggtaccattctcccagcttcccaatmcacccatttgcatacatttctactgctacctcactagtccatgctttcagaagctcacacctgaattcgtacaacagcctcttaacgggtgtcccaacccagcctcttgctcttctgaagcattccggattctgtcagactaaattttccaaaatagtatgctcacctctctacccaagaatcttcacaggctcccagtttccagtcattgcaaatacaaatcgcttattcttgaactttacttctcttattattcttgaatacatgctaactcctcccagtccttcagaataggcctat

SEQ ID NO: 107771 - DNA, 601 bp, Human
ccgtctcaataaagggacacacaaactgttccggcaccaggcagtgcctgttgtttacaggaatctttcgaacactagcccatggcccatagaaattggactgtctctgctgaggggaagaagccacgggtcctatgagaagccaaaatcagtacacagccccttggaagaaagggactcctcatctgcaaaaacagtcccagccacctcgttgtccagacaacccagagtgagcccctagggacattttttagttaattctgttccttacatcacacatccattaaaagaacaaaaatarttatgaagtaaaaacaggcagatatgaatctagaatagatggatatgaaaaagaaccaattaaataacctgaaaatgaactatatagtccttgaagtaaaaactagatagacagtttaagcatgagactttacatcagtgagagtctaagtcaaatttttaaaaagggccaccgtactccagctgggtgacagagcgagacccatctctaaaaaaaagtaaagaaaaagaagctggcaaccatatataggtgagtagatagatatagagataaatataggtatacacacaaatagagaaa

SEQ ID NO: 107772 - DNA, 601 bp, Human
agggagaactagagaaaaatcagcaaagaaaaggaaagagaaggaagggagggaaggaaggaattaattcataattaataaagtaatataattaataaataaagataaatctgcaaactataattcaaactcctatgaggaacattaatactaaaaatgtcaaccaaaaaactcaataataataatatatcatgtccagtgaaatataatcaatcaagagcttttctgacaggctttgtaagtaggtatgtttaaaataatcatagagatagtgaggaatagcatccctcatgcccagtgrgtacctctgtggttgccatgtgccatgcaatagtgttcaggattatgtcacagcatcgctcagcatggataatgaaggatagccttttcagggaaaggacaggctacaagccaagcaacagcaagagaagagaaggcacaggtgccccctcctcccatctccccgcacaggagtgctgggtgccccgctggatagtatgggtctagatttccaagcaaccactccccgcaacaccacagtaactacctatggggcaagctggagcgtaaccgtctcaataaagggacacacaaactgttc

SEQ ID NO: 107773 - DNA, 601 bp, Human
cagattccataaaaggaaaattcagaaaagcactgtccaaaactaatgaataaaagctctgcatgaaattaccactgtgtctctgattggtcaggtcaagctgcaagattctgtctagaacacatggactgcttctgtcccaggccatcagggttagacattctaccagattctgtcaaaagtcagctaatcgatcacaagtttggctgaagaaacaagtttatgtagaactattttcccactgcacagaatctcataccaacacttggaaaaggagaaccttcttaatatatatccttcyacagggatttgcaactttgcttgcttcatcaaaggaaaaaagatcagaagcggcaggcaaagaatggaatacagtttttgctttcaaaaagtaatgagatgtggaggtaatagaaaaactatcagatagggaaggtgtacctagggagaactagagaaaaatcagcaaagaaaaggaaagagaaggaagggagggaaggaaggaattaattcataattaataaagtaatataattaataaataaagataaatctgcaaactataattcaaactcctatgaggaacattaatactaaaaat

SEQ ID NO: 107774 - DNA, 601 bp, Human
taacttatttatagcatgaagggaaatactaagtttatactcaaacagtatcaatttaaatgtggttagaaaatgagaagggaacaaattctcatagaaaaagataaaataaccaagtaattcaaataacacattctggaagtataattgttacatttaagaatttatattataaccaaataggataagaatgtgtaaaacaagcattttattataaaccaaaagttatttttcacatgtatgtcatgtgaaggggcttatttattgaaactcatctgtcacaatcaccttcagtggaatragctcagacataagtatgggaatatgtataatgatataaacaaataaatatacaatgaggtctgaggcaaaaatagaaactggagacaagaaaacagattccataaaaggaaaattcagaaaagcactgtccaaaactaatgaataaaagctctgcatgaaattaccactgtgtctctgattggtcaggtcaagctgcaagattctgtctagaacacatggactgcttctgtcccaggccatcagggttagacattctaccagattctgtcaaaagtcagctaatcgatcacaagtttgg

SEQ ID NO: 107775 - DNA, 601 bp, Human
tacaaaaaatacaaaaatcagccaggcgtggtggtgcacacatatggtcccagctactcaggaagctaagggaggatcgctggagcctaggaagtggagtctgcagtgagctgtgattgcaccactgcactccagcctgaatgacagagcaagaccctgtctacaacaaaaagaacaaatggaaaagttaaaaaaaaaagatagtaacttatttatagcatgaagggaaatactaagtttatactcaaacagtatcaatttaaatgtggttagaaaatgagaagggaacaaattctcataraaaaagataaaataaccaagtaattcaaataacacattctggaagtataattgttacatttaagaatttatattataaccaaataggataagaatgtgtaaaacaagcattttattataaaccaaaagttatttttcacatgtatgtcatgtgaaggggcttatttattgaaactcatctgtcacaatcaccttcagtggaataagctcagacataagtatgggaatatgtataatgatataaacaaataaatatacaatgaggtctgaggcaaaaatagaaactggagacaagaaaaca

SEQ ID NO: 107776 - DNA, 601 bp, Human
ggcgcaggggctcacacctgtaatcccagcactttgggaggctaaagtaggtgggttgcttgagctcaagagttcaagaccagcctgggccatatggtgaaaccccatgcctacaaaaaatacaaaaatcagccaggcgtggtggtgcacacatatggtcccagctactcaggaagctaagggaggatcgctggagcctaggaagtggagtctgcagtgagctgtgattgcaccactgcactccagcctgaatgacagagcaagaccctgtctacaacaaaaagaacaaatggaaaagttaaaaaaaaaagatagtaacttatttatagcatgaagggaaatactaagtttatactcaaacagtatcaatttaaatgtggttagaaaatgagaagggaacaaattctcatagaaaaagataaaataaccaagtaattcaaataacacattctggaagtataattgttacatttaagaatttatattataaccaaataggataagaatgtgtaaaacaagcattttattataaaccaaaagttatttttcacatgtatgtcatgtgaaggggcttatttattgaaactcatctgtcacaatc

SEQ ID NO: 107777 - DNA, 601 bp, Human
gttagccacttgctgaataaaagaaaccatatgggtacatagaatcttcactaacaacttgtattgaattaagaacaagtggaggacaggcgcaggggctcacacctgtaatcccagcactttgggaggctaaagtaggtgggttgcttgagctcaagagttcaagaccagcctgggccatatggtgaaaccccatgcctacaaaaaatacaaaaatcagccaggcgtggtggtgcacacatatggtcccagctactcaggaagctaagggaggatcgctggagcctaggaagtggagtckgcagtgagctgtgattgcaccactgcactccagcctgaatgacagagcaagaccctgtctacaacaaaaagaacaaatggaaaagttaaaaaaaaaagatagtaacttatttatagcatgaagggaaatactaagtttatactcaaacagtatcaatttaaatgtggttagaaaatgagaagggaacaaattctcatagaaaaagataaaataaccaagtaattcaaataacacattctggaagtataattgttacatttaagaatttatattataaccaaataggataagaatgtgtaa

SEQ ID NO: 107778 - DNA, 601 bp, Human
gtgaggaacccctctgcttggccgccccactcgctgggaagagaggagcgcctctgcctggctgccccacagtctattaattgaggagctcctctgcttggccgccccactgtctgggaagagaggagggcctctgcctggcccgccccacagtctgtgaagtgaggggcccctctgcccggctgctgtgcaacccctccaagtgtgtgaagtggcagccttgtgtgtgatctttctgcgctccccaagtttgcatttttgacactaaagtttacttttaaattaaaaaaaaaaaaaaaagacacatcaggaacctattatcatacagcaatatgtcccagaaattttctgatgtaactccagggatggctaaaaactcaacagtattatgtaaaatgtagaaagcatggggaaccttttggtcaacagaatggcatttggtcaacagaaaagcactgtacaggaagtgaaaacagcaacataatagaacccttagagactgactttgatactgatacattgtatgaaggaagctcccctagtcacaatagggttatagctcacccagacggacatggttgtaagaaggggggtgtatgta

SEQ ID NO: 107779 - DNA, 601 bp, Human
ccccacagtctgtgaagtgaggaacccctctgcttggccgccccactcgctgggaagagaggagcgcctctgcctggctgccccacagtctattaattgaggagctcctctgcttggccgccccactgtctgggaagagaggagggcctctgcctggcccgccccacagtctgtgaagtgaggggcccctctgcccggctgctgtgcaacccctccaagtgtgtgaagtggcagccttgtgtgtgatctttctgcgctccccaagtttgcatttttgacactaaagtttacttttaaattaaaaaaaaaaaaaaaaaacacatcaggaacctattatcatacagcaatatgtcccagaaattttctgatgtaactccagggatggctaaaaactcaacagtattatgtaaaatgtagaaagcatggggaaccttttggtcaacagaatggcatttggtcaacagaaaagcactgtacaggaagtgaaaacagcaacataatagaacccttagagactgactttgatactgatacattgtatgaaggaagctcccctagtcacaatagggttatagctcacccagacggacatggttgtaag

SEQ ID NO: 107780 - DNA, 601 bp, Human
tgcagcatctttgcttagacaggtattaggaaaaactggaaatgtttaatgtaactagtaactgctttcataagaacacatcaggaacctagtgaggagcgcctctccccgggccccccaccgtctgggaagtgaggagcacctctgcccggcagccccactgtctgtgaagtgaggtgcgcctctgcctggccgccccacagtctgtgaagtgaggaacccctctgcttggccgccccactcgctgggaagagaggagcgcctctgcctggctgccccacagtctattaattgaggagcycctctgcttggccgccccactgtctgggaagagaggagggcctctgcctggcccgccccacagtctgtgaagtgaggggcccctctgcccggctgctgtgcaacccctccaagtgtgtgaagtggcagccttgtgtgtgatctttctgcgctccccaagtttgcatttttgacactaaagtttacttttaaattaaaaaaaaaaaaaaaaaacacatcaggaacctattatcatacagcaatatgtcccagaaattttctgatgtaactccagggatggctaaaaactcaacagtattat

SEQ ID NO: 107781 - DNA, 601 bp, Human
gtgccactggggtgcagcatctttgcttagacaggtattaggaaaaactggaaatgtttaatgtaactagtaactgctttcataagaacacatcaggaacctagtgaggagcgcctctccccgggccccccaccgtctgggaagtgaggagcacctctgcccggcagccccactgtctgtgaagtgaggtgcgcctctgcctggccgccccacagtctgtgaagtgaggaacccctctgcttggccgccccactcgctgggaagagaggagcgcctctgcctggctgccccacagtctatkaattgaggagctcctctgcttggccgccccactgtctgggaagagaggagggcctctgcctggcccgccccacagtctgtgaagtgaggggcccctctgcccggctgctgtgcaacccctccaagtgtgtgaagtggcagccttgtgtgtgatctttctgcgctccccaagtttgcatttttgacactaaagtttacttttaaattaaaaaaaaaaaaaaaaaacacatcaggaacctattatcatacagcaatatgtcccagaaattttctgatgtaactccagggatggctaaaaact

SEQ ID NO: 107782 - DNA, 601 bp, Human
aggttcaaaaacaagagaccaagaatagtctagaaattgggtggcatcagggttctaggcagagaaacaaagagtgaatattggttctaaagatagttcctcccttttttttttttttgcatcaggcaaggaaacttttacatcaatagcaaaaattatataagaaagtaatattatatgaactatagggtaaactaaattttagcactggctaggtatgataactcatgcctataacccctatactttgggaggccaaggtgggaggactgcttgaggccaagagtttgaggttagcgtrggccacatagaaagactctgtctctataaaaaataaaaaaaaaattattagttgggcatggtgggctcacctatagccctggctactcaggaagctgaggcaggaggatcatttgagccaagagtttgaggctgtagtgagctatgattgtgctaatcactccagcctgggcaacagagtgagacccatctcaataaataaataaatactggcactgattaatgggaatccagctccttaatttaaccaagggcaatcatgcttttaaaaatagaattttccaaatcctacaatgtagag

SEQ ID NO: 107783 - DNA, 601 bp, Human
aatgatccttttgacaatagtgatgaaaaataaatacgatgctccaaacgtccttgcattttattgtaactgcttcttatcatctagagaacctaaatttattccccctaatagaatatgggaaacagcttagtgcagtgatcttagcggtagctgtatttttaattgcatagtatataccataacataaaacagtaggttcaaaaacaagagaccaagaatagtctagaaattgggtggcatcagggttctaggcagagaaacaaagagtgaatattggttctaaagatagttcctcccttttttttttttttgcatcaggcaaggaaacttttacatcaatagcaaaaattatataagaaagtaatattatatgaactatagggtaaactaaattttagcactggctaggtatgataactcatgcctataacccctatactttgggaggccaaggtgggaggactgcttgaggccaagagtttgaggttagcgtaggccacatagaaagactctgtctctataaaaaataaaaaaaaaattattagttgggcatggtgggctcacctatagccctggctactcaggaagctgaggcagg

SEQ ID NO: 107784 - DNA, 601 bp, Human
attggctgtattcttcatgtcttatacaatgctttacattctataaactttagccctacatcactggcctaatctacaaaaccctgaatctattctaatgacaaaatattagaaaagtgcaaaatgtagaagtatgacttatgcagcatcccagagctgaatgggcctagaaaaaaaaaaaagtgtgacacttagaacagtaaaaggctcgtagcacatctccaaatgatccttttgacaatagtgatgaaaaataaatacgatgctccaaacgtccttgcattttattgtaactgcttcytatcatctagagaacctaaatttattccccctaatagaatatgggaaacagcttagtgcagtgatcttagcggtagctgtatttttaattgcatagtatataccataacataaaacagtaggttcaaaaacaagagaccaagaatagtctagaaattgggtggcatcagggttctaggcagagaaacaaagagtgaatattggttctaaagatagttcctcccttttttttttttttgcatcaggcaaggaaacttttacatcaatagcaaaaattatataagaaagtaatattatatga

SEQ ID NO: 107785 - DNA, 601 bp, Human
aaagcagtcatcagggtaatttgagaaatatgtaaactatataactacaattaggttttgttttctaattctgatgccaaaatggtctaaataaaggtgctccaaaagttttccttctgaaagagctgaaattggctgtattcttcatgtcttatacaatgctttacattctataaactttagccctacatcactggcctaatctacaaaaccctgaatctattctaatgacaaaatattagaaaagtgcaaaatgtagaagtatgacttatgcagcatcccagagctgaatgggcctagaaaaaaaaaaaagtgtgacacttagaacagtaaaaggctcgtagcacatctccaaatgatccttttgacaatagtgatgaaaaataaatacgatgctccaaacgtccttgcattttattgtaactgcttcttatcatctagagaacctaaatttattccccctaatagaatatgggaaacagcttagtgcagtgatcttagcggtagctgtatttttaattgcatagtatataccataacataaaacagtaggttcaaaaacaagagaccaagaatagtctagaaattgggtggcatcagg

SEQ ID NO: 107786 - DNA, 601 bp, Human
tcatgcacacctggcactagactatggtgaatggatctaaaagggatacaaagaagatatggtccttctcacaagaaaattacagtctgcctaagaaaacagggagaaatatatcaataaagatttgaactgggcagaattcactattcagaaagagagagaaagagaacagctgcagctttagacaagtttacgaaggaggtcaagtttaaggcaaggtctagaacgatgaaaactgtctacttaggcataaaggatgtttaaatgagcagggaaaagccttgccaggtgaagaagaagwcaccttagccaaaggtactgcagcaagaacaagcacactagttatatggaaaacggcaagaactgacagggtccatcgcaaagattgggcaatcagagtggggtctgatggcctcccttatttacgatctattcaaaattgcacttgggaggcatgtcaagttcaatgtgggtccagaacaccctaaactcctgactataatgatggtgttaggcgcttgcagttaaaggggaccctagtttaagctcaggaaaaagttacaaagatacatgaggccaattgatatgatttatttgtccc

SEQ ID NO: 107787 - DNA, 601 bp, Human
caacaattctctgacaggttaccatggcatccttaagagtcacgactccgggccaacatacagaaccatgaaaatgaagagagaaaaataaaaagcaaattaaaataaaatgtttaaattaccaaattaataaagcttattaagaaaacctgaaacaccaaagatacttaattataataactattatctgtagtatcacaaatatggggagtggacatatttgaaacatcaactactggcgtcaccttatgaaaatcaaacaccagtgacaaaaaattccactctgaacatttatgaagaygtcatgcacacctggcactagactatggtgaatggatctaaaagggatacaaagaagatatggtccttctcacaagaaaattacagtctgcctaagaaaacagggagaaatatatcaataaagatttgaactgggcagaattcactattcagaaagagagagaaagagaacagctgcagctttagacaagtttacgaaggaggtcaagtttaaggcaaggtctagaacgatgaaaactgtctacttaggcataaaggatgtttaaatgagcagggaaaagccttgccaggtgaagaagaa

SEQ ID NO: 107788 - DNA, 601 bp, Human
acatttgaaattgtatcaaaataaaaagctaaagaacaaaaaataaccaggactaaccttttcatagggtatctgcagaagatccaacaccaccgaatgcgcccccatatttttcagtaatcgttgatgttgattccgacactttttattctgcacacagagtttacttagcctgatcaaaatctttaaaaggaagagggaaagcatcaaatataataaataacaatattaagtataatatataagcaaaacttatttggcatgcaaatataaacctatataagaatattttgtatctgcygacctcctttacaatccggtagttattgctcttgttgctgtcaatctgaggtttctttgttccatcctgcactggacttaaaatgtttgattcctaaaaggaacacaaatatgtacttttatgccatttgtagctttgtgttacatttatttcttttgtattaaataataaatatattttgtaattattttgtaataaatctattattcaacttaaatgtttcttttgtacttttttattgcataaaaagttccttggcttgactgagccatgcaaattaccgctacccagtgagaaccc

SEQ ID NO: 107789 - DNA, 601 bp, Human
ccctctttcttaacactcttaatagtgaatatccttattcattgccattttccaaagtcctatactaagctactatcatttgattataagaatcttaacaagaaacttaagtctcaaaattcacagagaagcaaatttgtcttcttaaaagtggtcttgtgacaacatcagtgaaactacctaaaatttccccatgtagttgattgtaccatttgtcatgtgggcattgttacgaattcagatggactcatgttttcagtggtattttatattaatattaaataaatttctacatgcaccyatacatatgcatattccctagctttgcctatttagagggcctatgggggcaacaccccaaagcaataagaactgagaactcagttctcagaactttgctcctaaataccatttcccaccaaatggaaatggggcctcttgaagaaatggctgattctagagtcgaagcaaggagaatacaagatgaacctggaacattttattgtgccagaaagcaaggaagtaatcaaagaatggtgggggtgatgttagaagacagatagtctagctcaaaggaactccactggtcaaatctgagaca

SEQ ID NO: 107790 - DNA, 601 bp, Human
ttcacccacataccatttttctctctgcccatctttgatctcctttctctgtgtcctttatgtttcacacctctcccagtttcccctcctgtccctcttctctgttttctagatctttctcaccttctcttggttattcctcctgattctattctgctctacttttccaatgcccccttcatttcacagcccttctctttctccccaatctttccaactgtccaccacgtttcctcatctctgtacatagccaccttttcctcctctgctttatctccacacctcctctgtcctcctttcytctctgtccctatctttctctgtttctcctcccttctctgctgtactccccagtccccataattcttcccttcctttaaatgtctcattttgcagtatgcctatatctccatcatgctgcttctattcttgtctctctttccctactctatttcactctctttctcatacatcttcctttcctactctttctcccacatctattccatctcctctcttcttttcctcttttcctatctattatttcttctgctcccatccccttttctcctgctctgctctcactctatttcctctctat

SEQ ID NO: 107791 - DNA, 601 bp, Human
caaactccacctctgagttttccatatttaccttactcatggtattgtgagttagttctttgttctaccatatcttttccctaacatttaactatatacgtataaaatacattgtcatttgcatgtaaaacttgtgcaatttttcaagtttctttaaaagtttccttaatgaaaaaaaaaagatattcacttctggagagagaatttccacaaggaaaaaaaaatgaagcaaggaagtgtaacaaaattctcttcatgaatgttactgagacaaatttgatgcacactttactagaaataytagaagccactaaaatacttacacctggagttaaaaacaaattcagatgtttatgaagaagaacttgattctgtggatttcctcgacagaaattctgcagaaatgtatgggctagattcattacttcattcatcttttcatcattctgtaagttaaagaatagcacatgatagaaacaaacataggagacagcaaatgttatgcaaaaatctctccttcacccacataccatttttctctctgcccatctttgatctcctttctctgtgtcctttatgtttcacacctctcccagtttcc

SEQ ID NO: 107792 - DNA, 601 bp, Human
cagtgcacaaagtgttgtacaactctctcgctaatttcgttgcacagatggtaattgttcatgaagatgtgccgcatggtttctgcttcaaggagctaaacacagaggaacatgcccttgtaattctgacaagatcaattttctattctacagtacttagactaattgccctgcttgtgatcagttttatattttatacgaagccacagtgaattttctgtgcatgtctttcaaaaaatgcgatgagatcattaaccattaaaagaaaactgagctcacagaggaatttagttggagaaakgagcttattatcataaagtgcaacatattggcaacagtattcttgagactaattatgaattcaaaattaggtcttccataaaatctgctcaaacacattttacagacaagggcaaactccacctctgagttttccatatttaccttactcatggtattgtgagttagttctttgttctaccatatcttttccctaacatttaactatatacgtataaaatacattgtcatttgcatgtaaaacttgtgcaatttttcaagtttctttaaaagtttccttaatgaaaaaaaaaagatattc

SEQ ID NO: 107793 - DNA, 601 bp, Human
aaagaaatgaagtaccttcatctattcatttgctgaaatttgtaacttactctaagtagtaagtttccacatgttgtaaaaaaaatcactgttaggtagtttgtattacttagtttgattctcttcaaagctttctgcaaatagcagcagagaacacccattctatgtttcagaaacagagcaataaaggcactggaaaagcacagtttaatctgtctttcttatatcattggaaacttaaaaatataaaattttgtcactttcattccaaacaatcgacaacatttcataggattttacscattttttaaaatacacaaattcattataggtcaaaaagaaaaacaaacttagaaaaatcataaaaccaacttaagatatgttgcttcactaaattaaagcaaaatatatttgcacttgagtagtcatgattaaattaaataattttccaaacctatgttgttgggggctttttcactgtaatagaaaatgcatatttgaacatactgtttaggtgaagctgataaaaggcaaactgagaacatacctctgtcattaccatatcctggcatttcttcacatatttaccatctgcttttac

SEQ ID NO: 107794 - DNA, 601 bp, Human
caagaaatctcataattttactaaagcagagtaaaatatcctcatccattgcaataatgactacataaggaagcaagtacattgagctaattacagctctacaaaagtctacaaaattccatgtgtcataagaaggcatcagcagagaatgaaggtaaaagcagagttaagagaaataagtagaaaactaaaaccaaaaaaccgagagaaacaaagatatgaataggtagggtcttttaagacataaattttccttcacattttgtttatataattttagtagaaaattccatcaggtggmagttttattgttcaagctccatagtatcttattgtctattatcagtaccaattttctaaccccagtgtgagatacattggtgggtaactaaggacatacaatttttttctctaggtattatatttaaagtgacaatatatttaaatctataagccgattcattggcttactttgaaagtgttgttgaaagagaatgtatgtgtatcaaaaatatgtattatatattaacataatattacaaatacttctttgtgcacagaaacacttcacccaacagtatcatagggatggtttcactgt

SEQ ID NO: 107795 - DNA, 601 bp, Human
tgtggaagcagcagatagggcaagaatgaaacaacatggatgaaagtaaattgttcatcacactgaaattaaacctgtaaaaaaataaagttattttcctctacttttttttgggagactccatggccaaagcacaagaaatctcataattttactaaagcagagtaaaatatcctcatccattgcaataatgactacataaggaagcaagtacattgagctaattacagctctacaaaagtctacaaaattccatgtgtcataagaaggcatcagcagagaatgaaggtaaaagcagagwtaagagaaataagtagaaaactaaaaccaaaaaaccgagagaaacaaagatatgaataggtagggtcttttaagacataaattttccttcacattttgtttatataattttagtagaaaattccatcaggtggcagttttattgttcaagctccatagtatcttattgtctattatcagtaccaattttctaaccccagtgtgagatacattggtgggtaactaaggacatacaatttttttctctaggtattatatttaaagtgacaatatatttaaatctataagccgattcattggc

SEQ ID NO: 107796 - DNA, 601 bp, Human
gaggcagtgagctaacagataacagcatctgttcttgtaattgagataatgaaaatatggacttcactaatctttctcctccaaatacatctatataaggcctatacaaagctactagcactcaggaatgttggaaggccaaaggggctgagtccagccaccatcattcataataggtctaaggagttatctatatactgtcttctttagtgaaactttatttgaacttcaagtcccataactttaaagggaaaattagatttttttttagacactggctgttatgataattcagtatgcaaaaaaaaaaggctaagatgtgctaaagaaaattgtgttgtccatcaaagatattccttctttcttatatttcttcactcattcatttactcaatattaacagagcaaaaacatatgtcaggcagtatctagaaaatgccaaccagctccacatgtcctccccaacagcccccaacaaaacaaacagtaataagcgaatataatttggtggacacgagtgaaaatgccagatgattaaattactggagtacacttccaaagaagattttgaataggcaacagcgagcaaggccaagtcctc

SEQ ID NO: 107797 - DNA, 601 bp, Human
aggtaaactaagcacatttcacttggaaaccctggctaaataaaaagagtccgtggtctggaataacgtatgattcattgtattatccaagggtgctcttacatgtctgagtctacaggcagtgaaaggagggatgacaaggatgtaccttgtcatccctcctttcagaaaaaggtatagagaggcagtgagctaacagataacagcatctgttcttgtaattgagataatgaaaatatggacttcactaatctttctcctccaaatacatctatataaggcctatacaaagctactagcrctcaggaatgttggaaggccaaaggggctgagtccagccaccatcattcataataggtctaaggagttatctatatactgtcttctttagtgaaactttatttgaacttcaagtcccataactttaaagggaaaattagatttttttttagacactggctgttatgataattcagtatgcaaaaaaaaaaggctaagatgtgctaaagaaaattgtgttgtccatcaaagatattccttctttcttatatttcttcactcattcatttactcaatattaacagagcaaaaacatatgtca

SEQ ID NO: 107798 - DNA, 601 bp, Human
gggagagaaagaaatcccagatatgaaaaagtcaggtttctatttccttccctgaaaaaggaaaggtgattcctgtcaaccctggtgaagggattagagagctactgttttaaaatataaacaagagggaaatatttttaaaaacctttttgcagtatagctaagttattgtggttagacataaataataaatagatcaagaagatattgaaattcccctagagctttaatataataaataacattaattatccaattaagcaatagttaaaatcattgctattttttttgtttttttttktgtgtttttcaaaaaaagaatgtaaatctgtacacctttgccttgcaaatacatcggtgaaaacggtatttctcaggtggcataatcaatggaagttatcattggctttctttggtttaaaaaataaaaatcctttcagctttatagctcatgctgcctacaatgtgaccttgatctgtttcaagcttatctttagtcagtagcactgtgcaactccgcaaatcagtctataatctctttaatatcctcctgcacgtgcagttttaaagcttagtcattggcatggaagtcactccttac

SEQ ID NO: 107799 - DNA, 601 bp, Human
tcttcatggggagagaaagaaatcccagatatgaaaaagtcaggtttctatttccttccctgaaaaaggaaaggtgattcctgtcaaccctggtgaagggattagagagctactgttttaaaatataaacaagagggaaatatttttaaaaacctttttgcagtatagctaagttattgtggttagacataaataataaatagatcaagaagatattgaaattcccctagagctttaatataataaataacattaattatccaattaagcaatagttaaaatcattgctattttttttgtttttttttttgtgtttttcaaaaaaagaatgtaaatctgtacacctttgccttgcaaatacatcggtgaaaacggtatttctcaggtggcataatcaatggaagttatcattggctttctttggtttaaaaaataaaaatcctttcagctttatagctcatgctgcctacaatgtgaccttgatctgtttcaagcttatctttagtcagtagcactgtgcaactccgcaaatcagtctataatctctttaatatcctcctgcacgtgcagttttaaagcttagtcattggcatggaagtca

SEQ ID NO: 107800 - DNA, 601 bp, Human
ttcttcatggggagagaaagaaatcccagatatgaaaaagtcaggtttctatttccttccctgaaaaaggaaaggtgattcctgtcaaccctggtgaagggattagagagctactgttttaaaatataaacaagagggaaatatttttaaaaacctttttgcagtatagctaagttattgtggttagacataaataataaatagatcaagaagatattgaaattcccctagagctttaatataataaataacattaattatccaattaagcaatagttaaaatcattgctattttttttgkttttttttttgtgtttttcaaaaaaagaatgtaaatctgtacacctttgccttgcaaatacatcggtgaaaacggtatttctcaggtggcataatcaatggaagttatcattggctttctttggtttaaaaaataaaaatcctttcagctttatagctcatgctgcctacaatgtgaccttgatctgtttcaagcttatctttagtcagtagcactgtgcaactccgcaaatcagtctataatctctttaatatcctcctgcacgtgcagttttaaagcttagtcattggcatggaagtc

SEQ ID NO: 107801 - DNA, 601 bp, Human
tctgatctttcttcatggggagagaaagaaatcccagatatgaaaaagtcaggtttctatttccttccctgaaaaaggaaaggtgattcctgtcaaccctggtgaagggattagagagctactgttttaaaatataaacaagagggaaatatttttaaaaacctttttgcagtatagctaagttattgtggttagacataaataataaatagatcaagaagatattgaaattcccctagagctttaatataataaataacattaattatccaattaagcaatagttaaaatcattgctattttttttgtttttttttttgtgtttttcaaaaaaagaatgtaaatctgtacacctttgccttgcaaatacatcggtgaaaacggtatttctcaggtggcataatcaatggaagttatcattggctttctttggtttaaaaaataaaaatcctttcagctttatagctcatgctgcctacaatgtgaccttgatctgtttcaagcttatctttagtcagtagcactgtgcaactccgcaaatcagtctataatctctttaatatcctcctgcacgtgcagttttaaagcttagtcattggca

SEQ ID NO: 107802 - DNA, 601 bp, Human
aggggttaagtactttgcccaagataaactgagctactgagaggcacagtctggactcgaactctggtctggctaaatcttttgaaatccctactcttagctaccatgctctgtctactacagtgattctcaaagtgtggtccctggaccagcacctgcagcaccacttaggaatttgttaaaaatgtaaagtctttcatttatggaaattagaaattctggggacaaggaccagcaatctgtatttcaccaagccctccagctaggcctgatgctcactaaagcttaaaaactgctcaamtgaactgaaaatttacctagaaggccacattctattcatttaaccacacttagttttataacttgaatttgaaagtttctggtgactctgatctttcttcatggggagagaaagaaatcccagatatgaaaaagtcaggtttctatttccttccctgaaaaaggaaaggtgattcctgtcaaccctggtgaagggattagagagctactgttttaaaatataaacaagagggaaatatttttaaaaacctttttgcagtatagctaagttattgtggttagacataaataataaatagat

SEQ ID NO: 107803 - DNA, 601 bp, Human
ttctagtttttccctatgctgaatggtcctctggatacaatgatatggatgatgttaccaactctcttactgatgctaatatgtgctaagaattttatacacattatctcattggattctcccactaaccctatggggaatgtgaatttattgtattcattttacaaatcaggaaactcagggcccagaggggttaagtactttgcccaagataaactgagctactgagaggcacagtctggactcgaactctggtctggctaaatcttttgaaatccctactcttagctaccatgctctrtctactacagtgattctcaaagtgtggtccctggaccagcacctgcagcaccacttaggaatttgttaaaaatgtaaagtctttcatttatggaaattagaaattctggggacaaggaccagcaatctgtatttcaccaagccctccagctaggcctgatgctcactaaagcttaaaaactgctcaactgaactgaaaatttacctagaaggccacattctattcatttaaccacacttagttttataacttgaatttgaaagtttctggtgactctgatctttcttcatggggagagaa

SEQ ID NO: 107804 - DNA, 601 bp, Human
gtacattgaagagatatctgcactcccatgtttgttgcagcacagttcacaatagccaaaatttggaagcaccttaagtgcccatcaacagatgaatggataaagaaaatgtggtacatatacacaacagagtactattcagccagtaaaaaagaatgtgatccagtcatctgcaacaacatagacggaactggaggtcattatgttaagtgaaataagccgggcacacaaagataaattttgcctgttctcacttatttgtgggcactaaaaaaattgcaacaactaaattcatggagayagagaataaaaggatggttactagaggctaggaagggtagtggggcagaggggaagtggggatggttaatgggtacaaatatacagttgaaaacaatgaataaaatctaatatttgatagcacaacagagtgactacagtcaacaataatttcttgtacattttaaaataactaaagaaatataactggattgtttgtaacagaaagaaaggataaatgcttcaggtgatggatatcccatttaccttgatgtgttcattacacattatatggctgtatcaaaatatctcctgtacctca

SEQ ID NO: 107805 - DNA, 601 bp, Human
tctcacttctggatatattcccacaagaaaggaaattgtacattgaagagatatctgcactcccatgtttgttgcagcacagttcacaatagccaaaatttggaagcaccttaagtgcccatcaacagatgaatggataaagaaaatgtggtacatatacacaacagagtactattcagccagtaaaaaagaatgtgatccagtcatctgcaacaacatagacggaactggaggtcattatgttaagtgaaataagccgggcacacaaagataaattttgcctgttctcacttatttgtgrgcactaaaaaaattgcaacaactaaattcatggagatagagaataaaaggatggttactagaggctaggaagggtagtggggcagaggggaagtggggatggttaatgggtacaaatatacagttgaaaacaatgaataaaatctaatatttgatagcacaacagagtgactacagtcaacaataatttcttgtacattttaaaataactaaagaaatataactggattgtttgtaacagaaagaaaggataaatgcttcaggtgatggatatcccatttaccttgatgtgttcattaca

SEQ ID NO: 107806 - DNA, 601 bp, Human
ggttgaaccccggaggcagaggttgcagtgagctgagatcacaccactgtactccagcctgggtgacagaaccagactctatctcaaaaaaaaaaaagcaacaactaaaaatagagctaccatatgatccaacaatctcacttctggatatattcccacaagaaaggaaattgtacattgaagagatatctgcactcccatgtttgttgcagcacagttcacaatagccaaaatttggaagcaccttaagtgcccatcaacagatgaatggataaagaaaatgtggtacatatacacaacagagtactattcagccagtaaaaaagaatgtgatccagtcatctgcaacaacatagacggaactggaggtcattatgttaagtgaaataagccgggcacacaaagataaattttgcctgttctcacttatttgtgggcactaaaaaaattgcaacaactaaattcatggagatagagaataaaaggatggttactagaggctaggaagggtagtggggcagaggggaagtggggatggttaatgggtacaaatatacagttgaaaacaatgaataaaatctaatatttgatagcacaacag

SEQ ID NO: 107807 - DNA, 601 bp, Human
aaaactaaaaatagccgggcgcagaggctcacgcctgtaatcccagtactttgggaggccgagatgggtggatcacttgaggtcaggagttcaagaccagcctggccaacatggtgaaaccccatctctactaaaaaaaaaaaaatacgaaaattagccaggcatggtggtgcatgcctgtagtcccagctactcgagaggctgaggcaggagatggttgaaccccggaggcagaggttgcagtgagctgagatcacaccactgtactccagcctgggtgacagaaccagactctatctcaaaaaaaaaaaagcaacaactaaaaatagagctaccatatgatccaacaatctcacttctggatatattcccacaagaaaggaaattgtacattgaagagatatctgcactcccatgtttgttgcagcacagttcacaatagccaaaatttggaagcaccttaagtgcccatcaacagatgaatggataaagaaaatgtggtacatatacacaacagagtactattcagccagtaaaaaagaatgtgatccagtcatctgcaacaacatagacggaactggaggtcattatgttaagtgaa

SEQ ID NO: 107808 - DNA, 601 bp, Human
aactctataggaaaaaatagaataatccgattcaaaaatgggcaaaagatctgaatagatatttctcaaaagaagacatacaaatggcaaacaggtatatgaaaaggtgttcaacatcattgatcacaagagaaatgcaaatcgaaactacaatgagatatcatctcaccccagttaaagtggcttttatccaaaagacaggcaataacaaatgctgaagagcatgtagagaaatggaaacccttgtacacattagtgggaatgtaaatttggacaatcacaagggaaaacattttggagkttcctcaaaaaactaaaaatagccgggcgcagaggctcacgcctgtaatcccagtactttgggaggccgagatgggtggatcacttgaggtcaggagttcaagaccagcctggccaacatggtgaaaccccatctctactaaaaaaaaaaaaatacgaaaattagccaggcatggtggtgcatgcctgtagtcccagctactcgagaggctgaggcaggagatggttgaaccccggaggcagaggttgcagtgagctgagatcacaccactgtactccagcctgggtgacagaaccagac

SEQ ID NO: 107809 - DNA, 601 bp, Human
aaacgggagtggtggcaggtgcctgtagtcccagctactcgggaggctgaagcaagagaatcactggaacccaggaggcaggtgttgcagtgacctgagatagcaccaccgcactccagcctgggtgacagagtgagactccatctcaaaaaaaaaaaaaaaaaaaaaaagccttttgtgcagcaaaggaaacaatcaacaaagtaaagagataatccacaaaatgagagaaaatatttacaaactgtccatctggcaagggattaataaccagaatctataaggacctcaaacaactctrtaggaaaaaatagaataatccgattcaaaaatgggcaaaagatctgaatagatatttctcaaaagaagacatacaaatggcaaacaggtatatgaaaaggtgttcaacatcattgatcacaagagaaatgcaaatcgaaactacaatgagatatcatctcaccccagttaaagtggcttttatccaaaagacaggcaataacaaatgctgaagagcatgtagagaaatggaaacccttgtacacattagtgggaatgtaaatttggacaatcacaagggaaaacattttggagtttcctc

SEQ ID NO: 107810 - DNA, 601 bp, Human
gaggtcaggagttcaagaccagcctggccaacatggtgaaaccccgtctctactaaaaatacaaaaattaaacgggagtggtggcaggtgcctgtagtcccagctactcgggaggctgaagcaagagaatcactggaacccaggaggcaggtgttgcagtgacctgagatagcaccaccgcactccagcctgggtgacagagtgagactccatctcaaaaaaaaaaaaaaaaaaaaaaagccttttgtgcagcaaaggaaacaatcaacaaagtaaagagataatccacaaaatgagagaraatatttacaaactgtccatctggcaagggattaataaccagaatctataaggacctcaaacaactctataggaaaaaatagaataatccgattcaaaaatgggcaaaagatctgaatagatatttctcaaaagaagacatacaaatggcaaacaggtatatgaaaaggtgttcaacatcattgatcacaagagaaatgcaaatcgaaactacaatgagatatcatctcaccccagttaaagtggcttttatccaaaagacaggcaataacaaatgctgaagagcatgtagagaaatgga

SEQ ID NO: 107811 - DNA, 601 bp, Human
cagatcacttgaggtcaggagttcaagaccagcctggccaacatggtgaaaccccgtctctactaaaaatacaaaaattaaacgggagtggtggcaggtgcctgtagtcccagctactcgggaggctgaagcaagagaatcactggaacccaggaggcaggtgttgcagtgacctgagatagcaccaccgcactccagcctgggtgacagagtgagactccatctcaaaaaaaaaaaaaaaaaaaaaaagccttttgtgcagcaaaggaaacaatcaacaaagtaaagagataatccacaraatgagagaaaatatttacaaactgtccatctggcaagggattaataaccagaatctataaggacctcaaacaactctataggaaaaaatagaataatccgattcaaaaatgggcaaaagatctgaatagatatttctcaaaagaagacatacaaatggcaaacaggtatatgaaaaggtgttcaacatcattgatcacaagagaaatgcaaatcgaaactacaatgagatatcatctcaccccagttaaagtggcttttatccaaaagacaggcaataacaaatgctgaagagcatgta

SEQ ID NO: 107812 - DNA, 601 bp, Human
aaaaacatacactggggaaaagacagtctcttcaataaatagtgcgaggaaaactgaatatccataagcagaagaaatgaaactatacccctatctctcatgatatacaaaaatcaaatcaaaatggattaaagacttaaatctgagatctcaaaccttgaaaccactacaagaaaacatcagggaaactgtccaggacattggtctgggcaaaaatttctagagtaacacccaacaagcacaggcaaccaaagcaaaaacggaaaaatgggatgacgttaagttaaaaggcttcaggtcrggcacagtggctcacgcctgtaatcttagcactttgtgaggctgaggtgggcagatcacttgaggtcaggagttcaagaccagcctggccaacatggtgaaaccccgtctctactaaaaatacaaaaattaaacgggagtggtggcaggtgcctgtagtcccagctactcgggaggctgaagcaagagaatcactggaacccaggaggcaggtgttgcagtgacctgagatagcaccaccgcactccagcctgggtgacagagtgagactccatctcaaaaaaaaaaaaaaaaaaaaaaa

SEQ ID NO: 107813 - DNA, 601 bp, Human
atatctgaccagctgttggggaaaagcactgaatgatgctacagcagccctcccactctatatctagctaggagagtcacccagaaaattctctctgtagaagccacaggcaaaattatgagaccaactaagatgatcttcattttcttcaagttatataattttgtcgtttcaaaataggtcactagcaagaatagtgaggaggtgtttatagtaaacacatctttaactgaattattttgtgttgctggagaaaaaataactaggcaaaaaatgtaataaggaaaaacttgatagcaargttctggcataaaaagacacatagaccaatggaacagaaaagaggactcagaaacaaatccacacacctacaatgaactcattttccacaaaggtgccaaaaacatacactggggaaaagacagtctcttcaataaatagtgcgaggaaaactgaatatccataagcagaagaaatgaaactatacccctatctctcatgatatacaaaaatcaaatcaaaatggattaaagacttaaatctgagatctcaaaccttgaaaccactacaagaaaacatcagggaaactgtccaggacatt

SEQ ID NO: 107814 - DNA, 601 bp, Human
tcaacttaagaaattcaagaaaattatttttttaaattgacttaatgtcaccaaattaaagaactaggaaagtgtgtttcaatgtgcatataaattatatctttactccaacctcttacatatttatttggtaagttaagggagcaaaaattttaagtaaaaacttgactcaatataagagttgttaacaaagttgtagaataataaaaccaattatatcaaaaaaatggctcaagttatctacctgaaagtgaaatacacaagtttgtcttgttaaccagtgactgatgggatactgacrtgacagagagttaggtgagcctcctaaattatttcttggtctaatttcattctgctagtacatcacttagagtactgttggtccttataggatcctgacattgatagcaaaattggaaacatcttcaaagaaaaaatatagtctgaggctaacattgaccatagtctaccctctttacgtgccttctaataatgactcaaatcccctgactatcaacaacaatcagttataaagccaaagaaaagcttttctgccctacaaacaccagttttagctgcactggaacatagatcaaagtgg

SEQ ID NO: 107815 - DNA, 601 bp, Human
gtcaggtggtaataaattctatggagaaaaatgaagcaagtgttaagaaggataaagaaaagagcctgttattttatatagggtggttggcaaagccctctctgaaggagtgactttgaaggaaaaacctaaaggaaaaggaagaagttatgcagatacagggaagtccagcatccctggaaaatgtacagttgctgagataggaatgcatttggcatacctgaggagtagcaaggaggccacagtatggaacagatagctagctagggggagaataagaggacaaggggaagaagggtgktcatagggcagaggctaagtcacacaggggttttattctgagcaagacaggaagtcactggaggaatctgagcagaggagtgacgatcatcttctccttcttctccctctctttccccttcatccctttctcctccatctcctccacctcctcttccacctccttcaatcatgatggctgctagataaagaatagatggagagagggacaagagcagaagcttggaaacaggttatgaggctattgcaatcatccaaatgagagagaatggtacttggggtagcgtagttgtgatgggag

SEQ ID NO: 107816 - DNA, 601 bp, Human
ttaaatatttttagcttcatatgacatttatttatttcacaaatatttactgagtatctattatgtgtgagacattgttctaggtcaggtatgcagcagtgaacagagataaaattcctgtctttcatttgttcctactgaaatacaaataaatatatatatatatatatgtaaatgtcaggtggtaataaattctatggagaaaaatgaagcaagtgttaagaaggataaagaaaagagcctgttattttatatagggtggttggcaaagccctctctgaaggagtgactttgaaggaaraacctaaaggaaaaggaagaagttatgcagatacagggaagtccagcatccctggaaaatgtacagttgctgagataggaatgcatttggcatacctgaggagtagcaaggaggccacagtatggaacagatagctagctagggggagaataagaggacaaggggaagaagggtggtcatagggcagaggctaagtcacacaggggttttattctgagcaagacaggaagtcactggaggaatctgagcagaggagtgacgatcatcttctccttcttctccctctctttccccttcatc

SEQ ID NO: 107817 - DNA, 601 bp, Human
ttctaaacgctttttagaaaggctgcatgaaattatactctcatcagcaggatatgcaaatacatacgctgaaccatcaccaacatttaatattatctttccaagcttgcaacttagatggttgaaaattggatcttattttttgtgttattttaaaaattattaatatttgaacatttttcagaggtttattaactttttgtatttcctgttctataaatcatgaatgtttggtttttcccattttcttattaaattgttaagagtttttcttataaatacatataagttcttcatgtgrtggttattaccctttttaaaactgtaccatagctatttaaattttgatgtgttttatttattcatttattttcagagacagggtcttgctctgttgcccaggctggagtgcaggggcatgatctcggctcactacagcctcaaactcctgggctcaggggatcctcttccctcggtgtccctagtagctgggactacaggcatataccaccatgccgagcttatttttttgtagagacaggctccctctatgttgcccaggctgggtctcaagcttctggccttaagcagtccctgaact

SEQ ID NO: 107818 - DNA, 601 bp, Human
ctacatattatcgtattatcataaaagtacggagtctcgctctgtcacccaggttggagtgcagcggtgcaatcagctcattgcaacctccgcctcccaggtttaagggatcctcctacctcagcctcccaagtagcagggactacaggcgcatgccacaacacccgactaatttttgtattttttgtagagacagggtttcgccatgtttcccaggctggtctcgaactcctgggctcaagcaatccggctgcctcagcctcccaaagtactgggattacaggtctgagccactacaccygaccctttatagcatttctaattatttcccaaggacagatttttggagggtaaattacttgacacattagaaaagtatgaagggtttttctaaacgctttttagaaaggctgcatgaaattatactctcatcagcaggatatgcaaatacatacgctgaaccatcaccaacatttaatattatctttccaagcttgcaacttagatggttgaaaattggatcttattttttgtgttattttaaaaattattaatatttgaacatttttcagaggtttattaactttttgtatttcctgtt

SEQ ID NO: 107819 - DNA, 601 bp, Human
atttacttcttttagtatcttcctaacactggctttacagtgaaccttcctgatacataggttaaaaatataataaagttgaagaggtagcagaccaattccatcataaccaaaacaaacgacctccctcattcagtgacatttcatgcaattgcgtggggctctctggagtcatcagagtataccacactgcatcttctgcaactgggcacttgccaaaaaaccacccagaaatttgctttttagtcagtggattaatgaaaataatctatttctggatcaagactttcttcaaaatccwgggttatgaaaagtctgtgttttacaaagctatgtggaacctagtcctcagttcatttaaacaagaaattcaaataatttttcaagatgtttttcctgtcccctatgaatgataacatttcaccttgcatcttatattataatatcatggacagccaagaaatgtaggaagcacttattaaaatattttaaaatttttcaggaaaatgatcctcatacatatgaatatttctttattttcttttattttaatttattttctctttacaatagattggccatggctcaagtaaaattacat

SEQ ID NO: 107820 - DNA, 601 bp, Human
taggatttacttcttttagtatcttcctaacactggctttacagtgaaccttcctgatacataggttaaaaatataataaagttgaagaggtagcagaccaattccatcataaccaaaacaaacgacctccctcattcagtgacatttcatgcaattgcgtggggctctctggagtcatcagagtataccacactgcatcttctgcaactgggcacttgccaaaaaaccacccagaaatttgctttttagtcagtggattaatgaaaataatctatttctggatcaagactttcttcaaartccagggttatgaaaagtctgtgttttacaaagctatgtggaacctagtcctcagttcatttaaacaagaaattcaaataatttttcaagatgtttttcctgtcccctatgaatgataacatttcaccttgcatcttatattataatatcatggacagccaagaaatgtaggaagcacttattaaaatattttaaaatttttcaggaaaatgatcctcatacatatgaatatttctttattttcttttattttaatttattttctctttacaatagattggccatggctcaagtaaaatt

SEQ ID NO: 107821 - DNA, 601 bp, Human
agatttttagggtatctaatttcataggataactgcaggaacagtgcaattaacggaaataaattatgtcaaattatgtaaccttctagttattgttccagcatataacatggtgcctggcatacacaagatgttcaacaaacgtttgtgaaatgaattaataatttagtaaatttttaaatgaaagagggattaaggactcttattttgttttaggttaactttaggttgggctatattcctggaacatctaacctaggattaaaatttaatttaatttacatggtcccagatctaatayaaaattgatcttcctatgatggataagaattaggatttacttcttttagtatcttcctaacactggctttacagtgaaccttcctgatacataggttaaaaatataataaagttgaagaggtagcagaccaattccatcataaccaaaacaaacgacctccctcattcagtgacatttcatgcaattgcgtggggctctctggagtcatcagagtataccacactgcatcttctgcaactgggcacttgccaaaaaaccacccagaaatttgctttttagtcagtggattaatgaaaata

SEQ ID NO: 107822 - DNA, 601 bp, Human
aaataattcaatttaaagatgaggtctctttatttaaagtaaagtttggtaaactcagaaagaggcataatagtaaataatataagagaagaataaacatctgaagtgtaggagatgacttcctgaccagaaaaaatttctcctactcaaataagagaaactctttgcaacagaatgctttgcaattgtttaacttacctggaggctggtactattgtctgaaaagggagaattaaagaagccgctcacaatattcattattgactcagtaacacacttttccaaaaagatgtctgcatgyttcctgtctgtagttgtgttgcaaacctggagagaaaataaaacaactcaatatgttttatcacatttttaaaccacaattcagtattggaaccacctaaaaattgtcctgaaatagttgtcagtaacatttcttctgctttttaaagttgctgagaagagaagcatttcagcctgaaatcatgataattgtatcaatcttcagtagctgctccatcaagttagcctgtcatttcagccttgaaaccagaattctttcacagacccccagcctcttctttttaatttgcttctcccttct

SEQ ID NO: 107823 - DNA, 601 bp, Human
aattgtgcagttatttcaacacctggcaatcaacatacagatatgaagttcttagtctgcttagagaaaaaggaaaaataattcaatttaaagatgaggtctctttatttaaagtaaagtttggtaaactcagaaagaggcataatagtaaataatataagagaagaataaacatctgaagtgtaggagatgacttcctgaccagaaaaaatttctcctactcaaataagagaaactctttgcaacagaatgctttgcaattgtttaacttacctggaggctggtactattgtctgaaaarggagaattaaagaagccgctcacaatattcattattgactcagtaacacacttttccaaaaagatgtctgcatgtttcctgtctgtagttgtgttgcaaacctggagagaaaataaaacaactcaatatgttttatcacatttttaaaccacaattcagtattggaaccacctaaaaattgtcctgaaatagttgtcagtaacatttcttctgctttttaaagttgctgagaagagaagcatttcagcctgaaatcatgataattgtatcaatcttcagtagctgctccatcaagttagc

SEQ ID NO: 107824 - DNA, 601 bp, Human
tttgttaatataaaataacctaggtcaaattgcaaacagggagaaatgactaaaaacattttaaatggtcattaattagttaagtcatttattcatttctcacatatttgttgaggtatgctataaccctggccaaattgcataacctataaaactctctgttttcttaactatcaaatgtaaataatttaaaacctatctaaggattaaatgagataatgcatgtaaatggctggcattgcacatggtaagtacccaacaaatgttaacagtgatgaagactgataatgaaatacgctayaaactgcctttcccaatgtctgcagagccaccattagttgaaaggatgatcaagctcttccttttttgttcagtacagccaagtgtgcatttcttctctcctctcccctccaccattgggggaatggccctaattaacttattaactttctctctctctctctctctcgacaccccacccccatacacagagaagaatctatgagaaactcttctagaatctactcaccttcctttagctgtaattcccttgccttcaatttcatttgtaatttctgaagccttgaatattgacacactt

SEQ ID NO: 107825 - DNA, 601 bp, Human
ctgcctttcattgtattcaaatcaaaatcagggctgtcactaaattttgttaatataaaataacctaggtcaaattgcaaacagggagaaatgactaaaaacattttaaatggtcattaattagttaagtcatttattcatttctcacatatttgttgaggtatgctataaccctggccaaattgcataacctataaaactctctgttttcttaactatcaaatgtaaataatttaaaacctatctaaggattaaatgagataatgcatgtaaatggctggcattgcacatggtaagtacycaacaaatgttaacagtgatgaagactgataatgaaatacgctacaaactgcctttcccaatgtctgcagagccaccattagttgaaaggatgatcaagctcttccttttttgttcagtacagccaagtgtgcatttcttctctcctctcccctccaccattgggggaatggccctaattaacttattaactttctctctctctctctctctcgacaccccacccccatacacagagaagaatctatgagaaactcttctagaatctactcaccttcctttagctgtaattcccttgcct

SEQ ID NO: 107826 - DNA, 601 bp, Human
aattttccaatcaagaaattatgtttctctatttattaaaatattttatatccttcaatatagtaaaattttattctctcatattgtttacccttagatgtttaatgtttttgttgctattgataatgacgtctttttcatattacattctcttttgtggtatacagaaagtctgttaagtataatactcatttataattaattacttaagtcaactgtattattagtctattagttccactaattttcaattaagcctcttgggttataactgcctttcattgtattcaaatcaaaatcrgggctgtcactaaattttgttaatataaaataacctaggtcaaattgcaaacagggagaaatgactaaaaacattttaaatggtcattaattagttaagtcatttattcatttctcacatatttgttgaggtatgctataaccctggccaaattgcataacctataaaactctctgttttcttaactatcaaatgtaaataatttaaaacctatctaaggattaaatgagataatgcatgtaaatggctggcattgcacatggtaagtacccaacaaatgttaacagtgatgaagactga

SEQ ID NO: 107827 - DNA, 601 bp, Human
cagctaagacaatgtattcctatgtaaaaattaacaccatcatatttctttgcttttcctttgattttatcttttattggttagtgtgtttcctaaccgatttggcccaaataaaaatacatttactgctgtttcattataacttgaaagtaatatattagcagaaattacataaaagtgtgaagaagaaaaccagatccacacatcatccatccaccactcagagataatcaatattaaaattttatttatctctctgaacactttcttctgtgcatccttttaaaataaaaattacgtkctctttctttatttctccttctttatttttgtgtgtccttctttattcttgatatgatacatattgtgaccacttcctcttcctgtacctcttcacttcccctcccacaccattcagttctaaaatctttaggaggagcgcagcgcagtaagtgtccgtgctgggtaagatgtgcaaaagagccatggcgctccagaatgtggggacccaaaagggagtggaaggtctatgtaggaggactgcctgcagagaatcagaactcaagtggagtgaggagggtgtccatgcgaggagcagcct

SEQ ID NO: 107828 - DNA, 601 bp, Human
agcagctaagacaatgtattcctatgtaaaaattaacaccatcatatttctttgcttttcctttgattttatcttttattggttagtgtgtttcctaaccgatttggcccaaataaaaatacatttactgctgtttcattataacttgaaagtaatatattagcagaaattacataaaagtgtgaagaagaaaaccagatccacacatcatccatccaccactcagagataatcaatattaaaattttatttatctctctgaacactttcttctgtgcatccttttaaaataaaaattackttctctttctttatttctccttctttatttttgtgtgtccttctttattcttgatatgatacatattgtgaccacttcctcttcctgtacctcttcacttcccctcccacaccattcagttctaaaatctttaggaggagcgcagcgcagtaagtgtccgtgctgggtaagatgtgcaaaagagccatggcgctccagaatgtggggacccaaaagggagtggaaggtctatgtaggaggactgcctgcagagaatcagaactcaagtggagtgaggagggtgtccatgcgaggagcagc

SEQ ID NO: 107829 - DNA, 601 bp, Human
gtaagcattaattagaaaacctggttggttgtcaagttctactgtatagcccaggtggagcacaggaaagtggaatggcagggacagagaatggcacatttcctgtatcatgtcaaaggacccagaataaatctgtactgaagcaccagtatacataaacaggaagaacatcaaatatattaaattcatctttcctgtttggcactcaaattatactgagtgaatcctcaattaatccttacattgaataatgcacgtaatttttatgggttattgaagaactagtattggcacacttgaytagtcatctggaaaaaataaagttggttccacaccttatacctcacaactaaatgtatcccagatagctcacaattttaaacagcaactcccaaaacacaaagagacaaaccaaaactatgaaaattctccatgagaattcaaaaaacatcttagactgataagggctattccgaagatgaaagaaaaccttaaaagcctaaaagaaaatttaaaaatattgcatgccaaaaaataaataaaagttcaaatgacaaatggcaagaaaaaaaatatggtgggcacggtggttcatacctgt

SEQ ID NO: 107830 - DNA, 601 bp, Human
tatgaatctgaagaagaaaattaagttagaaacaaatgaaaaaagatccatcagctatttccatggttaggaaattctcttctacttggaaaagttttaatatcatagtgctacattttttgtcctaaatggttatagcagaactataaagatcatatttaaaattataatgatagtccccagaaggcttactttaaatgaatgaaaataggaaggaagggataaaaaaaaattggatgaatagatagacagatgatagatagatagatagatagatagatagatagatagatagatagayagacagacagacagatagatagataatctggcttgcttcatataatgaaaggaaagcaaatagtagataatattaccagctggtggaaattctctgaagcttaaagatactcaaaaacttgtttgaaaatagacaatttgctggatgcaatggtagcctcagctattcaggaggctgagtcaggtggatcacttgagtccaggagtttgaggttgtagtacactgtgatgcgaatagccactgcatctagcctaggcaacacagcaaaaccctgtctctaaaaaggaaagaaaagaagag

SEQ ID NO: 107831 - DNA, 601 bp, Human
attcccaaacaaaaacatttcaaaatacgtaaaggctcagaaattcttcaatgaaccccctatgaaaaaattactctaaaaaaagagcaaataatttttacatgtccacatggatatgagaaactatggcaactaagtatgaatctgaagaagaaaattaagttagaaacaaatgaaaaaagatccatcagctatttccatggttaggaaattctcttctacttggaaaagttttaatatcatagtgctacattttttgtcctaaatggttatagcagaactataaagatcatatttaaarttataatgatagtccccagaaggcttactttaaatgaatgaaaataggaaggaagggataaaaaaaaattggatgaatagatagacagatgatagatagatagatagatagatagatagatagatagatagatagacagacagacagacagatagatagataatctggcttgcttcatataatgaaaggaaagcaaatagtagataatattaccagctggtggaaattctctgaagcttaaagatactcaaaaacttgtttgaaaatagacaatttgctggatgcaatggtagcctcagc

SEQ ID NO: 107832 - DNA, 601 bp, Human
caattcaactggtgtccttataagaagggaaggagagacacagagaaatacctgagggacacacacgatgtgaagatggaggaagagaatggatttatgcagctgcaagccaaagaatgccaaagattgtcagcaaacctcagaagctaagagaaaggcatggaacgaattcttccctggagccttcagagagagcatggtactgatgaacccttgattccagactcctagtctccaaattgtgagacactaaaatttctgttgttttaagctacacagttatgctaatttatggccagcygtagaaaaatatacaaatgtcaatagtatggagaaaatatcaagtacttccagagagaaaagatgattcctaaaaagagtctgactagcatcagacttatcatcatcagcattgaatgctaaaagatccaatacctttatagatgaaaaattttgaaacacggactttatgtccatctaaactaaaaatcaaatgtaattcccaaacaaaaacatttcaaaatacgtaaaggctcagaaattcttcaatgaaccccctatgaaaaaattactctaaaaaaagagcaaataatttttacat

SEQ ID NO: 107833 - DNA, 601 bp, Human
taaaaattaagcataaaagatcaaaaagcagaataaaacagagagactgtgaaataaagagggtaaacccaggaatttaaatatctaacaaatataagttccagaaagaaatagcagatacaatgtgagagaagaaattattaagaaaacaatataagacaacttccttgagcttaagacacatgtacatctccaaattaaaaaggtccacaatatgttaaacaggattaagtaagcatattggccgtattctggtagaattttagaatgctgttttgggttgaactgcatccccaaaaagtatatgttgaagtattaatcatcactccccctgaatgtgaccttatttggaaatacggtctttgcagatgtaatcacgttaagttgaggtcatactgaatcatggtgggccccaatccaattcaactggtgtccttataagaagggaaggagagacacagagaaatacctgagggacacacacgatgtgaagatggaggaagagaatggatttatgcagctgcaagccaaagaatgccaaagattgtcagcaaacctcagaagctaagagaaaggcatggaacgaattcttccctggagc

SEQ ID NO: 107834 - DNA, 601 bp, Human
gccctcctattgcattctcttctcctctgctcttaaaataaacagtcttaatgatactacctagtctctaatcatcggggcctcttaaactcctctcatgccctgtctctacttccacctaagagccccaggtctgctgaccctgccttcattattatctgcaacacctatttcttcatttcatccatatcaccacctggcttagaccttaagtaacttctcactagtccctcttcctctagtctcttttagataaccctatcctacaaatcaagaaccacttataatggcattttccccmaaatttttaatgtctcacaccatttaggtttctcatactctctgaatctaacttgtccttctaatcccgtataacactcatctacatgttacctctcataatatttatttcagttaatgtcttggccattttgtagaaaaaaaacttcttcaaactataccccaattcaactccatgcaatattctactaattatgtgaatgggaagatgtctattatgggctgaattagaactcccccaaatttcatatgttgaaggcctaactcacagtacctcagaatgtgactgtctttagagcta

SEQ ID NO: 107835 - DNA, 601 bp, Human
tctacattttcttccgagaaatctcatccaattctatggttttaataacatctgtatgttggaactcccacatttatatttccagcatggacatctttctaaaccacttcagactcacttatctaacagcctagttgacacactcacttaggtatctaaataggcatctcaactttaaaattccccaaatagaactcctaatttcaactcagcctcaacttctttctctcccattacttcctatcttagtaaataacacaatcatatcaaaaccagagtcatccttgattcttctttccawtatcctacaacacatcgattcatccaccaagttctattagttctacaactaaatacatacaaaattaatacacttctctgcattactattgttacctccttaagccaagctaccatcaccttttgcctgaattaatgcaaagctacctaactagattcactgcttccatgtctggatcttataatacactcagaattcacagtgatcttttaaaaagtaaaccaggtcagcctctcctctgctgaaaatcttcaatgagttgtcatcacacatagaatacaattaaaatgccttaatatg

SEQ ID NO: 107836 - DNA, 601 bp, Human
actgacatatatttataggagatgaagggtatttatcaaagatcctattatctttgcttttttttttcatttagttcttatgtttagatctgtaatgggtacaggtgcagagttctcacatgcatgtatgtgcagtggtgaagtctgggctttcaacgtacccatcatctgaataatgaactgcgctcaacaccctatttttatagtgaattactaggcaatacctccacttaaaattttctttctactgttctcagcagtcatcagttgtacactcagggcctcttcactttaaaatccttactcacaagactggcaggtgtctggacaaatacactcttcccaatctccctaagacgcaatgagtctaaagccaaaaatacctgattctggccatagtataaaaaccccacctattcttcaacatgatccctgtagtcagtttttctcatcccataccttgttttcactcccaaggttccagcttaaatggtgaaagaaaggaacacacttcttgtgtgccctagtcctttaatctctgcctcgatatatcacagttgatagaagaggtttccagatctattttggtaataccctctac

SEQ ID NO: 107837 - DNA, 601 bp, Human
gtagcaggaccaatttagcctgagggccagagcttgccaacccgttccaggctgtcacatctcggggatatagctattgtattatgttaatttactgaatttaacaggtttatcgcctaacttttaacccatattccatacactgacatatatttataggagatgaagggtatttatcaaagatcctattatctttgcttttttttttcatttagttcttatgtttagatctgtaatgggtacaggtgcagagttctcacatgcatgtatgtgcagtggtgaagtctgggctttcaacgtrcccatcatctgaataatgaactgcgctcaacaccctatttttatagtgaattactaggcaatacctccacttaaaattttctttctactgttctcagcagtcatcagttgtacactcagggcctcttcactttaaaatccttactcacaagactggcaggtgtctggacaaatacactcttcccaatctccctaagacgcaatgagtctaaagccaaaaatacctgattctggccatagtataaaaaccccacctattcttcaacatgatccctgtagtcagtttttctcatcccatacc

SEQ ID NO: 107838 - DNA, 601 bp, Human
gtattcctattatcacatcacttctgcttctctcctttcaggttacctaatgatgccacaggcttgtctccatctgcagcacagctcaatatttgcttgatatcatgagttacttcataacactttctcatagaccagtatctccaagttctagaccagtgctgtctaacagaactctctgcaaaaatacacgtgttccatatttgtgctgccaaatttggtagccattagccacatgtggctactgagcacttgaaatgttgcagatatgactgaggaagtggatttttatttcattttwattcatttaaactataatttaaataaccatgtgtggctagtagctaccatactggcaccctagttctcgacaaggagtcaggaaaccttttctctaaaggatcagacagtaaatattttaggctttgtggggtacacagtctctgtggcaactaactgattctgccacagtggcatgaaagcagccacagacaatccagaaatgaatgagcactactgtatttcagtaaaactttatttacagaaatgagtagcaggaccaatttagcctgagggccagagcttgccaacccgttccagg

SEQ ID NO: 107839 - DNA, 601 bp, Human
gcaatgtattcctattatcacatcacttctgcttctctcctttcaggttacctaatgatgccacaggcttgtctccatctgcagcacagctcaatatttgcttgatatcatgagttacttcataacactttctcatagaccagtatctccaagttctagaccagtgctgtctaacagaactctctgcaaaaatacacgtgttccatatttgtgctgccaaatttggtagccattagccacatgtggctactgagcacttgaaatgttgcagatatgactgaggaagtggatttttatttcmttttaattcatttaaactataatttaaataaccatgtgtggctagtagctaccatactggcaccctagttctcgacaaggagtcaggaaaccttttctctaaaggatcagacagtaaatattttaggctttgtggggtacacagtctctgtggcaactaactgattctgccacagtggcatgaaagcagccacagacaatccagaaatgaatgagcactactgtatttcagtaaaactttatttacagaaatgagtagcaggaccaatttagcctgagggccagagcttgccaacccgtt

SEQ ID NO: 107840 - DNA, 601 bp, Human
aaaacaaaacaaaagtgacatcaagacagtctaaccatttactagtttgggtataatttgggcaaaaactccaatcaattttcatcaagtggtacactgtgcactggtgctccgttaggagaagagtttcaagatcaccatccccaagaacttaaaatcaaataaaatgttcattaacagaatttagcttatatagctatatatatcgcctatatagctcatgttgttaaaaagctgatcctcaaaatgaccctgtaagatgtcttccttaaatgatccaatttcagtgacataacatgartactgtgggatataaccctggggaaaaagtgaactttcactggttaatggctaccaagtgcttatcaggtgtcagggtcaagtgtaagggcttcccagggactcccaatttaccctcacaccaagcctatgagacaggttcagactaattttgctcatgacagaacagaggcccagggagatagggcaacttgcctctggttacctaaattgttaagtggtgagacctgcaaatgcattcaggtccatctgacctcagagcgaaaattcttaagaacgactctgtggtgacaggactcag

SEQ ID NO: 107841 - DNA, 601 bp, Human
taaagttttttaaaaaaatacctcttccacaaagctgtctttcttctctaacatttctcgtaatgtctgaagaattttaatgcacagtttttcttctttctccattagtttctttgtatgattaatcaaccttaaagcaaaacatgagacctttagaaagacagtgatttctcttcaagctatatacaaacatcaaaggccataggggaaaaaatttacacaattatttgagaatatgaagcaaaccaggtacatgttttcaaaagttttaagatcacacttcagcttataaattttgtaktacaacacattatttttgtcttacaacaaaatatctcagggcttctcaaacttactcaggtggcattcttttagtgggatacaatactctgagaaacaatgaaatactaatattctcaccccaatatatgaactaaaacaaatttattagagaaatacaaatatttatattatattacattttattatgttatactatattatttttatatactgtattacattaagcatacagtagcagtggctgtatacaactctgcaaccttaatataacaggctgctttccagtttccattcataa

SEQ ID NO: 107842 - DNA, 601 bp, Human
ttaaatatgaaagcacgtttttgagtcctatcttagagaaatatttgctaaaattgcattgaccacctttattttgatcatttgttttccaaatataatttaagtgatgcagagaactaatgcaaagtagaaggcattttgattactgaaacaaacattgattcacatggaatattttgaagcaatgctctttctattaatatctaagtttccattgcatttttttctaagatgggaatgcactttaaaaaacccaaccactacaatctttctggaatttagcatatacataaagtaatayataaaatccttccagttttaaaatatcagatgattagtatttaccgaaacagaccaaaaagttattgaggaacatggtacaaattttgtttaatatctaacataaaagtacagacagctagctaaaaaaaattctctagatttatactttatatttaagtgtatcaccttgggtatcaaacatgctgctagctatctcttaatgagcacctgagctgtcatttttaataacagactgacaattattatctataggttgatatttccctgaaaatcacttgtgaatctcaagttaatatag

SEQ ID NO: 107843 - DNA, 601 bp, Human
ggctatgatcaaaggagtaagaagattaaacaaagaggaaggagttccaatttaaactttggttctagctcttgctgtgtaacctcagtcaaatcacatcacctctctgggactctgtggcatcatctataaaataaggagcttggactaaatttccagatacagcctaaagtgtcctaaaagagaagcatgaagtattttggtaattctattgagaaagtaatcaccacttgctggaacaattgataagtactacccagtagctcctccacaaagatagccggtggcattgaggcttgaytggatttttgcaatctatgattccagatgaagcaaaggtcagggcaggaaaagcctgaggtacattataggtacattgagtaacacagatttccggaggctaatggatgaagacagatgggggtgtgaagtggagaggacaaatggagggcctggaacactgacgctgtgcagagcccctgatggtttctgaagggctctagtgatctcttccctacactattaagggagtccactagcacaggaattgtatccattcatggcccttggcaagctgtgtcattcatatcagtatccccag

SEQ ID NO: 107844 - DNA, 601 bp, Human
ccataaacctgctagacaaagtatactaacctttcttaatagcaatgcaaaaaatttgtaaaacttggctatgatcaaaggagtaagaagattaaacaaagaggaaggagttccaatttaaactttggttctagctcttgctgtgtaacctcagtcaaatcacatcacctctctgggactctgtggcatcatctataaaataaggagcttggactaaatttccagatacagcctaaagtgtcctaaaagagaagcatgaagtattttggtaattctattgagaaagtaatcaccacttgcyggaacaattgataagtactacccagtagctcctccacaaagatagccggtggcattgaggcttgactggatttttgcaatctatgattccagatgaagcaaaggtcagggcaggaaaagcctgaggtacattataggtacattgagtaacacagatttccggaggctaatggatgaagacagatgggggtgtgaagtggagaggacaaatggagggcctggaacactgacgctgtgcagagcccctgatggtttctgaagggctctagtgatctcttccctacactattaagggagtcca

SEQ ID NO: 107845 - DNA, 601 bp, Human
cccccatatttactattttcttagaagtttatctgaatctttacctattttggatgttattcctgtcttatattctgtctgcctatgtcttaaaatttggcgccataaacctgctagacaaagtatactaacctttcttaatagcaatgcaaaaaatttgtaaaacttggctatgatcaaaggagtaagaagattaaacaaagaggaaggagttccaatttaaactttggttctagctcttgctgtgtaacctcagtcaaatcacatcacctctctgggactctgtggcatcatctataagataaggagcttggactaaatttccagatacagcctaaagtgtcctaaaagagaagcatgaagtattttggtaattctattgagaaagtaatcaccacttgctggaacaattgataagtactacccagtagctcctccacaaagatagccggtggcattgaggcttgactggatttttgcaatctatgattccagatgaagcaaaggtcagggcaggaaaagcctgaggtacattataggtacattgagtaacacagatttccggaggctaatggatgaagacagatgggggtgtgaagtg

SEQ ID NO: 107846 - DNA, 601 bp, Human
catgtagtatttgtctttttgtacctggcttatttcccttaagataatgaccttcagttccatgcagcatccacgttgctgcaaatgacatgatatcatattcttttggaagaatcttaaaattcatatggaaccaaaaaagagttggaatagccaaagcaatcctgagtgaaaagaacaaagctggaggcatcaaattatctaacttataatatattgcagggctacactacactaaccaaagcagcacggtattggtataaaaatagacacacagaccaatggaacagaatgaagaatycaggaacaaagccatatatttacagccaactgatcttcaacaaagcagataagaacttacactggggaaagaacaccctctccaataaatgacactgggaaaattggacagtcacatgcagaagaaactggatccctatctctcaccatatacaaaaatcaactcaaaatggattaaagacttaaatataaaacttgaaacgataaaaatactggaagaaaacctagggaaaactctcttggaaattggtctaggcaaataatttatggctaagatctgaaaagcacaggcaacagaaac

SEQ ID NO: 107847 - DNA, 601 bp, Human
gcaattcacttttctgagtctctcttttcacatttgcaatgtggaggtaacactgcctgttctgtgtatgtgttagaattgttgaaaggtagcaaaatattctaaaatattttgaaaacagcaaagtgctatagattccaagcatttttgttctattcatttgcatttaaattgccctacacagtaatattaatcagccacaagtaaatactacatctacattctagatgttatttctcactgtcaataaaagggtcattgtgataggcagaataatggccctccccaaagatgcacatgycctcatgatccctttcctagtcaccagaacctgtaaacatgttacctcacatgccaaaagggattcggcaggtgtgatttgagttaaggctcttgagatgggaaaattataccagattatccaggtggttccaatgtaatcacaggtgttcttataggaaggagacaggagcatcagagtaggacgagatgtgacaattgtgggaaggggggcgggaaatagggagtggagattgaaaggtactacactaccggctttaaagataggggatggggccacgagccaaggaatgcaggtggc

SEQ ID NO: 107848 - DNA, 601 bp, Human
gcaactcaccactacacagatttggacctctaaagtatctttaaatacacagaacgaaggcacagtactttaataaagctattctcttcatcagcacacacatactatcagatattgtgtgtgtttgtgtgtgtgtgtgacagagacaggggaagagagagagagagaggagagagagggagagagaaagagagtgtcatggaaataagagtagaacaaaatggctttaaggatagagaattttagaaatcacattgccctcaggctgggcacggtagctcacagcactttgggaggctgmagcaggtggattgcttgaggtcaggagttcaagaccagcctgaccaagatggtgaaaccctgtttctactaaaaatacaaaaattagctgggtggcaggtgcctgtaatcccagctactcggaaggctgaggcaggagaatcacttgaacccaggaggtggagatcgcagtgagccaagatagcatcactgcactccagcctgggtgacagagcaagactctgtctcaaagaaaaagagaaatcacactgccctccagccattttgaagcattccttctcttctctttccctaccccaat

SEQ ID NO: 107849 - DNA, 601 bp, Human
ctttcatgatttatatatgtttttccctttttatgagagaaataacttgtaatgctctataaatcttgatgaaaatgtatactaaagagtacaagatgcgggaaattgacccccaaaatccttaaaaccaaaccaaaccaaaccattcctctgagtgcagtccttatttcctgctccaacctcatcagcccacctctatccaatccacgtaagctctttctgtctccattagcaactcaccactacacagatttggacctctaaagtatctttaaatacacagaacgaaggcacagtactktaataaagctattctcttcatcagcacacacatactatcagatattgtgtgtgtttgtgtgtgtgtgtgacagagacaggggaagagagagagagagaggagagagagggagagagaaagagagtgtcatggaaataagagtagaacaaaatggctttaaggatagagaattttagaaatcacattgccctcaggctgggcacggtagctcacagcactttgggaggctgaagcaggtggattgcttgaggtcaggagttcaagaccagcctgaccaagatggtgaaaccctgtttctac

SEQ ID NO: 107850 - DNA, 601 bp, Human
aaaacatctctgttgccctatagattatatgtatgtcagtgtaacattaacagataggaatatagtcatggggaaattgtaactgtcattctaaataggtcaacttctttgactagaatgtaaagagaataactgtaaattaccatttccacaggcgatccatgaatattttcaatgctcgttctcttctccaattctaaagtacagaagctatgaattttatatacttaggattggagttgacagacatctctactttcatgatttatatatgtttttccctttttatgagagaaataayttgtaatgctctataaatcttgatgaaaatgtatactaaagagtacaagatgcgggaaattgacccccaaaatccttaaaaccaaaccaaaccaaaccattcctctgagtgcagtccttatttcctgctccaacctcatcagcccacctctatccaatccacgtaagctctttctgtctccattagcaactcaccactacacagatttggacctctaaagtatctttaaatacacagaacgaaggcacagtactttaataaagctattctcttcatcagcacacacatactatcagatat

SEQ ID NO: 107851 - DNA, 601 bp, Human
tatagtctaacaagtgaccaaaccagcccagcaactgaaaagagtaaatttctaaaagcaactgttgcttttatacccactttaatggttgaaagtatttttgcctaagtgaaaatataaaataaaaattccaaagtggaagagcatgctaataatgtatactaaagcagatgtcttattataagaacacatcaactcattttcatatttccaaccacttagcgacatagcacttgtgttaaaacataacacagctgggcgtggtggctcaaacctataatcccagcactttgggaggccraggcaggtggatcaccttaggtcaggagttcaagaccagcctggtcaacatggtgaaaccccatctctgcttaaaaaaaaaaaaaaaaaaaaaaattagctggacatggtggcagccgcctgtaatcccagctactcgggaggctgagacaggagaatcacttgaacccgggaggcagaggttgcagtgagctgagatcacgccattgcactccagcatgggtgacaagagtgaaactccatctcaaaaaaataaaataaaataacacatgcaggtgcacacaaccacaatatacatggg

SEQ ID NO: 107852 - DNA, 601 bp, Human
actttgtaatttttttgtaataatgaggttaaaatgaatataattcatccagtaaatttatcacttttatagtctaacaagtgaccaaaccagcccagcaactgaaaagagtaaatttctaaaagcaactgttgcttttatacccactttaatggttgaaagtatttttgcctaagtgaaaatataaaataaaaattccaaagtggaagagcatgctaataatgtatactaaagcagatgtcttattataagaacacatcaactcattttcatatttccaaccacttagcgacatagcacwtgtgttaaaacataacacagctgggcgtggtggctcaaacctataatcccagcactttgggaggccaaggcaggtggatcaccttaggtcaggagttcaagaccagcctggtcaacatggtgaaaccccatctctgcttaaaaaaaaaaaaaaaaaaaaaaattagctggacatggtggcagccgcctgtaatcccagctactcgggaggctgagacaggagaatcacttgaacccgggaggcagaggttgcagtgagctgagatcacgccattgcactccagcatgggtgacaagagtg

SEQ ID NO: 107853 - DNA, 601 bp, Human
tcaatctgtccctctgcaaacatttattgagtagcaactaagtgcagggcacaattctagacatagaaatacttcagtgaataagatcaacagtctctgctttcaaatagtataccattttgtggagggtgggctggaactggagagaaatccagtactctaccctcctagattctcagcactgaaaggccttttaggcattctttccccttacattatgcatcagccctatccccaaggagtttctaacttatttaaaatggcagtacatacaccaaagaaaaccttcataaggcatgayatgaaaaggtctacactaataagataaatataatttgataagtgctgaaatgattacaaattagaatgatatggaattaaactaaatgggaaatacttcctggaaaaggttttaggtttagatttaggtggaaatgatgaacatgataacttaataatacattgattttagtgattctccttttagttccttattctcttctccttttttttcttttaatgctatccaagtttgttttttaatcacaatgccatttttcacctacaatcattagctaccaaatgtcctatacttactaga

SEQ ID NO: 107854 - DNA, 601 bp, Human
agctgggactacaggtgcgcaccaccatgccaggctaatttttgtgtttttagtagatacggggtttcaccgtgctggccaggctggtctcgaactcctgacctcgtgatctgcctgcctccacctcccaaagtgctaggattacaggcgtgagccactgcgcccggacagcctgtgattcttaccaggtcattttacctactgtgcctttctttttatctataaaatggagattaaaatactttctttcctcagagagttagtgtgaagatccaagcagacacagacacgttgttacctygcaaacagcttctctagatatgcctagtcaatagcagttaaataataacaacaataatagtgtggttttggtgcctcatataccaggttgcaaatattctctgtgaggacctgttcaaacagtatcccgaaattagtgtatttgatagaaaaggtgaaatgtatcaggcccagtcttatccagagcctttctattccttctcctctcaaccgtaacaccattgagcagttcagaacaccaatttcatcctgtggcaggagagcctgatgctgcttgagatcaacagtacttggactctgc

SEQ ID NO: 107855 - DNA, 601 bp, Human
cacccaagtatgagattactgcccggttattgcttaccttctggtgaatgtttccctgattactatactctggcactgtcagagaaaataaaatcaactcaatacctgggatggagttatataagtacatgtctctgagtcagtatcttcaacatcattccagctatgtgatattaattataagcatttgattagattttaattgtccatgagtcctcatttaaattattttgtgccacagactcattttatcaagctgccatgctgtgctcatttacatatcacatttgttttctgtatyccatgactgtataagtaatatagtctatattgagttttaattaaaaacccagccaaaagccagcgataactgagataagatagacctaacaacttcaccgagcaatctgcaaatattcataatgttctgtgttgttttgttttaagcaactaagatttatccaaaaatgtttaagatgttcaagcaccagatggaatatgcaggaaccaggcctactctgaagaaatcagtaaatggtagatactcaaaatcattatacataaaaaatatcttaagttggcttctgttatttaacgtaaa

SEQ ID NO: 107856 - DNA, 601 bp, Human
atgctgcagtctatttgttgaatgaataaatggctgcatacaccagggtggtagatggcaagaagcctaaagaagcatcctcaaaggtgcacccaagtatgagattactgcccggttattgcttaccttctggtgaatgtttccctgattactatactctggcactgtcagagaaaataaaatcaactcaatacctgggatggagttatataagtacatgtctctgagtcagtatcttcaacatcattccagctatgtgatattaattataagcatttgattagattttaattgtccatgmgtcctcatttaaattattttgtgccacagactcattttatcaagctgccatgctgtgctcatttacatatcacatttgttttctgtatcccatgactgtataagtaatatagtctatattgagttttaattaaaaacccagccaaaagccagcgataactgagataagatagacctaacaacttcaccgagcaatctgcaaatattcataatgttctgtgttgttttgttttaagcaactaagatttatccaaaaatgtttaagatgttcaagcaccagatggaatatgcaggaaccagg

SEQ ID NO: 107857 - DNA, 601 bp, Human
actgtatatttcaaaataactacaagacaggattttttgagttctcaccataaataaatgatatgtgtatgaggtggtggatatgctgaataccttaatttgatttttatgtaacgtaaacatgtatcaaaatatcacacagtaccccataaatatgtacaattgtgtccataaaagttgttctactaattgagcaataattggaacaatttaaaatatgctgaattacttatccctagaggtaacattaaaataaatcaggaactactatacacaataaaaatgattccaaaaaagctayatatggcatttaaaatgcttcatatgttctatttagtgtacggtcgaggtcacagaagaccaataaaactttatcaatgtcattaaataacacccattggtagacagtgttgttatgttccattaaagattttccaattatcttcccatgaaaaagtatgattagaaattaagatgcatcaaatatcactggagaacaccttggctatcactgtccaattcaaaataattatttggttctaaagtttatagcttcacagaaagaagaaacagttatctaccttgggactaaatcagtcaa

SEQ ID NO: 107858 - DNA, 601 bp, Human
tttcaaaattagtcacttgctgtattttgcatcattagcttcacatgaactgaggattctttgctaacagggttaggatcaatatctgtgtgaagcatttttcattcttaaggttaaaaattgttttattaagagaaataagttctggtgttctactgcacagcaaggtgactatggttaactctactgtatatttcaaaataactacaagacaggattttttgagttctcaccataaataaatgatatgtgtatgaggtggtggatatgctgaataccttaatttgatttttatgtaacrtaaacatgtatcaaaatatcacacagtaccccataaatatgtacaattgtgtccataaaagttgttctactaattgagcaataattggaacaatttaaaatatgctgaattacttatccctagaggtaacattaaaataaatcaggaactactatacacaataaaaatgattccaaaaaagctatatatggcatttaaaatgcttcatatgttctatttagtgtacggtcgaggtcacagaagaccaataaaactttatcaatgtcattaaataacacccattggtagacagtgttgtta

SEQ ID NO: 107859 - DNA, 601 bp, Human
ttgatctcaactaagataaattcctaatccctgatacggcccttgaagagagcaaaagatgtaaagaaatctcttctattctaaatataaatttcacatgatctagataaaactgaagaaatagaaatttcatcacttatcaatgagttagtatattttccaatttattaactctcatttaacaacggagtattctcacttcaaaaaaataaagaaaaagcaaaagaaaacccaaagctttatgaaaaccagagaatggagcttctctctcaagattttatgatgtaaatttttaaaaaakatgttgaacagctagatttaaggaatatcgaacatttcagtttaaatgttgaacacttaaggaattgtccctagtttagatgctgaacaggtggtttactaagaaagaaaagatactatggcactgtaatcaaacagtctttcaaaattagtcacttgctgtattttgcatcattagcttcacatgaactgaggattctttgctaacagggttaggatcaatatctgtgtgaagcatttttcattcttaaggttaaaaattgttttattaagagaaataagttctggtgttctactgcac

SEQ ID NO: 107860 - DNA, 601 bp, Human
tgaagcattgcagaaatattcagcatgcttttcccaggaagtattcctggcaagaatcagcaaaattgtatgcaaacatgtgaatttcattttgctttcagaaaatggcagatgtggaagagagatgacacttgccaatagatctcagaggaaatggtttgatctcaactaagataaattcctaatccctgatacggcccttgaagagagcaaaagatgtaaagaaatctcttctattctaaatataaatttcacatgatctagataaaactgaagaaatagaaatttcatcacttatcartgagttagtatattttccaatttattaactctcatttaacaacggagtattctcacttcaaaaaaataaagaaaaagcaaaagaaaacccaaagctttatgaaaaccagagaatggagcttctctctcaagattttatgatgtaaatttttaaaaaagatgttgaacagctagatttaaggaatatcgaacatttcagtttaaatgttgaacacttaaggaattgtccctagtttagatgctgaacaggtggtttactaagaaagaaaagatactatggcactgtaatcaaacagtcttt

SEQ ID NO: 107861 - DNA, 601 bp, Human
tcttaaatctgtttgtagatgcccgcaagctgctcggtgcattttggctgctgtcagcaaaatgcgcacaagagaagcatacacagaaaacctttgcacatctcatctatgaaaagattaaagacttagatatgttatgggctgaattatgccttaacctgcaacaccttagaatataaccgtattcagaaataagatctttgaagaggtaattacattaaaatgaggtcattagggtggaccctaattcaatattactagtggccctataagaagaggaaatttggacacagacacacawacagaaggaaaataatatgaagacacaaggagagggtggccatctacaagccaaggagaaacacctgggacagttccttctctcctggcccttggaaggaaaccacctgttgacccctgaatctctgacttccagcctccagagctataagaaaacaaatttctgttgtttaagccactcgatctgtgggactttgtgatggcagccctacaaactaatacaggtggcatcatttcttcctctgtgtcttcccacagaagatgatacaatacatggcagattccccctaggtgtcagtta

SEQ ID NO: 107862 - DNA, 601 bp, Human
ttattccaatcaactggtttttttcaaccttaacctaagataggaaacaagagaaaaacctcttttctgtttcttccatgggtttaaaccaacttaaacaataatgtttagaaatcacttcttaaatctgtttgtagatgcccgcaagctgctcggtgcattttggctgctgtcagcaaaatgcgcacaagagaagcatacacagaaaacctttgcacatctcatctatgaaaagattaaagacttagatatgttatgggctgaattatgccttaacctgcaacaccttagaatataaccrtattcagaaataagatctttgaagaggtaattacattaaaatgaggtcattagggtggaccctaattcaatattactagtggccctataagaagaggaaatttggacacagacacacaaacagaaggaaaataatatgaagacacaaggagagggtggccatctacaagccaaggagaaacacctgggacagttccttctctcctggcccttggaaggaaaccacctgttgacccctgaatctctgacttccagcctccagagctataagaaaacaaatttctgttgtttaagccactcg

SEQ ID NO: 107863 - DNA, 601 bp, Human
ttgcatattctcctttgattggcataagagaactggttaaaatatactagaagcaggaaaactttacacacaagaaaatacggtaatgctgtcttaaaatatcagaaaagtattttataaatatttttaagatttaaaaacaaagcttaaaattataggatatttgtgaaaggatatttacaaaagtaatactatgacatgagtcattttcttccttaaaatcatgacaatttattatttcattgttatctcccacatacaggtgcaaggaataagtcattgaggcttggctatatcacgrgctaaaagcagtgttcttgtttgtgttatgttccgtaaaattcactctatctttaggtagatattaaaagcaaccaccaacattttaaaaactgaccacttgccaaaacaaatagcaaaattgtgtatgtgtggtttacacaaacttgtgaacagtataaaacactcctccagaaaagggacatttttcaatgaaatattttttctttttttgagacagggtctcactttgttgcacaggctggagtgcaatggcacaatcatgactcactgcatcctcaatctcccaggctcaagcagt

SEQ ID NO: 107864 - DNA, 601 bp, Human
atgtgtaataaactggagcagaaacgaattgtagagaaattcagcagcagacaagtataaatagtggcttcttaaaatgctccttgattttttcattcgtcttagctttgtgacccatctaaagcaatgctctgacaattgttattcttgtgcagattagattgcctcttcacttccagaataatgtatctcagatttttaaaaggtgatattttctcacatacacctttgattttctaccatgttctaagcttcatgtttactgtatttacacacacacacacacacacacacacacaactgtgtatctgaatgattcaagacaattctcttttcctgtacagtcagtgaagtaccccaccacttagaacctcataggaaagattataccaacaccaaaacaaaaaatgatcaatcatcttgatttagatatggaatagatacttgcttgaggacagaaggaattactgtgagtctatcttgaagtttatttttctgaaattgcatattctcctttgattggcataagagaactggttaaaatatactagaagcaggaaaactttacacacaagaaaatacggtaatgctgtcttaaaat

SEQ ID NO: 107865 - DNA, 601 bp, Human
catgtgtaataaactggagcagaaacgaattgtagagaaattcagcagcagacaagtataaatagtggcttcttaaaatgctccttgattttttcattcgtcttagctttgtgacccatctaaagcaatgctctgacaattgttattcttgtgcagattagattgcctcttcacttccagaataatgtatctcagatttttaaaaggtgatattttctcacatacacctttgattttctaccatgttctaagcttcatgtttactgtatttacacacacacacacacacacacacacacacgtgtgtatctgaatgattcaagacaattctcttttcctgtacagtcagtgaagtaccccaccacttagaacctcataggaaagattataccaacaccaaaacaaaaaatgatcaatcatcttgatttagatatggaatagatacttgcttgaggacagaaggaattactgtgagtctatcttgaagtttatttttctgaaattgcatattctcctttgattggcataagagaactggttaaaatatactagaagcaggaaaactttacacacaagaaaatacggtaatgctgtcttaaaa

SEQ ID NO: 107866 - DNA, 601 bp, Human
ttaaccattcatttatcacatacactggtcatgtgtaataaactggagcagaaacgaattgtagagaaattcagcagcagacaagtataaatagtggcttcttaaaatgctccttgattttttcattcgtcttagctttgtgacccatctaaagcaatgctctgacaattgttattcttgtgcagattagattgcctcttcacttccagaataatgtatctcagatttttaaaaggtgatattttctcacatacacctttgattttctaccatgttctaagcttcatgtttactgtatttacacacacacacacacacacacacacacaagtgtgtatctgaatgattcaagacaattctcttttcctgtacagtcagtgaagtaccccaccacttagaacctcataggaaagattataccaacaccaaaacaaaaaatgatcaatcatcttgatttagatatggaatagatacttgcttgaggacagaaggaattactgtgagtctatcttgaagtttatttttctgaaattgcatattctcctttgattggcataagagaactggttaaaatatactagaagcaggaaaactttacaca

SEQ ID NO: 107867 - DNA, 601 bp, Human
gggaaccaagcaagtccatttctgtgtctggttcccttggattaccataaatattcattgggctttcctaatgcacctcactgtattctgcccactgaaatatcggaggcagtgagaagtacaaacacgcataacacactacagcattaaagtgtgtaagacatttcaataaatgtactgagggtaacagcagtgaacagtaaaatcagacaaaagattttcacattaaagtctataactcatttttaaccattcatttatcacatacactggtcatgtgtaataaactggagcagaaacraattgtagagaaattcagcagcagacaagtataaatagtggcttcttaaaatgctccttgattttttcattcgtcttagctttgtgacccatctaaagcaatgctctgacaattgttattcttgtgcagattagattgcctcttcacttccagaataatgtatctcagatttttaaaaggtgatattttctcacatacacctttgattttctaccatgttctaagcttcatgtttactgtatttacacacacacacacacacacacacacacaagtgtgtatctgaatgattcaagacaa

SEQ ID NO: 107868 - DNA, 601 bp, Human
gtttttatcttaaatacccttaagaataagataaaagatagaggtctgggaaccaagcaagtccatttctgtgtctggttcccttggattaccataaatattcattgggctttcctaatgcacctcactgtattctgcccactgaaatatcggaggcagtgagaagtacaaacacgcataacacactacagcattaaagtgtgtaagacatttcaataaatgtactgagggtaacagcagtgaacagtaaaatcagacaaaagattttcacattaaagtctataactcatttttaaccatwcatttatcacatacactggtcatgtgtaataaactggagcagaaacgaattgtagagaaattcagcagcagacaagtataaatagtggcttcttaaaatgctccttgattttttcattcgtcttagctttgtgacccatctaaagcaatgctctgacaattgttattcttgtgcagattagattgcctcttcacttccagaataatgtatctcagatttttaaaaggtgatattttctcacatacacctttgattttctaccatgttctaagcttcatgtttactgtatttacacacaca

SEQ ID NO: 107869 - DNA, 601 bp, Human
taaaatggacactggaatgtgaggattaaatctccatataaagcacctctaacatccttaaaatgattcctggtacctatgaagattcaatacatgatggctagtccatttttcatcacagcacactgtgtatttgtttatctatttatgtatcatctgctccccctccagaatgtaagctccaatataagaatggaccatgccatttcattgttttgttttctttcacaactgtatcttcagtaactggttcagctcctggcacatggtaggcatttaattaaatttttatttttgcagyttaagtctacctccaatatttctgaaaaggaatttatatgctttgtagtcccattaagaatctaaatccataagagagaaggagatcagagaatcaggatacagacctcaaaagctcacctggctcaactgggattttaatttaatttaacagatgatgcaggttagagccaagggtcctaggatcccacagccaataagtgatgtagcaagggccccaatgtcccagaccagcacacttaatgtggtcagaaaaccagctaacatctcaaacacttattctggaattttctacacctga

SEQ ID NO: 107870 - DNA, 601 bp, Human
caggaccctgtcaaagatgcattctcttaacaccccatagaaaacacaaacccatttctcttcactgttcttgctctccttttatcctgagacaggtagcagaataatttcctattaaagatcctataatcacgctgcctgggttctaatgccagctgggtcatgggctggttctgtctgtggaacctggaacaagtaaaataaccaaacgtctctaaacttcagtttttccatctgtaaaatggacactggaatgtgaggattaaatctccatataaagcacctctaacatccttaaaatgattcctggtacctatgaagattcaatacatgatggctagtccatttttcatcacagcacactgtgtatttgtttatctatttatgtatcatctgctccccctccagaatgtaagctccaatataagaatggaccatgccatttcattgttttgttttctttcacaactgtatcttcagtaactggttcagctcctggcacatggtaggcatttaattaaatttttatttttgcagtttaagtctacctccaatatttctgaaaaggaatttatatgctttgtagtcccattaagaatct

SEQ ID NO: 107871 - DNA, 601 bp, Human
gcttgcccctttggagagtctgggtttgccgttaggttggggggaaatattagcaaacacacccacagatctcaagccatgttttccagttgcatattccagttatgaacctgacattctgatctcaacctgaaagattcctatgactttcaatggttccagctcctgagagagggatgttacttcggggcctctgcaagccctaacactaacaaactgttcgaaatagaaccacaaaggatgttggatttttgtttagagctacaaaagtaaatataagattcaatgcacttgtatgttygaggaacactgcatctatcccagaaaaatagtttctatcctatcatgtcctcttccatatctttcttagccacttataacaatgctcatctgtatgaaaacctgaaggaagaagttgtactgaaatgccatttcttcacaggtcactgaaaacctgctcaaaataactctttacattgtacaagaatgaaatgttgattacatcttatgtccaggtttatcgtaaatgagattccatctccctccaaattaaaactacattttcccttttgatattgctgtcatcaagaagctcagaata

SEQ ID NO: 107872 - DNA, 601 bp, Human
ctaattttttgcccaaatgtaaaaatatctctaaaattgataatgaaatacaatacatgctaaacaaattcctacacatattttgtttttaaatttttaaaaaacaggtctatgtacaggatcttgaactcaagtacatggcaatgtctgcagattttttcaaaaaaataaaaaagattggtttaatctatacaagggctgaaaacaaagtacacaaaccagatattttcagattccatgacttgtttatatctccaccaacattacaatattatcaaaataaatagcataatactacagyagttaaaattaagcaggttatcaattgtataaaaatatcactaaaagagtattctaaacaaaatgtgactgttactgtaacaagatttagaaaatgttttctttgatttcatgtgactcaaaaaattatttataattatggagtgagaactcaaaatatagatggaataaaaataaaacatttctataatttaaaactaaacctgagaaacactgagtggaataagtcattggtgagaggatgacacctagtgatgagctgtgatattgcagcccagctctacaggccgtccattcacca

SEQ ID NO: 107873 - DNA, 601 bp, Human
tttcaaatactccatttttcaaacgaataaggctaatagtatctctgccatttcaaaggagttttcaaattgggaaggtgtgggaatgatacatttcagatactacatagagtataaccaactgacaaatatgagctagatattcctgaacatgagccacagggggtactatacattctaaacctcatatactcatcattttatttgcagggattaatcaaaaaatatgcacaactatgaaatattatgtacatctggtttttaagtaatgccattggatttataaataatgaaccattayatttgtatataaatatttacccttgccttattattattacactgctaattttttgcccaaatgtaaaaatatctctaaaattgataatgaaatacaatacatgctaaacaaattcctacacatattttgtttttaaatttttaaaaaacaggtctatgtacaggatcttgaactcaagtacatggcaatgtctgcagattttttcaaaaaaataaaaaagattggtttaatctatacaagggctgaaaacaaagtacacaaaccagatattttcagattccatgacttgtttatatctcc

SEQ ID NO: 107874 - DNA, 601 bp, Human
cataatcacatgctgttgttggcagagccgcctcagtggcttggcagtctgtgtctcctccaatcatgccccgcagctttaatctgcacggagtgtgcacatgtactgtcacatgctttgggactttcatagcagcaaataaaacagggaccatttccctactggtagaaacagttcattaaaaccagtcacacagtacacaagattataacgggatagaaggcatatgtaacacacatgcttctaaccaagcaacagagaaagcaaatttcaaatactccatttttcaaacgaataaggttaatagtatctctgccatttcaaaggagttttcaaattgggaaggtgtgggaatgatacatttcagatactacatagagtataaccaactgacaaatatgagctagatattcctgaacatgagccacagggggtactatacattctaaacctcatatactcatcattttatttgcagggattaatcaaaaaatatgcacaactatgaaatattatgtacatctggtttttaagtaatgccattggatttataaataatgaaccattatatttgtatataaatatttacccttgccttatt

SEQ ID NO: 107875 - DNA, 601 bp, Human
tccttccccccaccaaattatcactgtatcaatttctttattctcactcatagataattgcattgaaaaataaaatactggcagccttttaagcagattctcaaaaacaatggcaaaatcttttttttttttttaaaaagcctactgctaactgtctgtaagaaaacatttttctctacttgtgaaggttggtactcccccacccctacattatttatccaggttatataatgcttaaactcagctcttcaggggcatgatgatgtatacataatgcaaatatccttgctggaattacaawggcaatttatcaatttatgtgcagctaatcaacccatttgctttctactgtagagcagtaaaagcttatctcatgcagactcacggatcgttcaaagcaatctaattgaatttcagggccaagagcattgcacaacacgtgacgtgtctccagtggagcacagtgccagacactgcaggcgttacataatcacatgctgttgttggcagagccgcctcagtggcttggcagtctgtgtctcctccaatcatgccccgcagctttaatctgcacggagtgtgcacatgtactgtcacatgc

SEQ ID NO: 107876 - DNA, 601 bp, Human
aactagaagcctcaaccaaatatagggttaatttctgacggttccttaaattgatcagctataatctcacaaaaaattaatttgttcaacattaaaaggccatctgagctcacaacttagttttaatttaattgaactcacgatttgacactttttctcgctaatcttccttccccccaccaaattatcactgtatcaatttctttattctcactcatagataattgcattgaaaaataaaatactggcagccttttaagcagattctcaaaaacaatggcaaaatctttttttttttttwaaaaagcctactgctaactgtctgtaagaaaacatttttctctacttgtgaaggttggtactcccccacccctacattatttatccaggttatataatgcttaaactcagctcttcaggggcatgatgatgtatacataatgcaaatatccttgctggaattacaaaggcaatttatcaatttatgtgcagctaatcaacccatttgctttctactgtagagcagtaaaagcttatctcatgcagactcacggatcgttcaaagcaatctaattgaatttcagggccaagagcattgcac

SEQ ID NO: 107877 - DNA, 601 bp, Human
taactagaagcctcaaccaaatatagggttaatttctgacggttccttaaattgatcagctataatctcacaaaaaattaatttgttcaacattaaaaggccatctgagctcacaacttagttttaatttaattgaactcacgatttgacactttttctcgctaatcttccttccccccaccaaattatcactgtatcaatttctttattctcactcatagataattgcattgaaaaataaaatactggcagccttttaagcagattctcaaaaacaatggcaaaatcttttttttttttwtaaaaagcctactgctaactgtctgtaagaaaacatttttctctacttgtgaaggttggtactcccccacccctacattatttatccaggttatataatgcttaaactcagctcttcaggggcatgatgatgtatacataatgcaaatatccttgctggaattacaaaggcaatttatcaatttatgtgcagctaatcaacccatttgctttctactgtagagcagtaaaagcttatctcatgcagactcacggatcgttcaaagcaatctaattgaatttcagggccaagagcattgca

SEQ ID NO: 107878 - DNA, 601 bp, Human
atccagtcacctctgagcagtgcgaccccaagcagttcattatgcttcttgatgcatccattttccctttggttaaatggaataatacctactgcagatagttatggaaattgaatgaatgggaaagtacatgtgcaagttaaatctcacacgtcatttagataatctattaaattgaaaaattgttaaattctgggttttagtacatattagaaaataatctactcacatcaaaatcaggatataagaatttaccttaagcaaattcttgagaagattttcaaagaatagaagaaaaaamgccatgcttccacggcggggggggaaccccacaacaacaccggttttgctacagttcaagactgttttacctaaaatcgcaaaagaactgtacacctaatccctgttgatataacaaaatggaagcattctgcataacatttcgatgccttgggtttcagctcagtgtctgaacaattctaacgagcattgtctcacaaggtcttttggttaaaaacataaatcctatttggagtaaaatagaagtagagggagctgggatagccaagctcacatcattgattttggttgttccccagag

SEQ ID NO: 107879 - DNA, 601 bp, Human
tcttcgtaaaaagagtgggagggaggaatgaagaaaggagagatgctcagggagtcccatccccaacagtaatggatcatatctcatcttttaaagacgcagataggaaaggaaacaacaacaacaacaaagccagactcaattatgtcagggtaagggattagctagtccctttttattattttgcaaagatgcagcagcgagttatattccctgatgataatgagctatccctacatcactaactcattaaaccaactctgaattcactcattaacaaagttactccagctagcatcartttaagacctggaggctagcctttttatagcagatgccatttactgaattacatttcccactatattcttttgactactataaaatactacagcgtcagacacagaatattttatgtctattctagcaagatatattttctattaaagttttactaagaaccaaaaagaataaactatgtttttacaatttgatttgaataaacaggatgaacactatatagtataaatactcgaaactttcagttaaccaacctgtataatgctgatttaattccctgaagattttttagatattatat

SEQ ID NO: 107880 - DNA, 601 bp, Human
tcaggggcccctcgagtctttccaaagcttcagccaggatgctttggtcatcaagcatgtaggtttacagacttaatttggccttttcaaacactttcctttaaaacaaatatctgtggtacaaaacaagacgatcttcgtaaaaagagtgggagggaggaatgaagaaaggagagatgctcagggagtcccatccccaacagtaatggatcatatctcatcttttaaagacgcagataggaaaggaaacaacaacaacaacaaagccagactcaattatgtcagggtaagggattagctrgtccctttttattattttgcaaagatgcagcagcgagttatattccctgatgataatgagctatccctacatcactaactcattaaaccaactctgaattcactcattaacaaagttactccagctagcatcaatttaagacctggaggctagcctttttatagcagatgccatttactgaattacatttcccactatattcttttgactactataaaatactacagcgtcagacacagaatattttatgtctattctagcaagatatattttctattaaagttttactaagaaccaaaa

SEQ ID NO: 107881 - DNA, 601 bp, Human
atatgagtcactgtgaaagaaagtacattaaagactcagattttgcccctaagtagcttcctttctatggtataaatactcaaatagaaactccagttaaccaacctgtataatgctgatttattttattacctgaagatattttttgggaggtggtgcattttcaatagttatacaaaactgacattaatatttagttcatttgcaaagaaaagttcacacactcttaactgaagttcagaaaaccatgatactgtattattatttatttttataagtgcagcgcatgaaaaataatttmtattaattatgtaatataaagagtaaaatttaagataaaaataccttaatagctgtcaatcatatacttggtaatgcactatgacagctgaacaattaagaatgcgtttctagaaaatacatgttctgcaaagttgcatgtaccctgttattaactgtcaatatttttcagattcattatatgcagtcaggggcccctcgagtctttccaaagcttcagccaggatgctttggtcatcaagcatgtaggtttacagacttaatttggccttttcaaacactttcctttaaaacaaatatc

SEQ ID NO: 107882 - DNA, 601 bp, Human
tggtccccaaggtctgagttccagccacatgggacctctcatctaagttttaagttacttctctttgctcctgatgtaggggtgagatctgcttcatgaaatggctatctttgtgacactttagtgtctttcttttcatctttcatttcttcattcctagctatcaattcttcatattaaattttttgttaaaataatttgtggatttttgtctcctgattcaaacctgattgatagaccaaccaagaaaatctttctctttattttttaagcacatactatatctatatatgaatttgaytgattagatatttatggggtatggatcttctataggctgatataactttgaaaaattatagcagaacaagtcaggaatcaagtagaattagtttatgtaaggaatataacatgctcctttttagagcatctggataaattatttcctgaaccaaacatcacattgaagtagcaatatgagtcactgtgaaagaaagtacattaaagactcagattttgcccctaagtagcttcctttctatggtataaatactcaaatagaaactccagttaaccaacctgtataatgctgatttatttt

SEQ ID NO: 107883 - DNA, 601 bp, Human
tgacaaaataatctatacatcaaacccctgtgacatgcaatttacctatataacaaacacatgtacccccgaacctaaaataaatgttgtcggggaagggggggcgggaataaatacaaataaaaaataaagtagtgctaagagaaaaatctgtatcctcaaaacatccatagaaataaaaataaatgtcatacccaaaaataaaaaatagcaaaattttaaaccaactcattaaatatagaagcatggtgtaacgaggttgaaaagaaatacaaacagcactaatttttaaatttttaaratttaacaattttttaaaaacttgctttctgagaaaattaaccagcagaaaccctagtaaagaaagaaggaaagcctgaaatactaagtaaaacattgcaagaaggaaataactaaagaaacagaaaaaaattaaatgatcacaagattttctatgatcaacaagatttttcaactacacgtaaacttttttgaaagactgcataaaacgaataaatttctagaaaaataaaatttatcaaaattgaacccaaaagagacagaaaatctaaagggaccattttcatgtaataaataaagg

SEQ ID NO: 107884 - DNA, 601 bp, Human
gaactatgcttattaccagggtgacaaaataatctatacatcaaacccctgtgacatgcaatttacctatataacaaacacatgtacccccgaacctaaaataaatgttgtcggggaagggggggcgggaataaatacaaataaaaaataaagtagtgctaagagaaaaatctgtatcctcaaaacatccatagaaataaaaataaatgtcatacccaaaaataaaaaatagcaaaattttaaaccaactcattaaatatagaagcatggtgtaacgaggttgaaaagaaatacaaacagmactaatttttaaatttttaaaatttaacaattttttaaaaacttgctttctgagaaaattaaccagcagaaaccctagtaaagaaagaaggaaagcctgaaatactaagtaaaacattgcaagaaggaaataactaaagaaacagaaaaaaattaaatgatcacaagattttctatgatcaacaagatttttcaactacacgtaaacttttttgaaagactgcataaaacgaataaatttctagaaaaataaaatttatcaaaattgaacccaaaagagacagaaaatctaaagggacca

SEQ ID NO: 107885 - DNA, 601 bp, Human
agaatatatataaggaatataaaggggaaaggaaaggtgagagatgcaagagcaaagtttatcaataaatagcactcatggattatacaaacaaattaaaatcattataaaaaaatttttatatgcactttttaacatgatgaaatcacctctataaaggaatgctgcatagcaaaaagataagaaattcaggaagaaattgtggaaaaaataggagatgaacatttaaaaagtatttctttggaaatgaataaataattggaagggacacaaataagctcgacactacagcaaacaaagrgatggagaggatagatatgagaaaaaaataaaatgggtatttcaaaaatctcttcaaaagttaaaagagaacgtaaaagaaaaaaaagacagtgaatggaagactcagcatatacataattggagatctgaagaaggaaacaaaagaaatggaagttaacaaatagttttaaaatatataatgtaatagaattatcttaaatgtaagaatatttgaagagtataacattgatgacaagtaagaaaactaggaactagttttttaaacttcaaaagatcccttgcatctagaaaataaact

SEQ ID NO: 107886 - DNA, 601 bp, Human
gtgtaaacatgtgtgggaccacgtttgggacatgcgtgaggccaacgcatagacagctggaggctggtagaacatagctacaaatcaagtcttgaagtctaagccatctctgtccaccattttcgccctcaggccccatcagtttctttagttctgtcctcctcaacgtctttccacaccatcttactattcctgacactaaaatctccttctctgaaacatctgtcatcctaaacaacctcccagtacctctctgcctcatctactcttcatctcatttccaccctcagtcaaaaacatmttttgctcttgctttacctctgtgaaaggaaaataaatcccaggaccccaaaatgactaagccaacgggaaaatcaagctgggaactgtgtcaggcaaacctgcctcccattttattcctaaataagatagctacaaagataaaaaaaaaaaaaaagctgcagatctccctcacaatttgcccacaagaagattccttgtgggcctccagacctttaccctaaaacaagtctgttgaatttcactctggcaatgtaaattgatagcttatcttcacaggtgcgggacaaaggacaaaact

SEQ ID NO: 107887 - DNA, 601 bp, Human
aaattgttttaataatggagacaaatgaatcagtaaattcaatttgaattaaactaatatttgattacgtatcagggcagtttcacaaatgtcatctcatttggtgctcatagcaaactaacacctagcttagcagcaagagtcaactgcattatttgctcttccgaaatatttttgaggagtgtgcatttgttttaatttaaagcaaaataaagacagctttttgaaaaattataaaatgttcactagacgtgttgggggcagaagttgttggtaaaaaatcacaaaaagaactgtaccraaaaatacattaagtatatctctgctctaataacattttctatgctattatcaactcttctcccctatttcaaattcactatcatcttgacttccccaaattctgttttctcagtctcttttttcctgagctgtaaccaatcgtttccctgcaatccttcttgcttcttctgggtgtctaattgtttaaaagtaaaagagtgctccacaagtatcatcccatcagtggaacaggagcatccttcacacctgtgtgtgtgttccactgctcccagggccttttccaccaaatcctccttgc

SEQ ID NO: 107888 - DNA, 601 bp, Human
ctctttgaatcctggctaaaatccatagcattactttaggggatgatacacaatgcaacacctacagatttgagccactgtctcattgtcttctgaacaatccacatcttccttctgccacacagcttcttagtgtcttatcatgctcccttctgcttcaagacattaacagatgatgttctctttcaccagccatgctttctgtcccccgaccctgagtcctcctggctttacttaattcctacttaacctttagatctcagctcaaccatatcttcctcagagtcatcctctctaacckcaccaagtcaattctcattaagtcctcttataatagcatgtatatcaccatgtgctttagctgtatatttatttataccaatctttcaatgatttctatcaccctctattagattataagtaccatgaggacaggaactatacctttctttttttcctttttggctgaccattgattccaacacctagccccaaagctagcaaactaagtactcaataaatatttttgactgaatgtatgaatcaatgattttgaatgagagatcactcaatttatcaacaaaatttgatgctgagtgcc

SEQ ID NO: 107889 - DNA, 601 bp, Human
tagttttaacacaagaaatgtattaagtatatttataaagttattatcagcaacaattgttcattagtggaaaggctgtgcttcctaacacatatccatatgtctctccatatccacaggatgcccctctaagtcattgctcacttaacattcagaggcttgcaaaacaacagatgactggtattcagaatacatgactatacaaagagtgtttataaatcattaagaatcttgtagaaaagctgacagaagaactgaactggcatttcatataagaaacacatacagccaataaacatgaaaaaaaatgctcaccttcattggtaatcaaagaaatgctaataaaatggtggagacaccattttatacccaataaattgacaaaaattaagaagtcttacaaaatcaagtgttgaagaggacatggatcaagagaatgtgggatgcaaattggtacaactactttggaaatcacatcaatgtatgctctcagccaccaatttcactcccaggggaaacatgctcaaggaaacaaatagtatcccatcctagacatttatatctgcatgatagcaatagcaaaacaaacaacaagcaaaac

SEQ ID NO: 107890 - DNA, 601 bp, Human
tcatttttgagaaagcacaactctgtttgccttaatggggagttaatagccttaggaatgaagagttcaaggatgtgtgatatttgaggtatagctacccacattcattcccatccccttagaaaaacaatttactaaagtaatattttttcattatgtaaaatataatcaagatatcatgaaaaaacacaaccagcatcctagaaaactaagtcctcaactagaaattcaaaatgtaataaaaactgcaaactaaggatgcccaatttaagacttatcctcaaagattcatgataagctrccaatcagctgagacaagatctacaaggaggtgatgataggtacctgttagtctccccatagtcccattttaacattaaacttggtattagcataatttgtgtttctgtaaccttttggcttagtaacaatacgtctgattaggtatttttcctcatttgaattgccaggggtaaaaaggtacatttctcatttcaatacattaatgtaacaactgtatctttgtggagtgatattctgtccatcgttataatcaactatattttcagataactccttcgggagaatatggtcaatctcc

SEQ ID NO: 107891 - DNA, 601 bp, Human
acttttttaccatttactttttaaaatgtcgtttatactgctagaataatgaaactattgaaaaccaaccaaagagtagaattatgtcacaccaaataaaaataagcatcatatttgtgattatttttaaattctcttcggcagatataatcacagtgcctatcagattcatagacatcaaaatcaaacgagtaacactcttcttattcaattatagccccattagaagcatctatttcctcaccatgtaatattcagactgccatagaaaaggcaggggcttcctatttttctgttgtcractctgaagccactctgcctgggtttaaatcccctctatgccatatactaactggggatcttaaacaagttacttcatcactctgggcctcagtccctcaattgtcaaatgaaattgttaatatctactctcagaggatttctgtgataattaaatagttaaaatttactgaaagtacttggaacagttccaaacacatagtaagtgctataaaagttgtacattgttgatgttatccctgctagtattaatattatccagatcatgggaacagtctacaacttgcaaagtgcttttgca

SEQ ID NO: 107892 - DNA, 601 bp, Human
caagaaccttttatgtattattatttctattattatttagagatagggtcttgttgtgttgcccaggctggagtacagtggcacaatcatagctcattgcaacctcacactcctggcctcaagcaaccctctcaccttggcctcccaaagttctgggattacagacatgaacctggccctggaagaatcttttaatcacaccatttatcacactgctacaagaacccaaccaacagataaacaaataaatttttttaaagatgaaatagaaaacttttttaccatttactttttaaaatgycgtttatactgctagaataatgaaactattgaaaaccaaccaaagagtagaattatgtcacaccaaataaaaataagcatcatatttgtgattatttttaaattctcttcggcagatataatcacagtgcctatcagattcatagacatcaaaatcaaacgagtaacactcttcttattcaattatagccccattagaagcatctatttcctcaccatgtaatattcagactgccatagaaaaggcaggggcttcctatttttctgttgtcgactctgaagccactctgcctgggtttaa

SEQ ID NO: 107893 - DNA, 601 bp, Human
cacttctgctggtctgcctgccaaatctgtttcctccagcctgaaccttgctttcctaagcttcttattctgtttccacttagatttccttacctgtgtcttgaggttccactggcatctcaaactcaatttttcagaacagaatattccttctctttcaaatgttttccccttaattttaatttcttttaagaagatcacacccattctcataatcccagcactttgggaggccgaggcgggcagatcacgaggtcaggagatagagactatcctggctaacacagtgaaaccccgtctstactaaaaatacgaaaaaattagccaggcgtggtggtgggcgcctgtagtcccagctacttgggaggctgaggcaggagaatggcgtgaacccaggaagcggagcttgcagtgagccgagattgtgacactgcactccagcctgggcgacagagcgagactccatctcaaaaaaaaaaaaaagaagatcacacccattttcatcatttaagctccaaatttaagggatcacctactacccgcccccaccccaacttgataatgatttgaaatgtcaaatgacatgaaatcctgcccattc

SEQ ID NO: 107894 - DNA, 601 bp, Human
ggaaactgtggcccaagagcttaagtaattggctgcagatcatgcagttaacaggtgattgagcaacacctgattcaactcttggctacaaaatccagccatttcttcatgtcccgctgcacccaaccttcatgctgtgacatgtagctctcattgctcattcactttctcatattttggctattctttctcaagttctttaggtattatcctcagttcttttgttgtgctcctctcctggctggcaatttcatcttctccttagttgcacaatcacttctgctggtctgcctgccaaatstgtttcctccagcctgaaccttgctttcctaagcttcttattctgtttccacttagatttccttacctgtgtcttgaggttccactggcatctcaaactcaatttttcagaacagaatattccttctctttcaaatgttttccccttaattttaatttcttttaagaagatcacacccattctcataatcccagcactttgggaggccgaggcgggcagatcacgaggtcaggagatagagactatcctggctaacacagtgaaaccccgtctgtactaaaaatacgaaaaaattagcca

SEQ ID NO: 107895 - DNA, 601 bp, Human
agtaaaatactagagtaacactgacatgaagatgtatcatgagaatcctaaaatgagaaaacaaatgacaggacttacctcccacctgtgcagttttggagtaggctcctgataggtgtccattcacaccaatactataatcacctttaaagtatcgattcagaagtatctttcttaatgtgttaccctaataagaaggataacaaagagttactgttcccttttctaataaaagtgaaaaatgtcagtatgttaaatgctttaaatgcattttgtgaatgatgttgaggcatggaaaaaktaactttctatcagataatattttctgaggcaaaaatttacaaatgcatcccaataaaataatcattttgcttctcataataaataaagagggtgggagaagctttttggaggtgacgaacaggtttatggcagatattgtggtggtggtttcacagtgtatacttatctccaaactcatcaagttgaagacattaaatatgtacagctttttgaatgtcaattaatcataactcaataaagagttttaaatataactttattctgtcaaaaataaaagagtgtgttcaatagaatgtac

SEQ ID NO: 107896 - DNA, 601 bp, Human
tatccccatcttatctgaatcttgtccagaaaagcttcctgtgattgggaaaaataaataaataaaccttaattgtagacattattaatatgtaaggttttcaaattcttaaattttattattttaataaaaatattaatcattgagattttttccctacaaagttaaatataatagaagcttgaggctgggcatggtggctcacgcctgtaatcccagcactttgggaagctaaggcaggcagatcacttgaggtcaggagtctgagaccagcctggccaacagagtgaaaccccaattytactaaaaatacaaaaattagccaggcgtggtggcacatgactgtaatcacagctacttgggaggctgaggcaggagaattgcttgaacctcagaggcagaggttgcagtgagccaagattgcgccactgcactctgggctgggtgacagagtgagactctgcctcagaaaaaaaaaaaaaaaaaaaaaaaagcttgagtttaaaaatatcaaagtttgtaaaaatagaactctttattaaatgtttgacacatgtgattaaatgtttttcttaaaaacagaaagagaaaactagcttta

SEQ ID NO: 107897 - DNA, 601 bp, Human
attcctgtgttctaatcctcagtagggtggccataattaaccatttattgtatattttcaaacagctagaaaagtgaattttgagtgttcccaacacaaagaaatgataaacatttgaggtgaaagatgtgctaattaccttgatttgatcattacatattgtacacatgtatcaaaatatcacactgtaccctataaatatgtacaattattattatttaaccataatgataaatgaaaaaaaaagactggaggacaatgtctgtcatctgggaacactccccagcactcgggctcatgmagcatgttttgcttttgggtgtcgtcaaccctacgggccacttggcagaagtttcaaaagaaaacatgtgccttctggaaatagtggcctaatctcctgtgtgcaggtgagcatattgctcactgttgtggaattcctggaataatgtcagaaggaagtttcagaggaatgttctgcttgactgaataaattgtgaagctctgtagtttctacagcaaacaaatttaagaaaagtgtgatacatggatttttttttttttagatagtaataagagctaaaagaaacacattacttttcct

SEQ ID NO: 107898 - DNA, 601 bp, Human
ttgaatggctataaagcactgtagacataaagaataggatatgatcccctatactgaagaagttgaaattcaattggagaggcagggtataatacaaattacaaccaaacaaagtagcacatgcaaaatgccaagtggtattaaagaaacaagtgcatggaagctgagataagggaatggacaccaaatgtcccagacagctaggaaagactttgtgaagaagaaagaatttaattaggaccattcattcacagaaccattcacttctgcacattgactgaaccccaagattggtccagayacaaggggtacaaagatgaataaaacgtagtttcaacctttaaggacttataatttactagacgaagcctgatgcacacatgaagaggcaaaataaagcggcagaaatggccgggcgcagtggctcatgcctgtaatcccagcactttgggaggccgaggcaggtggatcacctgaggtcaggagttggagaccagcctggccacaggatgaaaccctgtctctactaaaagtacaaaaaattagtcaggcatggtagtgggtgcctgtaatcccagctactcaggaggctgaagcagga

SEQ ID NO: 107899 - DNA, 601 bp, Human
tcatatataagagtaatttaatgctgtttcatcaaaaaatatttgttgaatggctataaagcactgtagacataaagaataggatatgatcccctatactgaagaagttgaaattcaattggagaggcagggtataatacaaattacaaccaaacaaagtagcacatgcaaaatgccaagtggtattaaagaaacaagtgcatggaagctgagataagggaatggacaccaaatgtcccagacagctaggaaagactttgtgaagaagaaagaatttaattaggaccattcattcacagawccattcacttctgcacattgactgaaccccaagattggtccagacacaaggggtacaaagatgaataaaacgtagtttcaacctttaaggacttataatttactagacgaagcctgatgcacacatgaagaggcaaaataaagcggcagaaatggccgggcgcagtggctcatgcctgtaatcccagcactttgggaggccgaggcaggtggatcacctgaggtcaggagttggagaccagcctggccacaggatgaaaccctgtctctactaaaagtacaaaaaattagtcaggcatgg

SEQ ID NO: 107900 - DNA, 601 bp, Human
gacaagagcatgatgcagggagaatcctcaagtgaaatatcctagtggtgaggatggagatggctatttctagaaaagagatgcttattgcatctaagagcacagaatctggagccagactgcatcggtttgaaacctatctctatctctaactagcgatgtaagcttgggtctatctcagtttcttcttcagtaaggtaggataacataccacttacctcacaggttgtttgaatattagccaagttaatacatacaaatcacaaagaacagcgccttatatttagtaggtataattttycttattgctatcattaggttccatttgaaattgtaatataagtacctcctataccttctccttcagttgatctttaacaaagtatagaacatacacacattgacttaatgtagttagaaaggaagaaataaaggaaggggctgcagttctcagtatgacagaagcaggggtgttaagaatttatgtgctgagaaagcaagacttttttggctaaggagacagtgagaatgtaaaacccccatggaactggcaagtgtcttggggaggagtgcgctttagactgctatagggcaaggaata

SEQ ID NO: 107901 - DNA, 601 bp, Human
tacaagacaaacaagataaatatcatttgtaaattaataaagataataactccctaactgtagtgaataaaagagttatataagcttgaggagagatagtatgaagaaaacataagaaaaaataatttccagatcaagcagaactggccctactccaatataagaacatttaaacagccagtttgggggagtttgccccaggatatgctttcctttaggaattcctggaaacatgacccacaggtcttgggatctgtaactgagactctaatgacatcaggtcttgaaatggttgcctacyctgcaattttctctgtgggcaatgtatatacacagagtgtcttatgaagccttagatgtcagctgcacacctacaagggtaagctcctacacagagggcaagcaaccctcaagaaagaaggccaaaaagtcacggtaaccatagcaaccacagtaaaacagtcaagctggttttgttaattcaaacaacaaatgcagcatccacagacctctacaatcccatgaattaagcagatgataaagcccaaatcttttcaatataatggggttagaaggtggaaggagtttccagtatattaat

SEQ ID NO: 107902 - DNA, 601 bp, Human
acccaacaggcccaggccaccggttgtacttccacaaatgcagtccagaaactgaagggtctcacagactaggttgtaatttgttttgttgttttgattcctcaagaagttctgaaggcaaaagaaaataaaattgaagggttacaaaaattcactgtgctgattgtttgctgttcttcccatatgtgtgcttttctaacttttctttgtaagaaaagtattcgcatttattaaaactgtcctccacttaaggagggagaaacgcccttaggtttttccccaagcatctatatatatatayacacacacacatatatatgtatacatgtacatatatatgtgtgtatatgtgtgtatatatgtatatatgtatatatacatatatgtgtatatatatatcaagatagttcataataaacatttctcagtgtcattatcatcaaactacacagagagggaaagagtaatgggaagtcggaaaaagagaaaaaaaaactaggtagaaagaagttcattagggagagaagcaaattttcaattataaataatctcatatgaacagtgcaacttcattgttcattaattataaatgatataatca

SEQ ID NO: 107903 - DNA, 601 bp, Human
gtaatatagtcaaaagagcactcgatttagactcagaatcaaaagtccttagttgtaagaatggctctacaacttattgattctgtcactctgaaactctggaaagtcacttaatctttgggttagaacctattcatcagcaaactagaaataatgatacctattcataagtttattgtgcatataaaataaataacatatactactccttgtagggatgccaaaggagccaaagaaagtttattccacaaatcctggaaaagttcactaaagatgaaaactgggtggtggtcatgacacrtatttcacttttttcagtaagttgatttttatcttgaacattttcatgggacttgtttttacaatgaaattatctacaaatacagcatagtatttccttgtctataattcagtctttgtatgttttattaggaaagtaaaaatgtctggcaaagcaagaagaaagatctttcaagtgcacacaaagattggctccttccccaaattaatccctttactaattagtcatggatacttctggttacctgattttcatggcaagggccctggcaatactcagtcaagctctccaggttctggt

SEQ ID NO: 107904 - DNA, 601 bp, Human
ttgacccaagtgtcctgccttctactcccacaatatatccttgatatcccagaaaacaaaatcagagacaaacattctggaaaagagacttgaaactgtgccctccaaaatgtaatatagtcaaaagagcactcgatttagactcagaatcaaaagtccttagttgtaagaatggctctacaacttattgattctgtcactctgaaactctggaaagtcacttaatctttgggttagaacctattcatcagcaaactagaaataatgatacctattcataagtttattgtgcatataaaakaaataacatatactactccttgtagggatgccaaaggagccaaagaaagtttattccacaaatcctggaaaagttcactaaagatgaaaactgggtggtggtcatgacacgtatttcacttttttcagtaagttgatttttatcttgaacattttcatgggacttgtttttacaatgaaattatctacaaatacagcatagtatttccttgtctataattcagtctttgtatgttttattaggaaagtaaaaatgtctggcaaagcaagaagaaagatctttcaagtgcacacaaagatt

SEQ ID NO: 107905 - DNA, 601 bp, Human
agtacagaaagggaaaatacccccataacaaattgtttatgccaaaactgtcctgttttcattgtacacacctatgcatgtacacatgtgtgtatagattcataaatgtatgtgtgtgtgcatagacaccgtgtgtatgtgtgcgtatctcatgtaaactgcaatgtttaaaaaagcaaatttctttttcacaattttctatgtcaatcgttgatgtttgctctcaatgacttttttaatatttatatccagaaatgtttatgacttgaaaactctgtcttctggactgatccatgcttaygatggtagctccatgatgcctgagaggaggtgaaacagtcaactggcaaactttcaggtggcatcccttaccttgattgacccaagtgtcctgccttctactcccacaatatatccttgatatcccagaaaacaaaatcagagacaaacattctggaaaagagacttgaaactgtgccctccaaaatgtaatatagtcaaaagagcactcgatttagactcagaatcaaaagtccttagttgtaagaatggctctacaacttattgattctgtcactctgaaactctggaaagtcactta

SEQ ID NO: 107906 - DNA, 601 bp, Human
gatttcttaaacttacatgagggaatcttgattggggaaaatttatgaaacatcctgtgagataaatatccacattttgaaggttaagatcgaccatgctggggttctgaatttaattttacaggtcttaaatcaggaacttgcgagccagatttgtaggactatgtgttaacaatgtagcaccttgtcaagaggtatgaaaaactgaaatcctggtgagttaaatgagaaagaccaaaatcaagacaacttcaaaatgactgctttttcagcatgggccttatttctcccttcatacaayggagtttttattcctctgacacagaggaaaggtgttttctacccatctcctacctgtcctgaggttcttctgctcattaaaatatttcccaaacttaaagagaatctttttgcagatcatctccagaatttgccagcaatctttcctcccacacattttcagagcaatggggaattatatgtggggttcatgttatttgaaaattagcttttacttttagaacttatttggttttagtaaattactttcaaagctctattccattctcttatgagaccaaaactggggaacattcttaca

SEQ ID NO: 107907 - DNA, 601 bp, Human
gttttaaaaatacatcagcaccttttgcttctccctataatgaaaaatataaaattaaaaacaaagccgggcacgatggctcacacttgtaatcccagcactttgggaggccgaggtgggcagatcacgaggtcaggagttccagaccagcctggccaacacagtgaaaccccgtctctactaaaaatacaaaaattagccgggcatggtggcgggcgcctgtaatcccagctactcaggaggctgaggcaggagaatcacttgaacctgggaggaggaggttgcagtgagccgagatcgygccactgcactccagcttgggcggcagagctagacttcatctcaaaaagtaaagttaaaaataaaataaaaaataaaataaaaataaaaacaaaagggaagtcatgaaacacagtggctgcttggaaaacttccaggaaaggaccttgccatggaatattacctcaaagctaacttcacattgcatctggagtttagtaagcattgtactttcactatccctttctgtcaattgattagttgaaaacatgataatatgcttttgacaagagctgcttgaagattgtactatagagactgt

SEQ ID NO: 107908 - DNA, 601 bp, Human
aataatctatatgcttatactttattttaaatggatgagccattcagtatttctgtccattaagtttaattaattacaaatgaaatttaaaggtatagtctttagactaatgaaggattttaaaagccaaagatcaagacctctctatgttgtttcttaatgaattatggttaaatatgaatttaagataaaacaacaaaaatttttctaataacttgaatttaagctgactatcttacaggcctaggctggtttcattaactgaaacatgatggtaatgaatcgaggggcacaagtacakctatgtaagaatcgtctttgctaatctatgaatagaaagagcagaagcttatacacattacaactgaaaacatgaaaaaatacaaactaatctcttctattaaaaaagcatttaagctgggtgtggtggcatgcacctgtaatcccagcttatcaggaggcagatgctggaggatcacatgggcccaggagttcaatatcagcctgggcaacatagtgagaccctgactcaaaaaaataaaataaagataaagaagcacatgcttactaagagcctttagcacaatcttcacgtaaacat

SEQ ID NO: 107909 - DNA, 601 bp, Human
tgtggaggacaatagattcatgaggaacttggaaacaatcttagggattggcctgctaagaaaccaaatatgacatcctagcctagagaaagccaaggagtcacctgcagaaagatcagcagagcacaatggtctctcttctgtgagtgaaagctcataatttttcatgaaaaactggtgacggggttaccccataaagaatacatttatatggtggcaaggaaatgactccttgtgtcactataatagaataagcggacaattgcttaactctacactgtcagttacatacaactggccyacttttcttccatacctatgccctctttgggttctaagagggactcatgaggactcttatttaatatttaatctcttacagtgtaatcatgaggcttaaagtattcagcaattcagaatctccttttctctttactttcttttgttttgatgtttgttctctctcttctcgagtctgcctttgtttctctacttctatattggaccttcgttgctctacaaatcattgcttttccaacattttgcttctgggaagtttaaaaaaaaaaacaacttcgatatatccaccccaatcattttc

SEQ ID NO: 107910 - DNA, 601 bp, Human
ttgttgaaagactatcttataataaataagcctgaggtgaactgtaggtgattagtgtaatagtcaagtactaatagctggctgggggtaggttcaagctacccaggccttcttttgttcctttaaatatgccaagttcattgccactttcaagccactgggatgttcccctgcaaaccccccacccccatggtatcctgctggcttttgatttttgacttagatctagtctaaattgctccccagaaaaccctccagatcaaccaatctctaatagcctctagtaactgtctttcaccasgatctattcttattcactgcgtagcttatatcaccatctggtatctttctggttcattgtctactcttcattgctcccagccagaatgcaaattccctgagagctgatctgttgcggatcttctttaccactgcattcctagtatctggcacagcgcttggcatctagtaagcactcaatgcatctgtgaaactcaatgaaagaaagaacaagaaatgtaaatcctttcctccacagtggtaaactgatggatcgagggctgcattcagcttgctgctgagttttctttggcctgttcag

SEQ ID NO: 107911 - DNA, 601 bp, Human
tataaaaacatatgtagataccatacaagatccctaccaatatgaccaaaagaagtttctctccttaaaatatttttggctcctctccctaaaatatttttggctctttgcagaagttgttctgcttgcctggactgtcttcctctatccctctctttcaagatttagttcaaatgtcacctcttccaagaagctctcttgactcctaggggaagtagatcttgtacataacctccatgttaagacaaacacattcaattataatgatttatctctctcgctcttccttttatatacactwcattgtgagcttcttgattgcatttttagtcatctttccatcttagaaactagcacaatgcctgacataagaggtgttcaataaatgttgttgaaagactatcttataataaataagcctgaggtgaactgtaggtgattagtgtaatagtcaagtactaatagctggctgggggtaggttcaagctacccaggccttcttttgttcctttaaatatgccaagttcattgccactttcaagccactgggatgttcccctgcaaaccccccacccccatggtatcctgctggcttttgatt

SEQ ID NO: 107912 - DNA, 601 bp, Human
agatggagacaggaggctactgcagctgtccaggcacaaaatgaagatggcagcaggaagaaactggcagtatgagtggagaggagtgagcagctctgccaggctgtccaggtgagggcggtacgggggcccaggtgaatgccacttctagttggtagccgcttagagaactgtgccactcatggagaaaaggggctctgagttattttaaggagaggctgctgacgacatcaagactcagtttccctgcaacatagcacactcagatcggaacaatcaagaaaggaaaataccagggccytccaggggaagccagaaagggcctggctgcctgtcaccacctgcacccaaagcactgatattttcttgatatgtgtgtttattactttgttctcccttactttgtgtcaatgttaaacacgagggcgtcatcaacgataaaaacaagataaacacgagacacttctagaatcaatgatacagttaataaaatgaggggtgacggaggggaacattttcaaggaaaacttgcccaaataaaaattgttttctgttaaaactacaaagacatgagtttgtttattccttttggagctcattt

SEQ ID NO: 107913 - DNA, 601 bp, Human
tcctaatcatttatatacaacaagaaaaatgggaatgatagcaacacttttcttttaaaagcattctgattctttcactgtttctggtgattttttttttaaggcaaacatcaaaaggtgaagaaagtcatctttttgagatgttggaccatgttaaaatagtacctgtggttgactgggaaaacttagagagctcttgttctcaaagtaattgctgcgggggtgggggtggcttatgatggacactgagaaatgacttctggctttatcactgaccttttatggtagcacgttcaagtcrtttgacctttttatgtctaatttacctaactgtgaaataacaacatctgcaataatataccaaagagaattactgcaggatctgtgctcctaatgctccttaagttcctgaaccaatgaggctgagtgaagagcacaatcttactattctacttttctctatgatatacctattccaagaatgagtcaattgcttttctgtttctcatagtcttgacaaagccactttaaagtgggttaattagaggcttgaaattataatgatgagttccgcaacagttctcacactgccagtgtgtgc

SEQ ID NO: 107914 - DNA, 601 bp, Human
gatggatggatggatggcatacagtattttttgcttatttattagttcaattttaatggcatatgtgtttaattttctgaaataaattgagtttttagaaaatgatgaattacaatattatatgtaaatatgagaaatgtggtgttttttgtttgtttgcttgtttgtttgttttttgagacagagtcttgctctgtcaccaaggtggagtgcagtggcgcaatctcagctgatggcaacctctgcctcccgggttcaagcgagtctcctgcctcagcctcctgagtagctgagactacargcacgcaccaccatgaccagctaattttttgtatttttagtagagatggggtttcaccatattggccaggatggtctcgagatctcttgaccttgtgatctgcccacctcggcctcccaaagtgctgggattacaggcgtaagccaccatgccgggccagaaatgttttaattcctaatcatttatatacaacaagaaaaatgggaatgatagcaacacttttcttttaaaagcattctgattctttcactgtttctggtgattttttttttaaggcaaacatcaaaaggtgaagaaagt

SEQ ID NO: 107915 - DNA, 601 bp, Human
agaaactatgaaggagtacacccctctccccctgcaccccaccatctgttttaacaagccctccaagtgatttcaatcctgccaacatttgtaaaccactgttctaatagatagtagatgttatcaccataagcaatttggattcccttctgaaaatccaccagtttttttttttaaaccaaaattaaacataaaagaatgaagtgtttttaaagaatttttttttcctttaaaagcatacaagagaaatgttaacatgtagatactcttaataacagtacatttactgaacacattttcaaaaaaatgagattaggatcagaaatataaaatatgctccacttaattttaaacaattggttatttgtcactcatagcttctaatttctaggctcatgaatttctatactgctttgcatggagtgtgtcacccataatgcatgtgttggaaattttgtccccagtgtggtggtgttgggaggtagggcctttgggaagtgattaggtcattaagagggattaatgctgctcctgaggggactgggttaattttcagaggaagtgagtgcattctcactctcaaggaaccggatttggtatc

SEQ ID NO: 107916 - DNA, 601 bp, Human
tgcaagttctctggcccgacctcaagcctcccaaatcagaaactatgaaggagtacacccctctccccctgcaccccaccatctgttttaacaagccctccaagtgatttcaatcctgccaacatttgtaaaccactgttctaatagatagtagatgttatcaccataagcaatttggattcccttctgaaaatccaccagtttttttttttaaaccaaaattaaacataaaagaatgaagtgtttttaaagaatttttttttcctttaaaagcatacaagagaaatgttaacatgtagayactcttaataacagtacatttactgaacacattttcaaaaaaatgagattaggatcagaaatataaaatatgctccacttaattttaaacaattggttatttgtcactcatagcttctaatttctaggctcatgaatttctatactgctttgcatggagtgtgtcacccataatgcatgtgttggaaattttgtccccagtgtggtggtgttgggaggtagggcctttgggaagtgattaggtcattaagagggattaatgctgctcctgaggggactgggttaattttcagaggaagtg

SEQ ID NO: 107917 - DNA, 601 bp, Human
aatgaaacaaacttctcctaatttcaaatgatctagactcctactcattagggtctgtcttaaactatagtaaaattgataaaagaccctactgattataataaacaaatgattcatgacagctcaacccttgaagcagggcaaagcaggagagaaaaaaaggaagaaaacagcccacaaaaaatgcactttaaaatgacttagggcagtttttagtaagcatgctatctttgtactacgattttatcatcaagcattgcaaagtgttgtgacgattgatgaagctaactttcctacagaytgctaacactcatcctaatagaatgcttctcaaaatggggtttctgggacagctatatagcatcgcctggaagcatgttagaaatgcaagttctctggcccgacctcaagcctcccaaatcagaaactatgaaggagtacacccctctccccctgcaccccaccatctgttttaacaagccctccaagtgatttcaatcctgccaacatttgtaaaccactgttctaatagatagtagatgttatcaccataagcaatttggattcccttctgaaaatccaccagtttttttttttaaac

SEQ ID NO: 107918 - DNA, 601 bp, Human
aggactttcggcttccagaaccgtgggacaagaaatgtctgtcattgtgaacttccaagttgtggacatttgttatggcagccctaggaagttaacacaaatccaccaaggaacttttctcttgactgtggcaagataaactcagattctattcatctctttcttcccttctcttaaaaaaggaatttggggataagacaggatccatttgggcatggtgccatctgtccagggttccttgcagtactgtgaggtccttcataaagaacacagaccaaagaagaaataactggtcttcccraatactgatgccagaattactaccctgttagtagggtcagagtcctgtgagaaagaagaaaaggctttcccacatgagactcaactgtgtggtctcagccagaaaatactcactacggcaggtgaatatttggtacttagaccactttagaagaagatcagcttcaggaattcctagtagggagaagcacattttccccactttagtcagcagaactgaggcagccagaaccaccaggaatatccagcataagtctcaagctaaacaatccagaagacacgtgaagggctgtacgcactc

SEQ ID NO: 107919 - DNA, 601 bp, Human
agaaatgggctagttaataacatatatttatgcgtttaagtggacaacaactcttaagcctcaatgaattatctctctgtttcatcctctgtaaagaagaagggcaaataaatctgattagaaatcagatgatggtacaaattccagtatttgtagaaagaaaatattttaatattttttcttgtttgatagttatttatgtactcatatgtattctgatagattgtaagctattaggaggaaggaaataaccatttttagtggcatcctttattatccatttcacatttatctttttacmgctgagattttaatgttcacttcagtatgggtccaagtaaggacagagtaaaaaaaaaaatcaagaaatatgctttgatgacattcaataataattatttcttcgtatttttcatctgtgtttttttaatgtgagtttcacttttattgggtacccagtcaatgttgaaaggaacactggatgataaagcaaggatagcattcctattatatagacaaaatgcaaaaggattaaggaatatctcaatgattgtgaaatgcataaaaatgactgatatcaatacagtgctttcctggtcca

SEQ ID NO: 107920 - DNA, 601 bp, Human
gacagatgaggaaactgaagcacagagagtgtaaggaacttgtttgtgataacatagctagaaaatggtagagccagtattttatcgacattacggagcaataagttttcctattattcatgagatcttaataccaattattattataatcatggagatgaattttaaataataattcagaaactagaagaccaaatgaacattatccttataagtgataatttggtaagttaaatgttcattacattgatgctgctctagagcaaatcattttgaaaactgttatttcagaattggtttyctgggtcactaatcaatcactcaagaaaactatttcctattttctatttacatttttttaactaaatttgaattatacacatttttattacaaaccacagtcatgaaacttgttgtgacttacaggggtttctaaaaatctcaatcagtttgaaagcataaaattactgtaatctttaggtaccttagcatgttttaagaagtggccagttcttgaaggcaaaactggcatgatttgtttgctgactggatctggggcatgaaagaaagagaattaaggatgattccaaagttattgacc

SEQ ID NO: 107921 - DNA, 601 bp, Human
caatatgaaaactgtattagtttctttcatgtttactccacttgtgaattgctggagatctctattttaataagctttccacaattttaaaaaagaaaccttttcctgaatgatggcttctattataataatcccatctctcaaacgctattgctctgcaatgattgattgcttctacagttaaaaaacatctattaattacaaaaaaaaattttacatatagttttagtaaaaaaagacaactttgaaagatgtacacctcagtttcctataaatcactcctcactcatccttttgctayacatttttcagtttaaaccactcacttctgcatcattgctctagaaaaaaatatgaaaatggtctaaaataggaagtaagcataacttttcacagttggtctctttcaataaataatagatggttacctcaatctgtgcagtgtggttggcataatactttaaggcttcatctccttcatctggatccgatcctggtttgagcatctgctgcaacagtttattgtggcgggccaactagagtagggaaaaaataaaggttttaggtctttttttcccctttcctagggtcaaactttgca

SEQ ID NO: 107922 - DNA, 601 bp, Human
ctatcaatatgaaaactgtattagtttctttcatgtttactccacttgtgaattgctggagatctctattttaataagctttccacaattttaaaaaagaaaccttttcctgaatgatggcttctattataataatcccatctctcaaacgctattgctctgcaatgattgattgcttctacagttaaaaaacatctattaattacaaaaaaaaattttacatatagttttagtaaaaaaagacaactttgaaagatgtacacctcagtttcctataaatcactcctcactcatccttttrctatacatttttcagtttaaaccactcacttctgcatcattgctctagaaaaaaatatgaaaatggtctaaaataggaagtaagcataacttttcacagttggtctctttcaataaataatagatggttacctcaatctgtgcagtgtggttggcataatactttaaggcttcatctccttcatctggatccgatcctggtttgagcatctgctgcaacagtttattgtggcgggccaactagagtagggaaaaaataaaggttttaggtctttttttcccctttcctagggtcaaactt

SEQ ID NO: 107923 - DNA, 601 bp, Human
agtgtaggggttatatatcttgagagtgaatacagtgatgcccatcatgcactctgctgaaaagtaaaaaatatctgccaaaatgaatgaatgtataaatgtaaattataggagtgacaagcgtcaactactctgctcacttctgcctgattagctctgccagccagtgtcaaaatgataccatagctagtaaatgacagccagatgggtctcagaacacataatggtaagtccattttgacccacacctcctggactgccaccaaccattaaataatgtctcatttatgagggtggtggrggggtcaagtgctgcatactgaaaatggaaactgttaaacctttccaaggctatgctatcaatatgaaaactgtattagtttctttcatgtttactccacttgtgaattgctggagatctctattttaataagctttccacaattttaaaaaagaaaccttttcctgaatgatggcttctattataataatcccatctctcaaacgctattgctctgcaatgattgattgcttctacagttaaaaaacatctattaattacaaaaaaaaattttacatatagttttagtaaaaaaagaca

SEQ ID NO: 107924 - DNA, 601 bp, Human
cattttcctaacatgtgcaattcaacttcaacttcaaagccctgtcagtatgtatatgtatatgtgtgtatttataatatatatataactatatagagatctatatgtatgtatgtatctgcatctatgtatctatgtattttccagtccagccatcttcgatatcatctctcacttttgccattataatatcttcctatctgttctatgtgttttctatcccactctcttttccagtcctgtctccaaacggcaaccagattgatcttttgaaaatagtcatctccttcccatgtttttyaataccttcccttcacttactttctcctttctgaaatccccatcctgaaggagaaactcgtactcaatctttaatacattcttaaaggcaaccttctcagtgaaatctatcctgaaatcgctcaggcaccactaattattattttctctacatttccttggccctttgtttatatacttataacatagaattatcttctatatgtgtgaattggtagagagtaagtgctcagtaaacatgtactgaatgtgtgtatttatagctaaatctctcctcactactggaatcaataaaacaaca

SEQ ID NO: 107925 - DNA, 601 bp, Human
acaaaataattggacatatttgatatgacaggcaaccatatagggaaaaaaggtttacttgattcaatagtgtcaaatatttaaaaaaaatctcagggtgcatcaaagaaatcatgtctagattattataagccaagctcttcagtccttttatgaaatgttatgtttgattatggttgtcacattttacaagcagcatggacaaactggagggattactgaaggaaatggaggtgtgttaaccgcaaaaagccagagatggataatttttcaatacgtttattcaacaaatgcttattcmgtctttaggtgaggcatgttggagaaaaaaacaacatgaaccccaacaggtaagagcttgtagtttagtaatcatgatggctcttcagatgttagagtcaagctatcatgttgagggagaaaaaaatgttctgaatgtaaacattaaaatgggctaatgttaactcttcattttaaaaaaagtttctaattactagtcattcaaaatcggatcagtttcttcctgatgtagtgagaactctatcgcaggaagaatttaaagcagaagcagatcattagagggcaattccttcttagatgg

SEQ ID NO: 107926 - DNA, 601 bp, Human
gtattctattaatcttgtaactgaaggtatcctaaatgatatgtgatatattcaattacatactagaatactgtcataaagcaaactacatgaaatttagtagggtaaataaaaattcttgcatataggttacaaaaatcaattgtacaaaataattggacatatttgatatgacaggcaaccatatagggaaaaaaggtttacttgattcaatagtgtcaaatatttaaaaaaaatctcagggtgcatcaaagaaatcatgtctagattattataagccaagctcttcagtccttttatraaatgttatgtttgattatggttgtcacattttacaagcagcatggacaaactggagggattactgaaggaaatggaggtgtgttaaccgcaaaaagccagagatggataatttttcaatacgtttattcaacaaatgcttattccgtctttaggtgaggcatgttggagaaaaaaacaacatgaaccccaacaggtaagagcttgtagtttagtaatcatgatggctcttcagatgttagagtcaagctatcatgttgagggagaaaaaaatgttctgaatgtaaacattaaaatgggc

SEQ ID NO: 107927 - DNA, 601 bp, Human
caattacagaactactggtactccagacttcccataagataaaattttactgtttaaacaattgtcactgtggtattctattaatcttgtaactgaaggtatcctaaatgatatgtgatatattcaattacatactagaatactgtcataaagcaaactacatgaaatttagtagggtaaataaaaattcttgcatataggttacaaaaatcaattgtacaaaataattggacatatttgatatgacaggcaaccatatagggaaaaaaggtttacttgattcaatagtgtcaaatatttwaaaaaaatctcagggtgcatcaaagaaatcatgtctagattattataagccaagctcttcagtccttttatgaaatgttatgtttgattatggttgtcacattttacaagcagcatggacaaactggagggattactgaaggaaatggaggtgtgttaaccgcaaaaagccagagatggataatttttcaatacgtttattcaacaaatgcttattccgtctttaggtgaggcatgttggagaaaaaaacaacatgaaccccaacaggtaagagcttgtagtttagtaatcatgatggct

SEQ ID NO: 107928 - DNA, 601 bp, Human
cactgaatcactgaatcaattacagaactactggtactccagacttcccataagataaaattttactgtttaaacaattgtcactgtggtattctattaatcttgtaactgaaggtatcctaaatgatatgtgatatattcaattacatactagaatactgtcataaagcaaactacatgaaatttagtagggtaaataaaaattcttgcatataggttacaaaaatcaattgtacaaaataattggacatatttgatatgacaggcaaccatatagggaaaaaaggtttacttgattcartagtgtcaaatatttaaaaaaaatctcagggtgcatcaaagaaatcatgtctagattattataagccaagctcttcagtccttttatgaaatgttatgtttgattatggttgtcacattttacaagcagcatggacaaactggagggattactgaaggaaatggaggtgtgttaaccgcaaaaagccagagatggataatttttcaatacgtttattcaacaaatgcttattccgtctttaggtgaggcatgttggagaaaaaaacaacatgaaccccaacaggtaagagcttgtagttt

SEQ ID NO: 107929 - DNA, 601 bp, Human
tagactaaaaaaaggctgaatattttcatacagctttactatgtaacaagggcttatgtagcctaaatttcaaggttcatatttatgtacagtgcccagttctcaggaatgaataaggattggcttaacccaaacgagtaattctgcttccctttgccactgactggtgtggtggtggtcatggactgtacctctggaaagtgaggcataaagagaaatatcctgaaagggcttccaggagagattttgcttcttggtaaaggcagagagccataagagacacacaaaacaacaacaacarcaacaacaaccaaatacacgaaaacaaaagttttttgttgttgttgttgttttggtttgcctgtaccctctttcttcttgcttagaacaaaagggtctaagggcatgatgcttagaatgctagcagccattttgcaaccatgaggtgagatagtgtcagcatgataaggaacctagtataaagatgtgaagagtctgcatattttaagacatcactgaatcactgaatcaattacagaactactggtactccagacttcccataagataaaattttactgtttaaacaattgtcactgtg

SEQ ID NO: 107930 - DNA, 601 bp, Human
taagacagtcttaattagaaagtgattggctgggtagccttaaacatagcgcttatgttatttgtatcttgttcttagcctcttcatcctaaaaggggctgccaggtaacaaatgacatattcagcattatgtgtctgaactctacagagaaaagcgctttatatcattaaaatgttctcttattcatggtaaaacatatttttgtagctacaacatccatgtaaacatatacccacatttaaatactcatcatttttagcctcccttatttgttatttgtgactgtttaactttagactaaaaaaaggctgaatattttcatacagctttactatgtaacaagggcttatgtagcctaaatttcaaggttcatatttatgtacagtgcccagttctcaggaatgaataaggattggcttaacccaaacgagtaattctgcttccctttgccactgactggtgtggtggtggtcatggactgtacctctggaaagtgaggcataaagagaaatatcctgaaagggcttccaggagagattttgcttcttggtaaaggcagagagccataagagacacacaaaacaacaacaacaacaacaa

SEQ ID NO: 107931 - DNA, 601 bp, Human
ttggggaggtaaagatatgttcaaagaaagaattactctcagcaaaacatgaaacaatcccctcaatcacaggacaacagaggaagagtgcgcaggagctgatgtctctcaatcctattcactgataggccagtcagggcccattcacggacttcaaacctgtggctgttcaacatttgaaatgtacagcttcaaccctgcatttcataacatttatttaaaaataggatcatcatgaagagtcgatgtaattagttagggctttctgttttccttaagctgcgggtgtctcggctccagyggtagactaagcggacactcttaagactgcaagtgatttcagtaatatcagaccagcaagaaattaaaaaaacaatttaaatgagctgcatcatgtgtcccaaagtaccaaattatctaccactatgcacaaaactaaccatttcagtttactgtacttactcctgattttcttctgccacttcatttcattgtagagatcttctgtttgctggaaaaagtcattcactttacttccttgttcatccctttcagttgtattgaacacacggcacttggattctcgagtgaggtattcaca

SEQ ID NO: 107932 - DNA, 601 bp, Human
tggtgtctcactctgtcgcccaggctggagtgcagtgttgcaacctcggctcactgcaacctctgcctcctgggttcaagtgattctcctgcctcagcctcccgagtagctgggactacaggtgcctgccaccacgcccggctaattttttgtatttttggtagagacagggtttcactgcgttagccaggatggtctcgatctcctgacctcatgatctgcctgcctcggcctcccaaagtgcagggattacaggcatgagccaccacgcctggccagaaaatatatgttttttaaatgytccaaataaaattgtgtcttcatatgtattttagacacccaaaattttcactgaattccataaggctctacatggtaaaatgctaagggagaataattttgatttttttaaaagcattctgttttaaaagcctgaaaatgcataccacacccctatatctaaagatgatatttctcaagcaccactcaaattcataaatcatacccactaaagttgctgaaaactaccataatgaaatactgttgaatagaagtattgagaacatatcctgtttgtctagaaaactccaagagactgaaa

SEQ ID NO: 107933 - DNA, 601 bp, Human
tataggccttgtccattctctaacttttaaaaacttaacaccaggattaaaaaattgaagttaatcaagggggaaaggcacatcgattttcaaatggaaatgattaactttgtagatatatcctgtgaatttcaacctagtgcctattgcctacttacaaactgtacttctctttagtacatcttgttttccttctcttggaagggaacattccaatgccgaaatatgctatgatcagctatgccattcaattgactaatgtatcataaactataaacatctgcatctccatcattcctgrattaggagtcctcatttttaaaggtagactattaagacaaaattagaagatgttgatgcatgtatttgtaataacaaattctcactattgaatccaccaaatgaattagactctgcctatagcctcataataagctgcttccaaattttaaagtaaaatgtacattgaaaattatttaagatttaatttttggtaaatgataaaatacttatttttttaaaagcacagacctccccaaagcactagttcagtattcaatttattgtcaaggagaaaatatatgtttttttgttttgtttt

SEQ ID NO: 107934 - DNA, 601 bp, Human
catatattcaacaaaggactctgtgtctgttatcacaaatgaattagtaaatacatcaatcgaatacagtttacattaaccaaaaatcagttctttccacctctgttaaataactgaacggattggtaatgcatgtaagtttgaatgacagccaaatctactagcctgccctgggcactcacatggctcctataggccttgtccattctctaacttttaaaaacttaacaccaggattaaaaaattgaagttaatcaagggggaaaggcacatcgattttcaaatggaaatgattaacttkgtagatatatcctgtgaatttcaacctagtgcctattgcctacttacaaactgtacttctctttagtacatcttgttttccttctcttggaagggaacattccaatgccgaaatatgctatgatcagctatgccattcaattgactaatgtatcataaactataaacatctgcatctccatcattcctgaattaggagtcctcatttttaaaggtagactattaagacaaaattagaagatgttgatgcatgtatttgtaataacaaattctcactattgaatccaccaaatgaattaga

SEQ ID NO: 107935 - DNA, 601 bp, Human
tgagcactataataaaaactgttaataagtggaacacgctttgctgcatatattcaacaaaggactctgtgtctgttatcacaaatgaattagtaaatacatcaatcgaatacagtttacattaaccaaaaatcagttctttccacctctgttaaataactgaacggattggtaatgcatgtaagtttgaatgacagccaaatctactagcctgccctgggcactcacatggctcctataggccttgtccattctctaacttttaaaaacttaacaccaggattaaaaaattgaagttaaycaagggggaaaggcacatcgattttcaaatggaaatgattaactttgtagatatatcctgtgaatttcaacctagtgcctattgcctacttacaaactgtacttctctttagtacatcttgttttccttctcttggaagggaacattccaatgccgaaatatgctatgatcagctatgccattcaattgactaatgtatcataaactataaacatctgcatctccatcattcctgaattaggagtcctcatttttaaaggtagactattaagacaaaattagaagatgttgatgcatgta

SEQ ID NO: 107936 - DNA, 601 bp, Human
tgtattattagtttaataatagtttcatattcagtatcctttatttcctattattatattgtcttatgctgttcacttttgaaacctcagatgataaacatttaattatcttaagaatccctgactttagtatagaattaaaaattatttctagattacatgtatgctcactatagaaaccttagacaagacagaaaacaaagagagtaaaatataaacgccagtatttaggtaacaacaattaatattgggcacagaactgtcatttgcataatttagatgatacagtataaaaatgggktcataataattaggtagaaatgacaaatcttttcattgctttatttgccaagatataatatagctctaataacaattgtgtatatgagctttttaaaaaataacagttctgttgaccacacttttctgcctgttctatttactatcatactctacttccaacaagtatagaaaaatccatttaacaggaatgaaattattcttattttgaagctttaaatagttaagtgggaactttaaaatatttatattttaaggaaaaacgagcacttgccttcatctccatcatccccaaatgggt

SEQ ID NO: 107937 - DNA, 601 bp, Human
ccaagacttaccaggtgatttcataatcagcttctataccgagtcaaggaacttcagggttggacagactccttacatttattatttttttttctttttaactttatcctttacctagattccccaaatgtcaacacctcatataactacatgaaaatgatcaatatcaggaaattaacattgatagaccacttttaccatctatctagtcaaagttagtcaatttcccaatttatgtccttcttctgaaccagggtcacacatgggattcggttgtcacgtctctttagtatcttttaatttggatagttgctcagtctttctttgtctttcataagcttgacaccttgaagagtactggccaattatgttgtagtatatccctcatttggggtttgtctgaaattttatcagttaatttatttttggaaaatgatgttatgtccttgtcggtgattgtatcaggaggcatgtgatgttgctgggtctcattacaggtgccattaatactgatcacttagctaaagtgatcactttaaagttattatttttcctttcataattaagtatactgtggggacagaattgtacattatatata

SEQ ID NO: 107938 - DNA, 601 bp, Human
agtatagtagcttgcacataggttcatactaaatatatatttgtggaataaactcaaaagttatttaaaacagctattgccaatgtttataattaacttctctaagaatgatcatattggtttctatctgaagattcaatgctaaaaaagaactgaagtctctctgacaaactctagagaagacagtacagattttctttgagtcttgctctgtcacccaggctggagtgcagtggcgtgatctcggctcactgcaacctctgcctcccaggttcaagtgattctcctgcctcagcctccygagtagctgtcagtacaggtgcctgccaccacgtctggctaaattttgtattgtcagtagagtctaggtttcaccctgttggccaggctggtctcgaactcctgacctcaggtgatccacctgccttggcctcccaaagtgctgggattacgggcatgagccacctcgctgagctgacagtacagattttcaaagccattctttacccattaatggtgggaagggaggagcattttctctccttaatactttatatatgtatccattttctataataaacatgatattattttaataata

SEQ ID NO: 107939 - DNA, 601 bp, Human
atgatgatgttggcttgtaagcactccacatctaccaaaatacaggctgaccaccaactgccctgacctcacagatctcaaagagccatagagtaaataatgtcttcaattttctctctttcttactgggacttgagactccaccaggatgtacaatctaaaaggatgagggccatctccagacctatcgccatgcctgttacacaacaacaaataaaaatttgttgattgagtaaataaacaaaaatatattctgtgagtttgttttgaataaataactaagtctccagttatcaactcsccaagtcatacagcttagcttttaagttcactaaaactgacaatatcttcaaggcacatttacagctgtcagccagttatttgacttttcagcataattcataagcaatgtcttggtgacactcttattctagaataatttggcatagatagtcacattgtgcattgtcactaatttctgataaactattcacctcttcactattctttccaagaccatatctggtttgctgagatatccccttgatcaaacagaaattatagtcaggcacttaaaattgggtgtttgatccctttgtga

SEQ ID NO: 107940 - DNA, 601 bp, Human
aatttataatctgataagattaatttggagatggggaaagaaaaagggtaaactgctctgaaagttaccttcaattcttgtcctctggcaatgctaacatacaggtaccctactcgtgtttatgatgatgttggcttgtaagcactccacatctaccaaaatacaggctgaccaccaactgccctgacctcacagatctcaaagagccatagagtaaataatgtcttcaattttctctctttcttactgggacttgagactccaccaggatgtacaatctaaaaggatgagggccatctcyagacctatcgccatgcctgttacacaacaacaaataaaaatttgttgattgagtaaataaacaaaaatatattctgtgagtttgttttgaataaataactaagtctccagttatcaactccccaagtcatacagcttagcttttaagttcactaaaactgacaatatcttcaaggcacatttacagctgtcagccagttatttgacttttcagcataattcataagcaatgtcttggtgacactcttattctagaataatttggcatagatagtcacattgtgcattgtcactaatttct

SEQ ID NO: 107941 - DNA, 601 bp, Human
gctaaatattaaatatttattactaaataaatatttgctatatattttatgtgcaagcccctgtaaatatataagaatacaaagataattgttcactcattcattcactcacttattaatttatttatttaggaaatatttactgagtacctataatgttcttgatactgaatgatcaatccttaagcatagtaaaatgtagtaggggagactagtcctaattacagataccagaatgtaggacattatgttagaaacccaggaaaagatcgaaagtgtctaggtattcaacacatagatyagcaatacttattttcttacctggccatttgttatttcattagcctgatggttttaccttttaatatctctgtatggctgtgccatgcataacgttggctagtccctttaaaattgtatttctcgggtaaaattatttctataaatgtatcacttgctttttgaaatactactactctgtgcttccttattctaatatttcaaaattcggtcaaaaaattaatcctatctatgactttcatcagtttataaaatttgttcacataaaaagaacccaatttaatattttctcatatagaaa

SEQ ID NO: 107942 - DNA, 601 bp, Human
atagacttctttgtaggtatagtacacttccctttattgacaatgattgaggataattggtaatttggttgcctgaatgttctagctaattgggagctgtcaaatacatcatgtctaattttcgaagaattgtaataaaatagaggtcagaaacacagaaatacagaattggccatattagctcagctttataattcttgaaagtttggttgactattttattaattcattttaataaataaataaaataaatacattttatttattaagtaaatatttgttaaatattagttattattamatatttgctaaatattaaatatttattactaaataaatatttgctatatattttatgtgcaagcccctgtaaatatataagaatacaaagataattgttcactcattcattcactcacttattaatttatttatttaggaaatatttactgagtacctataatgttcttgatactgaatgatcaatccttaagcatagtaaaatgtagtaggggagactagtcctaattacagataccagaatgtaggacattatgttagaaacccaggaaaagatcgaaagtgtctaggtattcaacac

SEQ ID NO: 107943 - DNA, 601 bp, Human
gtggcacgatctcggctcactgcaacctccacctcctgggttgaagcgattctcctgcctcagcctcctgagtagctgggattacaggcacgagccaccatgaccagctaatttttgttttgttttgtttttgaaacagaatcccattttgtcacccaggcagtagtgcagtggcctgatgtcagctcagtgcaacctctacctcctgggttcaagcgattctctggcctcagcctctggagtagctgggactacaggtacgcaccatcatgccatactaatttttatatttttagtagakacagggttttcaccatgttgaccaggctggtcacaaactcctgatctagtgtgatccgcccacctcagcctctcaaagtgctgggattacaggcatcagtcactgcacccagcagtgaacttgttatgttaaaaatgaaggtagatgatattcgctaaaatatttttttttattttttgtagagatgaggtctcactatgttgaccagactggcctcaaactcctgtcctcaagcaatcatcctgcctcagcctcccaaagtattgggattacaggcatgacatagcatccaacctaaaa

SEQ ID NO: 107944 - DNA, 601 bp, Human
agcacttatagtttcacctcttacacaatgcaaacttttaagtgtaaattaagttaataaatgtactaaaacttaaggtacaagatatgactaattgatattttcatgtatttatttcctacctcctgggtaatgataaaccatagatagctttgtagtgaacttgttttttggtttttgttttcattttgtgttttttttttttttttttttttgagatggagtctcgctctgtcacccaggctggagtgcagtggcacgatctcggctcactgcaacctccacctcctgggttgaagcrattctcctgcctcagcctcctgagtagctgggattacaggcacgagccaccatgaccagctaatttttgttttgttttgtttttgaaacagaatcccattttgtcacccaggcagtagtgcagtggcctgatgtcagctcagtgcaacctctacctcctgggttcaagcgattctctggcctcagcctctggagtagctgggactacaggtacgcaccatcatgccatactaatttttatatttttagtagagacagggttttcaccatgttgaccaggctggtcacaaactcctgatct

SEQ ID NO: 107945 - DNA, 601 bp, Human
gtgcaagaataaatgattcgggtgggaaagaagttgagctgtgaattctcctttcttcatgaaacttacaaattgttttcatatagcattttccatgaaagtttggaatatttatgccaagaatgagcaagttgctaaaacagtctcccttttcatgtcataaaaaagttgacatcgtctaaccagtccttcatttgtcagtgccattatagcaagggtccatgtgggtgacaaaaagtggatggtgtgcccaggaaactgggcaagatggtcacaaggctcttctgagctggtgctaagrggttcctcaagtcaacacacaaatttcaatttcaaggaccataactgtcctatatatttttttcttactctgtctattattcaaagccatccctgatacagtttttgttggggatgaggtgaactgtgtgacagtggggaaagggatggaattgaaacagcatcagtgcaagctttgggacagtctttaaaaaatgataatacaccatccaaatgatttaccaataggtcttctaaaaaaaaaagcaaaattaatgtttgtttgttaattagtgtatactaaagttcattacatttactt

SEQ ID NO: 107946 - DNA, 601 bp, Human
tactgagatcctttggcaataataacgatgtgtgtgcactgatttataaacttagcaccatctatttagttctagaatcactgcagtaattacaaaccaaagagccaattttgtgtcttagtcatcaaggaaagaattacagatttcaagggtttacagtttgctcttcctaattgttccgagttctttaggttatctactggaaccatatttgtccttaaatgtccaatcttaactttgtaaaaacaggttgctctttgcaacattgttgatttgttcaatatatattaacaaattattraatgatttttaaataacataagaaggaccataacactttgaagtagatgtaaaattggagggattggaaaaccttttcctttcaatttctgaagttcaaatcaatacagatgaagtgagaaatgggttactattacatgttttgaagagccaaccaaattaacaacatagcaactaaaaaggccaaacctttcctaaatttctcccctgctgattaagtatcctctcaataatcaatgttatcacttcattcatgtcttatttcactgtttagtgtttcatcatcaatatcttatgctat

SEQ ID NO: 107947 - DNA, 601 bp, Human
atactgagatcctttggcaataataacgatgtgtgtgcactgatttataaacttagcaccatctatttagttctagaatcactgcagtaattacaaaccaaagagccaattttgtgtcttagtcatcaaggaaagaattacagatttcaagggtttacagtttgctcttcctaattgttccgagttctttaggttatctactggaaccatatttgtccttaaatgtccaatcttaactttgtaaaaacaggttgctctttgcaacattgttgatttgttcaatatatattaacaaattatygaatgatttttaaataacataagaaggaccataacactttgaagtagatgtaaaattggagggattggaaaaccttttcctttcaatttctgaagttcaaatcaatacagatgaagtgagaaatgggttactattacatgttttgaagagccaaccaaattaacaacatagcaactaaaaaggccaaacctttcctaaatttctcccctgctgattaagtatcctctcaataatcaatgttatcacttcattcatgtcttatttcactgtttagtgtttcatcatcaatatcttatgcta

SEQ ID NO: 107948 - DNA, 601 bp, Human
ctcctaaaaatattacttttattatattttttatagtaaatatgtaaaatgtttttattatgctgtaaatataacagaaaatatcttttcaggaaatgtccagagatctgttcttgattttgtgtttttatcatggactttgtctactgagtactattttaaacaagtaagtgattaaaattatttttgcatttaatttattttatatacatagaaaatataaatgtacttatatacctgagttaaaataaatataatgtatgtatgtattttctaagccctatgtgtgataataattcartaaacattttggagtgtttattatgcttctgactatgtacagtatttatattcaacccacatttcatactgccttttgtggcataattttggaatgtagaaatttatactgagatcctttggcaataataacgatgtgtgtgcactgatttataaacttagcaccatctatttagttctagaatcactgcagtaattacaaaccaaagagccaattttgtgtcttagtcatcaaggaaagaattacagatttcaagggtttacagtttgctcttcctaattgttccgagttctttaggtt

SEQ ID NO: 107949 - DNA, 601 bp, Human
ggaaaatacaattagaaaatggggttaataaaaacataaacatgtgtacatcatttcacatgtttttcatattatctgatatggtttggctctgtgtctccacccaaatttcatctcgaattgtaatcgccatgtgtcaagggaaggacctggtgggaggtgattggatcatgggggtggtttccctcatgctgttcttgagacggtgagggagttctctggagatctgatggttttaaaagtggcagtttcccccgtgctctcctctctctcttctgccaccatgtaagacatgccttgyttccccttcaccttccaccatgattgtaagtttccttaggcctccccagccatgtggaactgtgaatcaattaaacctcttttgtttataaattactcagtctcaggtagtatattcatagcagtgtgagaacggactaacacatctgtttaatggatcttgatattcctatccattttataaacaagaaagttgagcacaaaagtattataaactcatcaaattgcatacattaaatgggtatagctttctgtatgtcagctatacttcagtaaagtggtttaaaaattatagaatatt

SEQ ID NO: 107950 - DNA, 601 bp, Human
atttgaaagataaaagaccagaggaaaatacaattagaaaatggggttaataaaaacataaacatgtgtacatcatttcacatgtttttcatattatctgatatggtttggctctgtgtctccacccaaatttcatctcgaattgtaatcgccatgtgtcaagggaaggacctggtgggaggtgattggatcatgggggtggtttccctcatgctgttcttgagacggtgagggagttctctggagatctgatggttttaaaagtggcagtttcccccgtgctctcctctctctcttctgycaccatgtaagacatgccttgtttccccttcaccttccaccatgattgtaagtttccttaggcctccccagccatgtggaactgtgaatcaattaaacctcttttgtttataaattactcagtctcaggtagtatattcatagcagtgtgagaacggactaacacatctgtttaatggatcttgatattcctatccattttataaacaagaaagttgagcacaaaagtattataaactcatcaaattgcatacattaaatgggtatagctttctgtatgtcagctatacttcagtaaagt

SEQ ID NO: 107951 - DNA, 601 bp, Human
cagctttcaggagctcctgggatgcttgctaaaaatgcatatgcctgggttccattctaggcccatggaatcagaatcttacaaaagctgttgacattgggcaagctgattgttctttccatttatttctgaaaacaaaatctagagtgtggtttttattattctggataaaagactgacaattgtgggtacaacagggaatattcaaatattttttcaaatataaaaaatcttttaaaaatatacttacatacgatttttgatattatgtataccacaattttcttctagtcctctaaasatcaaaatggactatatccttttcagaaccaacccactaaaaacaaactaccatcaatattgtaagatttgaaagataaaagaccagaggaaaatacaattagaaaatggggttaataaaaacataaacatgtgtacatcatttcacatgtttttcatattatctgatatggtttggctctgtgtctccacccaaatttcatctcgaattgtaatcgccatgtgtcaagggaaggacctggtgggaggtgattggatcatgggggtggtttccctcatgctgttcttgagacggtgaggg

SEQ ID NO: 107952 - DNA, 601 bp, Human
aagtctattttgcaatctatttacctcctggaaggagcagccagctttagaaatgaagtcaatattcttcagtacagacaaattaactaatgcacattcaacttccaaattgtcaacactgtggcttattaaatttatttaagcagtaagttgacatagtcgagatttttctttaagtcaactcggctgaggtttaaagaaaaaaaaatctggcaatgtgctgtaggtcagctctagagaacgtttacagctttcaggagctcctgggatgcttgctaaaaatgcatatgcctgggttccrttctaggcccatggaatcagaatcttacaaaagctgttgacattgggcaagctgattgttctttccatttatttctgaaaacaaaatctagagtgtggtttttattattctggataaaagactgacaattgtgggtacaacagggaatattcaaatattttttcaaatataaaaaatcttttaaaaatatacttacatacgatttttgatattatgtataccacaattttcttctagtcctctaaacatcaaaatggactatatccttttcagaaccaacccactaaaaacaaactacca

SEQ ID NO: 107953 - DNA, 601 bp, Human
gcttgaaacttctggtctactgctgcccattttgtaaaaaacaaaaaaagaaaaaaggcatttttccaaagaaaatatttatgttcataacacaatgataaccaagttactttttaaatagcacaaaatatttaccacttgatttgtaagacaataactactgcacacattttgaattcataaattacgattcagctttagactcaatctgtactgagttactcagtgtcatcatgcctcaaatctagtaagtaattaatgtggaggttttgggaagcagatagtctacatgtatatatgyacacacacacacacacacacacacacacacacacacacacaaacacaagtccccatatttatacctgtaaaactctgggaaaagtaacatttaaggaagaagaacaagaaagacagtaacagaaaatactctatgttcctgtgaataaagactaatacctaggtataaaattcaggacagtctcaagtttaataacttccagtccacatatatgatgtttccattctgtgctttgatgactgagacttactaatagacttaagtgccataatctaagtactaccatatatcgtcaattta

SEQ ID NO: 107954 - DNA, 601 bp, Human
agcttgaaacttctggtctactgctgcccattttgtaaaaaacaaaaaaagaaaaaaggcatttttccaaagaaaatatttatgttcataacacaatgataaccaagttactttttaaatagcacaaaatatttaccacttgatttgtaagacaataactactgcacacattttgaattcataaattacgattcagctttagactcaatctgtactgagttactcagtgtcatcatgcctcaaatctagtaagtaattaatgtggaggttttgggaagcagatagtctacatgtatatatrtacacacacacacacacacacacacacacacacacacacacaaacacaagtccccatatttatacctgtaaaactctgggaaaagtaacatttaaggaagaagaacaagaaagacagtaacagaaaatactctatgttcctgtgaataaagactaatacctaggtataaaattcaggacagtctcaagtttaataacttccagtccacatatatgatgtttccattctgtgctttgatgactgagacttactaatagacttaagtgccataatctaagtactaccatatatcgtcaattt

SEQ ID NO: 107955 - DNA, 601 bp, Human
gatggagagacaagggtaggtccagttgtagctacaaaggctgtagcagtattgaagtgcatttcccagcaatgccacaccatgattaccctgactgtgactaatcagctgagatggggtagaaatggcaaaggaaagctggagtttgaaggaaacatgaggaggaggaggcagagtgaggctggggttgccagccacacaaacactggagctgagagagctagtgtcctccccagacacagatttacctccatcccctgagggtgggcacatccccattaatcctgagttgagggtgtgygggtgtggggggtcagaaagtgagagaagagtgtgccctgtggccattcccttacttaatacttactgaagcatcctgctaggccccccaggcccagagctgaggcctggaagaacaacagttagctagaggacatagagagatatagacacaattataattgactggagagagtgaagtacagatttcttttttaatgtaatacattagaggaggaagaagtgaattctaggagggggaaaaaaacccagaaagctttttggaaaagggtccatctaaaggagtcataggacttagatt

SEQ ID NO: 107956 - DNA, 601 bp, Human
gcagtccctgagccctaagccactcgtccctacaactgaggcagggactgctgctggtagtggttctaacagtcaggtacaggctctagggaactaagggcatcatatgccttggggagcaaaaatcttctgccagatctgtgttcaggatcttctattcttccatagtccccaggaatccatctgcttcctggctcaccacctatttccctgacacagaatagaatagaaaatagtcaccctcctatttgtatgaaacaacgttttatttttttaaatgttgtttttgttagtaacacayatgaagtaaagaggttcctctcaaacctatttttcccatagagccatcgagggaagtcttcatgatggagagacaagggtaggtccagttgtagctacaaaggctgtagcagtattgaagtgcatttcccagcaatgccacaccatgattaccctgactgtgactaatcagctgagatggggtagaaatggcaaaggaaagctggagtttgaaggaaacatgaggaggaggaggcagagtgaggctggggttgccagccacacaaacactggagctgagagagctagtgtcctccccaga

SEQ ID NO: 107957 - DNA, 601 bp, Human
ggaggatgcaaatagcaggattttagaaactgcagagcacaataatgctatacgagtcaagaatgagctggttcttattgtgagccttgactgggagagcaggcggcaggggagagaagtgctggtgacggctgcccacagtgcctatggctgctgggacactggatggaatgtattcatgtgcttaattctctctttaggtcaagaagcataaaatatttagtcagtagaagggtctattcattattcctcaagcaatagtccaacatctcaaggaaaaggccgtttaggaaagaaagcrctatcattatgaccagacaaacagtgtggtcccagatggaaactggggaactccgcacctacactatgcttaactctttcttcccttatctgtcctaagtctaactttgccctctgtagatacaacacatcaactcctactaaatctgctcctttttgtatatgacaacccttaagatatttgaagacatacactccctaaatctttgctgcttcaggaaacaggtcactaatttcttctacagttccttatatatgacacatgccatagtttccagcctgccacatcctatgagatcaa

SEQ ID NO: 107958 - DNA, 601 bp, Human
aaaaagtgattttttaaaaagtcatggataatgatggaaaatgagggacacctgtagacctgaatttgagactgtgacagactctgcaagctgctgaaaaatgctgtttgacaccaagacaagatactaaagtggatcactaaagagacagtgtgagttaggactaacccacactatcagtgcattcagtacacgttcagactaacctcaaattagaaaagtagcagacatcatgtatctgggctttggcaaaaagtctttgataaaaagtctcatgatatcctttgaaaaaagatagagsaacatgggcggaatgatgttaacagtttctttaagagagatttctatgcaactgaagaattgcacaaaatgcaaccatgtccatgtgagagcatgttctagtgcttagcactgcattgctgtcctatgcatttctggcacccttaatggaaatcttctagaacagaggttggcaaaaaaaaaatttctgtagccagatgccaactatcttaggcttacatacagtttccatcacatgtttttcttgaaaaaaaaaatttacaatcattcttagctcaacggctgtataaaactagagcaa

SEQ ID NO: 107959 - DNA, 601 bp, Human
atgcagcatcaaagacattggcagaatctgtgcttggtcacttaccttagcgctgagtccaaggcacattctgatttaaaaagtaggagaactagaactcctttggaggaaggagaaatagggaagaggtagggcctgtggtgagagcaatcagagcagcagtgcagacaaggaagccagaccaagggtgggggaagctcagtctggaatgtgctagtgaggtccccccatacatggcagtagatgccaacatgatggctgagaagaatatgaggaaaaacagtcagaaatgtgtaagagrgcaaaaggggcttttaaggggaaaaatcattttccaataatcaggtcatgtggagcatgtctacatgctactttgccacaactggacttcccatcactaccgtctatctagcgtcacgatctgcattcatttattcattcaggaactacctggtcatgtcacaggtgtttgttaaaggcttagtaaatgctgattaatcagcacataaacgctacaggagagggcttctacctctctccgagaatttagaaataagattgtttgttctctaacaggtgagctcagtaaaatccacacaca

SEQ ID NO: 107960 - DNA, 601 bp, Human
taaaggaggaaagagaaaaagacataatgtgacagaaaaattcctattcttattttgtttaaaggtattgggatccaacttgaaacataatttcttagccatttaaagtagtgaaaaattaatactaagttggatattagaatcagaaattcctaacactggcaaatgaccagaaatgtatttttctcactacaaggttaaagaaccacaggggtgataaattttgggattatgcagccacaatatgcccgtcaaggcatgcgtataaaaacaagaagaacaattcagtccaactttatcwacgtgcttcatgcctacagtgcctttgatacttcgttaagaaaaggctaattttcctcttctgagccgactttattttaacattctatggataagggatcctgatatttttactttctttggagctgtttccttttaaaacatgctgggatacaccttgagaggagggctgaagtcagagatgaaggtgcaagtgcaaaatgcagcatcaaagacattggcagaatctgtgcttggtcacttaccttagcgctgagtccaaggcacattctgatttaaaaagtaggagaactagaactcc

SEQ ID NO: 107961 - DNA, 601 bp, Human
aaacctgataggcaagaggcaacctcgtttatgttatttgtgtaacaatcaactcctatataaagttcgcagtcatgatttcattgctgtaatacaatacacagattaacttggaaacatttcaccactctacgaacacacaaagagttgtagtacattagctatgtaatcctagcaaacaattaattggctttaacagccatggttatacttttaaagcaaatggtacaatatattttcctgaaaaccaaaactaaattataaatgctgtgaagaaaggtttaaaaaaaagatgtgctcsttgaaaaaatacttttactctggcttacatctttcgatggccttcttagcacatcccccacaccaccgccattcctgaggccctggttcagcacggtgacaatgcacataaggagagtgtcacacgtcctttcaattccatcttcatactcttcatcagctataaaaacacatacaaatatatgatataaaattatgtaaaaatatataaaataaaatacacataaaatgaaatatacatacaataaatatacatacatatacataagtatgtaaatttatacacatatgtaaatataca

SEQ ID NO: 107962 - DNA, 601 bp, Human
ccatctcaaaataacaaacaaacaaacagagagaaggctcagttcagaatccaaaacatagtgatgtcagtgagtagaagttcaagatgctgaaaaatcatatttggattcatattctaacaaaattaaatgtgattctgttgcataataaatatgttactgtgattaaaaatctgtttgccagttggtgaaaccttttggcattttgcatcacatttctatagtcagagaatcatgtaaatcacagaaataatgacaggatagctttggggtataattcctctctctatttatagaagcmgagaattccagtctaatgctcagttacataatctgaattttatccaaccttcattttgaaataatttttccgaaagcatgaaaaataaaaatccctctagcccctctttcctgcaaacagtctattcatctattattttagcatctgccgaacacttaccacagatgaaacaagttgtctttagaatttcttcttttttctgtttttcgcttctgagatcagcaaaagtatcgatgataacaccaaaaatcaagttcagaacaataatgataacaatgaaataaaaaagaaggtcataaa

SEQ ID NO: 107963 - DNA, 601 bp, Human
gttacatacagtaacgttgtagtgaacccttaggcttgttttgtgactatcaccaaaagatttttttcagcctaatgtggcaacaaggagggtgaatgaaacctagagtgggtgatcacccaaagaagaggatagattctagggtgccgagagaccagctacaaagacaactgaagccagaaagaggtgatgggtacagagaagagggcagagctgagggggatgatgagggcaatgagaaggaaggagaaggctgtgtgcactaggagagatgatgacaggagaaggggaggggagtggtgtgtgtgtgtgtgtgtgtgtgtgtgtgtgtgtgtgtgtaagagagacagagagagagagagaaattaaaaactgagagaagggccgggtgcggtggcttacacctgcaatcccagcactttgggaggccaaggcgggtggatcacctgaggtcaggagttcgagaccagcctggccaacatggcaaaaccccggctctactgaaaatacaaaaattagccaggtgtggtggtacatgcctgcagtcccagctactagggaggctgaggcagaagaatcacttgaacccgggaggcagagg

SEQ ID NO: 107964 - DNA, 601 bp, Human
ttgttacatacagtaacgttgtagtgaacccttaggcttgttttgtgactatcaccaaaagatttttttcagcctaatgtggcaacaaggagggtgaatgaaacctagagtgggtgatcacccaaagaagaggatagattctagggtgccgagagaccagctacaaagacaactgaagccagaaagaggtgatgggtacagagaagagggcagagctgagggggatgatgagggcaatgagaaggaaggagaaggctgtgtgcactaggagagatgatgacaggagaaggggaggggagtggtgtgtgtgtgtgtgtgtgtgtgtgtgtgtgtgtgtgtgtaagagagacagagagagagagagaaattaaaaactgagagaagggccgggtgcggtggcttacacctgcaatcccagcactttgggaggccaaggcgggtggatcacctgaggtcaggagttcgagaccagcctggccaacatggcaaaaccccggctctactgaaaatacaaaaattagccaggtgtggtggtacatgcctgcagtcccagctactagggaggctgaggcagaagaatcacttgaacccgggaggcaga

SEQ ID NO: 107965 - DNA, 601 bp, Human
ctggggaaaggttggagctgagcatgcatacttggcaataatctacataaaagtgatgtcaaagaggaggacagagaggagacaaggagtcaagggcaaaatcaaaaccttctattaaggggttttgggagacggaataggaccctgtgacccagagaaagcaagcagagggagaataaaaggtcagcgggaagttaacagtgagattcaagaacacttcaatttgttgatgacagttattgtgatgtttaaaggaatttataggtgactggctttttaataactgtgaaaagccaaagaraattctgaccgagaagggaaagcttagaggagcaggaatcttgggtaagcaatgggcttacgttgctgttcatgtttttggttaaaatataggagacaatatcatgtcttagaatgaggcttccagcctctggtccattcttccaaagagcatctctttcagaggtagtgtaccaacatgatgatgattatgaccgtgaaaaaaagggcatggaggaagaagcagtgcaaaagaaagaccacgagatacacagagaggtttctgagggcagcatcattctcctgtatgggactcaccctt

SEQ ID NO: 107966 - DNA, 601 bp, Human
agaagagaaattaacatgtgttgagggcagaccctcagttaagcctcgtgctagagattttgatatacatgatctcatttatactcatcacaacaccaaaccgtggcattatattcctcattttccaggtgagggaacaatagctcaggatgattagaaacttggccaagatcacatagcaaggatgcagaaccagtgtagacctatgactacttgtctataaagttcatgcattttctttgatatgagaatgcatggcatccagcagaggtgatcagacaacagaaatatgtacagtgcyatatagctaagtgtgatgtgaggaatttagggtccgatgtgtgagatcggagaagacttctagaacaatggcattagagctgggcctcagagagagggcaggagttcaacagcgtaggaattggggcattccaaatgaaattgttctcccacaactaagaatacatggagagtctgggaagttaaaggtaagtaatgtagttgccctggaacttgagctataaatgggagaacaacaggggagaaggtaggcaaaaaaagaaggggccagattgtgggggtagcttagatgccaggaaaa

SEQ ID NO: 107967 - DNA, 601 bp, Human
tgaagcttctagaaaacagacaatattgatcttacatctctttgtgcatcctgcaatgtcaccctacattcctgtgggcagcactccacagaaacaataccctgcatgtaacaaaatctggagcaacctggaatcagcacacctgttgtctgcagtatatacaatctcaatattttatctgccttttgtagattataagtcagacaagtatagagacaatatcagcctgaggctgacttattggatagtcattcattaagcaaatatttatggatattcaccaatgcacattatgaaagcaaaaaaaaatggataagacatggatctggttctcttaaagaagagaaattaacatgtgttgagggcagaccctcagttaagcctcgtgctagagattttgatatacatgatctcatttatactcatcacaacaccaaaccgtggcattatattcctcattttccaggtgagggaacaatagctcaggatgattagaaacttggccaagatcacatagcaaggatgcagaaccagtgtagacctatgactacttgtctataaagttcatgcattttctttgatatgagaatgcatggcatcc

SEQ ID NO: 107968 - DNA, 601 bp, Human
cagtaggcatgcaactaaatttgacagaataattaaataaatgaataagagagactgaagaggcattttggaatgaaaacttgaacgggcttgatgtccaattagagatatagatttagaagaaggagaaatcagtaatgactctgaattttctgacttgaataacttgagtttatgatacttgaatgactgagtttatgataatatcgccacagcaagataccctatccttagaataggaattctgacctatcatcaaatcctttctccattctgttgttttgtcacacctggtctttcracatctctttcttactggatcttcagcctctagtaactcaatgttcataattaatatggatgcaagagctaatctgtgtctctgcttcctgctcagctctgtcatctgctaatcctcaccctccagggccaccttctggatcactagctattgttttctgagtcatgtttcacttccaaacatctggacattgtcttcaaggctgggaaagttccaactaggtccattgcctgtcacagaatctacatcctcttgtcctactctgggtgtcccttggcacacacctggagccagttctct

SEQ ID NO: 107969 - DNA, 601 bp, Human
ccatgcccggctaatttttgtatctttttttttttctctgtagagatggagcttcacaatgttgcccagcctgaagaccttttttaaataataagatataaagcacaataagtaaaaaatctgtccccattgaaggggtgactttttacttacattattggatatctgtatggaaaatactataagattctgctggctgatggctaggcctcatcttatttgacctataatcagctcagcatgcccaaataaactacaattttcttccctaaacctgcttcacccacagtcctcccctttyattcgatggcagctctgttctagttgttcaagccaaaagcctggacgtcattcttgaatcctctccgcctctcacacagcacatccaatccatgttgaaatgcttttggctctaccttcaaaacatatccagaatctgaccacttctcacccgctctgctgctacactctggtctgggccattgtcatccctcatgtggattactgcaatagactcccaggcccccctgtttccatctttactctccacagcccattctcaacacagcagccagagcaatcctttaaaaacctaagagaa

SEQ ID NO: 107970 - DNA, 601 bp, Human
aaagaattgagacagtcatctgttcaaaaccacttggaatcagtgaaaggaacacaaagaagatggccgtccacacgctgaggacagcaagtgctcagactatgccagccctctagggtaccgtgttccaggcattttgggcagggggtgatctgttccatttccagggcacatttttaagcctttggaagtacagtaaagaaagcacctagataataaaattcttttctctcaaagttagagaatagatgaaaagaaatgaatagagatgaagaaaaacatctatggaaacatgaatttkagtgccaagtgaagtgggatgttgggattcagttaggttgttacagctcagatactgaagaagaaaccaggaaactgaaatccaaccctggctattctttctctaagcattttttgtaagttcactcagggatgtagaagacccttttatttatttatttttttgagacagagtctcactctgtttcccaggctggagtgcagtggctcaatgcagactcaacctcccaggttcaattgatcctcctacttcagcctcctaagtacctgggactacaggcatgcaccaccatgcccggct

SEQ ID NO: 107971 - DNA, 601 bp, Human
acaattttgtcagatttttttggggggtggggggaatatccaatctatagctatatttaattataaaaatgcaaacatttatatcagatgtaacgatactcactaaatgtgtacacatatacactgaagttgtaactttaatttccctttcgggccaatttgttttaattttctatgagacagaagaaacttcaaatcatggacaaccacatcctctgtcctaatcttgctgaggagttataagcaactagatgtggcaggatcagtgcaaattcatcagcaacattggtaaatcaatccraagtatgtgttgatggaaaatcagtgctctcccattaggactgaacatcatactatccccaaacacaattcaatttcttaaactcttgatttttgaaattcaagggattccttaaggtatgaatcttctgttcatatttaacaatgggaaagttccagatttcaggaagtgggacatcagcaatgataaaaggtatgatgtcagaaggtgatgaacataactgagatggtgctagtcattgcaaagagaatccaggaaatatcatctgtgcactggagactcaaatttggtttgaataac

SEQ ID NO: 107972 - DNA, 601 bp, Human
atataacaggagtctaataaatgtatattgatgaaacttactcaaactttgaaaaaagacagcaatgtgaggtcccattttaaatataatgttttacatgtttttaccctcagcaagcagaaacaaaatgtttttcacaagtgagatcaagaaagtataaatgatgaccatgaatatatatccttaaaatgattacctttttcctctgatttaaaaggaggaggaggcagaaaggcaaaagtggagaagacaaacaatgttaggttctgtccattgtccaatgaagaatgcagagaaaacaacttagagtagaatgcaagtcattaataacaaagcatgaaaaatgctgaaatatataaatccaatttacatgtagctcttttgtgacatgtaaatattgacaggtaaggtaaactatgactatatgaacttataattattaatatgttatcctccaaaaatgttctttggttgctccctaactacagtctcttcctaagcagatgataagtttgctgacatttcagcattggtgcaaatattggtgcttattaagtgttttccttaggaccaagtagcaaggaggatcatgagtcatcta

SEQ ID NO: 107973 - DNA, 601 bp, Human
caacatcaattataaagaatttgaaacttcttccaaagccctattgataagcacctaaatcaacttgttaagtgaacctatttttaaagaacaaaaataagagtggcagaaaatgtctggaagatttcctaccaaagtttgaagagtagctacctcaggagcagagaaagagaagagaaagaacagtctttgaactgaactgtagatgtgcttcaactttccacgtgctacaaaatcttctctctctctaggaggatagtcagaaggccatcatttccacagagcttggagtaacagattytctgaaatgggttttttagctacagatttttagatgttttccaaagaggctatttccataagtaaccttccatgcaaacaacttttcatttccatcagacctgagttaatatcactcttccttctcctggccattaaaattcaggaatggagcttgttctcttggatgtgcactgcttggatgaaaatgaaacgtttcatgttggaataagcttgggagttcttatccctcttgtcatggctctggagaaagctctgacagaagaggctggggagaaacatggataagtacttggatact

SEQ ID NO: 107974 - DNA, 601 bp, Human
ttttttttggtatttttaatagagatggggtttcaccgcattagccaggatggtctcaatctcctgacctcatgatcttcccgcctcagtctcccaaagtgctgggattacaggcgtgagccaccacacccaacctctattcttgtttttcccatttctctgaaaggtaggaggcattttctaagggtcccaaggtacaaatcagatttacataaacagtgtagcaggattcagatgagttgttttgtgaactaatatgaggaaggacttttcacattttcctttgcataaatccatgaawgtaaaagcaacatcaattataaagaatttgaaacttcttccaaagccctattgataagcacctaaatcaacttgttaagtgaacctatttttaaagaacaaaaataagagtggcagaaaatgtctggaagatttcctaccaaagtttgaagagtagctacctcaggagcagagaaagagaagagaaagaacagtctttgaactgaactgtagatgtgcttcaactttccacgtgctacaaaatcttctctctctctaggaggatagtcagaaggccatcatttccacagagcttggagta

SEQ ID NO: 107975 - DNA, 601 bp, Human
tgcccaccaccacgcctggctaattttttttttttttttttggtatttttaatagagatggggtttcaccgcattagccaggatggtctcaatctcctgacctcatgatcttcccgcctcagtctcccaaagtgctgggattacaggcgtgagccaccacacccaacctctattcttgtttttcccatttctctgaaaggtaggaggcattttctaagggtcccaaggtacaaatcagatttacataaacagtgtagcaggattcagatgagttgttttgtgaactaatatgaggaaggacttttcacattttcctttgcataaatccatgaatgtaaaagcaacatcaattataaagaatttgaaacttcttccaaagccctattgataagcacctaaatcaacttgttaagtgaacctatttttaaagaacaaaaataagagtggcagaaaatgtctggaagatttcctaccaaagtttgaagagtagctacctcaggagcagagaaagagaagagaaagaacagtctttgaactgaactgtagatgtgcttcaactttccacgtgctacaaaatcttctctctctctaggaggatagt

SEQ ID NO: 107976 - DNA, 601 bp, Human
ggctggagggcagtggcgtgatctcggcttactacaagctccacctcccaggttctcaccattctcctgcctcagcctcccgagtagctgggactacatgtgcccaccaccacgcctggctaattttttttttttttttttggtatttttaatagagatggggtttcaccgcattagccaggatggtctcaatctcctgacctcatgatcttcccgcctcagtctcccaaagtgctgggattacaggcgtgagccaccacacccaacctctattcttgtttttcccatttctctgaaaggyaggaggcattttctaagggtcccaaggtacaaatcagatttacataaacagtgtagcaggattcagatgagttgttttgtgaactaatatgaggaaggacttttcacattttcctttgcataaatccatgaatgtaaaagcaacatcaattataaagaatttgaaacttcttccaaagccctattgataagcacctaaatcaacttgttaagtgaacctatttttaaagaacaaaaataagagtggcagaaaatgtctggaagatttcctaccaaagtttgaagagtagctacctcagga

SEQ ID NO: 107977 - DNA, 601 bp, Human
ttgcccaggctggagggcagtggcgtgatctcggcttactacaagctccacctcccaggttctcaccattctcctgcctcagcctcccgagtagctgggactacatgtgcccaccaccacgcctggctaattttttttttttttttttggtatttttaatagagatggggtttcaccgcattagccaggatggtctcaatctcctgacctcatgatcttcccgcctcagtctcccaaagtgctgggattacaggcgtgagccaccacacccaacctctattcttgtttttcccatttctcygaaaggtaggaggcattttctaagggtcccaaggtacaaatcagatttacataaacagtgtagcaggattcagatgagttgttttgtgaactaatatgaggaaggacttttcacattttcctttgcataaatccatgaatgtaaaagcaacatcaattataaagaatttgaaacttcttccaaagccctattgataagcacctaaatcaacttgttaagtgaacctatttttaaagaacaaaaataagagtggcagaaaatgtctggaagatttcctaccaaagtttgaagagtagctac

SEQ ID NO: 107978 - DNA, 601 bp, Human
gtaaggctaggtgctgtggctcacacctgtaatcctagcactttgggagatcgaagcaggtggatcacttgaggtcaggagtttgagaccagcctggccaatgtggtgaaaccctgtctccactaaaaatacaaaaattagcaaggtgtggtggtgcatgactgtagtcccagctacttgggaggctaaggcaggaggatctcttgaacctgggaggcagaggttgcagtgagccaagattgtgccactgcactccagcctgagcaaaagagcaagaatttgtcacacacacacacacaacaaaaaagaatttgaaaacagaggtaagaaagttttaagttttgattaatatttcagaccccgatcctattattggatggatacaaagacacatatgtgtttcctgcgattctaacccttagaagcaatgtattactttatttacaatgtatgtttgatatagtatggatatctgtcccctccaaacttcatattaaaatgtcatcaatagatacaatattctctattatctgaattttacaaatgaagaaactgaggtgctatggcttggatatggtttgtctcctccaaacctcatgtt

SEQ ID NO: 107979 - DNA, 601 bp, Human
ggtaaggctaggtgctgtggctcacacctgtaatcctagcactttgggagatcgaagcaggtggatcacttgaggtcaggagtttgagaccagcctggccaatgtggtgaaaccctgtctccactaaaaatacaaaaattagcaaggtgtggtggtgcatgactgtagtcccagctacttgggaggctaaggcaggaggatctcttgaacctgggaggcagaggttgcagtgagccaagattgtgccactgcactccagcctgagcaaaagagcaagaatttgtcacacacacacacacacaaaaaaagaatttgaaaacagaggtaagaaagttttaagttttgattaatatttcagaccccgatcctattattggatggatacaaagacacatatgtgtttcctgcgattctaacccttagaagcaatgtattactttatttacaatgtatgtttgatatagtatggatatctgtcccctccaaacttcatattaaaatgtcatcaatagatacaatattctctattatctgaattttacaaatgaagaaactgaggtgctatggcttggatatggtttgtctcctccaaacctcatgt

SEQ ID NO: 107980 - DNA, 601 bp, Human
acgagtttgcaactgtgatgcagtaaaaggaggaaacggttcccgaaaacccatggccatgacatggggagggtggccatccaggtctcactagcagcccagtgctgtcagaatacttgtggaggcagcagctctccagacacgcatgccgcctgctcttatacagacctctggtttggatcctgctatttttcaaattaagtacaaatatccgttaatatacctcagcaaatgaacactggtaatctgaaaatgaccccaaaatgttagagaaacatctaaaagtcttgggtattttttmtaatgatgtctatttttgtttgttcctcctcagtcatcatcctttgcttaatgggagaagcaaaggggcttagtgatgctcaaaggccattatcagtatgggatggaggatttatcctttcataccttttcctctagttttctaaattttcttttattatttttactttcctgtatggtcgctccttttcccttcttactttctgttcccagcaaacactagctcaaaatatcatttattttatcaaacatgagggtttacatccccaaaataccttgatctactcatatttccctgaac

SEQ ID NO: 107981 - DNA, 601 bp, Human
taacaacctaagcactggaccagaatccttaagatgaagtcttcttcttcatcttcatcttaacagcattcagccacactgttaagtacctattacttctgtctctgtttcacaaactaataagaggaatagaaagatgttaacatctgtgcaaaaatgaggtaattcatggtcttacacatgaatactaaagagaaaatgagaataacataggggacagatcccatagtgacaataaaaatccagagaggggcattttaaaagatccatcttaaattacagacacatgtctggacttaamatgtgggaagtgagggtggtatctccctgaacgctcaaatttactttttaattgtgcattctgagctgcaaagacccccttggctttccttgaaatgtaaacatttaaaattaagttctgaagtctttaaaatagtgtttagttaaagattaagcagttacataattggcttaatgagatccaattacaaaattagtgtaaactagaagtaatagaacagaacatataatttcataattatgacacataacaataatgcagaaattaagttggccagtggtgctaaagcaggaggggtgc

SEQ ID NO: 107982 - DNA, 601 bp, Human
agtcaatacttatccatgtcagttatgttagttgtagtgttgttagtggcatgattttattgaatcctcatagcagctctgcaaaaaaagtgcagttatacccagtaccaatatttagctggtatgcaaagatatggctgtactgcaatatctcctgattgtcaagtaagcccctctcataagccctccaaatacgccctccccctatacccctgcagatttatctgccctagtctgcctctgggatccccaccacgcctcctctgcatgatccaacaactgaagggttaatgcctgatayagccagaggcctccagagtcctagctcacttcagttggcttctattttgagttctaactggcccattatacatattttatcaatgggtacattgaagtacagaggagataagtaaagtcactaatcttgtaaatggaaatcctaagaaatcaaacttcagattcatatgctcaggtttgttccttcacacggaacttctccttaaacactgattagaaaagctaacaaaagccacttgggttctgtaactctgtggccaatcacccgaacactagcagatctacagtttctgatcaattc

SEQ ID NO: 107983 - DNA, 601 bp, Human
ggatgactaacatttttctgagcctcaattcacataaaatgggtataaataagataacacgcaaagttgctaacacatatcatatccttaattcgtttcctttcttgttctcacacttttcttttaagatacacactttgcctggaacatattcccctccatccttctatcaaaatcctcctcatttttagctcgactctcctcaaaatcttctcggtgaaactgtccttagtgccttcgaccagaaagaacctgtcctctgtgctccagtggctctatatcttatttattttgttcaacraatttatgctgagtgcctactatatactgggcattaatttaggtgctgggaatacagaagagaacaaagcagaagtgtaaatgccttaatggggtgcatatggtactgatgaagaataaacactccaataaatataaaaacaatttaaggtcagatcaatataaagctaaaggaaataaagggtggtgggctaggaagtaacgggaatggggatgtcagggaaggcacagacatgcaaagagccagaggaccatgactgcaaagagccagaggaccatgaccacaagcagaaggcacacg

SEQ ID NO: 107984 - DNA, 601 bp, Human
aagggaagttagagaatctgcctcaactctgcatctctaaaccaagcctagcacctcgaacacaataacactcaatctgcatttgttgaataaacacatctttaaaaaataaaaaatgattcattgtcctgcattttcaaggcattttagatcacacctccacgaatgcagcttagagattaaaaattctaactcctaaaaatattggagaaacagaaacagctttcttccttctaaaggatgtcttttggcttttggttttgaggttttccctacctgttctccaatacttgatttacayatatttagcctttgtcaaattttacctgattattcactagaagaaggcatagctaaaggtaaaatcatagacatcggtcccaggaaaatctggatttgcatcctagttcaagtacttatttacagagcacctgggatgactaacatttttctgagcctcaattcacataaaatgggtataaataagataacacgcaaagttgctaacacatatcatatccttaattcgtttcctttcttgttctcacacttttcttttaagatacacactttgcctggaacatattcccctccatccttc

SEQ ID NO: 107985 - DNA, 601 bp, Human
agggaacagcagaagccaaggttggcagaattgaaagcctcataaagaagatcaggaaggctgagcctagtgagagaggcaggtacggggttgggtgtacgggaaccgagccctcttggtttatggattgtcactcttggtcaaatcttctttccaccacacccatcccttcctatttccagttccttctatcacatttttcatcagtgtgatggtcactgattttccttctgccagactcttgccccttcatgaaatcctgctatagactctttgatacttccttaaaatcggatttttwaaaaaatcacataattcctctacataaaagtcatcaatgcctctcctgtgtttgaaggatcaaacaggaactccttaccctgagaattaattcctgtttccctttagctccaacctaatccaggtgggttcacctactctctgagcttcaattattcagatctgcctattttcctttatacacaaggtcctcttcccatgctagaggacagctcctcatcttagctcatcaaatattgctgcctgttattaactcatctttatgaccatatattattatttctcattaggcccaagattc

SEQ ID NO: 107986 - DNA, 601 bp, Human
gttttgatggagtcttgctctgttgcccaggctgaagtgcagtggtgtgatcttggctcactgcaacctctgcctcccaggttcaagtgattctcctgcctcagcctccccagtagctgggattacaggcgcctgccaccaccaccggctaatttttgtgtttttagtagagacagggtttcaccatgttagctaagctggtctcgaactcctgaccccgtgatccgcctgcctcggcctcccaaagtgctgggattacaggcgtgagccactgcgtccggccaaacacgagtcttatgtrtgatttccaaaactcccatcttcaatttcattctgttttctctcctgaaacatcccagttttgttgtctccagggaccaggatatcattgccctctggatggcccattgacaccatacatggaatgagctggcaaccaaaatcagtgtgcctgaatgtttgaggagagaggataaaaactgatatttcagtcattaaaagtattcttcaagtcacccaaactcaaaaccttagtcttctttttccctttctcctaaatactctgtcagcaagcagttttcttaagttctctttcacctaa

SEQ ID NO: 107987 - DNA, 601 bp, Human
taggaacaaattatttcttctgggaagactttctgtgttattacgatttgaaaagatcaaataatttgcatgggttgccagatagagaaattgtattcatgtgtattagcccatgtttctaccactgtttgtttctagttcttcttacacagtgcactatatttcactaatgatatcaacaaatttctagtccttcttagatagtacttcattggagaaagagatggctgacatgggttgttgactaaatccaactcgagcctcgactacattttctttgtgattttcccctgcagaccasagctggcaacctaatcacagccaactgaaccatgctcttctgattatgttctgcaaagtagtttatttgacattggaagactctttggggactatttaaatgagcagaaccttataataaagaagagagcccactgcttttcttcgagcttggtatatgatttccctatcattctctggcttccaagtttgtccagacttgtggttttaattacaacaccacaaaatatcagcactcaaagagtctttggatagatttaattcaacatccttgtttttcaaaaaaggaagcaagaagcag

SEQ ID NO: 107988 - DNA, 601 bp, Human
ctagaaatgttaaattgttcatgcttgtttaccattatataagtaagtttaccattttaaatcctgaaataaatttgctcatctgtgcatttattctagaagttaggaagtaggaaagagaaggtgttttctttggaaaataaactgtggataatacttgcatactagctaaaggaataatgttttaattaaaaggcaaatctatcacttaaggagtttaaatagaatgcttgtttaaaacaattctatctgactaagacaatgtcaatgaagagggcagccaacgtgtttaaacacaaawgccaatgagcgtgcaaaggaaaagtcttacacaaacactgatcccacagctgctgcctgcttagaaaccatttctttttgaatattatttatttcagtattattcttgcacactgtcaaatttaccatgaaaactataaattattttaaactacaaaataaaaataacacgtagaatatctttaaaaaggcaccagaagagaaatctattttaaagtaattaccagttaaacctcttctgcttgctgacaggttttcagtgattatacaacaaatattcttattttcctacatcggttgg

SEQ ID NO: 107989 - DNA, 601 bp, Human
cactgcgttctattttaagcaaagcagtattctgactacagttatctggtataatcagggaataacgataatgaacatgaattgcgaagcgagactcattggtatcacactggcccaggtagaacacagaagggagtcatagttttattttagggtttactagcaaggttaaactggaaactctaggcaagtcagacagttttcatgcctgaacacagaggacctgaggaaaggaaaatgaacggtgtcactacaaagaatgaaaatgtaatttgaagcttagtgattcctgaaacctggrtacctaacaaaatttttaacgtaagagtagggcattgtatatttcccaaacattccaggattcaagaaatggctcctgcaactttaattacatgactctttttttctttttcctgaaactgtatttttttctccttggcgtactgtatccccagactcatgacacaggagttcagaagtaatagatcagaattttcattaagtacacatgacaccctagaaatgttaaattgttcatgcttgtttaccattatataagtaagtttaccattttaaatcctgaaataaatttgctcatctg

SEQ ID NO: 107990 - DNA, 601 bp, Human
agggaaaaatacactgacctgccatcatgtgtgtctgtcctgcttgaaaatcaatttatcttgttaaatcaatgcataggtattctgatttatccacatttctgtcttttgactccggttagtgtgttactacccccaatttgttctgtgtaccctgacggcctctaggatgagtctgtaaaggttagcactgggcctggacctttgtcccctaagagagagactgtctggagcactgtcctgagagaccatctgatgatcttcaggtcggcctccccatgtggtaacccaatatcactgygttctattttaagcaaagcagtattctgactacagttatctggtataatcagggaataacgataatgaacatgaattgcgaagcgagactcattggtatcacactggcccaggtagaacacagaagggagtcatagttttattttagggtttactagcaaggttaaactggaaactctaggcaagtcagacagttttcatgcctgaacacagaggacctgaggaaaggaaaatgaacggtgtcactacaaagaatgaaaatgtaatttgaagcttagtgattcctgaaacctgggtacct

SEQ ID NO: 107991 - DNA, 601 bp, Human
tttctctgtagcacccattaccatcaggcagactatattatttatcaatcgtattgatggcttgtgtgttagaatgtaaacatcatgaaggtagggatttttatctgttttgttcactgccattctgggatatgggcctaaaataattcctggcacaaaataagtgctttatacatagtataaatgaataaatgaatgaacattcacaataaccctaaggtagatactagtcagtgtttcccaaggtcacagagctggtaagtgggaaagccaggactcacacacaggatttaagcaagcycttgtctaaactctagtctccagctggatgcagcaatgaggttacatctgtttatctcggtctggtcaactattcaaatcataaaaccaactaactccctttgctcccaacctctgctcattcagcaaccaaccttctcattataatctggcgtctcagggaaaaatacactgacctgccatcatgtgtgtctgtcctgcttgaaaatcaatttatcttgttaaatcaatgcataggtattctgatttatccacatttctgtcttttgactccggttagtgtgttactacccccaatttg

SEQ ID NO: 107992 - DNA, 601 bp, Human
gatgggtgatcttgggcaagtcttattttattctctcatgaaccctatgaaaggcagccccaatgctccccaagacacaggaagaaaaactaagctacacagttatggcagcatcacgagtcacgtagatcagggcccccaaaccctgggccatggaccagtaccagtctgtggcctgttaggaactgggctgcatagcaggaagtgagtggtagatgagtgagtgaagcttcatctgtatttaccccatcgcctgcattaccgcctgagctccacctccggtcacagcaacggtggtatyagattctcatagaagtgtgaacctcctattgtgaactgtgcatttgagggatctaggttatatgctccttttaagaatctaatgcctgctgatctgtcactgtctcccatcacccccagatgggactgtctagttgcaggaaaataagcacatggctcccactgattgtacattatagtgagttgtataatatttcattatatgctacaatgtaataacaaataaagtgtgcacaataaatgtaatgcacttgaatcatccccaaaccattcccacctccaccccctcacccccgatccc

SEQ ID NO: 107993 - DNA, 601 bp, Human
atgcaatgtatggtgtaaattttctacccaccaaatcccactttgaatacataagtcttctgttattctctaattcacaataacaccaccttattgtgtagaatcccattgcaataaatacacttatgatgactggatcaaagtaattttgtgatatgcccagcttgcaagtggcttgtggttcaggggctggagggtgctgtattcccaggcttcaagctggggtcaaagtgctaaagctccgttaagcaggatggaatcacttgcagattgacattccacaaggcagtgtgtcacctgycctagttcaacctgcacttcctcagaggtgggcactagcaatttacttccagcctgagcttaaggtcaaacccagaactagcaaggatgtttcttaccaaaattaaaacttccataggccttctgagacctaagcaccagcagaacattttagaaaacatctttccaccattccctgggtcacatgcatctgagggccactcagatttttctcttagtgcctagcccacaagcccagcaagtgctcaaatatgtggaggtagatgcatacatgcaagaatacggatagacttttactgtc

SEQ ID NO: 107994 - DNA, 601 bp, Human
ggtctgtgcaccatattaatgctaactaggatgaaaccagtcttggcatcatccaaatgagaggatgctcagatatacagggaaccaagaaagcaggctatgatttaaaagtcagaggttttggaggcagggcaatctcagtctgaatcccagcctcacctctcattatgcatgtgatcagattagtattaaagtttcttcttctgaaaatagggataagaatgcctatcttttaggatttctgtaagggtttcataaaatgatgtagagaaactagtgcaatgcttttctcttgtggggaaaaaaaaagctaatatttagaacatgcttttggtgggaggagatggcagggggtcagggtggggaagcgtaggtgtgtcatgagggaacatatggtttggggcaaagcaaaaggagagtgggaggaatgatctgtgattggcctcatgggatgatgacatccccagagttaacacattttcagggacaagcacatggcgtcacccggatgtgagttttcaaaccttcccatgtcaattgcaatttgggagtttccatccactctgccccaccctactgcttggtaaccttgtgggaatga

SEQ ID NO: 107995 - DNA, 601 bp, Human
atactgaaatagatattgaagcaattcctacatgtaaaacttgtttctaatacatgatgaagccagtctgatgaaataacataatgttttatgattggccaatcatatcacttggtatttcccgagtgacagagtgtcttttttattcatgggctgccagagcgcacctgggtttatgctaatgaggtgactcttggtgggcccctacatagtgttgggaggttatggcgttgggggaagggggttggttaccagagagaccaagcacacatgattgcagggttggggtttcaagtcagcyccacctctggaaagggaaggaaggatgctggagatcgagttcattcacatggccaatgattcaatcaatcaggcctatgtaatgaagccctaaaaaaacctctggatactggggcttggttgaattttgttggtggacacactaatgtgtagggagggtgatctgccctggctccatgtggagaggccatagaaactccatgttccctctcagacctcaccccttgtgtcacttcatttggcagattctcttgatttgtatgctttatataataataaaactgtcatcattagtgttttt

SEQ ID NO: 107996 - DNA, 601 bp, Human
ccatactcatcgtacatgctgatttggtaatcaaacaatttattggctaaataggtacacattggagcataaaaggagtgctactaataattatgtagagacgaggacattaggtgaaagactgctccagtcaaaactatggttcctctctgggttccattaaaacctagactatcatttattggatctggaccaactaagtaagaatgaaataattctgtgacagtatttgggcagcttctctagattagaaagtcccatttacatgtgtaaaattgtgagagcatgactttgagatatwatctactgggaagtcataagcattctggtcactcaaaaaatgcctataacaatgggttttaacatatttcttttgtgagagtggtccgtactggccactcccatttcattattacccattctctcctttaactcttataaaatagacagatgctaatactcccttgaaattcctctttgattccaaatacctttttctagaaaatccctattttttcccctcagtctttcatccctggtctctctactggtctctgagctttccaaaaatccactgccaacaggctggggcacactcagg

SEQ ID NO: 107997 - DNA, 601 bp, Human
tgagaacctaaagaaaaaccatccccagaaattgtttagcaccataaccaaatgcaacaacaaaaatgcaaaaatagaattaaaaactgttttgggccaggtgcagtggctcatgcatgtaatcctagcactttgggaggccgaggcaggtggatcacctgaggtcaggagttcaagaccagcccggccaacatggtgaaaccccgtctctactaaaaatacaaaaattagccaggcatggtggcaggtgtctgtaatcccagctactcaggagactgaggcaggagaatctcttgaaccygggaggtggaggttgcagtgagccgagattgcgccactgcactccagcctgggcaacagagccagactccctcaaaaaaataaataataaaatccgttttggtaaatgcatctgttaccttttgatagtatatttttaggtttgtctcacacaaataaatgggtaaatctgctaaaagtctactgctccttttgaaaaaaaaatatttaacaagtgatgatgaaaccttaaaattacagagtagctcaaggaagggtccaccacatggtcatagtcacagagcgttacctgctgtcatct

SEQ ID NO: 107998 - DNA, 601 bp, Human
gggtggcaagagtgggacacagggaggtgataccacagtaatgtctgccaagggggctttgaagtcaaaaactgggtgcttgaaaatgcacacttgacagacaacagttttcccctggaggataagaacgcattcacagagctcaaaatagttggttagcatgattaatgtgaacagacagactggataattcagcccctaaagtggattattaggccaaaatcccacagctgttctctcagagaagagaactgggttgcgccatttgtaaggaccaatggtgcacatctctttccacctstgcatccagtgacactgtgttggcagtttgaaatcaaccctggtgggagtatttgcaccatggacataggcagatgctataattgaggcttactcaaattggttgttaaacaccaactagcacaccactgaacaatgtcccttactagcggagatggaggagaccataaaggataggttaaattaaatgactgacccaaagttacacatcagaagatcatagcagaaccaggacaatgaaggtctcctaatacaacaaagatgcttctgaccttaaaagcctctttacctttgaacatgt

SEQ ID NO: 107999 - DNA, 601 bp, Human
agcaggactctaggatgagtgaccagctctgatgagtgacttgctgggaggctctggggacgggcactggtcccaatgctgacccaacatgagggtgagaaacactcagagaggggaggtggagtccagctcccagaactgctctcagccatcagccagctgattcctagatgctgtagtggcatcagactcagggactggggcccaatctgtcaaaggtctctaggaatctggagatgcatttgatgatgaaatgatggggaagctggtctgagcaaggggcctgcccagcattctcccrgatccctattgctgtttttcctacagaaatgtcaagcgggaaacattctgcccataaaggaaacataattaggtaaagctttggcatcagaagagacaaatcagccaggagtggcagcacacacatgtagtaccagctactcaggagattgaggtaggaggactgcttgagctctgggaggtcaatgctgcactgagctgtgattgtgccactatactccagcctgggtgacacggtgagaccctgtctcaaaaaaggaagagactgttggggacaccagcaacccaaggtcctaccaat

SEQ ID NO: 108000 - DNA, 601 bp, Human
ttttggtcccagacttctcatcctcaatccagccaaccataagccttagctgtctacagaatgcatcagctacatctgctcatggtggggtcctgcccattcccagccaacagggcaccgagggatagagccacagagagaagagggagtgacccaggactggggaggtctaagaaggctcagatccagtggcagcttagacggctggcaagctacaaggcctcttatcaataactttagcagcactgctagggcagtaaccgggaacatgaagaagcaggactctaggatgagtgaccasctctgatgagtgacttgctgggaggctctggggacgggcactggtcccaatgctgacccaacatgagggtgagaaacactcagagaggggaggtggagtccagctcccagaactgctctcagccatcagccagctgattcctagatgctgtagtggcatcagactcagggactggggcccaatctgtcaaaggtctctaggaatctggagatgcatttgatgatgaaatgatggggaagctggtctgagcaaggggcctgcccagcattctcccagatccctattgctgtttttcctaca

SEQ ID NO: 108001 - DNA, 601 bp, Human
tagagactgtagtgagctatgatcatgccactgcactccagtctgggcaacacacagagaccctgtctctaaaacaacaacaacaaaaactattcttggactgacaaataaatgaaaaccttgacaattcattctaaaaacagggttagggttagggaagaagagtaagagtgaattttgctccattagaaaaacacgtgacaggacttgaagattcattttcaagcttgtattaaccagatccttctttctgtgtctccctgtctattctgtctggatctccctggatcttccttgtgarctgttagattcctgtaaatgtggtgcagtaccaaatttgtgtggattgagaaatttgaaatgtgttagttacacaaagcaaaacaggattgaaagattttgcaaagcaacaaatcccttcagagtattatcatcataccttgaaatattgctcaaatctaaatgctcaaatatcagatttacattatatactcacatattataaatttgtgaatttttacaaaattataaagcaatatgacaaacagaaagcatccttggttagctgaggccatatgcagagtggctgaagcccacgcct

SEQ ID NO: 108002 - DNA, 601 bp, Human
gagaccatcttggtcaacatagcaagacctcatctctactaaaaattaaaaaattaactgggtgtggtggtgcacacctatagtccatcttggtcaacatagcaagacctcatcgctactaaaaatttaaaaattaactgggtgtggtggtgtacacctatagtccatcttggtcaacagagcaagacctcatctctactaaaaattaaacaattaactgtgtgtggtggcgcacacctatagtccaagctacttgggaggctgaggtggaaggatcattcgagcctagaaggtagagacygtagtgagctatgatcatgccactgcactccagtctgggcaacacacagagaccctgtctctaaaacaacaacaacaaaaactattcttggactgacaaataaatgaaaaccttgacaattcattctaaaaacagggttagggttagggaagaagagtaagagtgaattttgctccattagaaaaacacgtgacaggacttgaagattcattttcaagcttgtattaaccagatccttctttctgtgtctccctgtctattctgtctggatctccctggatcttccttgtgaactgttag

SEQ ID NO: 108003 - DNA, 601 bp, Human
tgtttgtttttgttttttgtttgtttgtttgtttttaagactgagtttcactcttgttgttgtccaggctgaagtgcaatggcacaatctcagctcaccacaacctccgccccctggattcaagtgattctcccgcctcagcctcccgagtagctgggattataggtgtgcgccaccatgcccggctgattttgaatttttagtagagatggggtttcttcatgttggtcaggctagtcttgaactcctgacctcaagtgatccgcctgcctcggcttcccaaagttctgggattacaggygtgagccaccacgtccggtgagttctcactcttaggagcctggatgggttctcgggggagtggattagttcccatgagagtgcgatgttataagccaggatgcttggtttggtgtctttttgcacatgcccacttcccctttggcctttctctgccatattttgacgcagcacaaaagccctcaccagaaaccaagcagatgctggtgccacgcttcttgtgtagccttcagaaccatgacctaaataactttcttttctttataaattacccagtcccaggtattccttcacagcaaca

SEQ ID NO: 108004 - DNA, 601 bp, Human
gtgaaggctgcaggcattcagtgaatgatggtgaatgatgaggtggggtctggaggctgggggagcagatccaagtgtgtgtgggtacagcataggcatgcactgtttctctttccccctggcacacaagagaagtggggggatggtataggaaagtggtaaaagaaatgtttcagcctcagccacccacactactttacctcccacttcctctgtaaaggctccccaccagctctgcctccctcagagctccacttgaggaagagggaagtgggagggcatggcctgaggttactctgtytgctccctttggaaagattttattgcaatgggtgagagttagacttccccacagggcaatagctggttccacttctgtttttgtaggcagcctgggtgtatgtaggtgttttgtgtgtgtgtgtgtttttcctccaatcgtggcagactgacagatgctttcttcaagactctgctcgattgtctaacatcatagaatcactatgcattacttatatgacatttttccatcctccccaaagctctgcaaggtaaatcatgtggtccccattttacagataaggaaacaagaggctctaag

SEQ ID NO: 108005 - DNA, 601 bp, Human; identical to SEQ ID NO: 32205

SEQ ID NO: 108006 - DNA, 601 bp, Human; identical to SEQ ID NO: 32206

SEQ ID NO: 108007 - DNA, 601 bp, Human; identical to SEQ ID NO: 32207

SEQ ID NO: 108008 - DNA, 601 bp, Human; identical to SEQ ID NO: 32208

SEQ ID NO: 108009 - DNA, 601 bp, Human; identical to SEQ ID NO: 32209

SEQ ID NO: 108010 - DNA, 601 bp, Human; identical to SEQ ID NO: 32210

SEQ ID NO: 108011 - DNA, 601 bp, Human; identical to SEQ ID NO: 32211

SEQ ID NO: 108012 - DNA, 601 bp, Human; identical to SEQ ID NO: 32212

SEQ ID NO: 108013 - DNA, 601 bp, Human; identical to SEQ ID NO: 32213

SEQ ID NO: 108014 - DNA, 601 bp, Human; identical to SEQ ID NO: 32214

SEQ ID NO: 108015 - DNA, 601 bp, Human; identical to SEQ ID NO: 32215

SEQ ID NO: 108016 - DNA, 601 bp, Human; identical to SEQ ID NO: 32216

SEQ ID NO: 108017 - DNA, 601 bp, Human
atgtgccttccctgttacctgatttaaagcagattaccccttattatgtagtcagtatgtcctccagagcatgtcaagcaactgccttgttttttgtttttgtttttgatacagggtcttactatgttatccagactggtcttgaactcctgggttcaagcatttctctcgcctcagcctctagagttgctgggactacaggcacaagccactgtacctggcttcatttgtttttgtttgctgagcatccatctttccactccactgtatgctccataagggcccagacagctgtcaaatrtatggaggaatcgcctagaagaaccagatggaccgtaaacgcctgttttctccatcaaagtatggcacgtagaagacacctgacatatatggttgatggatgcttagatagttggagagtaaatttaagaatactggtgcatcttggctgggcgcagtggctcacgcctgtaatcccagcactttgggaggcggaggcaggcagatcacctgaggtcaggagtttgagaccaggctggccaacatagtgaaaccccgtctctactaaaaatacaaaaattaaccaggcacagtggcacgc

SEQ ID NO: 108018 - DNA, 601 bp, Human
tcttaaattatgttagatgtgccaggtgcagtggctcacacctgtaatcccaacactttgggaggccaaggcaggcggatcacgaggtcaggagatcgagaccatcgtgactaacatggtgaaaccctgtctctactaaaaaatacaaaaaattagctgggcgtggtggcaggcgcctgtagtcccacctactcggaggctgaggcagaagaatggcgtgaacccaggaggcggagcttgaagtgagccgagattgcgccactgcactccagcctgggcgacagagcgagactccgtctcaaaaaaaaaaaaaattatattagatgcatttaagttaagttagatgcatttaagatctcgacatagggcttattactgtgacttctgcaaaagctttaccaagaaaactgaattatcatctgaaaagcctcacatcaacttctacaggagtgctttaaagtatattacccaatgaacattctaatagagtgattaatgtgccttccctgttacctgatttaaagcagattaccccttattatgtagtcagtatgtcctccagagcatgtcaagcaactgccttgttttttgtttttgtttt

SEQ ID NO: 108019 - DNA, 601 bp, Human
ttttacctggatgttcttttataatgatcctcatataaccaactagtccatatgtcctacagatcaaaagaggaatctgggaattccagaggacatctgctaagcgtagtgaagtgctgtttaaaaaaaaaaagcaaaatatgaacataagcaaatggaaatatgccaaacatgaaaacatgcaaaacatgaaaatgtcttacagcaactttcttactaaataatagatgcaaaggtacataactgcatttacataagcaggtcaagaacacactgaaaagcaagcatttccacaggctgyagtctcaaagaaagtacatctttggacaagagggatgtgaaactttagtctgtcatattaaggagaaacgttaaagaaagataattctaaacatttccatgatagagaaaaaatataaaacccacaaatacacccctaacaattccaataaccaattctctgttgcccaggctggagtgcagtggcatgatcatggctcactgcagcctcgacctcccaggctcaagtgattctcccatcccagcctcctgagtagctgggaccacaagcaggcacaccatctggctaaattttgtagtt

SEQ ID NO: 108020 - DNA, 601 bp, Human
aagtgacccatttaaaataaaatgtttacatggtcactctcccactttcaactcttttgttccctcccatcagttgacaccactttcaactcttaaatggctcaccaccagcagccagagcttatcctgacaagcactccctaactgcccacacagatattactcctcagtgatgctaccaatgccaatggctatcaccacattagcagagtgcttggctcatagtaaaaatgttttcttgagtcaataaagagcactgttttgaatactggatgaaaattttatgatcatctaagattaraattttataagtaaagggcttatataaaccctcagctgatggaggtctgcctataaacgactttggtctcttacaacagtttccttgggaacagtagttatgtaaatgtctttgttgtgtgaaattgcacctgaattgagagaacctaaagcctgcatgagaatgaaataaaagattggacggacctggtgcagtggctcacacctgtaatcccagcaccttgggaggccaaggcgggtggatcacctgaggtcaggagttcgagaccagcctggccaacatggtgaaatcctgtctcta

SEQ ID NO: 108021 - DNA, 601 bp, Human
tttctaacagcaatcactgcctccaatctttgcccctttaaatccatttactttccactcaacttcaaagtgacccatttaaaataaaatgtttacatggtcactctcccactttcaactcttttgttccctcccatcagttgacaccactttcaactcttaaatggctcaccaccagcagccagagcttatcctgacaagcactccctaactgcccacacagatattactcctcagtgatgctaccaatgccaatggctatcaccacattagcagagtgcttggctcatagtaaaaatgytttcttgagtcaataaagagcactgttttgaatactggatgaaaattttatgatcatctaagattaaaattttataagtaaagggcttatataaaccctcagctgatggaggtctgcctataaacgactttggtctcttacaacagtttccttgggaacagtagttatgtaaatgtctttgttgtgtgaaattgcacctgaattgagagaacctaaagcctgcatgagaatgaaataaaagattggacggacctggtgcagtggctcacacctgtaatcccagcaccttgggaggccaag

SEQ ID NO: 108022 - DNA, 601 bp, Human
ccatttgtctaaattggttaaaaattttaaaaatctagttattaaaattcaaaatacagaaattgaaagtctaaagtgtcccccattctctacataagatttcatcaacaaatatatttctctgtgaaatcagaggctcacttgatagaaaacagacactgtgaccatttatctacattcattccccctgccagtttcataatgacatttattgaatttcattttaattaaaattatcaggatcaaaagaggaactgctagatttaaatttaaaagcatccatttgccctaccatacaacyccataaggaaaaaaaattaatctcccattccccatcaaggaaatcctttgtaagaaactgaaaatacagttgcatatgaaattttttttaaaaaaggacatacttcactataccactgtgctaaatatttagctatgatcacaatccatggagtatgactgtggtcctaaaaatgagagacaaataaaagaaaatatcagtattatgaattcttcactgtaccatctcgttttcaacaaattcaacaatatttatgatctcctaatatatgcagagtagtgaatagacgaaaatgaactg

SEQ ID NO: 108023 - DNA, 601 bp, Human
aacttatgaaacattaagataaaaaattcatcaaaccttcatggttttaagttacaaatacaaggtagtatagggccatagctaagcatacaggctctggtactgggtttcctggggttcaaatcttggttctgccatttaccagctatctgaccttgtataagtaaccttttcaataccttagtttcttcatgtgtaaaatggggccggtaacagtctctctctctctcataaggtcgttgtgaaccttgtgtgtgtgttaaattacttaatacatatagttcatagcacagagttaagkgatcaaatattaagtttatcatgaagtatgaaaaaaaactctgcctcctaggcgtatgtggtaattctgtatttcccattcaattttgctttgagcttaacaagaattgccccctaagttctttttttttttttttttttttttgagacggactcttgctctgtctccaggctggagtgcagtggcacgatcttggctcactgcaacctccgtctcctgggttcaagcgattcccctgcctcagcctcccgaatagctgggactacaggtgcgcaccaccacacctggctaattttttgt

SEQ ID NO: 108024 - DNA, 601 bp, Human
atttaaattgttaccatgaacaaaaattttctttccttttcatgaaaaaacacaggtctgacaatgtatgaaatgtgaaaatgccagggaaatgctatcaacagcaccatgagtagctgggaatctttccagtgttagtgacggactctcagtgcccactaaaacccagggtccctctaacagcacccaacttaaaaactgctcccctagagggatctatgatttcggcttctgtgacagaggacctgaaaaaatacattactgaagaacatgacttatctcctggaagtcaagtccaagraaagttaaatacattaaaactgttcatctccaatgtaaaacttctttgttttttgagacaggatctcgctctgccacccaggctggagtacagtggcgcagtcctggctcactgcagcctcaacttcccacgctcaactgatcctcccacctcagcttcccaagtagctgggaattcaggcacacgctaccatgcccgactaatttttgtcttttttgtagagacggagtttcaccatgttgcccaggctggtcttgaactcctgggttcaagtgatttagaaactgaaaatactgtatt

SEQ ID NO: 108025 - DNA, 601 bp, Human
atgtgtatacccttctcagacatgagaatgtgaagaaatgttttctccttggttctaatagcagagaaagcactagaacatgaatcaccttaaatttatatccctggcactacaaccagttcagaagcaagtaaggtgatggcctctctgaacctcagttttcaagtgtaaaatggggatgatactgtttacctttgagaattgttctacagattaaatgtgacatctgtataaagtgcatctctagcacaatgcctgatatggctctaaaaataatagttttcatcattattatggatargtagtcctaaaggagagaggtttatgaattgtactcttgatatatgtaatgactttaagctttgtattattgaaattttcaaaaacgccccaaagtagaacagaataataaatgttcaaatacccagcatcaaacttgtgatctagtattatataatctaatacaacaaacgctaattcaagattagtctaatagaacaaacaaggtgcaagattagtagtggcagaaaacattaaaaccgagcctaaacagacattgtggagaagtcataaaatggaaagcttggataaatctatttta

SEQ ID NO: 108026 - DNA, 601 bp, Human
ttcccaggctcaggtgatcctcccgagtagctgagtctacaagtgcacaccaccatgtctggctaattttttgtatcttcagtagagatggggttccaccatgttgcccacgctggtctccaactcctgggctcaagcaatctgcctgaatcagtctcccaaagtgctggcattacagacgtgagccaccgtactatgcctggccagcatatttcttgtggctttcctattccactaaattaaactcagtgtgagtcttagtaacaaactatggaaaatgacagaaaaaagttttcttctrtacatattcaaccaacatccccctgtaatagtttagaatcgaacactattttgcaaatagttaaacttaaaaaacaaaaggtggttcttcactggggaacgtttggggtgtaatctgtttacaatgtgaaattcaagcaacactattataaataccctgagaacactttcaatttaaatgttttattgaagatcttattatatctggtaattcaattgctattcttacctggatatctaccctgttgtttatgaaatctatcaacagcccgtaacattaagtacaacactatttcattat

SEQ ID NO: 108027 - DNA, 601 bp, Human
tgattacagaatgcacagaagtaaaaaacaaaaaaaaaaaaacaaagaaaaccttcaatttatacttttttctgctatagttaagtcatccagtccatccatctggctgtacctcttcttagattctggactgcatctgaataaataataatttgcccttttctgtgaattggcagaaaattttgctactttggcacaagagactacttggttttagtttaaaataaattattctgaatcaggctttaatttggatttgcttagaaaatagttttcttaggtctgtatgatgcatttacaytttgaacacttcaaatattaattagacctaaatctgcctttaaaacattcaacatctagaaggaaaatgccacaagctaatagctcagtctacaggagatcacaggacagtaattttttttgaggggtgttatggactgaatggttcgtttccccctcaaattcatatgttgaaatcctaacccccagtgtaattgtatgaggatagggcctttggtaggtgattaggtcaagagcgtagaaccttcatgaataggattagtgccctaagaagagaccccagagacttctcttgccattt

SEQ ID NO: 108028 - DNA, 601 bp, Human; identical to SEQ ID NO: 18295

SEQ ID NO: 108029 - DNA, 601 bp, Human; identical to SEQ ID NO: 18296

SEQ ID NO: 108030 - DNA, 601 bp, Human; identical to SEQ ID NO: 18297

SEQ ID NO: 108031 - DNA, 601 bp, Human; identical to SEQ ID NO: 18298

SEQ ID NO: 108032 - DNA, 601 bp, Human; identical to SEQ ID NO: 18299

SEQ ID NO: 108033 - DNA, 601 bp, Human; identical to SEQ ID NO: 18300

SEQ ID NO: 108034 - DNA, 601 bp, Human; identical to SEQ ID NO: 18301

SEQ ID NO: 108035 - DNA, 601 bp, Human
aacatttaaataatcgtaaaatacaaatgttgtttatggtttttattgtttaagggcatacttaattatggttacaaagtggagtgcaaatgttatttaccatgttttaaaaatacagccggaaaatacaagtgggaatgttgaaggagggcgggggaagtaaatggaatgggggttatgtccttataaagtggaaacttgaaaggtactgtctgttgttgagtggggaaagacatttttattacttacagggtagccataaagtttctaaaacggtaatatattaaagagggagagtggwaggggagaacagtatgaagtcaacaggaaatggctaaagatggagagctcaggtagaatagtttaaaaaatgaaaattgatagagtacctggtgtatttgaatacagcctagagagctttcattttccaaagagtgtggggataaattagtgaatgcatatttttcaaaattaagaaaacagaacatataattttgaacgctgagaaaaataaaaatttaaaaactacactgtatacacggtatacctcaactgtgaataatagtagtcatgtaaagtcagtcataattatgtaaatact

SEQ ID NO: 108036 - DNA, 601 bp, Human
cataaaatgctgcaagcttttgaactaatggcgagagtgtaagaaaatgggctctacttcagtgatcctgtggcaggacgtggatcaagacttggaaccgcagaaaacgaaatcccatagtagcacaaagcttggctgttcagtgaataacatttaaataatcgtaaaatacaaatgttgtttatggtttttattgtttaagggcatacttaattatggttacaaagtggagtgcaaatgttatttaccatgttttaaaaatacagccggaaaatacaagtgggaatgttgaaggagggcrggggaagtaaatggaatgggggttatgtccttataaagtggaaacttgaaaggtactgtctgttgttgagtggggaaagacatttttattacttacagggtagccataaagtttctaaaacggtaatatattaaagagggagagtggaaggggagaacagtatgaagtcaacaggaaatggctaaagatggagagctcaggtagaatagtttaaaaaatgaaaattgatagagtacctggtgtatttgaatacagcctagagagctttcattttccaaagagtgtggggataaattagtg

SEQ ID NO: 108037 - DNA, 601 bp, Human
ttttaagggtttacatggctgggaatataattttgtatgtatgtccttatgtatatacgcgtgtgtgtccactagttttttgcttgaatgtttatcattcctgtcacttgcaatttaaatattcctaataaatagaaaaatccaaagactaagattgtgatcctttttatgtctatggtatattatgaatacagagaccttgtgcttttattggcgtaggaatcatcttgccctaatattaatattatgaaatcaaaagggtaagattcctaacatcccacataacacagcagacaaactraagttttaatctagctttggcccttacaaattttgtgccctacggcaagttacatctcgcttagattttttcattttaaagtggaactatctgcatggatgttcgtacatgctatataacacatcctattccagagccacctaccatcagttgagctctaaatggtaaatgccacagtgagaagcagacaggaaggggcggagcgccagcggcgcccggggctacgcgccgcactgcaccgagcggcggcagcggcaagcttgggtgtgagcccgggagccgctttgcttaccgtcctgc

SEQ ID NO: 108038 - DNA, 601 bp, Human
tttctagttaaaatgggagataagtgaaggtaatgaaatgtgcatcatttaaataacaaaagtattgtggctattagagattcactgtgctgttactctaatggtattaagagtttggaagtacaggccgggcgctgtggctcacgcctgtaatcccagcactttgggaggctgacgcgggcagatcacgaggtcaggagatcgagaccatcctggctaacacggtgaaaccccatctctaccaaaaaatacaaaaaattagccgggcatggtggcgggcgcctgtagtcccagctactcrggaggctgaggcaggagaatggcgtgaacccgggaggcggagcttgcagtgagccgagatcgcgccactgcactccagcctgggcgacagagcgagactcccgtctcaaaaacaacaacaaaaaaagagtttggaagtacagagtagtattccagctcttggagcctagccacaggtttcacagatgcatctccatgcagaaatggctgaagcttccacagctaatctgaactttttaagggtttacatggctgggaatataattttgtatgtatgtccttatgtatatacgcgtgtgtg

SEQ ID NO: 108039 - DNA, 601 bp, Human
gtgtgcgattaaaaaatacagtgctttctagttaaaatgggagataagtgaaggtaatgaaatgtgcatcatttaaataacaaaagtattgtggctattagagattcactgtgctgttactctaatggtattaagagtttggaagtacaggccgggcgctgtggctcacgcctgtaatcccagcactttgggaggctgacgcgggcagatcacgaggtcaggagatcgagaccatcctggctaacacggtgaaaccccatctctaccaaaaaatacaaaaaattagccgggcatggtggcrggcgcctgtagtcccagctactcgggaggctgaggcaggagaatggcgtgaacccgggaggcggagcttgcagtgagccgagatcgcgccactgcactccagcctgggcgacagagcgagactcccgtctcaaaaacaacaacaaaaaaagagtttggaagtacagagtagtattccagctcttggagcctagccacaggtttcacagatgcatctccatgcagaaatggctgaagcttccacagctaatctgaactttttaagggtttacatggctgggaatataattttgtatgtatg

SEQ ID NO: 108040 - DNA, 601 bp, Human
tgcgatgtgtggtatctcaacaatgcttttcagaacaagactgtaaccttaaggtcatgatcagaaatcacacatttgaataatccatgaatgaagacggtgtgtgcgattaaaaaatacagtgctttctagttaaaatgggagataagtgaaggtaatgaaatgtgcatcatttaaataacaaaagtattgtggctattagagattcactgtgctgttactctaatggtattaagagtttggaagtacaggccgggcgctgtggctcacgcctgtaatcccagcactttgggaggctgasgcgggcagatcacgaggtcaggagatcgagaccatcctggctaacacggtgaaaccccatctctaccaaaaaatacaaaaaattagccgggcatggtggcgggcgcctgtagtcccagctactcgggaggctgaggcaggagaatggcgtgaacccgggaggcggagcttgcagtgagccgagatcgcgccactgcactccagcctgggcgacagagcgagactcccgtctcaaaaacaacaacaaaaaaagagtttggaagtacagagtagtattccagctcttggagcctagccacag

SEQ ID NO: 108041 - DNA, 601 bp, Human
attaatttttacaaatttctcagtggcacgttatttctaccagtcatataatcagtagactatatagaaacagaggtactctagggtaccgtacttgtgctctgaatagctgctagacatgcagtgcacggtgcgatgtgtggtatctcaacaatgcttttcagaacaagactgtaaccttaaggtcatgatcagaaatcacacatttgaataatccatgaatgaagacggtgtgtgcgattaaaaaatacagtgctttctagttaaaatgggagataagtgaaggtaatgaaatgtgcaycatttaaataacaaaagtattgtggctattagagattcactgtgctgttactctaatggtattaagagtttggaagtacaggccgggcgctgtggctcacgcctgtaatcccagcactttgggaggctgacgcgggcagatcacgaggtcaggagatcgagaccatcctggctaacacggtgaaaccccatctctaccaaaaaatacaaaaaattagccgggcatggtggcgggcgcctgtagtcccagctactcgggaggctgaggcaggagaatggcgtgaacccgggaggcggagct

SEQ ID NO: 108042 - DNA, 601 bp, Human
acaagttaatggtgtggtgtgaacataagtataaaaatattaagcagtattaaacacagctgttaaattctggagctggctaacctgatgaaaagtcagttaaaggaagcttccaatgcccaagccagtcaatgcagttaatctgtaaaatcaagccatttccaatcatgaattttctaatttgtacaatcaagccatttccaatcatgaatactctaatcatgaattctcctaatatcacccgcagcaaaagcagtgtggattaggcattcaaatctaaacatcaaggggcagataaaawctacaaccacctaaattattgctcctatcccactctcaggtggaaagaaggaaatctttcttcagctctagagcattaaggagtaggatttggagctttgtgactgttctttgcctattcccgtcccattggaataggccctcaatctggccatgttatcagtgggtggctgctattttccccacggtctcagggtggaagataaggttttcatggagttacccagaaacggagcaagtagggcgtaaagggtggcacaaaagaggaatagaagacagaatgagtccacatagctttaca

SEQ ID NO: 108043 - DNA, 601 bp, Human
atcagtgtccaaaaggaaacgtactttttttctagtttggcattagcacaagttaatggtgtggtgtgaacataagtataaaaatattaagcagtattaaacacagctgttaaattctggagctggctaacctgatgaaaagtcagttaaaggaagcttccaatgcccaagccagtcaatgcagttaatctgtaaaatcaagccatttccaatcatgaattttctaatttgtacaatcaagccatttccaatcatgaatactctaatcatgaattctcctaatatcacccgcagcaaaagmagtgtggattaggcattcaaatctaaacatcaaggggcagataaaatctacaaccacctaaattattgctcctatcccactctcaggtggaaagaaggaaatctttcttcagctctagagcattaaggagtaggatttggagctttgtgactgttctttgcctattcccgtcccattggaataggccctcaatctggccatgttatcagtgggtggctgctattttccccacggtctcagggtggaagataaggttttcatggagttacccagaaacggagcaagtagggcgtaaagggt

SEQ ID NO: 108044 - DNA, 601 bp, Human
ttgagtactgatcagtgtccaaaaggaaacgtactttttttctagtttggcattagcacaagttaatggtgtggtgtgaacataagtataaaaatattaagcagtattaaacacagctgttaaattctggagctggctaacctgatgaaaagtcagttaaaggaagcttccaatgcccaagccagtcaatgcagttaatctgtaaaatcaagccatttccaatcatgaattttctaatttgtacaatcaagccatttccaatcatgaatactctaatcatgaattctcctaatatcaccckcagcaaaagcagtgtggattaggcattcaaatctaaacatcaaggggcagataaaatctacaaccacctaaattattgctcctatcccactctcaggtggaaagaaggaaatctttcttcagctctagagcattaaggagtaggatttggagctttgtgactgttctttgcctattcccgtcccattggaataggccctcaatctggccatgttatcagtgggtggctgctattttccccacggtctcagggtggaagataaggttttcatggagttacccagaaacggagcaagtaggg

SEQ ID NO: 108045 - DNA, 601 bp, Human
ctacactttatccaaaggaaaaatggctgagaaaaattagctattgtgaaccacccccacctccaaaaattatcaggcagatagcaaaccaaagggttgagtactgatcagtgtccaaaaggaaacgtactttttttctagtttggcattagcacaagttaatggtgtggtgtgaacataagtataaaaatattaagcagtattaaacacagctgttaaattctggagctggctaacctgatgaaaagtcagttaaaggaagcttccaatgcccaagccagtcaatgcagttaatctgtamaatcaagccatttccaatcatgaattttctaatttgtacaatcaagccatttccaatcatgaatactctaatcatgaattctcctaatatcacccgcagcaaaagcagtgtggattaggcattcaaatctaaacatcaaggggcagataaaatctacaaccacctaaattattgctcctatcccactctcaggtggaaagaaggaaatctttcttcagctctagagcattaaggagtaggatttggagctttgtgactgttctttgcctattcccgtcccattggaataggccctcaatc

SEQ ID NO: 108046 - DNA, 601 bp, Human
tttattttttcctaatacaaaaaagttttcgtcaaggctttcaaggagccaaggtttcccatcatatcaagaatctaatcttccacagcattatcagtgaggtctgactcagcttgctcttcccaagaatcagaatcagagtgatcagaaaggcagaaggctcctactatctgcaaaagcaccatgcccagcaggctgtttaccataaagtgaatcaaatctgctataaaagctgaaaaacagtacatgataaaaagaaaataagaaagattacgactccaaaatcatttatttcccaatkgaatgttaataaaccaaggactccatcagaatcataatattcacataattaattctacactttatccaaaggaaaaatggctgagaaaaattagctattgtgaaccacccccacctccaaaaattatcaggcagatagcaaaccaaagggttgagtactgatcagtgtccaaaaggaaacgtactttttttctagtttggcattagcacaagttaatggtgtggtgtgaacataagtataaaaatattaagcagtattaaacacagctgttaaattctggagctggctaacctgatgaaa

SEQ ID NO: 108047 - DNA, 601 bp, Human
gaaagaaaagaaagaaaagaaagaaaagaaagaaagaaaggaaaagaaaagaaaagaaaaaagaaagaaagaaagagaaaagaaaaattaaagagtttttatgtgggcttctacttgattttattttttcctaatacaaaaaagttttcgtcaaggctttcaaggagccaaggtttcccatcatatcaagaatctaatcttccacagcattatcagtgaggtctgactcagcttgctcttcccaagaatcagaatcagagtgatcagaaaggcagaaggctcctactatctgcaaaagcaycatgcccagcaggctgtttaccataaagtgaatcaaatctgctataaaagctgaaaaacagtacatgataaaaagaaaataagaaagattacgactccaaaatcatttatttcccaattgaatgttaataaaccaaggactccatcagaatcataatattcacataattaattctacactttatccaaaggaaaaatggctgagaaaaattagctattgtgaaccacccccacctccaaaaattatcaggcagatagcaaaccaaagggttgagtactgatcagtgtccaaaaggaaacg

SEQ ID NO: 108048 - DNA, 601 bp, Human
aaagaaaggaaagaaaagaaagaaaagaaagaaaagaaagaaagaaaggaaaagaaaagaaaagaaaaaagaaagaaagaaagagaaaagaaaaattaaagagtttttatgtgggcttctacttgattttattttttcctaatacaaaaaagttttcgtcaaggctttcaaggagccaaggtttcccatcatatcaagaatctaatcttccacagcattatcagtgaggtctgactcagcttgctcttcccaagaatcagaatcagagtgatcagaaaggcagaaggctcctactatctgsaaaagcaccatgcccagcaggctgtttaccataaagtgaatcaaatctgctataaaagctgaaaaacagtacatgataaaaagaaaataagaaagattacgactccaaaatcatttatttcccaattgaatgttaataaaccaaggactccatcagaatcataatattcacataattaattctacactttatccaaaggaaaaatggctgagaaaaattagctattgtgaaccacccccacctccaaaaattatcaggcagatagcaaaccaaagggttgagtactgatcagtgtccaaa

SEQ ID NO: 108049 - DNA, 601 bp, Human
agagacggggtttcaccatgttagccaggatggcccagatctcctgacctcgggatccacccacctcggcctcccaaagtgctaaaattcagtttacctgctcaccttgtaacttcagttctaacaagctcaaaataaattatgactttgtagcctacctagtttactctctttgttagagcagaagcaacattctcttttggtctactgctaactaaaaggaagtaaaattctcaagctggttttcaaaatgcatgcataaatgcatgctatatcatattcttccacatgcatggtttamaaatgtctcaattaaaaaatagattcatgtataggtgattttttatgcacctatgaaatctggccttgtaatgaagaatacaatagatcttaataatctgacaattattaagtgtgtttcattgtctaaaagagaggtttgaggggagaaaaagaaaagtttcttgaaatatggaaataagagtatatatttagctctgagtatgttctggtaagaattacaatgacgtcaaactatatgtacatattaaagccatggcaaaaaacgaaagaaaagaaagaaagaaagaaagaaagaaag

SEQ ID NO: 108050 - DNA, 601 bp, Human
gagagacggggtttcaccatgttagccaggatggcccagatctcctgacctcgggatccacccacctcggcctcccaaagtgctaaaattcagtttacctgctcaccttgtaacttcagttctaacaagctcaaaataaattatgactttgtagcctacctagtttactctctttgttagagcagaagcaacattctcttttggtctactgctaactaaaaggaagtaaaattctcaagctggttttcaaaatgcatgcataaatgcatgctatatcatattcttccacatgcatggtttacaaatgtctcaattaaaaaatagattcatgtataggtgattttttatgcacctatgaaatctggccttgtaatgaagaatacaatagatcttaataatctgacaattattaagtgtgtttcattgtctaaaagagaggtttgaggggagaaaaagaaaagtttcttgaaatatggaaataagagtatatatttagctctgagtatgttctggtaagaattacaatgacgtcaaactatatgtacatattaaagccatggcaaaaaacgaaagaaaagaaagaaagaaagaaagaaagaaa

SEQ ID NO: 108051 - DNA, 601 bp, Human
aatctccatgccatataatgtaacatattaactagttccaaagattaagtcatagacatctttgggaaagccattattctgcctcctataccgtgtaccataaaggaactttcctaggtttcctgtctgtcctcaacctttccagtaagcattcggtagaagcccaaggggaaaagctggcaattacagaccactcctgtgtctggggctcccaggtattctaaactgtcacattaaactacactcaacctttgtaagaatttgttaaaatttcagccattttcttgttacctactgaaaygccagagaactcttctggagttctgccacagatgaaataaattcatgtctcctatttggaaaggcttgtaatttttttttttttttttgatatggagtctcgctctgtcacccaggctggagtgcagtggccccatctcggctcactgcaagctccgcctcctgggttcacaccattctcctgcctcagcctcccgagtaggtgggactacaggcgcctgccaccacacccagctaattttttgtatttttagtagagagacggggtttcaccatgttagccaggatggcccagatctcc

SEQ ID NO: 108052 - DNA, 601 bp, Human
cttctttttgtaaatcagctttactgaaatataatttttataaattatatgaaaaaccattttaattatacagtttacttttggcaaattatacagattaactaccacaatcaagatatagaacatttccatcacccccaaaaacatccttgacattcctagacccctttgcagtgcattctacctcaggcctttggctatcactgatctgttttctgtcactatatttttctctttgtagaagagaaaatggtatcatgtttgaacctttctttcacttggtagaatgtttagagtcatytgttgttgcatgtaaaagtgatttattcttttttgttgctgagtagtattcaattttacgggtatgttctcatttctcttaagaattgctgggtttcatggtattttttacttcataagaaactatcaaactcaaccaaagaggctttgccactttgcatctccaccagtaatgtatgaggattctagttgccccctatcctcacaaattagtattgccagtcttcccaattttttcctccatctcttctctccttttctccctctctttcatttttctgtttgaataatatatagtaat

SEQ ID NO: 108053 - DNA, 601 bp, Human
tgactaatacagtagcctgcatagaggatgcaagtagctgacacaaatgttattgccttcatgtacaacccctacaattctggattcctgaaagtaaccctccagaattagtctcacttcccccaaagccttctaatgtttgtatagtgtctaactccctgattaaacttcttctaactcagaacatctaaaatgtcttgttttctacctaatgtggtctgaggcttctcaaaaaaaaaatgcttctttttgtaaatcagctttactgaaatataatttttataaattatatgaaaaaccrttttaattatacagtttacttttggcaaattatacagattaactaccacaatcaagatatagaacatttccatcacccccaaaaacatccttgacattcctagacccctttgcagtgcattctacctcaggcctttggctatcactgatctgttttctgtcactatatttttctctttgtagaagagaaaatggtatcatgtttgaacctttctttcacttggtagaatgtttagagtcatctgttgttgcatgtaaaagtgatttattcttttttgttgctgagtagtattcaatttta

SEQ ID NO: 108054 - DNA, 601 bp, Human
tttacacatgtttattatgaaaattggctcataattatgattctgttggatctgtttatttggagatccctgactaatacagtagcctgcatagaggatgcaagtagctgacacaaatgttattgccttcatgtacaacccctacaattctggattcctgaaagtaaccctccagaattagtctcacttcccccaaagccttctaatgtttgtatagtgtctaactccctgattaaacttcttctaactcagaacatctaaaatgtcttgttttctacctaatgtggtctgaggcttctcaaaaaaaaaatgcttctttttgtaaatcagctttactgaaatataatttttataaattatatgaaaaaccattttaattatacagtttacttttggcaaattatacagattaactaccacaatcaagatatagaacatttccatcacccccaaaaacatccttgacattcctagacccctttgcagtgcattctacctcaggcctttggctatcactgatctgttttctgtcactatatttttctctttgtagaagagaaaatggtatcatgtttgaacctttctttcacttggtagaatg

SEQ ID NO: 108055 - DNA, 601 bp, Human
ctacaaatatactcctaggaatcacccactttgaggccagaggcacctgatatcatcagtagctgtgatggttaattttacatatcaacttgactgggttaaagaatacccgtataactggtaaaacattatttctgggtgcctctgtaaaggtgtttctagaagagatgagcattggaatctgtagaccgagtaaagatctgccctcaccaatgtaggtaggcatcaaccaatctgatgagggccctaatagaacaaaaagctggaggaagggcaaatatactctcttcttgagtggagwcatccatctcctcctgcccttggacatcagagcccctgattctcaggcctttggcctcaagactacaccactggttgtatcatgggacttctcagcctccataatcaattgagccaatccctataatgaatccctttttacacatgtttattatgaaaattggctcataattatgattctgttggatctgtttatttggagatccctgactaatacagtagcctgcatagaggatgcaagtagctgacacaaatgttattgccttcatgtacaacccctacaattctggattcctgaaag

SEQ ID NO: 108056 - DNA, 601 bp, Human
agtgatgtgtgaaaactctatgtccccaacaaatacagcctcaccccaaacacacacataaatacacatgcacacttgtaatgaagaataccccctgggcaaccatggaaaaatgtgttaatatttgcgaagacttctttagcctgagtcaatcaataattgcagagagaagggatacatggaacactattcagctgtaaaaagaaatgagaaagattgctatatagtactatgaagtgatacctaattattaaattattttaaaaggaaaaatgcagaacaatgtgtgtagtatgttctrtattgtttaagaatggtattgtcaaaagctgactttaaaaaatggttacgtatagtgttcacttcagcagcacatatactaaagttggaacaattacagagaatattagcatggccccttccatatcttaaatttttaaaagcaattaaaaaaggaaaaaaaattggttacctataggaaaggaaacacagagcatatgacaggaaagaagctaggcttctctgaatacattttgttttgaagttttacccctggtaccatgaacatttattaaataatcactaaaaattaaaataaagg

SEQ ID NO: 108057 - DNA, 601 bp, Human
aacatccagagggtaaagccaggatcctcagaaaatgatggataagggagtttctcccagagtccagacacagggactaatcaggaacttccctgtaaatccagggcaggcgactccacatagcctatcaaggaaggtttgtcactgctatggccaatctaccattgtattcctcctgttttctttctaaatgggaggagtttattgttgccagtcagcctgcccctaatcatccactttatactttgaagtgaagatatatatatcttgtgttttttgttttcatttattcccagaccaygagggactacatttggaagtggtaaacagaactgtctatcactcagaagccctgaactttaagctgatataacataagactttaatgcatccccaggaaaggagcataagtgtgttctatatgtgggaagaagggtacatatggtgatttaaaaataggcatgaagtctgtggcaggtactgtgttgctgaccaaaatccttgttctcctcttcctgagcacacatgagactacatttcccaggatcccatgcagttgggtgtgacccagtgtctgagttcttgccactggagcttgaga

SEQ ID NO: 108058 - DNA, 601 bp, Human
taaatatgtgatattaaaatgactctctggcttccaaacttgcattattgaaaagacttgaaatacgtaccttctccaggaaggtacccttctcatcatccttttcagatgcagccaaggaggataataatgaagaacatccagagggtaaagccaggatcctcagaaaatgatggataagggagtttctcccagagtccagacacagggactaatcaggaacttccctgtaaatccagggcaggcgactccacatagcctatcaaggaaggtttgtcactgctatggccaatctaccatkgtattcctcctgttttctttctaaatgggaggagtttattgttgccagtcagcctgcccctaatcatccactttatactttgaagtgaagatatatatatcttgtgttttttgttttcatttattcccagaccacgagggactacatttggaagtggtaaacagaactgtctatcactcagaagccctgaactttaagctgatataacataagactttaatgcatccccaggaaaggagcataagtgtgttctatatgtgggaagaagggtacatatggtgatttaaaaataggcatgaa

SEQ ID NO: 108059 - DNA, 601 bp, Human
tggatagtgaaggaacagatcttggagactggcaacacgatggcacatgtggtgtataagcaaactttttaaaaacattatatgcaataacttagaagaaggccatgtttaatgagtctctggccctaggggaagtggttgatgaaagtcaaaacggtgtgccagggttgttctccaaaatattttagcaagatattatgagaagatgagaaaggaaaagaattgactggtttgcaaataagaattaagagcaagagagagttcagaaatctaaggtttcagaggggtataaaatctcacmggtttggggtatcaaacagcaataagtgagactgaaaaaaaaattaagaggcccattaagacttttcaattaaacatagagaccattgtttcgaatgccttcaagataactgccaccaaagtgaaagaaagaggcctgggataagtaagggaaaaatgtttatctattttcttatttatacagacatgaaacatttgtgtaaggacaaccattttggaaatttttgtagggtaagatggaactgaccagaagcaagtagattaaaaactttatatgttgctgaggatattgcatttgtca

SEQ ID NO: 108060 - DNA, 601 bp, Human
accttttctgctcctggctgcctggaataaggtgaccccaaggcaatcttggaagctgtgttaaaggtcaccaagtgatcagcctattttagtgaataactacatagggaaggttactcagacatatcagtaccattaaaagaacaaaattaaatcatattgttcgaaacgttttacattttggagctatttgtgatgcagtttgtctacccagtctaacacagaaattggaactgaaagtgggagaatttgtttagaggatttggatagtgaaggaacagatcttggagactggcaacaygatggcacatgtggtgtataagcaaactttttaaaaacattatatgcaataacttagaagaaggccatgtttaatgagtctctggccctaggggaagtggttgatgaaagtcaaaacggtgtgccagggttgttctccaaaatattttagcaagatattatgagaagatgagaaaggaaaagaattgactggtttgcaaataagaattaagagcaagagagagttcagaaatctaaggtttcagaggggtataaaatctcacaggtttggggtatcaaacagcaataagtgagactgaaa

SEQ ID NO: 108061 - DNA, 601 bp, Human
agtatgtaaacatgcaaaaatgagagatcatttttcactaatttgcattttcatctcccctgagccataccacttgaatacaaatatcttaaattttgaatagaaattgttagaaataacatttatttcagtaattatttgtctctcattcagtaacatccttctacataccaagcatttttgttgatgcaatatgatttatagaaataagttcctaaaattattcatagttcaagaatttcacccaagtcctaaaactattaatataaataatttgtatgcaatgttacaggagctaaamagaataaacaaaatataccagaattaaagacgaggaagatacaaatgcttcagtgaagaattgactatagttctctgaggttagggacattcagtttgaactggaatttttgtttgtttgtttgtttgtttgtttgagacagagtgagactccatcacacaggctgtactgcagtggcacaatctcagctcactgcaacctccgcctcccaggttcaagcgatccttctgcctcagcctcccgagtagctgggactataggcgagcaccaccacgcccagctgatttttgtattttcagt

SEQ ID NO: 108062 - DNA, 601 bp, Human
aatgatgtctatttatcttcagcatcagccacaattttccattcatggtaatgactaaagaagcgaagtcgagtatgtaaacatgcaaaaatgagagatcatttttcactaatttgcattttcatctcccctgagccataccacttgaatacaaatatcttaaattttgaatagaaattgttagaaataacatttatttcagtaattatttgtctctcattcagtaacatccttctacataccaagcatttttgttgatgcaatatgatttatagaaataagttcctaaaattattcatarttcaagaatttcacccaagtcctaaaactattaatataaataatttgtatgcaatgttacaggagctaaacagaataaacaaaatataccagaattaaagacgaggaagatacaaatgcttcagtgaagaattgactatagttctctgaggttagggacattcagtttgaactggaatttttgtttgtttgtttgtttgtttgtttgagacagagtgagactccatcacacaggctgtactgcagtggcacaatctcagctcactgcaacctccgcctcccaggttcaagcgatccttct

SEQ ID NO: 108063 - DNA, 601 bp, Human
tttctagaacaaacactaatgatgtctatttatcttcagcatcagccacaattttccattcatggtaatgactaaagaagcgaagtcgagtatgtaaacatgcaaaaatgagagatcatttttcactaatttgcattttcatctcccctgagccataccacttgaatacaaatatcttaaattttgaatagaaattgttagaaataacatttatttcagtaattatttgtctctcattcagtaacatccttctacataccaagcatttttgttgatgcaatatgatttatagaaataagtycctaaaattattcatagttcaagaatttcacccaagtcctaaaactattaatataaataatttgtatgcaatgttacaggagctaaacagaataaacaaaatataccagaattaaagacgaggaagatacaaatgcttcagtgaagaattgactatagttctctgaggttagggacattcagtttgaactggaatttttgtttgtttgtttgtttgtttgtttgagacagagtgagactccatcacacaggctgtactgcagtggcacaatctcagctcactgcaacctccgcctcccag

SEQ ID NO: 108064 - DNA, 601 bp, Human
agcccagagagttgagctgcaaattcttggtgtgtctcactaaggatataaataaaaggagcaaagaggtcagagtcagaagaaagggaataacgtatgtcaagctgagaagcctaaggccttgaagatagactattttacttgtatctgagtgcaaagtcatgtttttttcacaactcactaatggcattggacataaaaaggtaaacaaacgataagaacaaagaccgcaggaaaagcacaagaaccactctgttcattctccacttcagccaggcaaaaaaataagtgggagaaattsgctatcttaagcaagtagaaaatgcttaggcaggtggcaaactagatacttaactgattaattaatgcccaaagaatagtaaacagttttactagtttacggatggtatatagatgaggggacaataccattataaatgaatcaaatagtattaaatacagtcgaatgattctgactatagccaagctggtgaggatgaaatcagctgatgagaccttccaactcttggcccactcaatgcagtttaccagtccaatgagcccgtttcccagcattcctaagacaagtcctcttgttgcc

SEQ ID NO: 108065 - DNA, 601 bp, Human
actttgagaaaatatggttagtgaatattttaaggaaaatttcagaattatttaacaacacttaaaaggactccaaaaaagaaattgttaaatataaaattaacttatgaggtcttctattatttctttcatagatgcagaaagttaaattttgtctatgaagttaaaggttttgcttttttcagagagaatttaagatgccacagtagtctcaaggagctctgtcttagcttgttgtttcccaaaattataataaatgagtggcctgagggaaaggcaagtaaaatcatcataataaacrtcatgacctgataattctctacctcaaggaagatccaatctcctattaaagtggaaataaagttaataataaaaaggaggaggaaggctatcaccattttcatggcccttttatgggcctctgtgctggagtcccttgagcccagagagttgagctgcaaattcttggtgtgtctcactaaggatataaataaaaggagcaaagaggtcagagtcagaagaaagggaataacgtatgtcaagctgagaagcctaaggccttgaagatagactattttacttgtatctgagtgcaaagtca

SEQ ID NO: 108066 - DNA, 601 bp, Human
tttttagtagagatggggtttcaccatgttagccaggatggtctcgatctcctgacctcgtgatctgcctgccgcagcctcccaaagtgctgggattacccacactttggtcaagaatagaataaaagcgtgagtctaatcattcttaaccaagttgaaaagaactaaaaataaatttgatgcaagtagcagcttctctgttgctgcatcttcaccacagactcttattacatgaaaattcaaggagcagaacttgatctcaaaatgccattaccataaataaaagataatacatcaatcwcagcaacaccatcttataacatggcttaatatttaagtagtccttttactctccttacactgttagacatggggctttgtgtcttacaagtccatcatcaagagagtatgatattgaagatgtgagggcttatttctgtttggttcattgacttttaaagcctctcttttgaaataagagtttaattataaaatggtttattgactttatctctcttattatacaaatgctatttacactaaaaactaaatatttctggtagttagcctctgatgagtttaagattatttataaatcatt

SEQ ID NO: 108067 - DNA, 601 bp, Human
ttttttttttttttagacgcaggcttgctctgtcacccaggctggagtgcagtggcgcgatcttggctcactgcaagctctgcctcccgggttcacaccagtctcctgcctcagcctcccgagtagctgggtctataggcacctgccaccatgcccggctaatttttttgtatttttagtagagatggggtttcaccatgttagccaggatggtctcgatctcctgacctcgtgatctgcctgccgcagcctcccaaagtgctgggattacccacactttggtcaagaatagaataaaagygtgagtctaatcattcttaaccaagttgaaaagaactaaaaataaatttgatgcaagtagcagcttctctgttgctgcatcttcaccacagactcttattacatgaaaattcaaggagcagaacttgatctcaaaatgccattaccataaataaaagataatacatcaatcacagcaacaccatcttataacatggcttaatatttaagtagtccttttactctccttacactgttagacatggggctttgtgtcttacaagtccatcatcaagagagtatgatattgaagatgtgaggg

SEQ ID NO: 108068 - DNA, 601 bp, Human
tctgtaagttatttctatggataaataaaatactcataataccaaattcttaaagattttttaaaaacttttagtaaacttgacaagaaaataccaataattctcttcttttacccacactttggtcaaagaaaacaccaatttttttttttttttttagacgcaggcttgctctgtcacccaggctggagtgcagtggcgcgatcttggctcactgcaagctctgcctcccgggttcacaccagtctcctgcctcagcctcccgagtagctgggtctataggcacctgccaccatgcccrgctaatttttttgtatttttagtagagatggggtttcaccatgttagccaggatggtctcgatctcctgacctcgtgatctgcctgccgcagcctcccaaagtgctgggattacccacactttggtcaagaatagaataaaagcgtgagtctaatcattcttaaccaagttgaaaagaactaaaaataaatttgatgcaagtagcagcttctctgttgctgcatcttcaccacagactcttattacatgaaaattcaaggagcagaacttgatctcaaaatgccattaccataaataaaa

SEQ ID NO: 108069 - DNA, 601 bp, Human
ctttcactctatttctgtaagttatttctatggataaataaaatactcataataccaaattcttaaagattttttaaaaacttttagtaaacttgacaagaaaataccaataattctcttcttttacccacactttggtcaaagaaaacaccaatttttttttttttttttagacgcaggcttgctctgtcacccaggctggagtgcagtggcgcgatcttggctcactgcaagctctgcctcccgggttcacaccagtctcctgcctcagcctcccgagtagctgggtctataggcaccygccaccatgcccggctaatttttttgtatttttagtagagatggggtttcaccatgttagccaggatggtctcgatctcctgacctcgtgatctgcctgccgcagcctcccaaagtgctgggattacccacactttggtcaagaatagaataaaagcgtgagtctaatcattcttaaccaagttgaaaagaactaaaaataaatttgatgcaagtagcagcttctctgttgctgcatcttcaccacagactcttattacatgaaaattcaaggagcagaacttgatctcaaaatgccatt

SEQ ID NO: 108070 - DNA, 601 bp, Human
aatattgaattcttaatattaattttttcagtcattattttggtggtagaaagaaactttcactctatttctgtaagttatttctatggataaataaaatactcataataccaaattcttaaagattttttaaaaacttttagtaaacttgacaagaaaataccaataattctcttcttttacccacactttggtcaaagaaaacaccaatttttttttttttttttagacgcaggcttgctctgtcacccaggctggagtgcagtggcgcgatcttggctcactgcaagctctgcctccygggttcacaccagtctcctgcctcagcctcccgagtagctgggtctataggcacctgccaccatgcccggctaatttttttgtatttttagtagagatggggtttcaccatgttagccaggatggtctcgatctcctgacctcgtgatctgcctgccgcagcctcccaaagtgctgggattacccacactttggtcaagaatagaataaaagcgtgagtctaatcattcttaaccaagttgaaaagaactaaaaataaatttgatgcaagtagcagcttctctgttgctgcatcttcacc

SEQ ID NO: 108071 - DNA, 601 bp, Human
aattatgcttcactctgtgtagttatcttccaattcactaattctttattctaccatttctaactgattgttaaatctaattgattgttaaatattgaattcttaatattaattttttcagtcattattttggtggtagaaagaaactttcactctatttctgtaagttatttctatggataaataaaatactcataataccaaattcttaaagattttttaaaaacttttagtaaacttgacaagaaaataccaataattctcttcttttacccacactttggtcaaagaaaacaccaatttttttttttttttttagacgcaggcttgctctgtcacccaggctggagtgcagtggcgcgatcttggctcactgcaagctctgcctcccgggttcacaccagtctcctgcctcagcctcccgagtagctgggtctataggcacctgccaccatgcccggctaatttttttgtatttttagtagagatggggtttcaccatgttagccaggatggtctcgatctcctgacctcgtgatctgcctgccgcagcctcccaaagtgctgggattacccacactttggtcaagaatagaataaa

SEQ ID NO: 108072 - DNA, 601 bp, Human
aatcagataaggaaattccagagagaattccctctggtgcttcaggaaagaggatcagagacacagacagaagggaaaacttcagacagagaatttgaggcttcctgtttagtccagcatgtcaaagagcgatatattttcagtatcattttctgagccccaatagtatacagttgtagttagtttcatggtgccatatttcttgcagtgtgtcacatcttccgcttaattgtagagttttaatagaaaaatccttcatacatgtgggcacaaattttatattaacataaaaacattttcrttcctatcaaacagttctgccaatcccaggcagtaacactcgatctgtaattttgattgaagggctggattcaactttgattacatgcaaataggagaaaaagtaacttgcactgatttgcaattttcattctgccctaaagcttgggtcacttggatccaaatgccaactttcctaaatctctgctcaaaaaagagaggtggaaaactttccagtataattcatgggggtgcttaggtgtagcttttctcacttgaaaaccagagaaccagagaaggtacagaaacctggaaaaatgat

SEQ ID NO: 108073 - DNA, 601 bp, Human
ccagggaatctcttggagctgccttcaaaagaacaactgaaaagtctgtctaggcatgttgacaactccaagtatcttatccagtggttatctgatccagtatcttatcctggtcatttgatgagattcctagacaaggagtcttttaaaaattgcatttcttctggaaagaaattttcttaatcagataaggaaattccagagagaattccctctggtgcttcaggaaagaggatcagagacacagacagaagggaaaacttcagacagagaatttgaggcttcctgtttagtccagcatgtcaaagagcgatatattttcagtatcattttctgagccccaatagtatacagttgtagttagtttcatggtgccatatttcttgcagtgtgtcacatcttccgcttaattgtagagttttaatagaaaaatccttcatacatgtgggcacaaattttatattaacataaaaacattttcgttcctatcaaacagttctgccaatcccaggcagtaacactcgatctgtaattttgattgaagggctggattcaactttgattacatgcaaataggagaaaaagtaacttgcactgattt

SEQ ID NO: 108074 - DNA, 601 bp, Human
agataaagtcacccagggaatctcttggagctgccttcaaaagaacaactgaaaagtctgtctaggcatgttgacaactccaagtatcttatccagtggttatctgatccagtatcttatcctggtcatttgatgagattcctagacaaggagtcttttaaaaattgcatttcttctggaaagaaattttcttaatcagataaggaaattccagagagaattccctctggtgcttcaggaaagaggatcagagacacagacagaagggaaaacttcagacagagaatttgaggcttcctgtttagtccagcatgtcaaagagcgatatattttcagtatcattttctgagccccaatagtatacagttgtagttagtttcatggtgccatatttcttgcagtgtgtcacatcttccgcttaattgtagagttttaatagaaaaatccttcatacatgtgggcacaaattttatattaacataaaaacattttcgttcctatcaaacagttctgccaatcccaggcagtaacactcgatctgtaattttgattgaagggctggattcaactttgattacatgcaaataggagaaaaagtaac

SEQ ID NO: 108075 - DNA, 601 bp, Human
tgtcttattatgcagataaagtcacccagggaatctcttggagctgccttcaaaagaacaactgaaaagtctgtctaggcatgttgacaactccaagtatcttatccagtggttatctgatccagtatcttatcctggtcatttgatgagattcctagacaaggagtcttttaaaaattgcatttcttctggaaagaaattttcttaatcagataaggaaattccagagagaattccctctggtgcttcaggaaagaggatcagagacacagacagaagggaaaacttcagacagagaatytgaggcttcctgtttagtccagcatgtcaaagagcgatatattttcagtatcattttctgagccccaatagtatacagttgtagttagtttcatggtgccatatttcttgcagtgtgtcacatcttccgcttaattgtagagttttaatagaaaaatccttcatacatgtgggcacaaattttatattaacataaaaacattttcgttcctatcaaacagttctgccaatcccaggcagtaacactcgatctgtaattttgattgaagggctggattcaactttgattacatgcaaatag

SEQ ID NO: 108076 - DNA, 601 bp, Human
aggggccagacaattgactcttaagtatactcttaattggggagaggaaagcaagggatgtaagaataaatgatttccagaggaaatgcataatctaaagagcaatggcctaggacaaatttcctctgagctctacgggaggtggagggaaggttagggccagaacttcactgtgaacaaaggttgtcttattatgcagataaagtcacccagggaatctcttggagctgccttcaaaagaacaactgaaaagtctgtctaggcatgttgacaactccaagtatcttatccagtggttatytgatccagtatcttatcctggtcatttgatgagattcctagacaaggagtcttttaaaaattgcatttcttctggaaagaaattttcttaatcagataaggaaattccagagagaattccctctggtgcttcaggaaagaggatcagagacacagacagaagggaaaacttcagacagagaatttgaggcttcctgtttagtccagcatgtcaaagagcgatatattttcagtatcattttctgagccccaatagtatacagttgtagttagtttcatggtgccatatttcttgcagtgt

SEQ ID NO: 108077 - DNA, 601 bp, Human
tgtgcatatataaatgacagccatataccaagtatgagacccaaagcaggggccagacaattgactcttaagtatactcttaattggggagaggaaagcaagggatgtaagaataaatgatttccagaggaaatgcataatctaaagagcaatggcctaggacaaatttcctctgagctctacgggaggtggagggaaggttagggccagaacttcactgtgaacaaaggttgtcttattatgcagataaagtcacccagggaatctcttggagctgccttcaaaagaacaactgaaaagtctgtctaggcatgttgacaactccaagtatcttatccagtggttatctgatccagtatcttatcctggtcatttgatgagattcctagacaaggagtcttttaaaaattgcatttcttctggaaagaaattttcttaatcagataaggaaattccagagagaattccctctggtgcttcaggaaagaggatcagagacacagacagaagggaaaacttcagacagagaatttgaggcttcctgtttagtccagcatgtcaaagagcgatatattttcagtatcattttctgagccccaat

SEQ ID NO: 108078 - DNA, 601 bp, Human
tacattaaaagagaatcaagtattgtaagaagccaagagaaagttttcatctgctctgagggttcattgaaaataaactgacaatagataaataagagaaaacacaagtttttattaatgtgcatatataaatgacagccatataccaagtatgagacccaaagcaggggccagacaattgactcttaagtatactcttaattggggagaggaaagcaagggatgtaagaataaatgatttccagaggaaatgcataatctaaagagcaatggcctaggacaaatttcctctgagctctasgggaggtggagggaaggttagggccagaacttcactgtgaacaaaggttgtcttattatgcagataaagtcacccagggaatctcttggagctgccttcaaaagaacaactgaaaagtctgtctaggcatgttgacaactccaagtatcttatccagtggttatctgatccagtatcttatcctggtcatttgatgagattcctagacaaggagtcttttaaaaattgcatttcttctggaaagaaattttcttaatcagataaggaaattccagagagaattccctctggtgcttcagg

SEQ ID NO: 108079 - DNA, 601 bp, Human
gtgaattatgataaatattatgagctcactaacagatattacccccaaaaaaatggcaaacaagagagcgaaacaagtggtttgtgtccagagcaaaatagtggaatgttttttctactttaatattgaaataaagaagtaatatttaaaaatagtataaaatatttttgagttttgaaaaatagtatatagtattcaacatactcaatactggagacaaatttgttagaataaagtcactcaaataaatcttatgatacatcagccaactttggcagtttacggatacaatcaaacaatkccaaaatgttttttatcaataattcttttaattctcccatcagtagcatatactccaattcaactgaaatacattaaaagagaatcaagtattgtaagaagccaagagaaagttttcatctgctctgagggttcattgaaaataaactgacaatagataaataagagaaaacacaagtttttattaatgtgcatatataaatgacagccatataccaagtatgagacccaaagcaggggccagacaattgactcttaagtatactcttaattggggagaggaaagcaagggatgtaagaa

SEQ ID NO: 108080 - DNA, 601 bp, Human
gaaataggaacttaaaaactggggtgggcctgtaatggcagatcccaaagaatctggaggatcttgaacccctaaattctgctggtgcaccgttgccaggagatgcactcttcctcccctcgctgagaaggttagtcttccttcccttgccttaaaaacctgtaatgagttaccttgagctgtttggcttacagaggaatgctgatacccctctatatatatccctgcctcctcttatgtttaaatatatgataacactcaattcccagcaggccccaaatgacaagatacaaaatgtgayacaggacaaagtaaaattcagaccaaaagacttgtaagattttgtgaattttataccaacacacacctgagatatatgagtagaaatggatcttatgaatgggtagatataacaatataatacatataatgtgaattatgataaatattatgagctcactaacagatattacccccaaaaaaatggcaaacaagagagcgaaacaagtggtttgtgtccagagcaaaatagtggaatgttttttctactttaatattgaaataaagaagtaatatttaaaaatagtataaaatatttttg

SEQ ID NO: 108081 - DNA, 601 bp, Human
acataagtagaatagggttcgttgctgacttataagtgtgctagaaaacttggagaaagaaaaattatgaacttaaggctctgaattactagcttcggattatgtaaactaacataacattcctacgactgtcttcaaaaaagtccttatctcctatagcagaagtactaaaatttctgaaaagcaaactcaaatcaatttctgcaataaataaatcatcttgaaaattgtatttacaacttcacaacttcctgtgttaaagtcaggaaatttgctaaaaaagaaataggaacttaaaaaytggggtgggcctgtaatggcagatcccaaagaatctggaggatcttgaacccctaaattctgctggtgcaccgttgccaggagatgcactcttcctcccctcgctgagaaggttagtcttccttcccttgccttaaaaacctgtaatgagttaccttgagctgtttggcttacagaggaatgctgatacccctctatatatatccctgcctcctcttatgtttaaatatatgataacactcaattcccagcaggccccaaatgacaagatacaaaatgtgacacaggacaaagtaaaatt

SEQ ID NO: 108082 - DNA, 601 bp, Human
gatttaagggtattcatgaccctgtttccaacggtaaaggagacactggcaatccctggcatgcggtgacacaacagttatttaaattattgtccatagatgatcacttacaaaataacttataatcaagttcctatagaaggcaagacattgagtgaggctgccatagaacattttagtgaacataagtagaatagggttcgttgctgacttataagtgtgctagaaaacttggagaaagaaaaattatgaacttaaggctctgaattactagcttcggattatgtaaactaacataacrttcctacgactgtcttcaaaaaagtccttatctcctatagcagaagtactaaaatttctgaaaagcaaactcaaatcaatttctgcaataaataaatcatcttgaaaattgtatttacaacttcacaacttcctgtgttaaagtcaggaaatttgctaaaaaagaaataggaacttaaaaactggggtgggcctgtaatggcagatcccaaagaatctggaggatcttgaacccctaaattctgctggtgcaccgttgccaggagatgcactcttcctcccctcgctgagaaggttagtc

SEQ ID NO: 108083 - DNA, 601 bp, Human
ttcttgtattttgatgatcaccatgagaatagccacagctacacttcaagtacagctgccccttctgcctgagactcagaatgagactgttgatcatgacagaatcaaattccaagtctaggtaggagttgtctggtattagttgtctcatataattagatttaagggtattcatgaccctgtttccaacggtaaaggagacactggcaatccctggcatgcggtgacacaacagttatttaaattattgtccatagatgatcacttacaaaataacttataatcaagttcctatagaagrcaagacattgagtgaggctgccatagaacattttagtgaacataagtagaatagggttcgttgctgacttataagtgtgctagaaaacttggagaaagaaaaattatgaacttaaggctctgaattactagcttcggattatgtaaactaacataacattcctacgactgtcttcaaaaaagtccttatctcctatagcagaagtactaaaatttctgaaaagcaaactcaaatcaatttctgcaataaataaatcatcttgaaaattgtatttacaacttcacaacttcctgtgttaaa

SEQ ID NO: 108084 - DNA, 601 bp, Human
cagtagattggatttttagccccaattatttattccctttaatagtattactcacagcctttgcatgtaactttgctgtgctctcccactgtgggcaaagtataatttccatgcccattaatgttgtacttgtctgtgaattgctttagaatattagcagaatgtatatgagcagagatcttaaaaatgcattatcagtttgtctgggccttcttgtattttgatgatcaccatgagaatagccacagctacacttcaagtacagctgccccttctgcctgagactcagaatgagactgtkgatcatgacagaatcaaattccaagtctaggtaggagttgtctggtattagttgtctcatataattagatttaagggtattcatgaccctgtttccaacggtaaaggagacactggcaatccctggcatgcggtgacacaacagttatttaaattattgtccatagatgatcacttacaaaataacttataatcaagttcctatagaaggcaagacattgagtgaggctgccatagaacattttagtgaacataagtagaatagggttcgttgctgacttataagtgtgctagaaaactt

SEQ ID NO: 108085 - DNA, 601 bp, Human
tattttagttttaactattctccacttttatgtttattgacatctatggttaagaaagttcagcttgggagatgacagtagattggatttttagccccaattatttattccctttaatagtattactcacagcctttgcatgtaactttgctgtgctctcccactgtgggcaaagtataatttccatgcccattaatgttgtacttgtctgtgaattgctttagaatattagcagaatgtatatgagcagagatcttaaaaatgcattatcagtttgtctgggccttcttgtattttgatratcaccatgagaatagccacagctacacttcaagtacagctgccccttctgcctgagactcagaatgagactgttgatcatgacagaatcaaattccaagtctaggtaggagttgtctggtattagttgtctcatataattagatttaagggtattcatgaccctgtttccaacggtaaaggagacactggcaatccctggcatgcggtgacacaacagttatttaaattattgtccatagatgatcacttacaaaataacttataatcaagttcctatagaaggcaagacattgagtga

SEQ ID NO: 108086 - DNA, 601 bp, Human
tttatagaagaaaatttctcttctctcaagatcaatttatttttgttttatcacttatctgtactatattttagttttaactattctccacttttatgtttattgacatctatggttaagaaagttcagcttgggagatgacagtagattggatttttagccccaattatttattccctttaatagtattactcacagcctttgcatgtaactttgctgtgctctcccactgtgggcaaagtataatttccatgcccattaatgttgtacttgtctgtgaattgctttagaatattagcasaatgtatatgagcagagatcttaaaaatgcattatcagtttgtctgggccttcttgtattttgatgatcaccatgagaatagccacagctacacttcaagtacagctgccccttctgcctgagactcagaatgagactgttgatcatgacagaatcaaattccaagtctaggtaggagttgtctggtattagttgtctcatataattagatttaagggtattcatgaccctgtttccaacggtaaaggagacactggcaatccctggcatgcggtgacacaacagttatttaaattattg

SEQ ID NO: 108087 - DNA, 601 bp, Human
tgcatttcccctcagtcattaagcctgatactacccacctctcttttcctgtcttgggatttacctgcagcagctgaagtgtgagaacctgcaagagtctgtcaacatccacacaaatgcacacgaagttgcaggctgctggccaaaaacagactgctggtcatccttgcttttttttttttcaatgtgccctgcttatgccataagtgctgttgctgctctctcgggatcttgctacaccaggggctggttagagaggctagaaaatatagttgagaaatacacagaggggacaccctgraaactctgaccaatgaaagatgagagccaatatatacattctttttatttcttcccttggatagagacagaaatttcacagactccttttaaacacatacgaagaaatcaactgtgattatgaagtgacagccagctaaatatgtcttgtattttctctcttcctttttttgcctaactcatcctttacttccattcctgcttccatggtaatgcaggctcaaataaattactaggatacaagattacttcaagcctcttttctgtggaactcataatatgataagcatttgttacaaga

SEQ ID NO: 108088 - DNA, 601 bp, Human
tatccaaacaatttactgcaaaaaacacatcttatctactaatttctaatgataatcttattgtaagacaaattacatgtgcacaaaaagtaaattacctaaatatattctgccttactattcccttttgttgtctattgcatccttctgtgccaaaattctttcaattttcataattacactataataaatcttgatacccagtaaagaacttaccttcttctttttccaagttttcttgcctatctccgaactgttaattttctatatgtatttttcaagtcatttttcacaatttccrcaaaactttaataagactttgccacaacttgcattgactatattaatctagaaagaaattatattttataatactcagtttatctatgaacatgatacatctcttcatgtattgtttttgaaacaatgtctcactccagttgcccaggctggagtgcagtggcgcgatctcggctcactgcagcatcagcctcccaagatcagatcctcccacctcagcttactgagtagctgtgactacaggtgtgtgccaccacacaccgctaatttttgtatttttagtagagacacggtttcacca

SEQ ID NO: 108089 - DNA, 601 bp, Human
attatccaaacaatttactgcaaaaaacacatcttatctactaatttctaatgataatcttattgtaagacaaattacatgtgcacaaaaagtaaattacctaaatatattctgccttactattcccttttgttgtctattgcatccttctgtgccaaaattctttcaattttcataattacactataataaatcttgatacccagtaaagaacttaccttcttctttttccaagttttcttgcctatctccgaactgttaattttctatatgtatttttcaagtcatttttcacaatttycgcaaaactttaataagactttgccacaacttgcattgactatattaatctagaaagaaattatattttataatactcagtttatctatgaacatgatacatctcttcatgtattgtttttgaaacaatgtctcactccagttgcccaggctggagtgcagtggcgcgatctcggctcactgcagcatcagcctcccaagatcagatcctcccacctcagcttactgagtagctgtgactacaggtgtgtgccaccacacaccgctaatttttgtatttttagtagagacacggtttcac

SEQ ID NO: 108090 - DNA, 601 bp, Human
ttaatgtttagatcttagtccttttggactattttttgtgatacaagttacacattgattttcctccttatgaaaagtccattatccaaacaatttactgcaaaaaacacatcttatctactaatttctaatgataatcttattgtaagacaaattacatgtgcacaaaaagtaaattacctaaatatattctgccttactattcccttttgttgtctattgcatccttctgtgccaaaattctttcaattttcataattacactataataaatcttgatacccagtaaagaacttacctycttctttttccaagttttcttgcctatctccgaactgttaattttctatatgtatttttcaagtcatttttcacaatttccgcaaaactttaataagactttgccacaacttgcattgactatattaatctagaaagaaattatattttataatactcagtttatctatgaacatgatacatctcttcatgtattgtttttgaaacaatgtctcactccagttgcccaggctggagtgcagtggcgcgatctcggctcactgcagcatcagcctcccaagatcagatcctcccacctcag

SEQ ID NO: 108091 - DNA, 601 bp, Human
atttttcttagctttaaattttgttcttaatgtttagatcttagtccttttggactattttttgtgatacaagttacacattgattttcctccttatgaaaagtccattatccaaacaatttactgcaaaaaacacatcttatctactaatttctaatgataatcttattgtaagacaaattacatgtgcacaaaaagtaaattacctaaatatattctgccttactattcccttttgttgtctattgcatccttctgtgccaaaattctttcaattttcataattacactataataaatgttgatacccagtaaagaacttaccttcttctttttccaagttttcttgcctatctccgaactgttaattttctatatgtatttttcaagtcatttttcacaatttccgcaaaactttaataagactttgccacaacttgcattgactatattaatctagaaagaaattatattttataatactcagtttatctatgaacatgatacatctcttcatgtattgtttttgaaacaatgtctcactccagttgcccaggctggagtgcagtggcgcgatctcggctcactgcagcatcagcct

SEQ ID NO: 108092 - DNA, 601 bp, Human
taatttacatttttcttagctttaaattttgttcttaatgtttagatcttagtccttttggactattttttgtgatacaagttacacattgattttcctccttatgaaaagtccattatccaaacaatttactgcaaaaaacacatcttatctactaatttctaatgataatcttattgtaagacaaattacatgtgcacaaaaagtaaattacctaaatatattctgccttactattcccttttgttgtctattgcatccttctgtgccaaaattctttcaattttcataattacactayaataaatcttgatacccagtaaagaacttaccttcttctttttccaagttttcttgcctatctccgaactgttaattttctatatgtatttttcaagtcatttttcacaatttccgcaaaactttaataagactttgccacaacttgcattgactatattaatctagaaagaaattatattttataatactcagtttatctatgaacatgatacatctcttcatgtattgtttttgaaacaatgtctcactccagttgcccaggctggagtgcagtggcgcgatctcggctcactgcagc

SEQ ID NO: 108093 - DNA, 601 bp, Human
aacttagctggattaattaacagatctttccaaggaatttaaaacttatcaaacttttcctttatgttttgtggtttttgtatctttcagataaaatcctcacctaccctgaatttataaaataatttacatttttcttagctttaaattttgttcttaatgtttagatcttagtccttttggactattttttgtgatacaagttacacattgattttcctccttatgaaaagtccattatccaaacaatttactgcaaaaaacacatcttatctactaatttctaatgataatcttattrtaagacaaattacatgtgcacaaaaagtaaattacctaaatatattctgccttactattcccttttgttgtctattgcatccttctgtgccaaaattctttcaattttcataattacactataataaatcttgatacccagtaaagaacttaccttcttctttttccaagttttcttgcctatctccgaactgttaattttctatatgtatttttcaagtcatttttcacaatttccgcaaaactttaataagactttgccacaacttgcattgactatattaatctagaaagaaattat

SEQ ID NO: 108094 - DNA, 601 bp, Human
taatttcatccatatattcctagttttaatactctttctgtattcattatcaaatgcctagatgtataattagactagagtcagacagctaacttagctggattaattaacagatctttccaaggaatttaaaacttatcaaacttttcctttatgttttgtggtttttgtatctttcagataaaatcctcacctaccctgaatttataaaataatttacatttttcttagctttaaattttgttcttaatgtttagatcttagtccttttggactattttttgtgatacaagttacacaytgattttcctccttatgaaaagtccattatccaaacaatttactgcaaaaaacacatcttatctactaatttctaatgataatcttattgtaagacaaattacatgtgcacaaaaagtaaattacctaaatatattctgccttactattcccttttgttgtctattgcatccttctgtgccaaaattctttcaattttcataattacactataataaatcttgatacccagtaaagaacttaccttcttctttttccaagttttcttgcctatctccgaactgttaattttctatatgta

SEQ ID NO: 108095 - DNA, 601 bp, Human
gtagtttttttactgaatctaaagtgtttcccaggcccttagcataataaactactctaaatgagaaaaaaaatggcaatatttgccttaacatcttacatgtatacctgaatttggcaagaattgatgtcatcacaacaatgagaatgtcatctaagaacatgatttttttattaggtaaaatgagtatttttaatttcatccatatattcctagttttaatactctttctgtattcattatcaaatgcctagatgtataattagactagagtcagacagctaacttagctggattaatkaacagatctttccaaggaatttaaaacttatcaaacttttcctttatgttttgtggtttttgtatctttcagataaaatcctcacctaccctgaatttataaaataatttacatttttcttagctttaaattttgttcttaatgtttagatcttagtccttttggactattttttgtgatacaagttacacattgattttcctccttatgaaaagtccattatccaaacaatttactgcaaaaaacacatcttatctactaatttctaatgataatcttattgtaagacaaattacatgt

SEQ ID NO: 108096 - DNA, 601 bp, Human
tctttcagtctttttctagtattcattctgctttattcttctaggtagtttttttactgaatctaaagtgtttcccaggcccttagcataataaactactctaaatgagaaaaaaaatggcaatatttgccttaacatcttacatgtatacctgaatttggcaagaattgatgtcatcacaacaatgagaatgtcatctaagaacatgatttttttattaggtaaaatgagtatttttaatttcatccatatattcctagttttaatactctttctgtattcattatcaaatgcctagatrtataattagactagagtcagacagctaacttagctggattaattaacagatctttccaaggaatttaaaacttatcaaacttttcctttatgttttgtggtttttgtatctttcagataaaatcctcacctaccctgaatttataaaataatttacatttttcttagctttaaattttgttcttaatgtttagatcttagtccttttggactattttttgtgatacaagttacacattgattttcctccttatgaaaagtccattatccaaacaatttactgcaaaaaacacatcttatc

SEQ ID NO: 108097 - DNA, 601 bp, Human
ttagaaacgtttcagaaatatgtagttatacatgcatatcaaaaagtatgtgtacatagatacatagatataaagtgtatgtatttttatgctaaattcgctttgactatatcctactatatgcttctaccagtagtgaaagagatttttcatgtttctgagctttttactatctggatacctttttagtatttttataatatattttaccaacagatgttcctcattctgtgcgtctttacacattttttttctttcagtctttttctagtattcattctgctttattcttctaggtagtttttttactgaatctaaagtgtttcccaggcccttagcataataaactactctaaatgagaaaaaaaatggcaatatttgccttaacatcttacatgtatacctgaatttggcaagaattgatgtcatcacaacaatgagaatgtcatctaagaacatgatttttttattaggtaaaatgagtatttttaatttcatccatatattcctagttttaatactctttctgtattcattatcaaatgcctagatgtataattagactagagtcagacagctaacttagctggattaattaaca

SEQ ID NO: 108098 - DNA, 601 bp, Human
gttcctcactgatacataatccctcaatattagaatttctcaaattaaattcctgaaaatgttagaattaaaaggtattttctaaaacagaaaaggatttcacagaaaaggaaatttgggaaactccacatagagcacttccttttacatactaacagagtatacagaaagcttatgatttaaaaacaaacaaaaaggttaaagtcgcttaagccagcattgcctaaaatatttaaaaattaagaacatttttttgtaacaactatgaatattctgctgaactctgagaaattctgctctrtatctcttttaatgacaaatgtgtattctgctataatgaagcattataatgtttttaagcataaaaaatgttaaggcttttatcttaatgttaacaaactatacatagctctataactgtttttgcatatctgtaatcattttatgattatttttagaaacgtttcagaaatatgtagttatacatgcatatcaaaaagtatgtgtacatagatacatagatataaagtgtatgtatttttatgctaaattcgctttgactatatcctactatatgcttctaccagtagtgaaagagatt

SEQ ID NO: 108099 - DNA, 601 bp, Human
attacaggtgtgagccaccatacccagtctacatgttctaaaaaatgaaattgttcctcactgatacataatccctcaatattagaatttctcaaattaaattcctgaaaatgttagaattaaaaggtattttctaaaacagaaaaggatttcacagaaaaggaaatttgggaaactccacatagagcacttccttttacatactaacagagtatacagaaagcttatgatttaaaaacaaacaaaaaggttaaagtcgcttaagccagcattgcctaaaatatttaaaaattaagaacatttttttgtaacaactatgaatattctgctgaactctgagaaattctgctctatatctcttttaatgacaaatgtgtattctgctataatgaagcattataatgtttttaagcataaaaaatgttaaggcttttatcttaatgttaacaaactatacatagctctataactgtttttgcatatctgtaatcattttatgattatttttagaaacgtttcagaaatatgtagttatacatgcatatcaaaaagtatgtgtacatagatacatagatataaagtgtatgtatttttatgctaa

SEQ ID NO: 108100 - DNA, 601 bp, Human
gattacaggtgtgagccaccatacccagtctacatgttctaaaaaatgaaattgttcctcactgatacataatccctcaatattagaatttctcaaattaaattcctgaaaatgttagaattaaaaggtattttctaaaacagaaaaggatttcacagaaaaggaaatttgggaaactccacatagagcacttccttttacatactaacagagtatacagaaagcttatgatttaaaaacaaacaaaaaggttaaagtcgcttaagccagcattgcctaaaatatttaaaaattaagaacwtttttttgtaacaactatgaatattctgctgaactctgagaaattctgctctatatctcttttaatgacaaatgtgtattctgctataatgaagcattataatgtttttaagcataaaaaatgttaaggcttttatcttaatgttaacaaactatacatagctctataactgtttttgcatatctgtaatcattttatgattatttttagaaacgtttcagaaatatgtagttatacatgcatatcaaaaagtatgtgtacatagatacatagatataaagtgtatgtatttttatgcta

SEQ ID NO: 108101 - DNA, 601 bp, Human
tttagtagagatgggatttcaccatgttggctaggatggtctgaaactcctgacctcaaataatctatcctccttggcctcccaaagtgctaggattacaggtgtgagccaccatacccagtctacatgttctaaaaaatgaaattgttcctcactgatacataatccctcaatattagaatttctcaaattaaattcctgaaaatgttagaattaaaaggtattttctaaaacagaaaaggatttcacagaaaaggaaatttgggaaactccacatagagcacttccttttacatactarcagagtatacagaaagcttatgatttaaaaacaaacaaaaaggttaaagtcgcttaagccagcattgcctaaaatatttaaaaattaagaacatttttttgtaacaactatgaatattctgctgaactctgagaaattctgctctatatctcttttaatgacaaatgtgtattctgctataatgaagcattataatgtttttaagcataaaaaatgttaaggcttttatcttaatgttaacaaactatacatagctctataactgtttttgcatatctgtaatcattttatgattatttt

SEQ ID NO: 108102 - DNA, 601 bp, Human
tcctgcaggagcactctgcttccttcagaggatctgtgggtcctcttgggattactggtttgttcttgcagtggatttgtagctaaaattcacaatacaagcatccacatgctggtctgtctagagctgcaatctagtcctgcctcacatccatctgccacaatcccctgaatctctgcagtgtttattgttccatccaaacctacacatgtgcctatactttttttgttttgttttttgtttttggttttctttgaaacggagtctcgccccattgcccaggttggaatacagtggcgcratctcgggtcactgcaacctctgcctctcaggttcaagtgattctccctgcctcagcctcctgagtgtctgggattacagatacataacaccatgcatggctaatttttgtatttttagtagagatgggatttcaccatgttggctaggatggtctgaaactcctgacctcaaataatctatcctccttggcctcccaaagtgctaggattacaggtgtgagccaccatacccagtctacatgttctaaaaaatgaaattgttcctcactgatacataatccctcaatattagaatttct

SEQ ID NO: 108103 - DNA, 601 bp, Human
cagaccttcagttctccagtggtggtgtgtgttcagaagaggagggtctccctttcctactcctgcagttggggaagtcactgtatttgggtgtctcctgggtcctgcaggagcactctgcttccttcagaggatctgtgggtcctcttgggattactggtttgttcttgcagtggatttgtagctaaaattcacaatacaagcatccacatgctggtctgtctagagctgcaatctagtcctgcctcacatccatctgccacaatcccctgaatctctgcagtgtttattgttccatccraacctacacatgtgcctatactttttttgttttgttttttgtttttggttttctttgaaacggagtctcgccccattgcccaggttggaatacagtggcgcgatctcgggtcactgcaacctctgcctctcaggttcaagtgattctccctgcctcagcctcctgagtgtctgggattacagatacataacaccatgcatggctaatttttgtatttttagtagagatgggatttcaccatgttggctaggatggtctgaaactcctgacctcaaataatctatcctccttggcctccca

SEQ ID NO: 108104 - DNA, 601 bp, Human
ccagaaacttctcctgcaaacagaccttcagttctccagtggtggtgtgtgttcagaagaggagggtctccctttcctactcctgcagttggggaagtcactgtatttgggtgtctcctgggtcctgcaggagcactctgcttccttcagaggatctgtgggtcctcttgggattactggtttgttcttgcagtggatttgtagctaaaattcacaatacaagcatccacatgctggtctgtctagagctgcaatctagtcctgcctcacatccatctgccacaatcccctgaatctctgyagtgtttattgttccatccaaacctacacatgtgcctatactttttttgttttgttttttgtttttggttttctttgaaacggagtctcgccccattgcccaggttggaatacagtggcgcgatctcgggtcactgcaacctctgcctctcaggttcaagtgattctccctgcctcagcctcctgagtgtctgggattacagatacataacaccatgcatggctaatttttgtatttttagtagagatgggatttcaccatgttggctaggatggtctgaaactcctgacctcaaataat

SEQ ID NO: 108105 - DNA, 601 bp, Human
gtaaagccagaaacttctcctgcaaacagaccttcagttctccagtggtggtgtgtgttcagaagaggagggtctccctttcctactcctgcagttggggaagtcactgtatttgggtgtctcctgggtcctgcaggagcactctgcttccttcagaggatctgtgggtcctcttgggattactggtttgttcttgcagtggatttgtagctaaaattcacaatacaagcatccacatgctggtctgtctagagctgcaatctagtcctgcctcacatccatctgccacaatcccctgaawctctgcagtgtttattgttccatccaaacctacacatgtgcctatactttttttgttttgttttttgtttttggttttctttgaaacggagtctcgccccattgcccaggttggaatacagtggcgcgatctcgggtcactgcaacctctgcctctcaggttcaagtgattctccctgcctcagcctcctgagtgtctgggattacagatacataacaccatgcatggctaatttttgtatttttagtagagatgggatttcaccatgttggctaggatggtctgaaactcctgacctca

SEQ ID NO: 108106 - DNA, 601 bp, Human
caaggtaaagccagaaacttctcctgcaaacagaccttcagttctccagtggtggtgtgtgttcagaagaggagggtctccctttcctactcctgcagttggggaagtcactgtatttgggtgtctcctgggtcctgcaggagcactctgcttccttcagaggatctgtgggtcctcttgggattactggtttgttcttgcagtggatttgtagctaaaattcacaatacaagcatccacatgctggtctgtctagagctgcaatctagtcctgcctcacatccatctgccacaatccccygaatctctgcagtgtttattgttccatccaaacctacacatgtgcctatactttttttgttttgttttttgtttttggttttctttgaaacggagtctcgccccattgcccaggttggaatacagtggcgcgatctcgggtcactgcaacctctgcctctcaggttcaagtgattctccctgcctcagcctcctgagtgtctgggattacagatacataacaccatgcatggctaatttttgtatttttagtagagatgggatttcaccatgttggctaggatggtctgaaactcctgac

SEQ ID NO: 108107 - DNA, 601 bp, Human
attcacatcctcccccgagttctggccaggaggcttcttgaccagttcaaattgttataaagttcagctagagatttcttctgcctggggggttttaccccctgctcctctggccaccctcctgatggagtactatggtgccaggcaggaatcggctgtttggggacccagtgagctcccagggccttctgccctgcttcctctacccctgcatttcactcagctctctaacttaactcagctcaaggtaaagccagaaacttctcctgcaaacagaccttcagttctccagtggtggtgwgtgttcagaagaggagggtctccctttcctactcctgcagttggggaagtcactgtatttgggtgtctcctgggtcctgcaggagcactctgcttccttcagaggatctgtgggtcctcttgggattactggtttgttcttgcagtggatttgtagctaaaattcacaatacaagcatccacatgctggtctgtctagagctgcaatctagtcctgcctcacatccatctgccacaatcccctgaatctctgcagtgtttattgttccatccaaacctacacatgtgcctatactttttt

SEQ ID NO: 108108 - DNA, 601 bp, Human
gctgctgtgggggatggggatgagattcccaggtcactggagttgggtacctaggaggattatggctgcctctgctgagtcttgcaggttgtcaggaaagtgggggaaaggcaacagtcacaggtctcacccagcaaccatgcaaactgaagggctggtctcactcccaccatgcccctcccagccgacagcaccgattctatttccaggcagagggcaaaatgggcttgaaaacttgcccaaggctatctgcctcccagccatgagagaaaagggctttagttcttccccagcctgtgamgtctgcatgcccgattcacatcctcccccgagttctggccaggaggcttcttgaccagttcaaattgttataaagttcagctagagatttcttctgcctggggggttttaccccctgctcctctggccaccctcctgatggagtactatggtgccaggcaggaatcggctgtttggggacccagtgagctcccagggccttctgccctgcttcctctacccctgcatttcactcagctctctaacttaactcagctcaaggtaaagccagaaacttctcctgcaaacagaccttcagttc

SEQ ID NO: 108109 - DNA, 601 bp, Human
caggaggtggtgctttccagaaagcatcagctgtagtagtgtggtgagggactggcagtgggtgtggccctagatctcccagaattatataccctttgtcttccactaccagggtggatagggaaggaccatcaggtgggggcagggctaggtatgtctgagctcagactctcctgtgggtcttgctgtggctgctgtgggggatggggatgagattcccaggtcactggagttgggtacctaggaggattatggctgcctctgctgagtcttgcaggttgtcaggaaagtgggggaaagscaacagtcacaggtctcacccagcaaccatgcaaactgaagggctggtctcactcccaccatgcccctcccagccgacagcaccgattctatttccaggcagagggcaaaatgggcttgaaaacttgcccaaggctatctgcctcccagccatgagagaaaagggctttagttcttccccagcctgtgaagtctgcatgcccgattcacatcctcccccgagttctggccaggaggcttcttgaccagttcaaattgttataaagttcagctagagatttcttctgcctggggggtttta

SEQ ID NO: 108110 - DNA, 601 bp, Human
atgggactctcagccttggacaccagtgcatgttccagttgaggtgatggagggtgcaatggactccacgggggtccttagctttggtggtttaatgctctatttttgtgctggttggcctcctaccaggaggtggtgctttccagaaagcatcagctgtagtagtgtggtgagggactggcagtgggtgtggccctagatctcccagaattatataccctttgtcttccactaccagggtggatagggaaggaccatcaggtgggggcagggctaggtatgtctgagctcagactctcccgtgggtcttgctgtggctgctgtgggggatggggatgagattcccaggtcactggagttgggtacctaggaggattatggctgcctctgctgagtcttgcaggttgtcaggaaagtgggggaaaggcaacagtcacaggtctcacccagcaaccatgcaaactgaagggctggtctcactcccaccatgcccctcccagccgacagcaccgattctatttccaggcagagggcaaaatgggcttgaaaacttgcccaaggctatctgcctcccagccatgagagaaaagggctttagttc

SEQ ID NO: 108111 - DNA, 601 bp, Human
agtcctgtgatgtgaacaatttatgggactctcagccttggacaccagtgcatgttccagttgaggtgatggagggtgcaatggactccacgggggtccttagctttggtggtttaatgctctatttttgtgctggttggcctcctaccaggaggtggtgctttccagaaagcatcagctgtagtagtgtggtgagggactggcagtgggtgtggccctagatctcccagaattatataccctttgtcttccactaccagggtggatagggaaggaccatcaggtgggggcagggctaggyatgtctgagctcagactctcctgtgggtcttgctgtggctgctgtgggggatggggatgagattcccaggtcactggagttgggtacctaggaggattatggctgcctctgctgagtcttgcaggttgtcaggaaagtgggggaaaggcaacagtcacaggtctcacccagcaaccatgcaaactgaagggctggtctcactcccaccatgcccctcccagccgacagcaccgattctatttccaggcagagggcaaaatgggcttgaaaacttgcccaaggctatctgcctcccagcca

SEQ ID NO: 108112 - DNA, 601 bp, Human
aagataggaaggaaagaaagaagagcagaccacaacataaccagaaaacagataacaaaatggcagaagtaagtccttactaccaataataacattgaatgtaaatggactaaactctccaatcaaaaggcatagtctagctaatcagttgcctataagaaacacaattcgcctatacagacatgcacagatagaaaataaagggatggaaaaagacactccatggcaatggaagccaaaaaaagaggaatagctatactaatattagacaaaatagatttcaagacaaaaactatgaagygacaaagaaggtcaacatatggaaaggatataacaattgtaaatatatatgcactcaacactggagctcccaggtatataagtcaaatatgattagagcaaatactgtaatagatggagatgacaacttattagcaagtctactggctccaggctggtactgggagttgtctgcacagagtcctgtgatgtgaacaatttatgggactctcagccttggacaccagtgcatgttccagttgaggtgatggagggtgcaatggactccacgggggtccttagctttggtggtttaatgctc

SEQ ID NO: 108113 - DNA, 601 bp, Human
aatagtgttactggagaaaatattcttcaaacatgaaagagaaagacttttccaaaccaacaaaagctgagggatttcataaacaccagatctgtcctataagaaatgttaaagggattacttcaatcagaaagaaaagggcattaatgagcaatatgtaatcacctaaagctataaaactcactggtaatagtaaggagacagaaaaacacagactagtataacactgtaaatgtggtgtgtaaacctcgctaaagtacaaaaattaaatcatgaactgacaaaaaaaaaatagttcccrcaacctttgaagatatagacagcacaatgatatataaatagtgacacaaaaagttaaaaactgagaagatggtgttaaggtgtagagtcttcatttgtttagtgtttgtgcttgtttgtttgcttatgcaaacagtgctaagttgctatcagcttgaaataatgggttacaagatagtatttgcaagcctcatagtaatcgcaaatcaaaaaacataatacaatggatacacacaaaaaaataaaaagcaagaaactatatcatatcaccagagaaaataaccttcactaaagaaagata

SEQ ID NO: 108114 - DNA, 601 bp, Human
ttcacagaaattggaaaaccactcctaaaatatatctggaaatgccaagtgacaagatcacaaaaagaaattgttaaaaaataagaaatttggaggattatactttctgatttcaaagcttacttcaaagctgccctaatcaggattctatagaactcacattacagtagacaaaaagaacaatgaaacacaactgagagtccagaaactaacaccaacattcatggtcaattgctttcaaaaaaaggtactattgcaattcgaaaggaattaatcgtttttctcaacaaacaatgccagrtaaaattgaagaagactacctcaaggaatttaataatcaatttccctaaggtcaaggataaagaaaggattctaaagcagcaaaagaaaagaaacaaataatgtacaatggagctccactacatctggcagcagacttctcagtggaaaaaggccaggagacagtggcatgacatattagaagtgctgaaggaaaaaacttttagcccagaatagtgttactggagaaaatattcttcaaacatgaaagagaaagacttttccaaaccaacaaaagctgagggatttcataaacaccaga

SEQ ID NO: 108115 - DNA, 601 bp, Human
attttagggagatcatccaggtggaaatagccctattttcccatttgggctttttgacccattttcaatatttatcaaacttaccactcatgcttgggcctttcactaagttattctcttgagtctagttaatacttaaatatttattgtttaattaaaatgctcagcaattgtgtaactattgtgggtcacttgaaaaacacgttttccattgaagagtctagacttctttctatatgaatatttggttttgttttcctctgcttaatttatttttgattacttaatggtttaagatgartagatgttaaaatcagtctccaatcttggattttatttatttttcatttttacagtataattgtttctaagagaggattttggagtcagactgccaagacaggaaaccagattttctgcttcatataggtatgctccagacagacctcattttacaactactctctgccttggtataatcatctgtaaaatacagatgataataatattctctttggatagtctttctgaggagttaatatactatttgtataactgctttcaattttaccttctggtacaggcaggaatcaaggattat

SEQ ID NO: 108116 - DNA, 601 bp, Human
aaattctgtgaccaacgtcaaacaggaaatcatctcaatatgctaatggatgaaatcaatgctgtctttatggaaaacatgataatttccaaaacagctcaaattaactcctattcaaacacaacatccttgctgtaaggtaaaattttccatattgatgttgaagtgaaagctgaattctcatatactagcatgccaaggaagagttttttaattgttctgcaattttttccttgtttcacctctccataatttgttttcagcaacttcagttgttagagatattttacaacccaatacrtatatgacacattggttgtatagcctggtgaatggagcttgaggatagctaggatcatcaccaaagtagatttattttttttcaatgccagtaatatgtagagtgaatcccaacttttcctaccaaaagcattcaaggttttcttaggaacctcaaaaaggccaatagtccttaaaacctggttgctactaagtaatacttgtataacttattgttaacaagctcattaatacaaacacactcacacacatacacacatactcacccctcatgaataggaggaattattgtcctataatt

SEQ ID NO: 108117 - DNA, 601 bp, Human
ccattgtataagtatgccataatttgtttatccatttggaggactgacagacattccaagtacttctcaactttagctactgaaactcagtgatacgcatgtgcatgtatatgtattcggataagagtgtaaatactgggtttaggatgtgatccttcatcttaatcagataatgccatactcagccaaaatgatggtacagatttatcatcctaggagtagaatatgaaaattcccattgtttcatatcctttccaaaataagtaacgtaagagtaatatttacagttttgtatttatawaacatattattaaacaatagtttccaagttctttcctattctaatttagaatgtatttttacttcaataaatttcattctatgatagttatttcatatacatttattaataatgccttatatattatacatatttatttatatttcattataaatttgtctaacctttttttcttcaagtttcaaatactcttttcttataagcaagtgtaattatactggagatatttcctttaatcaatcattatgccaaaggactttgaaaaaatataattgttaacagcactgtaagggaaatttc

SEQ ID NO: 108118 - DNA, 601 bp, Human
atttagagacacattttggcataataggtctatatatgtaatacccatcttactatagtttattggaaattcatgactttctgacactgaaatgtgaattatgaataattaaattggaaataagaataaaggtgtctagcaatcataaatattcaaattttgatgtttcaaattcatattagcattaagaaggtggatttacagttcttgcttatcttcttttttaattaatttaagaaaacttttgggccaggtgtggtggctcataactgtaatcccaccattttaggaggctgaggcagtggattgcctgagcacaggagttcaagaccagcttgggcaacatggcaaaatcccatctctaccaaaaatagaaaaaattagcagggcgtggtggtgcacgcctgttgtcctagctactctggaggctgaactgagagaatcacttcagcccgggtggcagaggttgcattgagccgcgattgcacttgtgcactccagcctggacaacagagcaagaccctgtctcaaaataaaaaaagttttaaattttaacttgtatttcttagtaccataatgctctattctcctttattcagca

SEQ ID NO: 108119 - DNA, 601 bp, Human
tattttcaatgatttatttgctttttttattttattacactttaaaaattcatagcaaaagtgatctccaacaattaggattctattttgggtttttttgtgcagttttcaatatgaaaatagacaaatactctatgcaatatacagcatatcaattttatttcatcttttaatagcatcattagcaagccaaattcttgtaaatgctttttcacattcttagctatggtgactaaatctgttatcttactatagcagtcaaagtagcattatatatgcacaaacatactcaaagatcatrctaaatatgttttacaccttaacaaatttgcctatgatttttcttctctaatgcagaaccaaaaaatatatagtaacaaaatatttaacccaaaatgcaggtgtacacatgaatagtattgtgaaattagaatgctaacaatatgaatatacatatttcatttagagacacattttggcataataggtctatatatgtaatacccatcttactatagtttattggaaattcatgactttctgacactgaaatgtgaattatgaataattaaattggaaataagaataaaggtgtctagca

SEQ ID NO: 108120 - DNA, 601 bp, Human
ttatgtgtttaaatatttcaaaaataaatcatttaatgagatagatgtggatatagataatgataatgatgatggcaggtaaaagggagaatgctatttgataaatgtgatttcagtcttgttttttaagtactagacttcaaggtaatgagagaacaatattattcttcttcatggcctcatgattcttatattattctcagcatcaggcctaggcaaataccctcacgtggtatttcatcaagaataatgtaaaaccaatgtattttcaatgatttatttgctttttttattttattayactttaaaaattcatagcaaaagtgatctccaacaattaggattctattttgggtttttttgtgcagttttcaatatgaaaatagacaaatactctatgcaatatacagcatatcaattttatttcatcttttaatagcatcattagcaagccaaattcttgtaaatgctttttcacattcttagctatggtgactaaatctgttatcttactatagcagtcaaagtagcattatatatgcacaaacatactcaaagatcatactaaatatgttttacaccttaacaaatttgcctatga

SEQ ID NO: 108121 - DNA, 601 bp, Human
tttttcgtatacctgacatgaaaatggtcacaattttcttctttttgtaatacaaaggtcacagaagagattaaaatcatggtctaggcattctcctgcaacttggaagaaaccggaaattgatttgatgtgagtagctttttttggatagtagcttgtctgttgctgggtcatcaccacaaactcaccttatagggaaattcagtgagcagcactagatctcaaaatgtcattacaattaataaaatatagtatctcaaccacagctccaccaatctattccacgatttaaattttactttttttataagcagaaatcaaggcttcttcatttataacaatctttaaaagatcaaagagtaaaacagtacttacaagtttatcaaacattgaagaacttttattcccatggaaacaaaactgaatctggtgcttctaaggaattccaccatttaatccctatccgtgaatatagttttggttatagaactataaccttcaaactccatcatcactcactcaagtgtgacagaagatctgaggtcttacctctgtttgacaatctggtcctaaaactctctctttagaaatataagcttgc

SEQ ID NO: 108122 - DNA, 601 bp, Human
gacattattattttatacagtaaacattcatttacaattatgcacatatttaccactttcattaatttgtattccttcttgcatattcaacttaatattttcaataagtctctttattggccaggcagggtggctcacacccataatcccaacattttgtaaggctggggcaggagcacccaggagttcaagaccagcctgtgcaatacaccgaaactccctctacaataaatgaaaatgttagccaggcatagtgaagctactcacaagttctttaaaaaggagtttttataaatttttmgtatacctgacatgaaaatggtcacaattttcttctttttgtaatacaaaggtcacagaagagattaaaatcatggtctaggcattctcctgcaacttggaagaaaccggaaattgatttgatgtgagtagctttttttggatagtagcttgtctgttgctgggtcatcaccacaaactcaccttatagggaaattcagtgagcagcactagatctcaaaatgtcattacaattaataaaatatagtatctcaaccacagctccaccaatctattccacgatttaaattttactgttttt

SEQ ID NO: 108123 - DNA, 601 bp, Human
acctccagtctattttttgccatttgcatatgtcttatcaattatataatcaccctcaagacattattattttatacagtaaacattcatttacaattatgcacatatttaccactttcattaatttgtattccttcttgcatattcaacttaatattttcaataagtctctttattggccaggcagggtggctcacacccataatcccaacattttgtaaggctggggcaggagcacccaggagttcaagaccagcctgtgcaatacaccgaaactccctctacaataaatgaaaatgtkagccaggcatagtgaagctactcacaagttctttaaaaaggagtttttataaatttttcgtatacctgacatgaaaatggtcacaattttcttctttttgtaatacaaaggtcacagaagagattaaaatcatggtctaggcattctcctgcaacttggaagaaaccggaaattgatttgatgtgagtagctttttttggatagtagcttgtctgttgctgggtcatcaccacaaactcaccttatagggaaattcagtgagcagcactagatctcaaaatgtcattacaattaataaaa

SEQ ID NO: 108124 - DNA, 601 bp, Human
actagagaattctttcatatatcatttgatgcaattcctctgtatatatacctttgggtaaaattacagggtcattgttcaaaatctcctcatagacatagaaaagttcaaaaactacttcaagtaaatttactcctgtcacctttacctccagtctattttttgccatttgcatatgtcttatcaattatataatcaccctcaagacattattattttatacagtaaacattcatttacaattatgcacatatttaccactttcattaatttgtattccttcttgcatattcaacttaayattttcaataagtctctttattggccaggcagggtggctcacacccataatcccaacattttgtaaggctggggcaggagcacccaggagttcaagaccagcctgtgcaatacaccgaaactccctctacaataaatgaaaatgttagccaggcatagtgaagctactcacaagttctttaaaaaggagtttttataaatttttcgtatacctgacatgaaaatggtcacaattttcttctttttgtaatacaaaggtcacagaagagattaaaatcatggtctaggcattctcctgcaa

SEQ ID NO: 108125 - DNA, 601 bp, Human
tgtacatttggtcagcttcttttttgaagttatgaataattctactagagaattctttcatatatcatttgatgcaattcctctgtatatatacctttgggtaaaattacagggtcattgttcaaaatctcctcatagacatagaaaagttcaaaaactacttcaagtaaatttactcctgtcacctttacctccagtctattttttgccatttgcatatgtcttatcaattatataatcaccctcaagacattattattttatacagtaaacattcatttacaattatgcacatatttaycactttcattaatttgtattccttcttgcatattcaacttaatattttcaataagtctctttattggccaggcagggtggctcacacccataatcccaacattttgtaaggctggggcaggagcacccaggagttcaagaccagcctgtgcaatacaccgaaactccctctacaataaatgaaaatgttagccaggcatagtgaagctactcacaagttctttaaaaaggagtttttataaatttttcgtatacctgacatgaaaatggtcacaattttcttctttttgtaatacaaagg

SEQ ID NO: 108126 - DNA, 601 bp, Human
tggaattaatgtaatgattcacccatccttaatgtacatttggtcagcttcttttttgaagttatgaataattctactagagaattctttcatatatcatttgatgcaattcctctgtatatatacctttgggtaaaattacagggtcattgttcaaaatctcctcatagacatagaaaagttcaaaaactacttcaagtaaatttactcctgtcacctttacctccagtctattttttgccatttgcatatgtcttatcaattatataatcaccctcaagacattattattttatacagyaaacattcatttacaattatgcacatatttaccactttcattaatttgtattccttcttgcatattcaacttaatattttcaataagtctctttattggccaggcagggtggctcacacccataatcccaacattttgtaaggctggggcaggagcacccaggagttcaagaccagcctgtgcaatacaccgaaactccctctacaataaatgaaaatgttagccaggcatagtgaagctactcacaagttctttaaaaaggagtttttataaatttttcgtatacctgacatgaaaatg

SEQ ID NO: 108127 - DNA, 601 bp, Human
aacattatgtttctgaaatttagtcacatagttgcaagtacatgtggttttttttcacttctctatattgttccgttgcatggaattaatgtaatgattcacccatccttaatgtacatttggtcagcttcttttttgaagttatgaataattctactagagaattctttcatatatcatttgatgcaattcctctgtatatatacctttgggtaaaattacagggtcattgttcaaaatctcctcatagacatagaaaagttcaaaaactacttcaagtaaatttactcctgtcaccttyacctccagtctattttttgccatttgcatatgtcttatcaattatataatcaccctcaagacattattattttatacagtaaacattcatttacaattatgcacatatttaccactttcattaatttgtattccttcttgcatattcaacttaatattttcaataagtctctttattggccaggcagggtggctcacacccataatcccaacattttgtaaggctggggcaggagcacccaggagttcaagaccagcctgtgcaatacaccgaaactccctctacaataaatgaaaatgt

SEQ ID NO: 108128 - DNA, 601 bp, Human
taatttctatgagacgtttctcctaattaaaactttttatgttaaaattataatgcacacttagaaatgaaccaaaacaaaaatgggaaataccgcagtgtatcataaacattcaagtaaccattatgtggagcaagacaaggaacactgaaaacagcctaggtccacctccatgccactttccaaccccctaaacccttcttcacatctcctgagataagcaatatccataatttatattgattatttccttaattttcttcatactttaccaactaggtatgcaaccctaaactccatmgcttggtctggcctgctttgaactctgtgtaggtgcattcctacatgttcttgttgtttgtggcttcttggactcaacattatgtttctgaaatttagtcacatagttgcaagtacatgtggttttttttcacttctctatattgttccgttgcatggaattaatgtaatgattcacccatccttaatgtacatttggtcagcttcttttttgaagttatgaataattctactagagaattctttcatatatcatttgatgcaattcctctgtatatatacctttgggtaaaattacagg

SEQ ID NO: 108129 - DNA, 601 bp, Human
atttttcccctcagtatataatgagacgagtaataataatttctatgagacgtttctcctaattaaaactttttatgttaaaattataatgcacacttagaaatgaaccaaaacaaaaatgggaaataccgcagtgtatcataaacattcaagtaaccattatgtggagcaagacaaggaacactgaaaacagcctaggtccacctccatgccactttccaaccccctaaacccttcttcacatctcctgagataagcaatatccataatttatattgattatttccttaattttcttcayactttaccaactaggtatgcaaccctaaactccatagcttggtctggcctgctttgaactctgtgtaggtgcattcctacatgttcttgttgtttgtggcttcttggactcaacattatgtttctgaaatttagtcacatagttgcaagtacatgtggttttttttcacttctctatattgttccgttgcatggaattaatgtaatgattcacccatccttaatgtacatttggtcagcttcttttttgaagttatgaataattctactagagaattctttcatatatcatttgatgcaa

SEQ ID NO: 108130 - DNA, 601 bp, Human
tccatttactatgagaatatcacctggctagtacactgttcccagaaggagaatcagaaactaatgaaggcagattgccccccacctgatccagactaaattggccaaactctaacgacctccaagatgcagaatttggcccatctcaagtcaccagagctatccaatgtagttttgaagggtttctcttgcagaaaaacataactgataaaagaactctgctaaaccaagagtgtgggaaatgtgtacaaccttgttgtgtcaggaattcaggagccaaaagaaaaaatagatggggaayggcaaagatttgttcatgtgaggtggataattaaggctagaagaaatcctttggaaaaatctggggtggcaaataaaatcatctcaaatttcctcatgttgcaactaaataaagttcttacttcaactctcttagagttgtataagaatgtataccaatagtttatttttcccctcagtatataatgagacgagtaataataatttctatgagacgtttctcctaattaaaactttttatgttaaaattataatgcacacttagaaatgaaccaaaacaaaaatgggaaataccgcagtg

SEQ ID NO: 108131 - DNA, 601 bp, Human
agtcctattttcccactcaaggttttcagcccatgaataatgtttatttatcaaacatatctctaattcttaggcctttggtaaagtttctctcaagtctaatatttaaatatttattatttaattaaaatgttcagcaattttataagtattcctgagtaccagaccctttgatatataatcttgcagtatcctcccatcacacgaagactgactacctttcccctgaacttgaagttcaatcatttaacttactttgatgaacaaaaaattaatacactttgcatagaaatttgagatrgcttccatactgggtgttcttcctctttccatttactatgagaatatcacctggctagtacactgttcccagaaggagaatcagaaactaatgaaggcagattgccccccacctgatccagactaaattggccaaactctaacgacctccaagatgcagaatttggcccatctcaagtcaccagagctatccaatgtagttttgaagggtttctcttgcagaaaaacataactgataaaagaactctgctaaaccaagagtgtgggaaatgtgtacaaccttgttgtgtcaggaattcag

SEQ ID NO: 108132 - DNA, 601 bp, Human
cggacttttttaaatgccagatttaaatacacagaatccaaactgcttttatcaaaagcatctaagatttacttgagaaccacaggcaggccaatactccataagatctggttgctgctaatacttttgtgtaacttcattattcacaagctcataaatacacacacaaacacacacatgtgcacaccacttatgaatggaacgaattattttctcataatttccaaaataaaaaatcagtttccaggaggttgtccaggtgaaattagtcctattttcccactcaaggttttcagcccaygaataatgtttatttatcaaacatatctctaattcttaggcctttggtaaagtttctctcaagtctaatatttaaatatttattatttaattaaaatgttcagcaattttataagtattcctgagtaccagaccctttgatatataatcttgcagtatcctcccatcacacgaagactgactacctttcccctgaacttgaagttcaatcatttaacttactttgatgaacaaaaaattaatacactttgcatagaaatttgagatggcttccatactgggtgttcttcctctttccatt

SEQ ID NO: 108133 - DNA, 601 bp, Human
tttaattgctgtgaccagtgtcaagtcagaaatcaccatggcatgctaatggataagttcaatgctctctttatggaaaacattcttattttcaaaacaattcaaattaactgactcattcaccatctgttcttgttataggctggaattattcatactgaaattgacatgaaacctgaattctcatttgctagtatgcaaacaaggacatgttcacttccagtgtttgcaatttttccttgtgtaacctctccatcatttgtctttagcgacttcagttgcttgggaagttttataaccygatatgtagatcgtatagtaaatgtctaaaatcttaaagggagcttgatcataactaagatcatcaccaatacggacttttttaaatgccagatttaaatacacagaatccaaactgcttttatcaaaagcatctaagatttacttgagaaccacaggcaggccaatactccataagatctggttgctgctaatacttttgtgtaacttcattattcacaagctcataaatacacacacaaacacacacatgtgcacaccacttatgaatggaacgaattattttctcataatttccaaa

SEQ ID NO: 108134 - DNA, 601 bp, Human
ttctaggtatacatttggaaattattcatatacatatattacagaaaacccagtaagaaatataaaatgtttcatacaccaccagtttgttttctgctagaagacacacaatgcccctcttgtgaatctatggagacgaaggcttctgtctttcacccagtacctcacatgccgcaaaactgaaagaaaaatctgctttagcttcttgtttcccaaaatcaggatgaatgggtgggttgaaggatagctgaatataatagcttggcagaacatgaagacaggttgcttttccagcctcccmaaattacaaactgatatgatcatggacagaaagtaaatggcacataacagaagaaaggaggtcacagtttgcaaagcttttatgtggaccttggtgctgggatcttgagatcctttgccatggagctgcatcttcttgagatgtttacacagagaacagattaacagcagaaaagatatcagggtcagagtgaggggtacaaagtttgctagcatggttagagtcatatttgaatggtacattgcactcctcaatttgatcttccaagtcacgtttccttcatattcttttgtccataca

SEQ ID NO: 108135 - DNA, 601 bp, Human
taacaatagaaaagagcaatatttttcctgagataagctgttagttcttaataattataaatagatataaattctacaaatgaaatataaaatacatgtatgaaataaacatggcttcataattgaggaatttttgtcatattttctataatttggcagtttttgtgaaaaaacaataaaaagcatgttattgtcaatgttcttcagtttttcatacacacaacacacacacacacacacatctatatatatatacttttctagactaactttaggtaaaagacttttctaggtatacatktggaaattattcatatacatatattacagaaaacccagtaagaaatataaaatgtttcatacaccaccagtttgttttctgctagaagacacacaatgcccctcttgtgaatctatggagacgaaggcttctgtctttcacccagtacctcacatgccgcaaaactgaaagaaaaatctgctttagcttcttgtttcccaaaatcaggatgaatgggtgggttgaaggatagctgaatataatagcttggcagaacatgaagacaggttgcttttccagcctccccaaattacaaactga

SEQ ID NO: 108136 - DNA, 601 bp, Human
taaaacaacagattgtaagcacactgtggtatatttgtgtcattcaaataacaatagaaaagagcaatatttttcctgagataagctgttagttcttaataattataaatagatataaattctacaaatgaaatataaaatacatgtatgaaataaacatggcttcataattgaggaatttttgtcatattttctataatttggcagtttttgtgaaaaaacaataaaaagcatgttattgtcaatgttcttcagtttttcatacacacaacacacacacacacacacatctatatatatrtacttttctagactaactttaggtaaaagacttttctaggtatacatttggaaattattcatatacatatattacagaaaacccagtaagaaatataaaatgtttcatacaccaccagtttgttttctgctagaagacacacaatgcccctcttgtgaatctatggagacgaaggcttctgtctttcacccagtacctcacatgccgcaaaactgaaagaaaaatctgctttagcttcttgtttcccaaaatcaggatgaatgggtgggttgaaggatagctgaatataatagcttggca

SEQ ID NO: 108137 - DNA, 601 bp, Human
tcaagactatattattgtgatatttcccctaaaattgtggaatagccaaacttttcctctgaggaaggattctgcttggataagcctgtaatcttaacctgagaccagaacaggggaactcatgcaactgcagattttgtgatgagtttccttttcattggtttaccacatcagcttacccattttatccacccatttatttgttcattaaaatatcatttttgaccatctattccttgtgctgggttctaggtcctgggagtcaacagaaagcctgacagacacgatctcttcttttatrgttcttacattgtactgaggaagatacatgattctaaaaaatacatgaatcaggtgtggggatgatttatcttaaggtctgaacaacattgttaaaatttcataacaccaagaattaatacagtcatgtagaatttagctgtaaacaagactgtacatttccttcttataatagaacttcctattaatgaatatgtcaagacaattccatttaatcattgacaacaaaattacactaggacaaatcccataattaatacatagatttcatagatactattttaacacttaaaaaaagttt

SEQ ID NO: 108138 - DNA, 601 bp, Human
tcataatacaaatatataattcacaatagaaaaaaatacatacgcaaatagaccaaagtcttttatatgcttttttaaaatattgtaatagtggcatctaattttgatgttctaccttgtctccaattcagacacctgatacagctgcatcaagactatattattgtgatatttcccctaaaattgtggaatagccaaacttttcctctgaggaaggattctgcttggataagcctgtaatcttaacctgagaccagaacaggggaactcatgcaactgcagattttgtgatgagtttccytttcattggtttaccacatcagcttacccattttatccacccatttatttgttcattaaaatatcatttttgaccatctattccttgtgctgggttctaggtcctgggagtcaacagaaagcctgacagacacgatctcttcttttatggttcttacattgtactgaggaagatacatgattctaaaaaatacatgaatcaggtgtggggatgatttatcttaaggtctgaacaacattgttaaaatttcataacaccaagaattaatacagtcatgtagaatttagctgtaaacaagac

SEQ ID NO: 108139 - DNA, 601 bp, Human
atgaccaccaccaagggactggatgatgtaagacagaacaacagagatggtagttctaactcagggaaaccctggccaaggggaaacagaagactaacaacagctgagcagatacattctccctcctctctctctcttccatggactaatgccagctgtcgtttccctttgtagcccttctggaaaagttctgggagtcaagtgcatgcatctgatgaccaccatgctgtctctctcacctcactgtgaagtggctgccagcagagtcataccagacatcaccacacattgtttcacatcsgttcttgtctcaatttccacatgtccctgccatttttgtcttgaattggccttccatataaatgtcatcactttaatatcaggtattacgttaaaaacattttagtaaagtagctggttactaactcaattttttgaaatgaaatgccatttttatatgataatcaactagaaaatatcataatacaaatatataattcacaatagaaaaaaatacatacgcaaatagaccaaagtcttttatatgcttttttaaaatattgtaatagtggcatctaattttgatgttctaccttgtctc

SEQ ID NO: 108140 - DNA, 601 bp, Human
acactgtgggcatgaggtctgactttcatgaccaccaccaagggactggatgatgtaagacagaacaacagagatggtagttctaactcagggaaaccctggccaaggggaaacagaagactaacaacagctgagcagatacattctccctcctctctctctcttccatggactaatgccagctgtcgtttccctttgtagcccttctggaaaagttctgggagtcaagtgcatgcatctgatgaccaccatgctgtctctctcacctcactgtgaagtggctgccagcagagtcataccrgacatcaccacacattgtttcacatccgttcttgtctcaatttccacatgtccctgccatttttgtcttgaattggccttccatataaatgtcatcactttaatatcaggtattacgttaaaaacattttagtaaagtagctggttactaactcaattttttgaaatgaaatgccatttttatatgataatcaactagaaaatatcataatacaaatatataattcacaatagaaaaaaatacatacgcaaatagaccaaagtcttttatatgcttttttaaaatattgtaatagtggca

SEQ ID NO: 108141 - DNA, 601 bp, Human
ggtattggacacaaacatgtgctttctcagattcccttcactatctcctgttcccctggtcagcaccttgcctgatccagatcatccttccatttgggacttgaatgcatcaccacactgtgggcatgaggtctgactttcatgaccaccaccaagggactggatgatgtaagacagaacaacagagatggtagttctaactcagggaaaccctggccaaggggaaacagaagactaacaacagctgagcagatacattctccctcctctctctctcttccatggactaatgccagctgtsgtttccctttgtagcccttctggaaaagttctgggagtcaagtgcatgcatctgatgaccaccatgctgtctctctcacctcactgtgaagtggctgccagcagagtcataccagacatcaccacacattgtttcacatccgttcttgtctcaatttccacatgtccctgccatttttgtcttgaattggccttccatataaatgtcatcactttaatatcaggtattacgttaaaaacattttagtaaagtagctggttactaactcaattttttgaaatgaaatgccatttttatatg

SEQ ID NO: 108142 - DNA, 601 bp, Human
ttgaggctgcaatgagctgtgatcctgccactgcattccagcctcagggacagaaagagaccgtgtctcaaaataataccaataataatatattagttggtacaataatcaggaaatggcaagtttcttcagtatagtaaaatattataacattgagcagaagtaaaataccagaagaaaatagataaatcagagaagattcagggaccgacaacataggtgacgttttaaggtttttggtgtccctagtccacatgctgagacaatcttttttacagtaaacggcattttgctctctctrtatatttcctatcactacaaaagagacactatgttttgggggcctactgggattttggagacaacatattccacatttgagaatattgctctgactcacgaacgatgtttctaaaggctactggtctcaaatggagcccagaactaaagagggctctacagaagatataggctctggtccaagctgctctggccactgtgccagatgatccagcggaattcaaagctgctagaggcatgcatagtgggcattataggactctgtgcatgtctctgacaagcctgtaggagaggggagagc

SEQ ID NO: 108143 - DNA, 601 bp, Human
gtgcccctgcagtcccagctgccagcaatgccgaagtgggagaatcacttgtgcccagaaggttgaggctgcaatgagctgtgatcctgccactgcattccagcctcagggacagaaagagaccgtgtctcaaaataataccaataataatatattagttggtacaataatcaggaaatggcaagtttcttcagtatagtaaaatattataacattgagcagaagtaaaataccagaagaaaatagataaatcagagaagattcagggaccgacaacataggtgacgttttaaggtttttrgtgtccctagtccacatgctgagacaatcttttttacagtaaacggcattttgctctctctgtatatttcctatcactacaaaagagacactatgttttgggggcctactgggattttggagacaacatattccacatttgagaatattgctctgactcacgaacgatgtttctaaaggctactggtctcaaatggagcccagaactaaagagggctctacagaagatataggctctggtccaagctgctctggccactgtgccagatgatccagcggaattcaaagctgctagaggcat

SEQ ID NO: 108144 - DNA, 601 bp, Human
gccaggcatggtgttgtgcccctgcagtcccagctgccagcaatgccgaagtgggagaatcacttgtgcccagaaggttgaggctgcaatgagctgtgatcctgccactgcattccagcctcagggacagaaagagaccgtgtctcaaaataataccaataataatatattagttggtacaataatcaggaaatggcaagtttcttcagtatagtaaaatattataacattgagcagaagtaaaataccagaagaaaatagataaatcagagaagattcagggaccgacaacataggtgaygttttaaggtttttggtgtccctagtccacatgctgagacaatcttttttacagtaaacggcattttgctctctctgtatatttcctatcactacaaaagagacactatgttttgggggcctactgggattttggagacaacatattccacatttgagaatattgctctgactcacgaacgatgtttctaaaggctactggtctcaaatggagcccagaactaaagagggctctacagaagatataggctctggtccaagctgctctggccactgtgccagatgatccagcggaattcaa

SEQ ID NO: 108145 - DNA, 601 bp, Human
ttcttcgtgaactgtagagtaaggaacattattatagcaggaccaagggaaagcctctgaaattctcctctactggcaacaaaatatataaaatataataaccgcattccctaaggaatggaactggtcactgtcatgacaaaacacctgaaagttacaggggatggtagtcttttctataacccgattcacttaacctatctggcctctaccaaaaccagatgggttatcgaatgaatgcagactaccataaacttaaatcaacactcacaaatgctttccaggatgtgctatcttcacygagcagagcagagcttctggtactttttgtggggctagtgatttggtgaatggttcttaatctacacccattatgagggaaaatcaaaacaatttgccttgtaagaataatagcactgcttcactgttgtatgtcagggctatgtcacttctgttctcagtttaatttacattttttaaaacatcctgccagtttaatgtattgataatattacagaccgggccctgtggcatatgactgtaatcccagcactttaggaggccgacacaggcagatcacttgagcccaggagtttgagac

SEQ ID NO: 108146 - DNA, 601 bp, Human
ctggaactcctgggctcaagcaatcctcctgcctcagcttctcaagtatttggaactataggcatgtaccaccatgccaggtaatttttaaaattttttgtagagacggagtttccatatgatgcacagggaactcctgctctcaaaggatcttcacaccttggcctcccaaagtactaggactacaggcataagccatcacatccagcccgcagtgggagttttgaaggtcagatgctacctagagcttcggctcatgtccatcccaaggtggatctaatcagtttgtagttattacctsttcctgaattgaaatggatacgtatggcagctggcaggactctcacattcttcgtgaactgtagagtaaggaacattattatagcaggaccaagggaaagcctctgaaattctcctctactggcaacaaaatatataaaatataataaccgcattccctaaggaatggaactggtcactgtcatgacaaaacacctgaaagttacaggggatggtagtcttttctataacccgattcacttaacctatctggcctctaccaaaaccagatgggttatcgaatgaatgcagactaccataa

SEQ ID NO: 108147 - DNA, 601 bp, Human
tgatatttgacaccagtgagaacttccacctttttttttgttctgagacagcatctccctctgttacccaagctggagtacagtggcacaatcatagcccactgcagcctggaactcctgggctcaagcaatcctcctgcctcagcttctcaagtatttggaactataggcatgtaccaccatgccaggtaatttttaaaattttttgtagagacggagtttccatatgatgcacagggaactcctgctctcaaaggatcttcacaccttggcctcccaaagtactaggactacaggcatragccatcacatccagcccgcagtgggagttttgaaggtcagatgctacctagagcttcggctcatgtccatcccaaggtggatctaatcagtttgtagttattacctgttcctgaattgaaatggatacgtatggcagctggcaggactctcacattcttcgtgaactgtagagtaaggaacattattatagcaggaccaagggaaagcctctgaaattctcctctactggcaacaaaatatataaaatataataaccgcattccctaaggaatggaactggtcactgtcatgacaaaac

SEQ ID NO: 108148 - DNA, 601 bp, Human
agcaggaaccaaagattgttacttattgatttgatcatgtttttcttgatatttgacaccagtgagaacttccacctttttttttgttctgagacagcatctccctctgttacccaagctggagtacagtggcacaatcatagcccactgcagcctggaactcctgggctcaagcaatcctcctgcctcagcttctcaagtatttggaactataggcatgtaccaccatgccaggtaatttttaaaattttttgtagagacggagtttccatatgatgcacagggaactcctgctctcaarggatcttcacaccttggcctcccaaagtactaggactacaggcataagccatcacatccagcccgcagtgggagttttgaaggtcagatgctacctagagcttcggctcatgtccatcccaaggtggatctaatcagtttgtagttattacctgttcctgaattgaaatggatacgtatggcagctggcaggactctcacattcttcgtgaactgtagagtaaggaacattattatagcaggaccaagggaaagcctctgaaattctcctctactggcaacaaaatatataaaatataat

SEQ ID NO: 108149 - DNA, 601 bp, Human
aacaacaaaaaggagatgataataaaactttcattggttagttttgttaggagttaatatactatttctgtaactactttcaattttacctgtttgctataagcaggaaccaaagattgttacttattgatttgatcatgtttttcttgatatttgacaccagtgagaacttccacctttttttttgttctgagacagcatctccctctgttacccaagctggagtacagtggcacaatcatagcccactgcagcctggaactcctgggctcaagcaatcctcctgcctcagcttctcaastatttggaactataggcatgtaccaccatgccaggtaatttttaaaattttttgtagagacggagtttccatatgatgcacagggaactcctgctctcaaaggatcttcacaccttggcctcccaaagtactaggactacaggcataagccatcacatccagcccgcagtgggagttttgaaggtcagatgctacctagagcttcggctcatgtccatcccaaggtggatctaatcagtttgtagttattacctgttcctgaattgaaatggatacgtatggcagctggcaggactctca

SEQ ID NO: 108150 - DNA, 601 bp, Human
ttttacttttctctatttatttttgattacttattgatttatgatgaatagatgttaaaatcagtctccaatcctggattttgtttcttttcagtttttatagcataactgtttctaagaggggatcttggagtcagacgccaggtcaggaaatcatattccctgcttggtatagctatgctctgagactccattttccaactactcctgcctcagtataatcacctataaaaagcgggcgcagtggctcatggctgtaatcccagcactttgggaggccaaggcaggtggatcacctgargtcaggagtgcaaatccagcatggccaacatggtgaaaccctgtctccactaaaaatataaaaattagccaggtggtggtggcacgcacctataatccgagccactcggtgactgcagcaggagaatcatttgaacccagaaggcagaggttacagttagtcgagatcacgccactgcactctagcctgagagacagagcgagactccgtctcaaaataacaacaaaaaggagatgataataaaactttcattggttagttttgttaggagttaatatactatttctgtaactactttca

SEQ ID NO: 108151 - DNA, 601 bp, Human
aagaatttacacttctctgtgtatgaatattcacttttacttttctctatttatttttgattacttattgatttatgatgaatagatgttaaaatcagtctccaatcctggattttgtttcttttcagtttttatagcataactgtttctaagaggggatcttggagtcagacgccaggtcaggaaatcatattccctgcttggtatagctatgctctgagactccattttccaactactcctgcctcagtataatcacctataaaaagcgggcgcagtggctcatggctgtaatcccagyactttgggaggccaaggcaggtggatcacctgaggtcaggagtgcaaatccagcatggccaacatggtgaaaccctgtctccactaaaaatataaaaattagccaggtggtggtggcacgcacctataatccgagccactcggtgactgcagcaggagaatcatttgaacccagaaggcagaggttacagttagtcgagatcacgccactgcactctagcctgagagacagagcgagactccgtctcaaaataacaacaaaaaggagatgataataaaactttcattggttagttttgtt

SEQ ID NO: 108152 - DNA, 601 bp, Human
actctagcctgggcgacagagcgagactcagtctcaaaaaaaaaaaaaagaaaaagaaaaagaaaaacctcaacaattgtataactattccttgggcactaaaaaaacatgttttccatagaagaatttacacttctctgtgtatgaatattcacttttacttttctctatttatttttgattacttattgatttatgatgaatagatgttaaaatcagtctccaatcctggattttgtttcttttcagtttttatagcataactgtttctaagaggggatcttggagtcagacgccaggwcaggaaatcatattccctgcttggtatagctatgctctgagactccattttccaactactcctgcctcagtataatcacctataaaaagcgggcgcagtggctcatggctgtaatcccagcactttgggaggccaaggcaggtggatcacctgaggtcaggagtgcaaatccagcatggccaacatggtgaaaccctgtctccactaaaaatataaaaattagccaggtggtggtggcacgcacctataatccgagccactcggtgactgcagcaggagaatcatttgaacccagaaggc

SEQ ID NO: 108153 - DNA, 601 bp, Human
gccactgcactctagcctgggcgacagagcgagactcagtctcaaaaaaaaaaaaaagaaaaagaaaaagaaaaacctcaacaattgtataactattccttgggcactaaaaaaacatgttttccatagaagaatttacacttctctgtgtatgaatattcacttttacttttctctatttatttttgattacttattgatttatgatgaatagatgttaaaatcagtctccaatcctggattttgtttcttttcagtttttatagcataactgtttctaagaggggatcttggagtcagrcgccaggtcaggaaatcatattccctgcttggtatagctatgctctgagactccattttccaactactcctgcctcagtataatcacctataaaaagcgggcgcagtggctcatggctgtaatcccagcactttgggaggccaaggcaggtggatcacctgaggtcaggagtgcaaatccagcatggccaacatggtgaaaccctgtctccactaaaaatataaaaattagccaggtggtggtggcacgcacctataatccgagccactcggtgactgcagcaggagaatcatttgaacc

SEQ ID NO: 108154 - DNA, 601 bp, Human
ttaatttctatgtgctcctgatttctgactgtgcaataacgttcttgttccttttaaattctctggctaatgtcaaacaggaaagcaccggggaatgctattgaatgagttcaaggctgtcttaatggaaaacaggataatttccaaaacagctcaaattaactcctattcaaatactatatgcttgttataagataaaatttttcatactgatgttgatgtgaaagctgaattctcatttgctagcatgcaaatcaagtcatacacttaatcatcattttgcaattttttccttgtttartgtctccataatttgcgttcagcaatgtgagttgttagggaaattttccaacctaatacataaatcatacattggatgcctacactgttatatgtagcttggtcaaaactagaatcatgaccactgttgaatcattttttcaatgccagatttatggagagtgaatcccaacttttctaccaaaagtgtccaaggttttcttgggaagcccaggaaggccaatattccttgaaaactggttactgctaactaataattttgtacaacttattgttaacaagctcattaacacaaacacat

SEQ ID NO: 108155 - DNA, 601 bp, Human
agagtgcaatagtgggtcttcagatgtgatccatcatcttaatcagataatgccatactcaaagtaattgcactgatttacaattctaggattacaatcctagagtgtaactgtactagacatatttcctttaaccaaacattatgtcaaatgactttgggaaaatatgattagttaacagtatactgtaaggcaaattttagcattgtttaacaactcattaaaaggactcaaagaaaataatatgttgaaatatcaaaatagtctataagcctaatgaaggtgcccatgggaaaatacraattctaccattactgttatggaaaataatgatgagtagtaaacataccatgtccgcattttttaaggcaggcctaataccaatggacaagtttccctttaaggtcctgaccttaatttctatgtgctcctgatttctgactgtgcaataacgttcttgttccttttaaattctctggctaatgtcaaacaggaaagcaccggggaatgctattgaatgagttcaaggctgtcttaatggaaaacaggataatttccaaaacagctcaaattaactcctattcaaatactatatgcttgt

SEQ ID NO: 108156 - DNA, 601 bp, Human
tttatccattttatcacccatggacatttgagagacttgtcaactttagcaattaaaactcagtgatatgcatgtgtgtgtatatgtattctgataagagtgcaatagtgggtcttcagatgtgatccatcatcttaatcagataatgccatactcaaagtaattgcactgatttacaattctaggattacaatcctagagtgtaactgtactagacatatttcctttaaccaaacattatgtcaaatgactttgggaaaatatgattagttaacagtatactgtaaggcaaattttagcrttgtttaacaactcattaaaaggactcaaagaaaataatatgttgaaatatcaaaatagtctataagcctaatgaaggtgcccatgggaaaatacgaattctaccattactgttatggaaaataatgatgagtagtaaacataccatgtccgcattttttaaggcaggcctaataccaatggacaagtttccctttaaggtcctgaccttaatttctatgtgctcctgatttctgactgtgcaataacgttcttgttccttttaaattctctggctaatgtcaaacaggaaagcaccggg

SEQ ID NO: 108157 - DNA, 601 bp, Human
gtatagtattctattgtatgactatgcaataatttatttatccattttatcacccatggacatttgagagacttgtcaactttagcaattaaaactcagtgatatgcatgtgtgtgtatatgtattctgataagagtgcaatagtgggtcttcagatgtgatccatcatcttaatcagataatgccatactcaaagtaattgcactgatttacaattctaggattacaatcctagagtgtaactgtactagacatatttcctttaaccaaacattatgtcaaatgactttgggaaaatatsattagttaacagtatactgtaaggcaaattttagcattgtttaacaactcattaaaaggactcaaagaaaataatatgttgaaatatcaaaatagtctataagcctaatgaaggtgcccatgggaaaatacgaattctaccattactgttatggaaaataatgatgagtagtaaacataccatgtccgcattttttaaggcaggcctaataccaatggacaagtttccctttaaggtcctgaccttaatttctatgtgctcctgatttctgactgtgcaataacgttcttgttcctttta

SEQ ID NO: 108158 - DNA, 601 bp, Human
ctgtgccagttgttacaataatcactcttgggtctcactttagaatttcgacaacaatgtaataaattgcagttcattaaaaatatagttttgtaaactttatataaatgtaattatacggaatcatgtttccatcttaatatctctcgtatctatgtagtgcaaatttgttcattttcctttttattaacattctttataaacgtctctctagttggttcattttgattgctgtatagtattctattgtatgactatgcaataatttatttatccattttatcacccatggacatttgasagacttgtcaactttagcaattaaaactcagtgatatgcatgtgtgtgtatatgtattctgataagagtgcaatagtgggtcttcagatgtgatccatcatcttaatcagataatgccatactcaaagtaattgcactgatttacaattctaggattacaatcctagagtgtaactgtactagacatatttcctttaaccaaacattatgtcaaatgactttgggaaaatatgattagttaacagtatactgtaaggcaaattttagcattgtttaacaactcattaaaaggactcaaag

SEQ ID NO: 108159 - DNA, 601 bp, Human
acaccttcttgttgatatcatttcccttttgtttcctccgtccctactgtgccagttgttacaataatcactcttgggtctcactttagaatttcgacaacaatgtaataaattgcagttcattaaaaatatagttttgtaaactttatataaatgtaattatacggaatcatgtttccatcttaatatctctcgtatctatgtagtgcaaatttgttcattttcctttttattaacattctttataaacgtctctctagttggttcattttgattgctgtatagtattctattgtatgastatgcaataatttatttatccattttatcacccatggacatttgagagacttgtcaactttagcaattaaaactcagtgatatgcatgtgtgtgtatatgtattctgataagagtgcaatagtgggtcttcagatgtgatccatcatcttaatcagataatgccatactcaaagtaattgcactgatttacaattctaggattacaatcctagagtgtaactgtactagacatatttcctttaaccaaacattatgtcaaatgactttgggaaaatatgattagttaacagtatactgta

SEQ ID NO: 108160 - DNA, 601 bp, Human
atattcattcatttattatatgattctgcttttaaaatattttcattactatgaaacataacatatatataaattaataaagcctgaaggtacagtatagaaaaaaattatagcattaagggtcatgttaccacatcttggtcatgaagtagaatttaccagcaatccagacactccccatatacaccttcttgttgatatcatttcccttttgtttcctccgtccctactgtgccagttgttacaataatcactcttgggtctcactttagaatttcgacaacaatgtaataaattgcarttcattaaaaatatagttttgtaaactttatataaatgtaattatacggaatcatgtttccatcttaatatctctcgtatctatgtagtgcaaatttgttcattttcctttttattaacattctttataaacgtctctctagttggttcattttgattgctgtatagtattctattgtatgactatgcaataatttatttatccattttatcacccatggacatttgagagacttgtcaactttagcaattaaaactcagtgatatgcatgtgtgtgtatatgtattctgataagagtgc

SEQ ID NO: 108161 - DNA, 601 bp, Human
gaaatgttgtgatcataaatatctaaattggaaataagaaaaaaaggtgtctagcaaaatacagatgtgcaaaatctgatgtttcaaaataagaataacattaagagtgtggaggtagacttcctgtttatctcttcctttttaaaattaatttaaagtttaaaattttatcttggatttcttactatcataatgctctattcttctttattcagcaaaaattctaattaccatggtgtctacaagaatgttttttcagcctattttatattcattcatttattatatgattctgcttttwaaatattttcattactatgaaacataacatatatataaattaataaagcctgaaggtacagtatagaaaaaaattatagcattaagggtcatgttaccacatcttggtcatgaagtagaatttaccagcaatccagacactccccatatacaccttcttgttgatatcatttcccttttgtttcctccgtccctactgtgccagttgttacaataatcactcttgggtctcactttagaatttcgacaacaatgtaataaattgcagttcattaaaaatatagttttgtaaactttatat

SEQ ID NO: 108162 - DNA, 601 bp, Human
atgtattcaacttgacttgaactttgctgtttactaacgtaaatttcccacaatgatatctcttagaacttatgtaaacggtgtccaaattatgtatgtaaatatttcaaaaataaatcatataataagatagatgtaaatgtagatgattataataatgatgataatgtcagctaaaagggagaatgttatttgataaatgtgatttgggtcttcttttcaatgtactagagttaagggtagtgggagaacactattattctttctcatggatttacgatttttttttttgacatggagyttcactcttgtcacccaggctgcagtgcaatggcgcaatattggctcactgcagcctctgcctccctggttcaattgattatcctgcctcagcctcccaagtagctgggattacaggtgcccgccatcacgcccagctaatttttgtatttttagaagagatgggttttcactatattggccaggccagtctggaaatcctgacctcaggtgatccaccagcctcggtctcccagagtgctgggattacaggcatgagccaccatgcccggcacaattcttgtattattctcagcatcag

SEQ ID NO: 108163 - DNA, 601 bp, Human
tctttagaaataagagcttgatcatgaaatggtttatttatttttcttattaagcaattttatttatactaaaatcaaaatctttttatagtgttccttggattagtttaatatcatctataattgttttcttcagcaatgtattttaaactgcactacacttaactttctaaatctaaatgtattcaacttgacttgaactttgctgtttactaacgtaaatttcccacaatgatatctcttagaacttatgtaaacggtgtccaaattatgtatgtaaatatttcaaaaataaatcatwtaataagatagatgtaaatgtagatgattataataatgatgataatgtcagctaaaagggagaatgttatttgataaatgtgatttgggtcttcttttcaatgtactagagttaagggtagtgggagaacactattattctttctcatggatttacgatttttttttttgacatggagtttcactcttgtcacccaggctgcagtgcaatggcgcaatattggctcactgcagcctctgcctccctggttcaattgattatcctgcctcagcctcccaagtagctgggattacaggtgcc

SEQ ID NO: 108164 - DNA, 601 bp, Human
tgggggagggcttatttgatttgtttagccctaaaatcctctctttagaaataagagcttgatcatgaaatggtttatttatttttcttattaagcaattttatttatactaaaatcaaaatctttttatagtgttccttggattagtttaatatcatctataattgttttcttcagcaatgtattttaaactgcactacacttaactttctaaatctaaatgtattcaacttgacttgaactttgctgtttactaacgtaaatttcccacaatgatatctcttagaacttatgtaaacgktgtccaaattatgtatgtaaatatttcaaaaataaatcatataataagatagatgtaaatgtagatgattataataatgatgataatgtcagctaaaagggagaatgttatttgataaatgtgatttgggtcttcttttcaatgtactagagttaagggtagtgggagaacactattattctttctcatggatttacgatttttttttttgacatggagtttcactcttgtcacccaggctgcagtgcaatggcgcaatattggctcactgcagcctctgcctccctggttcaattgatt

SEQ ID NO: 108165 - DNA, 601 bp, Human
agaaatggggctctgtgcctttgaactccatcattacctacatgaaatagagaagatgtgggggagggcttatttgatttgtttagccctaaaatcctctctttagaaataagagcttgatcatgaaatggtttatttatttttcttattaagcaattttatttatactaaaatcaaaatctttttatagtgttccttggattagtttaatatcatctataattgttttcttcagcaatgtattttaaactgcactacacttaactttctaaatctaaatgtattcaacttgacttgaactttgctgtttactaacgtaaatttcccacaatgatatctcttagaacttatgtaaacggtgtccaaattatgtatgtaaatatttcaaaaataaatcatataataagatagatgtaaatgtagatgattataataatgatgataatgtcagctaaaagggagaatgttatttgataaatgtgatttgggtcttcttttcaatgtactagagttaagggtagtgggagaacactattattctttctcatggatttacgatttttttttttgacatggagtttcactcttgtcacccaggctg

SEQ ID NO: 108166 - DNA, 601 bp, Human
cagaataatcttttattatctttccataaattattttctacagggaaactgaacaaactaatcttaacggcatgttctttttaaaagtgtttttgattttggggttttttgttttctgttttagtatgttagaaatgaaaatggtaacaaattccttcttttcccaacactttggtcagagaatagaataaaagcttcatcttggaatttaccttcaatttgaaagaaaccggaaatgaagttcatataagtagcttttttgggatagtagcttgtcttgctgggtcctcgccacacaatstcctcacaaggaaactcaatgagtagcactgcatttcaaaatatcattgcaatagataaaatatagttcatcaaccacagctatgtcattgtattccatgaattaattttcactttgcttatgttgtagaaatggggctctgtgcctttgaactccatcattacctacatgaaatagagaagatgtgggggagggcttatttgatttgtttagccctaaaatcctctctttagaaataagagcttgatcatgaaatggtttatttatttttcttattaagcaattttatttatactaaaa

SEQ ID NO: 108167 - DNA, 601 bp, Human
tctttctctcagtgcttcattctttgtagctatcttccaattcactaattatctcttctactccatctaactggttaactctgtctattggattctcaatattgataattcattttttagttttcttgttttagtgttcagaataatcttttattatctttccataaattattttctacagggaaactgaacaaactaatcttaacggcatgttctttttaaaagtgtttttgattttggggttttttgttttctgttttagtatgttagaaatgaaaatggtaacaaattccttcttttyccaacactttggtcagagaatagaataaaagcttcatcttggaatttaccttcaatttgaaagaaaccggaaatgaagttcatataagtagcttttttgggatagtagcttgtcttgctgggtcctcgccacacaatctcctcacaaggaaactcaatgagtagcactgcatttcaaaatatcattgcaatagataaaatatagttcatcaaccacagctatgtcattgtattccatgaattaattttcactttgcttatgttgtagaaatggggctctgtgcctttgaactccatcatt

SEQ ID NO: 108168 - DNA, 601 bp, Human
attttctctcctctaatcttacagaactccagaagtatgttacatattccaactgtagcatgaatttgttaccctctagtcttatattttccatctttctctcagtgcttcattctttgtagctatcttccaattcactaattatctcttctactccatctaactggttaactctgtctattggattctcaatattgataattcattttttagttttcttgttttagtgttcagaataatcttttattatctttccataaattattttctacagggaaactgaacaaactaatcttaacgscatgttctttttaaaagtgtttttgattttggggttttttgttttctgttttagtatgttagaaatgaaaatggtaacaaattccttcttttcccaacactttggtcagagaatagaataaaagcttcatcttggaatttaccttcaatttgaaagaaaccggaaatgaagttcatataagtagcttttttgggatagtagcttgtcttgctgggtcctcgccacacaatctcctcacaaggaaactcaatgagtagcactgcatttcaaaatatcattgcaatagataaaatatagttc

SEQ ID NO: 108169 - DNA, 601 bp, Human
tatcttcaagatgcagtacgtggcccatctccaatcaccacagccatccatcaaacccagcttagaaaaatgaaatccaaagacatatgagatacaaatatctaatgtagttttggaggattttctcttgcagaaaaacataagtgacataggtattctgctaaaccaaaagtgtgggaaatatgtccacacttgttgtgtcaggaattcaggatacaagggaaaaatagttggagaatgtcaaagttttgtcatatgaagtcaataattaaacctaaaagaaaaacctgttgaaaaatcyggggttggcaggaaacatcatgtcaaatttccaaaagttgcaactaaaatcagaaagtttcttcttaaaatctcttagagttatacatgaatgtatacaaatagtggatttttcccttcagtatataatgagcagggtaataataattttcatggaaaatttctcctaattaataatttttataactagactacacacttagaaatgggccaaaacaaaaatggaaaacatagcaatgtatcataaacactcatgtaaccattatgtagggcgagacatggaacattgctaagaggctag

SEQ ID NO: 108170 - DNA, 601 bp, Human
taggaatgggagacaaaggagataattggaaattcaggggctcagaggtggctaagcaaattaaatggaaatacttgacatcagatgtcaacttcaaaaaaggctttctttaattaaaaagtggaagaaatctcttttctaactacacataaaaaattataacagcactgaaatgatcatgattatgtttcttcattcctattatacaaacgaattttttttctaagctattcacatactggtataaatctagtattctttagtactgtttttggtatatatatacaaaatttactctacrtatgtttgtcactcaaatttaattgtgtgcatcattatctaacaacaacataaaataagaattcataatgaaataaaacctaccccaaagatacattctcctcattgatttagagttgaatgtctttaccatccaaaaaattagatgttcaaacaatgatagttaagttcatacatgtggtacaaattacaatggaaaacagcaataatttgctgataaaagctatatgttcttaattataaatagagataattcttcaaatgaaatatcatacaataaactatcatataataaacatac

SEQ ID NO: 108171 - DNA, 601 bp, Human
ttgaatttttttgaggaatattaggaatgggagacaaaggagataattggaaattcaggggctcagaggtggctaagcaaattaaatggaaatacttgacatcagatgtcaacttcaaaaaaggctttctttaattaaaaagtggaagaaatctcttttctaactacacataaaaaattataacagcactgaaatgatcatgattatgtttcttcattcctattatacaaacgaattttttttctaagctattcacatactggtataaatctagtattctttagtactgtttttggtatayatatacaaaatttactctacatatgtttgtcactcaaatttaattgtgtgcatcattatctaacaacaacataaaataagaattcataatgaaataaaacctaccccaaagatacattctcctcattgatttagagttgaatgtctttaccatccaaaaaattagatgttcaaacaatgatagttaagttcatacatgtggtacaaattacaatggaaaacagcaataatttgctgataaaagctatatgttcttaattataaatagagataattcttcaaatgaaatatcatacaataa

SEQ ID NO: 108172 - DNA, 601 bp, Human
ttctaaatcatcaagattggtggtttgaaaacatatccaagtgcttcgacatacctcatatgaacagatgcagtcttattccccttctcttcaaaacaggccttcatgatgtgttttagtaaattgtatgtctcagaactgacacagaagaagttacaaggtttataaagctggcaccttcttgtcacatgtgcccttggcacctagagccaaatgctggagaaactacgtagagaaacaaaataaaaatagagatgcctgaggatcctcagctcactgcccacccccaataaaacatatyattaatacgtttcctatcatcaatatattgattagacagataatttgtaatatttgcagaatgtttcattcagttatgatccatagtttctataccctctttacattgagttttttttaagagaaggaatatttgaatttttttgaggaatattaggaatgggagacaaaggagataattggaaattcaggggctcagaggtggctaagcaaattaaatggaaatacttgacatcagatgtcaacttcaaaaaaggctttctttaattaaaaagtggaagaaatctcttttctaactaca

SEQ ID NO: 108173 - DNA, 601 bp, Human
tccagagatcatacatttttatcaggatgaaattggaaaagggagcacatttctaaatcatcaagattggtggtttgaaaacatatccaagtgcttcgacatacctcatatgaacagatgcagtcttattccccttctcttcaaaacaggccttcatgatgtgttttagtaaattgtatgtctcagaactgacacagaagaagttacaaggtttataaagctggcaccttcttgtcacatgtgcccttggcacctagagccaaatgctggagaaactacgtagagaaacaaaataaaaatggagatgcctgaggatcctcagctcactgcccacccccaataaaacatatcattaatacgtttcctatcatcaatatattgattagacagataatttgtaatatttgcagaatgtttcattcagttatgatccatagtttctataccctctttacattgagttttttttaagagaaggaatatttgaatttttttgaggaatattaggaatgggagacaaaggagataattggaaattcaggggctcagaggtggctaagcaaattaaatggaaatacttgacatcagatgtcaacttcaa

SEQ ID NO: 108174 - DNA, 601 bp, Human
gaatagattgacagtcattagttttacagcttagtccacagattctgaattacagagaacggctcatgatggaatggaggggaatattggcaacgtccagagatcatacatttttatcaggatgaaattggaaaagggagcacatttctaaatcatcaagattggtggtttgaaaacatatccaagtgcttcgacatacctcatatgaacagatgcagtcttattccccttctcttcaaaacaggccttcatgatgtgttttagtaaattgtatgtctcagaactgacacagaagaagttmcaaggtttataaagctggcaccttcttgtcacatgtgcccttggcacctagagccaaatgctggagaaactacgtagagaaacaaaataaaaatagagatgcctgaggatcctcagctcactgcccacccccaataaaacatatcattaatacgtttcctatcatcaatatattgattagacagataatttgtaatatttgcagaatgtttcattcagttatgatccatagtttctataccctctttacattgagttttttttaagagaaggaatatttgaatttttttgaggaatatta

SEQ ID NO: 108175 - DNA, 601 bp, Human
tttcctttttctttggcccactatttcatgtagaatagattgacagtcattagttttacagcttagtccacagattctgaattacagagaacggctcatgatggaatggaggggaatattggcaacgtccagagatcatacatttttatcaggatgaaattggaaaagggagcacatttctaaatcatcaagattggtggtttgaaaacatatccaagtgcttcgacatacctcatatgaacagatgcagtcttattccccttctcttcaaaacaggccttcatgatgtgttttagtaaaytgtatgtctcagaactgacacagaagaagttacaaggtttataaagctggcaccttcttgtcacatgtgcccttggcacctagagccaaatgctggagaaactacgtagagaaacaaaataaaaatagagatgcctgaggatcctcagctcactgcccacccccaataaaacatatcattaatacgtttcctatcatcaatatattgattagacagataatttgtaatatttgcagaatgtttcattcagttatgatccatagtttctataccctctttacattgagttttttttaagag

SEQ ID NO: 108176 - DNA, 601 bp, Human
atattttatccagaatttatagaaagtatctgtgggaggtttggtcctatgggtgttatttgatcattagtgtaagcaaaaaatgttgtgtatatatttttactgcttatcatgttttcctttttctttggcccactatttcatgtagaatagattgacagtcattagttttacagcttagtccacagattctgaattacagagaacggctcatgatggaatggaggggaatattggcaacgtccagagatcatacatttttatcaggatgaaattggaaaagggagcacatttctaaatsatcaagattggtggtttgaaaacatatccaagtgcttcgacatacctcatatgaacagatgcagtcttattccccttctcttcaaaacaggccttcatgatgtgttttagtaaattgtatgtctcagaactgacacagaagaagttacaaggtttataaagctggcaccttcttgtcacatgtgcccttggcacctagagccaaatgctggagaaactacgtagagaaacaaaataaaaatagagatgcctgaggatcctcagctcactgcccacccccaataaaacatatcattaatac

SEQ ID NO: 108177 - DNA, 601 bp, Human
ggagttagaaccatggtagaaacaagaatggacaaggaatatgactgttatgaaaggtaatggaatgtagtttgggttttcaagaaaagagtatctttgcctaaagtaatgtgttttgttgctatttctgtcctcactgtgcttgatgataactgaaatcaattttattattttagctgggcttcatgaagtctgcctatacatgtgtggtgtagggaccagacaaagctttggatagtttatagtcagaagctggggctccccttttctggacttctcctttctcagattttctcctgayctcctgcggctcatgttaccctaaactcagtcctctgttacttcaacccagtaactctacagcttttttactgacgttttagtcctctgcctggtgcacactagggccagctataaaatcaggaaactcactccttgctatttccttcttccaagtgtcaactgcttttcagtatcggcctattttgttcattctccattgccttcagatggctgttttttttttaaatattttatccagaatttatagaaagtatctgtgggaggtttggtcctatgggtgttatttgatcattagtgt

SEQ ID NO: 108178 - DNA, 601 bp, Human
cataacttccagtttcctctttgaaagagaattactttgattaatgtaatgaataaaagtaggagttagaaccatggtagaaacaagaatggacaaggaatatgactgttatgaaaggtaatggaatgtagtttgggttttcaagaaaagagtatctttgcctaaagtaatgtgttttgttgctatttctgtcctcactgtgcttgatgataactgaaatcaattttattattttagctgggcttcatgaagtctgcctatacatgtgtggtgtagggaccagacaaagctttggatagtytatagtcagaagctggggctccccttttctggacttctcctttctcagattttctcctgacctcctgcggctcatgttaccctaaactcagtcctctgttacttcaacccagtaactctacagcttttttactgacgttttagtcctctgcctggtgcacactagggccagctataaaatcaggaaactcactccttgctatttccttcttccaagtgtcaactgcttttcagtatcggcctattttgttcattctccattgccttcagatggctgttttttttttaaatattttatcca

SEQ ID NO: 108179 - DNA, 601 bp, Human
agatggaatactgaaatgtggtcaccaatcacgggttatataaataaataactaaatgtaacttttatattttatggactggctatttgtttggattacattaacaaacatgggagttttgtatgccaattcaagcaagtgtaaaaaggatgtatatgactatagaaagttgtaatatatgtgcttgagaattttgcacatctgccaaaatacttatttttaatagtcctcaattacataacttccagtttcctctttgaaagagaattactttgattaatgtaatgaataaaagtaggasttagaaccatggtagaaacaagaatggacaaggaatatgactgttatgaaaggtaatggaatgtagtttgggttttcaagaaaagagtatctttgcctaaagtaatgtgttttgttgctatttctgtcctcactgtgcttgatgataactgaaatcaattttattattttagctgggcttcatgaagtctgcctatacatgtgtggtgtagggaccagacaaagctttggatagtttatagtcagaagctggggctccccttttctggacttctcctttctcagattttctcctgacctc

SEQ ID NO: 108180 - DNA, 601 bp, Human
cacaatagccaagatttggaagcaatcaaagtgtccagcaacagatgaatagataaagagaaggtggtatggccgggggcggtggctgacaccggtaatcccagcactttgggaggccgaggtgggtggatcatgaggtcaagagattgagaccatcctggccaacatggtgaaaccccatcgctactaaaaatacaaaaaaattagctgggcgtggtggctggcgcctgtagtcccagcgactcaggaggctgaggcaggagaaccacttgaacctgggaggctgaagttgcagtgagcygagattgcgccactgcactccagcctggagacagagcgagactccatctcaaaaaaaaaaaaaaaaaaaagagggagagagaatgtggtacatatacacagtggagtactattcagccatttaaaaaatgagatcctgtcatttgcagcaatacggatggaattggagattattatgttaagttgaataagtaaaaaataactgcaatgtttgtgcagaaaggcaagcattgcactttctcactcatctgtggtatctaaaaatcaaaacaattgaactcgtggacatagagagtacata

SEQ ID NO: 108181 - DNA, 601 bp, Human
tttggatagtcatttctcaaaacaagatatacgaatgtcaaacagacatgtgaaaaggtgctcaacatcattgatcatcagagaaatgcaaatcaaaactaaaataagatatcatctcatcccagttaaaacagcttatatacaaaagacaggtagtaacaaatgctggtgaggatgtggagaaacgggaaccactgtacaccgcaggtgggaatataaattagtaaaaccactatggaaaacagtttaaaggtttctcaaaagactaaaattagagttaccatatgatccagcaatctcrctggtgggtatatacccaaaagaaaggaagtaagtgtatcaaacaggtatccacactcccatgtttgttgtagcactgttcacaatagccaagatttggaagcaatcaaagtgtccagcaacagatgaatagataaagagaaggtggtatggccgggggcggtggctgacaccggtaatcccagcactttgggaggccgaggtgggtggatcatgaggtcaagagattgagaccatcctggccaacatggtgaaaccccatcgctactaaaaatacaaaaaaattagctgggcgtggtgg

SEQ ID NO: 108182 - DNA, 601 bp, Human
aaggagcttaaacaactgtataggaaaaaaaatctaacaatctgatcaaaaaaatgggtgaaatatttggatagtcatttctcaaaacaagatatacgaatgtcaaacagacatgtgaaaaggtgctcaacatcattgatcatcagagaaatgcaaatcaaaactaaaataagatatcatctcatcccagttaaaacagcttatatacaaaagacaggtagtaacaaatgctggtgaggatgtggagaaacgggaaccactgtacaccgcaggtgggaatataaattagtaaaaccactatggaaaacagtttaaaggtttctcaaaagactaaaattagagttaccatatgatccagcaatctcactggtgggtatatacccaaaagaaaggaagtaagtgtatcaaacaggtatccacactcccatgtttgttgtagcactgttcacaatagccaagatttggaagcaatcaaagtgtccagcaacagatgaatagataaagagaaggtggtatggccgggggcggtggctgacaccggtaatcccagcactttgggaggccgaggtgggtggatcatgaggtcaagagattgagacca

SEQ ID NO: 108183 - DNA, 601 bp, Human
tcaatgcaattcctatcaaaataccaaaaacattcttcacagaaatagagaaaacaatcctaaaatttatatagagccacaactgacccagaatagccaaaactatcctaagaaaaaagaacaaaactgaaggaatcatgttacttgacttcatatgatacttactactgaggctacagaaaccaaaacagcatgtactggcattaaaactgacacatagaacgatggaacagaacagacaactcggaaacaaacccacacacctacagtgaactcatttttgaaaaagatgccaagaacrtacactggaaaaagacagtctcttcaataaatggtgctgggacaactgaatatccatatgcagaagaatgaaactaggcccatatatctatacaaatatcaaatcaaaatggattaaagatgtatgattaagatctcaaaccatgaagctcccataagaaaacatcagagaaactccccaggacattggtttgagcaaaaatttcttaagtagtaataccctacaagtacaggcaaccaagtaaaaaatgcacaattgggatcacatcaagttaaaaaatacttctgcacagcaaaggta

SEQ ID NO: 108184 - DNA, 601 bp, Human
aaacgttttaattaatgctgaaaaagcatttgataagattcaacattccttcatgataaaaaccctcagaaaactggatatagaaggaaaatctcaacataataaaaatcacataaaaagacccacaactagtatcatactaaattgggaaaaactaaaaggctttcctctaagatctggaacatgacaagaatgctcacattcactactattattcaacataatagtagaagctctggctagagcaatcactcaagaaaaataaagagcatccacataggaaaggaacaagtcaaattaygcttgtttgtaaacaatatgatcttatatttgtaaaacctgaagactgtaccaaaaactattagaattgataaacaaactcagtaaatttgcagaatacacaattaacataaaaaattagtagtatttctacatgccaatagtgaacaatttgaaaacaaaatcaaaaaagtaatcccacttacaaaggtcacacataaaattaaatacctgaaaattaactcagccaaagagatgaaatagctctataatgaaaactataaaactctaatgaaagaaatggaaaaggacacccaaaaaa

SEQ ID NO: 108185 - DNA, 601 bp, Human
atacacaaatcaatcaatgtgatacatcatatatacagaatgaaggtcaagaaccatataaacgttttaattaatgctgaaaaagcatttgataagattcaacattccttcatgataaaaaccctcagaaaactggatatagaaggaaaatctcaacataataaaaatcacataaaaagacccacaactagtatcatactaaattgggaaaaactaaaaggctttcctctaagatctggaacatgacaagaatgctcacattcactactattattcaacataatagtagaagctctggctrgagcaatcactcaagaaaaataaagagcatccacataggaaaggaacaagtcaaattatgcttgtttgtaaacaatatgatcttatatttgtaaaacctgaagactgtaccaaaaactattagaattgataaacaaactcagtaaatttgcagaatacacaattaacataaaaaattagtagtatttctacatgccaatagtgaacaatttgaaaacaaaatcaaaaaagtaatcccacttacaaaggtcacacataaaattaaatacctgaaaattaactcagccaaagagatgaaata

SEQ ID NO: 108186 - DNA, 601 bp, Human
gaaacacaacataccaaaatctatgaaatacagcgaaagcaatactaagaaggaaatttatagctataagggcctacatcagaaaagaagaaaaacttgaaataaacaacctaaatgtgtatcttaaataactgaaaaaacaagagtaacccaagcccaaaattagtagaagaacacaaataataaaaattacagcagaaataaatgaaattgaaatgaagaaaacaatacaaaagatcaatgaaacaaaaacctgttttcttgaaaagttaaacaacattgacaaacgttcaggccgacyaagaaaaaaagatcaaaattaataaaatcagacatgaaagcagagatattacaactgataccactgaaattcaaagaattattagtgactactatgagcaactatatgccaataaattgaaatctctaaaaaaatggaaaaattcccaggcacatacaacctacaaagattgaaccatgaagaaatccaaaacctgataagaccaaaaacaggtaatgagattaattctgcaataaaaagtctcccactttagaaaaaacaaaacaaaacaaaacaaacaaaaaacaaaaaacaaagcct

SEQ ID NO: 108187 - DNA, 601 bp, Human
aacaaacaaacaaacaaaacaccaatctgttgcctctaagaaacacactttgtctataaagacatgcacagaaagaaaacaacgggatggaaaaagataattcatggcaatggaagccaaaaaaagtggagtacctatacaagtattagacaaaatagagttcaagacaaaaactatgaggagataaaggtcaccatataatgataaaggggtcaattcatcaaaatgatattgcaattgtaaatatatatgcactcaacactggagcacccagatatataaagcaaatactattagaccaaagcaaagagaaagcctcaatacaataatagatggagacttcaacactccactttcagcatcagacagatcctccagacagaaaatcaacaaagaaacatcagacttaatctgcagtatagaacaaattgattacagatatttacataacatttcatccaaaagtttcagaataaacattcttttcctcagcacatggatttttctcaaggatagaccatatgttagatcacaaaacaagtcttgaacaatccaaaaaattgaaatattaccaagcatcaactctgaccacaatggaata

SEQ ID NO: 108188 - DNA, 601 bp, Human
ttgtttttgtgcttgtttgtttgcttatgcgaacagtgctaagttgttatcagcttgaaataatgggttagagggtagtatttgcaagcctcatggtaatctcaaaccaaaaagcatagaatggatacacaaacataaaaagcaaaaaactatattatatcaccagagaaaataaccttcactaaagaaaaataggaaggtaggaaagaaagacgagcagaccacaacataaccagaaaacaaataacaaaatgacaaaagtaagtcctaactaccaatactaacattgaatgtaaatggrctaaactctccaatcaaaagacatagtctggctaaatggaaaaacaaacaaacaaacaaaacaccaatctgttgcctctaagaaacacactttgtctataaagacatgcacagaaagaaaacaacgggatggaaaaagataattcatggcaatggaagccaaaaaaagtggagtacctatacaagtattagacaaaatagagttcaagacaaaaactatgaggagataaaggtcaccatataatgataaaggggtcaattcatcaaaatgatattgcaattgtaaatatatatgcactca

SEQ ID NO: 108189 - DNA, 601 bp, Human
catacacagtacaataagaaataaatagtgaaaacagaaagttaaaaatgaagaagatggagttaaggtgcagagtcttcatttgttttgtttttgtgcttgtttgtttgcttatgcgaacagtgctaagttgttatcagcttgaaataatgggttagagggtagtatttgcaagcctcatggtaatctcaaaccaaaaagcatagaatggatacacaaacataaaaagcaaaaaactatattatatcaccagagaaaataaccttcactaaagaaaaataggaaggtaggaaagaaagamgagcagaccacaacataaccagaaaacaaataacaaaatgacaaaagtaagtcctaactaccaatactaacattgaatgtaaatggactaaactctccaatcaaaagacatagtctggctaaatggaaaaacaaacaaacaaacaaaacaccaatctgttgcctctaagaaacacactttgtctataaagacatgcacagaaagaaaacaacgggatggaaaaagataattcatggcaatggaagccaaaaaaagtggagtacctatacaagtattagacaaaatagagttcaagacaaa

SEQ ID NO: 108190 - DNA, 601 bp, Human
ggggataatggaacaaagttggaaaacactcttcaggatattatccaggagaacttacccaacttagcaagactggccaacattcaaattcagggaatacagagaacaccacaaagatactccttgagaagagcacccaaaaatacataatagtcagattcaccaaggttgaaatgaaggaaaaaatgttaagaacagccagaaagaaaggctgagtcaccaaaaagagaagcccatcagactaacagcagatctcctggcagaaaccctacaagccagaagagagtggggacattcttcragaaaaggattttcaacccagaatttcatagcaagccaaaaagcttcatagttgaaggagaaataaaatccttacagacaagcaaatgctaagagattttgttaccaccaggcctgcctcacaagagcttctgaagcaagcactaaatgtggaaaggaaaaaccagtaccagccacttcagaaaaacaccaaattgtaaagaccactggcactatgaagaaactacatcaactaatgaagcaaaataaccagctagcatcataattataggaaaaaaatcacacataacaatattaacct

SEQ ID NO: 108191 - DNA, 601 bp, Human
tcactggtgtacctgaaagagatggggataatggaacaaagttggaaaacactcttcaggatattatccaggagaacttacccaacttagcaagactggccaacattcaaattcagggaatacagagaacaccacaaagatactccttgagaagagcacccaaaaatacataatagtcagattcaccaaggttgaaatgaaggaaaaaatgttaagaacagccagaaagaaaggctgagtcaccaaaaagagaagcccatcagactaacagcagatctcctggcagaaaccctacaagccrgaagagagtggggacattcttcgagaaaaggattttcaacccagaatttcatagcaagccaaaaagcttcatagttgaaggagaaataaaatccttacagacaagcaaatgctaagagattttgttaccaccaggcctgcctcacaagagcttctgaagcaagcactaaatgtggaaaggaaaaaccagtaccagccacttcagaaaaacaccaaattgtaaagaccactggcactatgaagaaactacatcaactaatgaagcaaaataaccagctagcatcataattataggaaaaaa

SEQ ID NO: 108192 - DNA, 601 bp, Human
gagaaaaaagaatgaaaaggaacaaacaaagcctcaagaaatattggactatgtgaaaagaccaaacctatgattcactggtgtacctgaaagagatggggataatggaacaaagttggaaaacactcttcaggatattatccaggagaacttacccaacttagcaagactggccaacattcaaattcagggaatacagagaacaccacaaagatactccttgagaagagcacccaaaaatacataatagtcagattcaccaaggttgaaatgaaggaaaaaatgttaagaacagccagamagaaaggctgagtcaccaaaaagagaagcccatcagactaacagcagatctcctggcagaaaccctacaagccagaagagagtggggacattcttcgagaaaaggattttcaacccagaatttcatagcaagccaaaaagcttcatagttgaaggagaaataaaatccttacagacaagcaaatgctaagagattttgttaccaccaggcctgcctcacaagagcttctgaagcaagcactaaatgtggaaaggaaaaaccagtaccagccacttcagaaaaacaccaaattgtaaagac

SEQ ID NO: 108193 - DNA, 601 bp, Human
aagaaaggatatcagacattgaagatcaatttaatgaaataatgcatgaagatgagattagagaaaaaagaatgaaaaggaacaaacaaagcctcaagaaatattggactatgtgaaaagaccaaacctatgattcactggtgtacctgaaagagatggggataatggaacaaagttggaaaacactcttcaggatattatccaggagaacttacccaacttagcaagactggccaacattcaaattcagggaatacagagaacaccacaaagatactccttgagaagagcacccaaaaayacataatagtcagattcaccaaggttgaaatgaaggaaaaaatgttaagaacagccagaaagaaaggctgagtcaccaaaaagagaagcccatcagactaacagcagatctcctggcagaaaccctacaagccagaagagagtggggacattcttcgagaaaaggattttcaacccagaatttcatagcaagccaaaaagcttcatagttgaaggagaaataaaatccttacagacaagcaaatgctaagagattttgttaccaccaggcctgcctcacaagagcttctgaagcaagcac

SEQ ID NO: 108194 - DNA, 601 bp, Human
atgaattgacacaagtaggcttcagaaggtgggtaataaactcaactgagataaagaagcatggtctaacccaatgcaagggagccaagaaccttgaaaaaaggttagagcaattgctacctggaataaccagtttagaaaagaacataaatgacctgatggagctgaaaagcacagcatgagaactttgtgaagcatacacaaatatcaataggtgaaccaatcaagcggaagaaaggatatcagacattgaagatcaatttaatgaaataatgcatgaagatgagattagagaaaaaasaatgaaaaggaacaaacaaagcctcaagaaatattggactatgtgaaaagaccaaacctatgattcactggtgtacctgaaagagatggggataatggaacaaagttggaaaacactcttcaggatattatccaggagaacttacccaacttagcaagactggccaacattcaaattcagggaatacagagaacaccacaaagatactccttgagaagagcacccaaaaatacataatagtcagattcaccaaggttgaaatgaaggaaaaaatgttaagaacagccagaaagaaaggct

SEQ ID NO: 108195 - DNA, 601 bp, Human
aactctcatctccctgggacagagcacctgggagaaggggcagctgtgggagcagcatcagcagacataaactttcctgcctgacactctgaaaagagcagcagatctcccagcacagcacttgagctctgctaaaggacagagtgcctccttaagtgggtccctgacctctgtgcctcctgactgggagacatctcccagcaatggtggacagaaacctcatacaggagagctctgcctgacatctggcgggtaaccctctgggatgaagcttccagaggaaggaacaggcagcaatatytgctgttttgcagcctccactggtgatacccaggcaaacaaggtctggagtggacctccagcaaactacagcagacttgcagcagaggaccctgactgttagaaggaaaatcaacaaacaaaaaggaatagcatcaacatcaacaaaaaggatgtacacacagagaccccatctgaaggtcaccaacatcaaagaccaaaggtagaaaaatccatgatgatgaggaaaaaccagggcaaaaaaggctgaaaattccaaaaaccggaagcctcttctcttccaaaggatcacaactcctca

SEQ ID NO: 108196 - DNA, 601 bp, Human
tggagcccacagcagctctgcacaaccactgtagccaaactgcctctctagactcttcctctctggtcagggcatctctgaaagaaaggcagcagctccagtcaggggcttatagataaaactctcatctccctgggacagagcacctgggagaaggggcagctgtgggagcagcatcagcagacataaactttcctgcctgacactctgaaaagagcagcagatctcccagcacagcacttgagctctgctaaaggacagagtgcctccttaagtgggtccctgacctctgtgcctcctkactgggagacatctcccagcaatggtggacagaaacctcatacaggagagctctgcctgacatctggcgggtaaccctctgggatgaagcttccagaggaaggaacaggcagcaatatctgctgttttgcagcctccactggtgatacccaggcaaacaaggtctggagtggacctccagcaaactacagcagacttgcagcagaggaccctgactgttagaaggaaaatcaacaaacaaaaaggaatagcatcaacatcaacaaaaaggatgtacacacagagaccccatctgaaggtc

SEQ ID NO: 108197 - DNA, 601 bp, Human
agaaaaactaaatgatgaagtaataatgaaaaaaaatagtggagtggctggcaaaatgtcctaataggaacagctccagtctgcaaatcccagcaagatcaacacaaaaggtgggtgatttctgcatttccaactgagttacatggctcatctcattgggactggttagacagcgggtgaagcccacggaggacgagccaaaggagggtgtggtgttgcctcacccgggaagtgcaaggggtcggggaactccctctcctagccaagggaagctgtaagggaccatgcagtgagggacgaygtattctggcccagatactacactttccccatggtcttcgtaacccacaaaccaggagatttcctccagtgtttatgccaccagggccatgggtctcaagcataaaactgggcgatcatttgggcagacaccaagctagctgcagaagttttttgtcataccccagtggtgcctggaatgccagcaagacagaaccattcagtcccctggaaagggggctgaagccaggaagccaagttgtctagctcagtggatcccacctccttggagcccagcaagctaagatccactggtttgaca

SEQ ID NO: 108198 - DNA, 601 bp, Human
agtaatcacttgaagctataaaacgtacgggtaatagtaaggagacagaaaacacagactaatataacactgtaaatgtggtgcataaacatcacttaaatagaaaaactaaatgatgaagtaataatgaaaaaaaatagtggagtggctggcaaaatgtcctaataggaacagctccagtctgcaaatcccagcaagatcaacacaaaaggtgggtgatttctgcatttccaactgagttacatggctcatctcattgggactggttagacagcgggtgaagcccacggaggacgagccraaggagggtgtggtgttgcctcacccgggaagtgcaaggggtcggggaactccctctcctagccaagggaagctgtaagggaccatgcagtgagggacgatgtattctggcccagatactacactttccccatggtcttcgtaacccacaaaccaggagatttcctccagtgtttatgccaccagggccatgggtctcaagcataaaactgggcgatcatttgggcagacaccaagctagctgcagaagttttttgtcataccccagtggtgcctggaatgccagcaagacagaaccatt

SEQ ID NO: 108199 - DNA, 601 bp, Human
gcaataagtaatcacttgaagctataaaacgtacgggtaatagtaaggagacagaaaacacagactaatataacactgtaaatgtggtgcataaacatcacttaaatagaaaaactaaatgatgaagtaataatgaaaaaaaatagtggagtggctggcaaaatgtcctaataggaacagctccagtctgcaaatcccagcaagatcaacacaaaaggtgggtgatttctgcatttccaactgagttacatggctcatctcattgggactggttagacagcgggtgaagcccacggaggaygagccaaaggagggtgtggtgttgcctcacccgggaagtgcaaggggtcggggaactccctctcctagccaagggaagctgtaagggaccatgcagtgagggacgatgtattctggcccagatactacactttccccatggtcttcgtaacccacaaaccaggagatttcctccagtgtttatgccaccagggccatgggtctcaagcataaaactgggcgatcatttgggcagacaccaagctagctgcagaagttttttgtcataccccagtggtgcctggaatgccagcaagacaga

SEQ ID NO: 108200 - DNA, 601 bp, Human
aagaaaaggacattaatgggcaataagtaatcacttgaagctataaaacgtacgggtaatagtaaggagacagaaaacacagactaatataacactgtaaatgtggtgcataaacatcacttaaatagaaaaactaaatgatgaagtaataatgaaaaaaaatagtggagtggctggcaaaatgtcctaataggaacagctccagtctgcaaatcccagcaagatcaacacaaaaggtgggtgatttctgcatttccaactgagttacatggctcatctcattgggactggttagacagcrggtgaagcccacggaggacgagccaaaggagggtgtggtgttgcctcacccgggaagtgcaaggggtcggggaactccctctcctagccaagggaagctgtaagggaccatgcagtgagggacgatgtattctggcccagatactacactttccccatggtcttcgtaacccacaaaccaggagatttcctccagtgtttatgccaccagggccatgggtctcaagcataaaactgggcgatcatttgggcagacaccaagctagctgcagaagttttttgtcataccccagtggtgcct

SEQ ID NO: 108201 - DNA, 601 bp, Human
caatttccctaagctcaaggataaagaaaggattctgaaagcagcaaaagaaaaggaacaaataatgtacaatggagctccactacatgtggcagcagacttttcagtggaaaaaggccaggagagagtggtatgacatattaaaagtgcagagagtggtatgacatattaaaagtgctgaagaaagaaaactttcagcctagaatagtgtaactggagaaaatatccttcaaacgtgaaagagaaataaagacttttccagaccaacaaaagctgagtgatttcatcagcaccagatctstcctagaaaaatttcaaacggattacttcagtcagaaagaaaaggacattaatgggcaataagtaatcacttgaagctataaaacgtacgggtaatagtaaggagacagaaaacacagactaatataacactgtaaatgtggtgcataaacatcacttaaatagaaaaactaaatgatgaagtaataatgaaaaaaaatagtggagtggctggcaaaatgtcctaataggaacagctccagtctgcaaatcccagcaagatcaacacaaaaggtgggtgatttctgcatttccaactgag

SEQ ID NO: 108202 - DNA, 601 bp, Human
ttcatggtcaattgatttcaaaaaagggactactgcaatttgataggaattaatggtttttctcaacaaacaatgctgggtaaaattgaagaagactacctcaaagaatttaataatcaatttccctaagctcaaggataaagaaaggattctgaaagcagcaaaagaaaaggaacaaataatgtacaatggagctccactacatgtggcagcagacttttcagtggaaaaaggccaggagagagtggtatgacatattaaaagtgcagagagtggtatgacatattaaaagtgctgaagraagaaaactttcagcctagaatagtgtaactggagaaaatatccttcaaacgtgaaagagaaataaagacttttccagaccaacaaaagctgagtgatttcatcagcaccagatctctcctagaaaaatttcaaacggattacttcagtcagaaagaaaaggacattaatgggcaataagtaatcacttgaagctataaaacgtacgggtaatagtaaggagacagaaaacacagactaatataacactgtaaatgtggtgcataaacatcacttaaatagaaaaactaaatgatgaagt

SEQ ID NO: 108203 - DNA, 601 bp, Human
ccagcagatgttttatcacagaaagtggaaaactactcctaaaatgtgtctggaaatgccaagtgacaagatcacaaaaagaaattgttaaaaaataacaaatttggaggattacactttctgatttcaaagcttccttcaaagctgcacgaatcaggattctatggtactcgcattagggtagacaaaaagaacaatgaaacacaactgagagtccagaaattaacaccaacattcatggtcaattgatttcaaaaaagggactactgcaatttgataggaattaatggtttttctcaamaaacaatgctgggtaaaattgaagaagactacctcaaagaatttaataatcaatttccctaagctcaaggataaagaaaggattctgaaagcagcaaaagaaaaggaacaaataatgtacaatggagctccactacatgtggcagcagacttttcagtggaaaaaggccaggagagagtggtatgacatattaaaagtgcagagagtggtatgacatattaaaagtgctgaagaaagaaaactttcagcctagaatagtgtaactggagaaaatatccttcaaacgtgaaagagaaataa

SEQ ID NO: 108204 - DNA, 601 bp, Human
tgcagttatatattcagtgcaatccctatcaaatcccagcagatgttttatcacagaaagtggaaaactactcctaaaatgtgtctggaaatgccaagtgacaagatcacaaaaagaaattgttaaaaaataacaaatttggaggattacactttctgatttcaaagcttccttcaaagctgcacgaatcaggattctatggtactcgcattagggtagacaaaaagaacaatgaaacacaactgagagtccagaaattaacaccaacattcatggtcaattgatttcaaaaaagggactmctgcaatttgataggaattaatggtttttctcaacaaacaatgctgggtaaaattgaagaagactacctcaaagaatttaataatcaatttccctaagctcaaggataaagaaaggattctgaaagcagcaaaagaaaaggaacaaataatgtacaatggagctccactacatgtggcagcagacttttcagtggaaaaaggccaggagagagtggtatgacatattaaaagtgcagagagtggtatgacatattaaaagtgctgaagaaagaaaactttcagcctagaatagtgtaact

SEQ ID NO: 108205 - DNA, 601 bp, Human
atccagcacagggagagtctttatagattgcagttatatattcagtgcaatccctatcaaatcccagcagatgttttatcacagaaagtggaaaactactcctaaaatgtgtctggaaatgccaagtgacaagatcacaaaaagaaattgttaaaaaataacaaatttggaggattacactttctgatttcaaagcttccttcaaagctgcacgaatcaggattctatggtactcgcattagggtagacaaaaagaacaatgaaacacaactgagagtccagaaattaacaccaacattcrtggtcaattgatttcaaaaaagggactactgcaatttgataggaattaatggtttttctcaacaaacaatgctgggtaaaattgaagaagactacctcaaagaatttaataatcaatttccctaagctcaaggataaagaaaggattctgaaagcagcaaaagaaaaggaacaaataatgtacaatggagctccactacatgtggcagcagacttttcagtggaaaaaggccaggagagagtggtatgacatattaaaagtgcagagagtggtatgacatattaaaagtgctgaagaaag

SEQ ID NO: 108206 - DNA, 601 bp, Human
gtgagaccttcttttttggggtaggggagcgagaaagacagggtcttactcgtcacccaggctggagtgcaatggcttgatcacagctcactccagtctcaaacatttgtgtcctcccacctcagcttctggagtagctgtgtctacaggcatgcatcacaacacccagctaatttattaatttttttgttgagacagagtctccctatgttgcccagtctggtcttcaactcctgttctcaagtggtcccctcatcttggcctcccaaagtgcttggatacaggtgtgaacaaccacacrtggctgagaacttccatttttgggcagaatgcacaaggttcagaaaagcatgataccttctgctacaattaagataagagaaataaaaggccaaaattatattttcaatttgtcacagagttgtacaagcaagaatgaccagctgaactgaaatccagcacagggagagtctttatagattgcagttatatattcagtgcaatccctatcaaatcccagcagatgttttatcacagaaagtggaaaactactcctaaaatgtgtctggaaatgccaagtgacaagatcacaaaaagaaat

SEQ ID NO: 108207 - DNA, 601 bp, Human
acttgatacataaaagataaccagtgagaccttcttttttggggtaggggagcgagaaagacagggtcttactcgtcacccaggctggagtgcaatggcttgatcacagctcactccagtctcaaacatttgtgtcctcccacctcagcttctggagtagctgtgtctacaggcatgcatcacaacacccagctaatttattaatttttttgttgagacagagtctccctatgttgcccagtctggtcttcaactcctgttctcaagtggtcccctcatcttggcctcccaaagtgcttgsatacaggtgtgaacaaccacacgtggctgagaacttccatttttgggcagaatgcacaaggttcagaaaagcatgataccttctgctacaattaagataagagaaataaaaggccaaaattatattttcaatttgtcacagagttgtacaagcaagaatgaccagctgaactgaaatccagcacagggagagtctttatagattgcagttatatattcagtgcaatccctatcaaatcccagcagatgttttatcacagaaagtggaaaactactcctaaaatgtgtctggaaatgccaa

SEQ ID NO: 108208 - DNA, 601 bp, Human
gttttatcaccaatgtaatgaatgacaatgtattaaaaataaagtttttcaaactttacgtcgatgagattacagtaaatgtatttttccatcttgataattcctctcacatctgtgagtattattatctatgtagctcaaatttgttcattttctttgttgtattattctgttgtaaacatgtcagtcttgtttgttaattttgatcactgtacagtattccactgtataagtatgccacaatttctttatccatttggaggactgagacatttggaggacttctcaactttagctattraaactcagtgatatgcatgtgtatgtatatgtattctgataagagtgtaaatacttgatcttaggatatgatccttcaccttaatgagataatgccatactcagccgaaatgatggcacagatttataattctaggagtagtgtatgaaaattcccattgtgtcatatcctttccaaaataaataatgttgggctaatatatacatttttgtatttatataaaatattattaaacaatattttccaagtccttttctattcttattcagaatgtatgtttacttcaatgaattacattaa

SEQ ID NO: 108209 - DNA, 601 bp, Human
cttgttgatattttcctcccttctgactatcccaaattgttatgatgatcactcatatgatgatcactcatatgtttcactgtagggttttatcaccaatgtaatgaatgacaatgtattaaaaataaagtttttcaaactttacgtcgatgagattacagtaaatgtatttttccatcttgataattcctctcacatctgtgagtattattatctatgtagctcaaatttgttcattttctttgttgtattattctgttgtaaacatgtcagtcttgtttgttaattttgatcactgtayagtattccactgtataagtatgccacaatttctttatccatttggaggactgagacatttggaggacttctcaactttagctattgaaactcagtgatatgcatgtgtatgtatatgtattctgataagagtgtaaatacttgatcttaggatatgatccttcaccttaatgagataatgccatactcagccgaaatgatggcacagatttataattctaggagtagtgtatgaaaattcccattgtgtcatatcctttccaaaataaataatgttgggctaatatatacatttttgtat

SEQ ID NO: 108210 - DNA, 601 bp, Human
tgaattcatacacaaatttctaagcacacaataaatgctcaagaatgttagtggtattactgttactgtggctgtttactgtattttaacactaaagaaattcctcaaataaaattggtgttaagtcattgtgaggtgcttcaatatgtaatattttctttctacagttcactaaattactttttctagtaaccagtttcctggttctaatcagataatcacacgtgtttagatgggcttgtgcaacctaactaggctaccctgttgctgtaccaccactaccactcccccatccaacttyattgagtgcttttgatgtggacactaggatgttccagattcactttatttagatatttgattcaacggtgaccaacacagtcaaagatacttcgcacagataagatccaaatgaaagagtaaaaaaaaaaaaaaaaaaaaaaggaagaaaatagaatttgctagcaatccagatactcccgatatatgtcttcttgttgatattttcctcccttctgactatcccaaattgttatgatgatcactcatatgatgatcactcatatgtttcactgtagggttttatcaccaatgtaatgaa

SEQ ID NO: 108211 - DNA, 601 bp, Human
taaatgaattcatacacaaatttctaagcacacaataaatgctcaagaatgttagtggtattactgttactgtggctgtttactgtattttaacactaaagaaattcctcaaataaaattggtgttaagtcattgtgaggtgcttcaatatgtaatattttctttctacagttcactaaattactttttctagtaaccagtttcctggttctaatcagataatcacacgtgtttagatgggcttgtgcaacctaactaggctaccctgttgctgtaccaccactaccactcccccatccarctttattgagtgcttttgatgtggacactaggatgttccagattcactttatttagatatttgattcaacggtgaccaacacagtcaaagatacttcgcacagataagatccaaatgaaagagtaaaaaaaaaaaaaaaaaaaaaaggaagaaaatagaatttgctagcaatccagatactcccgatatatgtcttcttgttgatattttcctcccttctgactatcccaaattgttatgatgatcactcatatgatgatcactcatatgtttcactgtagggttttatcaccaatgtaa

SEQ ID NO: 108212 - DNA, 601 bp, Human
gtggggtggggggaggagggagggatagcattaggagatatacctaatgtaaatgacgagttaatgggtgcagcacaccaacaagcacatgtatccatatgtaacaaacctgcacattgtgcacatgtaccctagaacttaaagtaaaataaaaataaataaataaataaaatattaaaaaaatgaacaaaatctcgtgttaagccataggactatattaaatgaattcatacacaaatttctaagcacacaataaatgctcaagaatgttagtggtattactgttactgtggctgtttaytgtattttaacactaaagaaattcctcaaataaaattggtgttaagtcattgtgaggtgcttcaatatgtaatattttctttctacagttcactaaattactttttctagtaaccagtttcctggttctaatcagataatcacacgtgtttagatgggcttgtgcaacctaactaggctaccctgttgctgtaccaccactaccactcccccatccaactttattgagtgcttttgatgtggacactaggatgttccagattcactttatttagatatttgattcaacggtgaccaacac

SEQ ID NO: 108213 - DNA, 601 bp, Human
atcattctgagcaaactatcgcaaggacagaaaaccaaactccacgtgttctcactcataggtgggaactgaacaacgagaacacttggatacagggtggggaacatcacactctggggcctgttgtggggtggggggaggagggagggatagcattaggagatatacctaatgtaaatgacgagttaatgggtgcagcacaccaacaagcacatgtatccatatgtaacaaacctgcacattgtgcacatgtaccctagaacttaaagtaaaataaaaataaataaataaataaaatatwaaaaaaatgaacaaaatctcgtgttaagccataggactatattaaatgaattcatacacaaatttctaagcacacaataaatgctcaagaatgttagtggtattactgttactgtggctgtttactgtattttaacactaaagaaattcctcaaataaaattggtgttaagtcattgtgaggtgcttcaatatgtaatattttctttctacagttcactaaattactttttctagtaaccagtttcctggttctaatcagataatcacacgtgtttagatgggcttgtgcaacctaacta

SEQ ID NO: 108214 - DNA, 601 bp, Human
gattcctcagggatatagaactagaaatgccatttgacccagccatcccattactggatatataaacgaaggattataaatcatgctgctataaagacacatgcacatatatgtttattgcagcactattcacaatagcaaagacttggaaccaacccaaatgcccatcaatgatagactggataaagaaaatgtggcacatatacaccatggaatactatgcagccataaaaaatgatgagttcacgtcccttgtagggacgtggatgaagctagaaaccatcattctgagcaaactatygcaaggacagaaaaccaaactccacgtgttctcactcataggtgggaactgaacaacgagaacacttggatacagggtggggaacatcacactctggggcctgttgtggggtggggggaggagggagggatagcattaggagatatacctaatgtaaatgacgagttaatgggtgcagcacaccaacaagcacatgtatccatatgtaacaaacctgcacattgtgcacatgtaccctagaacttaaagtaaaataaaaataaataaataaataaaatattaaaaaaatgaacaaaatct

SEQ ID NO: 108215 - DNA, 601 bp, Human
tgagccaaggtgacagaggctgcattgagccaagattgttcttgtgcactccagcctggacaacagagtcagatcctgtctcaaaataaaaatagaaaagttttaaattttaacttggatttcttagtaccataatcctctattctttattcagcaaaaactctaattacaatgatatctataagaatatgctgcatcaccctaattttacacttagaaatgtactttaggtttctgcttttttaacattttttattgtggagcaaaacatacagatacagagtaataacaactaataaasagtaagataaaaaattataaggttaaaattgatgttaccataccttggtaagaaaatagaatttgccattgtatatttagaaaacctaatcttctctgcccaaaatctccttaagctgataagcaacttcagcaaagtctcaggatacaaaatcaatgtgcaaaaatcacaaacattcttatacaccaataacagacaaacagagagccaaatcatgagtgaactcccattcacaattgcttcaaagagaataaaatacctaagaatccaacttacaagggatgtgaaggaaatcttcaa

SEQ ID NO: 108216 - DNA, 601 bp, Human
ctggaggctaagatgggagaatcacttgagccaaggtgacagaggctgcattgagccaagattgttcttgtgcactccagcctggacaacagagtcagatcctgtctcaaaataaaaatagaaaagttttaaattttaacttggatttcttagtaccataatcctctattctttattcagcaaaaactctaattacaatgatatctataagaatatgctgcatcaccctaattttacacttagaaatgtactttaggtttctgcttttttaacattttttattgtggagcaaaacatacakatacagagtaataacaactaataaacagtaagataaaaaattataaggttaaaattgatgttaccataccttggtaagaaaatagaatttgccattgtatatttagaaaacctaatcttctctgcccaaaatctccttaagctgataagcaacttcagcaaagtctcaggatacaaaatcaatgtgcaaaaatcacaaacattcttatacaccaataacagacaaacagagagccaaatcatgagtgaactcccattcacaattgcttcaaagagaataaaatacctaagaatccaactt

SEQ ID NO: 108217 - DNA, 601 bp, Human
aaaaaccatgtctctacaaaaaaatagaaaaaattagcagggcgtagtggtgcacgcctgttgtcctagctactctggaggctaagatgggagaatcacttgagccaaggtgacagaggctgcattgagccaagattgttcttgtgcactccagcctggacaacagagtcagatcctgtctcaaaataaaaatagaaaagttttaaattttaacttggatttcttagtaccataatcctctattctttattcagcaaaaactctaattacaatgatatctataagaatatgctgcatcacyctaattttacacttagaaatgtactttaggtttctgcttttttaacattttttattgtggagcaaaacatacagatacagagtaataacaactaataaacagtaagataaaaaattataaggttaaaattgatgttaccataccttggtaagaaaatagaatttgccattgtatatttagaaaacctaatcttctctgcccaaaatctccttaagctgataagcaacttcagcaaagtctcaggatacaaaatcaatgtgcaaaaatcacaaacattcttatacaccaataacagacaaa

SEQ ID NO: 108218 - DNA, 601 bp, Human
gagcagcactggatctcaaaatgtcatttcaattaataagacaaagtatctccgccacagctccaccattctattccatgatataaattttaagctgtttttattagcagaaatcaacacttcttagtttttaacaatctttaaaagatcaaatagtaaaacagtacttaaaactttatcaaaaaatgacggcattctcagcaaactatcacaaatgctttttctcattcttagctatggtgactaaatctggattattttactacagcagtcaaagtagcattatatgtgcacaaacatrctcaaagatcaggctaaattattttttataccttaaaaaatttgcctttctatgatttttttctctaatggacagccaaaaaatttatagtaacaaaaaattttacccaacacactggtgtacacaggaatagtatagtgaaattagaatgctaacaatgtgaatataaatatttcatttagagacacatttttaatacatttaatttaatatatttaatatccatcgtactataatttattgtaaattcctgaatttcttacactttcaaatgtgtatcaaaaataattaaattggaaa

SEQ ID NO: 108219 - DNA, 601 bp, Human
actttggtcaaagaagagaataaaaccaaggtctaggcatcctcctgcaacttggaagaaactggaaattgatttgatgtgaggagtttttttggatagtagcttgtctgttgtggggtcatcaccacaaactctcctcacagggaaattcagtgagcagcactggatctcaaaatgtcatttcaattaataagacaaagtatctccgccacagctccaccattctattccatgatataaattttaagctgtttttattagcagaaatcaacacttcttagtttttaacaatctttaaaasatcaaatagtaaaacagtacttaaaactttatcaaaaaatgacggcattctcagcaaactatcacaaatgctttttctcattcttagctatggtgactaaatctggattattttactacagcagtcaaagtagcattatatgtgcacaaacatactcaaagatcaggctaaattattttttataccttaaaaaatttgcctttctatgatttttttctctaatggacagccaaaaaatttatagtaacaaaaaattttacccaacacactggtgtacacaggaatagtatagtgaaatta

SEQ ID NO: 108220 - DNA, 601 bp, Human
ctaagtccatctccatgccaccctcctgacatgaaaatggtaatgattttcttccttttgtaatactttggtcaaagaagagaataaaaccaaggtctaggcatcctcctgcaacttggaagaaactggaaattgatttgatgtgaggagtttttttggatagtagcttgtctgttgtggggtcatcaccacaaactctcctcacagggaaattcagtgagcagcactggatctcaaaatgtcatttcaattaataagacaaagtatctccgccacagctccaccattctattccatgatwtaaattttaagctgtttttattagcagaaatcaacacttcttagtttttaacaatctttaaaagatcaaatagtaaaacagtacttaaaactttatcaaaaaatgacggcattctcagcaaactatcacaaatgctttttctcattcttagctatggtgactaaatctggattattttactacagcagtcaaagtagcattatatgtgcacaaacatactcaaagatcaggctaaattattttttataccttaaaaaatttgcctttctatgatttttttctctaatggacagccaaaaa

SEQ ID NO: 108221 - DNA, 601 bp, Human
agggcaagagatggaacaccgaaaataggctaagtccatctccatgccaccctcctgacatgaaaatggtaatgattttcttccttttgtaatactttggtcaaagaagagaataaaaccaaggtctaggcatcctcctgcaacttggaagaaactggaaattgatttgatgtgaggagtttttttggatagtagcttgtctgttgtggggtcatcaccacaaactctcctcacagggaaattcagtgagcagcactggatctcaaaatgtcatttcaattaataagacaaagtatctccrccacagctccaccattctattccatgatataaattttaagctgtttttattagcagaaatcaacacttcttagtttttaacaatctttaaaagatcaaatagtaaaacagtacttaaaactttatcaaaaaatgacggcattctcagcaaactatcacaaatgctttttctcattcttagctatggtgactaaatctggattattttactacagcagtcaaagtagcattatatgtgcacaaacatactcaaagatcaggctaaattattttttataccttaaaaaatttgcctttctat

SEQ ID NO: 108222 - DNA, 601 bp, Human
gaaatatgtacaactttgttgtgtcaggaattgaggagccgaaagaaaaaatagatggggaatggcaaaggtttgtcctgtgaggtggataattaaggctagaagaaatcctttggagagatctgcgcttggcagataacatcatctcaaatttcctcatgatgcaactaaataagaaagttcctatttcaactatcttagagttgtataagaatgtatatacaactaattgatttttcccttcagtatataatcagatgagtaataataatttctatgagacatttctcctaatcaaaamctttaatattaaaattataatgcacacttagaaatgaaccaaaacaaaaatgggaaataccggaatgtatcataaacagtcaactaacccttataaagggcaagagatggaacaccgaaaataggctaagtccatctccatgccaccctcctgacatgaaaatggtaatgattttcttccttttgtaatactttggtcaaagaagagaataaaaccaaggtctaggcatcctcctgcaacttggaagaaactggaaattgatttgatgtgaggagtttttttggatagtagcttgtctgt

SEQ ID NO: 108223 - DNA, 601 bp, Human
ccatctactcagaagggtgaggcaggagaatcgcttgaaccctggaggtggaggttgcagtgagccaagatagtgccactgcactccagcctgggcaacagagtgagactccatctcaaaaaacagaaaacacacacacacacaaatgaaatccaaagacatgtgagatatatatgtctaatgttttagagggtcttctcttgcagaaaaacataactgataaaagaactctgctaaaccaagagtgtgggaaatatgtacaactttgttgtgtcaggaattgaggagccgaaagaaaaartagatggggaatggcaaaggtttgtcctgtgaggtggataattaaggctagaagaaatcctttggagagatctgcgcttggcagataacatcatctcaaatttcctcatgatgcaactaaataagaaagttcctatttcaactatcttagagttgtataagaatgtatatacaactaattgatttttcccttcagtatataatcagatgagtaataataatttctatgagacatttctcctaatcaaaaactttaatattaaaattataatgcacacttagaaatgaaccaaaacaaaaa

SEQ ID NO: 108224 - DNA, 601 bp, Human
ttcctgagtacccgaccctttggtatataatcttgcagtatcctcctatcacaggaagactgactacctttcccctgaacttggagttcaatcatttaacttactttgataaacagaaaattactacactttgcatagagatttgagatggcttccatactggggattcttcctctttccatttaccatgagaatatcgcctcgcaagtacactgttcccagaaggagaatgagaaagtaatgtagtcagattgcccccacctgatccagactaaattggccaaactctatctccaagatcccgaatttggcccatctcaaatcaccagagccatccatcaaacccagcttagaaaaatgaaatccaggccaggtgtggaggaggctgaggagggcagatcacgaagtcaagagattgagaccatcctggccaacatggtgaaaccccatctctactaaaaatacaaaaattaggtgggctcagtggagtgtgcctgtagtcccatctactcagaagggtgaggcaggagaatcgcttgaaccctggaggtggaggttgcagtgagccaagatagtgccactgcactccagcctgggcaac

SEQ ID NO: 108225 - DNA, 601 bp, Human
caagtctaatgtttaaatatttattattatataaaatatttagccattttataagaattcctgagtacccgaccctttggtatataatcttgcagtatcctcctatcacaggaagactgactacctttcccctgaacttggagttcaatcatttaacttactttgataaacagaaaattactacactttgcatagagatttgagatggcttccatactggggattcttcctctttccatttaccatgagaatatcgcctcgcaagtacactgttcccagaaggagaatgagaaagtaatgwagtcagattgcccccacctgatccagactaaattggccaaactctatctccaagatgccgaatttggcccatctcaaatcaccagagccatccatcaaacccagcttagaaaaatgaaatccaggccaggtgtggaggaggctgaggagggcagatcacgaagtcaagagattgagaccatcctggccaacatggtgaaaccccatctctactaaaaatacaaaaattaggtgggctcagtggagtgtgcctgtagtcccatctactcagaagggtgaggcaggagaatcgcttgaaccc

SEQ ID NO: 108226 - DNA, 601 bp, Human
cataatttccaaaataaaaaatgagtttccaagaagttgtccagatgaaattagccctattttcccactcaagagttttcagcccatgaataatatttatttatcaaacatatctctaattcttaggcctttggtaaagtttctctcaagtctaatgtttaaatatttattattatataaaatatttagccattttataagaattcctgagtacccgaccctttggtatataatcttgcagtatcctcctatcacaggaagactgactacctttcccctgaacttggagttcaatcatttmacttactttgataaacagaaaattactacactttgcatagagatttgagatggcttccatactggggattcttcctctttccatttaccatgagaatatcgcctcgcaagtacactgttcccagaaggagaatgagaaagtaatgtagtcagattgcccccacctgatccagactaaattggccaaactctatctccaagatgccgaatttggcccatctcaaatcaccagagccatccatcaaacccagcttagaaaaatgaaatccaggccaggtgtggaggaggctgaggagggcag

SEQ ID NO: 108227 - DNA, 601 bp, Human
caagctcataaatatgaacacaaatacacgcatgtgcacaccacttatgaatggaacaaattattttctcataatttccaaaataaaaaatgagtttccaagaagttgtccagatgaaattagccctattttcccactcaagagttttcagcccatgaataatatttatttatcaaacatatctctaattcttaggcctttggtaaagtttctctcaagtctaatgtttaaatatttattattatataaaatatttagccattttataagaattcctgagtacccgaccctttggtatatmatcttgcagtatcctcctatcacaggaagactgactacctttcccctgaacttggagttcaatcatttaacttactttgataaacagaaaattactacactttgcatagagatttgagatggcttccatactggggattcttcctctttccatttaccatgagaatatcgcctcgcaagtacactgttcccagaaggagaatgagaaagtaatgtagtcagattgcccccacctgatccagactaaattggccaaactctatctccaagatgccgaatttggcccatctcaaatcaccag

SEQ ID NO: 108228 - DNA, 601 bp, Human
ggactttttaaaatgccagatttgtatacacagaatccaaactgcttttatcaaaagcatctaagattttcttgagaaccacaggcaggccaatactccataagatttggttgctgctaatacttttgtataacttcattattcacaagctcataaatatgaacacaaatacacgcatgtgcacaccacttatgaatggaacaaattattttctcataatttccaaaataaaaaatgagtttccaagaagttgtccagatgaaattagccctattttcccactcaagagttttcagcccawgaataatatttatttatcaaacatatctctaattcttaggcctttggtaaagtttctctcaagtctaatgtttaaatatttattattatataaaatatttagccattttataagaattcctgagtacccgaccctttggtatataatcttgcagtatcctcctatcacaggaagactgactacctttcccctgaacttggagttcaatcatttaacttactttgataaacagaaaattactacactttgcatagagatttgagatggcttccatactggggattcttcctctttccattt

SEQ ID NO: 108229 - DNA, 601 bp, Human
ttttataacccaatacatagatcatatagcaaatgtctaaagtcttaaagggagcttggtcacaactaagatcattaccaatatggactttttaaaatgccagatttgtatacacagaatccaaactgcttttatcaaaagcatctaagattttcttgagaaccacaggcaggccaatactccataagatttggttgctgctaatacttttgtataacttcattattcacaagctcataaatatgaacacaaatacacgcatgtgcacaccacttatgaatggaacaaattattttctcawaatttccaaaataaaaaatgagtttccaagaagttgtccagatgaaattagccctattttcccactcaagagttttcagcccatgaataatatttatttatcaaacatatctctaattcttaggcctttggtaaagtttctctcaagtctaatgtttaaatatttattattatataaaatatttagccattttataagaattcctgagtacccgaccctttggtatataatcttgcagtatcctcctatcacaggaagactgactacctttcccctgaacttggagttcaatcatttaac

SEQ ID NO: 108230 - DNA, 601 bp, Human
aatgtaatatcactggttgtgattgcttgaatatcctgaccttaaattctatatgcacctaatttgtaaatctgctgggtcattctttttacttttaaacgttgtgaccagtgtcaagccagaaatcaccatggcgtgttaactgatgagttcaatgatctctttatggaaaacattcttattttcaaacaactcaaattaactcattcattcactgtttgttcttgttacaggctagaattattcatactgaaattgactggaaacctgaatcctcatttgctagtacacaaataagaaygtactctctttcagagtttgcaatttttctttgtgtaacctctccatcatttgtgtttagcaacttcagttgtttgggaagttttataacccaatacatagatcatatagcaaatgtctaaagtcttaaagggagcttggtcacaactaagatcattaccaatatggactttttaaaatgccagatttgtatacacagaatccaaactgcttttatcaaaagcatctaagattttcttgagaaccacaggcaggccaatactccataagatttggttgctgctaatacttttgtataact

SEQ ID NO: 108231 - DNA, 601 bp, Human
ctagcttcagaatagttctccaaatctccactccacccaggaagtccagctggcttcacctctcaatgtaatatcactggttgtgattgcttgaatatcctgaccttaaattctatatgcacctaatttgtaaatctgctgggtcattctttttacttttaaacgttgtgaccagtgtcaagccagaaatcaccatggcgtgttaactgatgagttcaatgatctctttatggaaaacattcttattttcaaacaactcaaattaactcattcattcactgtttgttcttgttacaggctrgaattattcatactgaaattgactggaaacctgaatcctcatttgctagtacacaaataagaatgtactctctttcagagtttgcaatttttctttgtgtaacctctccatcatttgtgtttagcaacttcagttgtttgggaagttttataacccaatacatagatcatatagcaaatgtctaaagtcttaaagggagcttggtcacaactaagatcattaccaatatggactttttaaaatgccagatttgtatacacagaatccaaactgcttttatcaaaagcatctaagattttc

SEQ ID NO: 108232 - DNA, 601 bp, Human
aataacaaatgtaaccactactagaatggaaaatatgatgggcagaaaagttatcatgtctgaacagacaaaaagaaatttttaaaatgctggtgttgtatccggagttggttcctgcaggtgggttcgtggtctcgctgacttcaagaatggaggcacggacctttgcagtgatgttacagctcttaaagatggcatggccccagggctgagcagtagcaaggtttcagctcttaaagacggtgtggacccaaagactgagtggtagcaaggtttattgttaagagcaaaaggacaaagsttccacagggtggaagggggcctgagtgggttgccccgtgggctgccccgtgggctggaatggccagcttttattcccttatttgtcccctcccatgttccatttttgtcctatcagagtgcccttttttcaatcctccctgtgattggctacttttaggatcctgatgattggtgcgttttatggagcgctgattggtgccttttacagagagctgattggtgcattttacaatcctctggctagctagagtgctgattggtgcatttttacagagtgttgactggtgcattttataat

SEQ ID NO: 108233 - DNA, 601 bp, Human
tgtctcttcacccactcggtggaatttaccaacgctatgaagccattagcaaaatttccaataacaaatgtaaccactactagaatggaaaatatgatgggcagaaaagttatcatgtctgaacagacaaaaagaaatttttaaaatgctggtgttgtatccggagttggttcctgcaggtgggttcgtggtctcgctgacttcaagaatggaggcacggacctttgcagtgatgttacagctcttaaagatggcatggccccagggctgagcagtagcaaggtttcagctcttaaagackgtgtggacccaaagactgagtggtagcaaggtttattgttaagagcaaaaggacaaaggttccacagggtggaagggggcctgagtgggttgccccgtgggctgccccgtgggctggaatggccagcttttattcccttatttgtcccctcccatgttccatttttgtcctatcagagtgcccttttttcaatcctccctgtgattggctacttttaggatcctgatgattggtgcgttttatggagcgctgattggtgccttttacagagagctgattggtgcattttacaatcctctg

SEQ ID NO: 108234 - DNA, 601 bp, Human
ccgccagagcagtgacaatttggtcagcaaaggagatcttttgtctcttcacccactcggtggaatttaccaacgctatgaagccattagcaaaatttccaataacaaatgtaaccactactagaatggaaaatatgatgggcagaaaagttatcatgtctgaacagacaaaaagaaatttttaaaatgctggtgttgtatccggagttggttcctgcaggtgggttcgtggtctcgctgacttcaagaatggaggcacggacctttgcagtgatgttacagctcttaaagatggcatggmcccagggctgagcagtagcaaggtttcagctcttaaagacggtgtggacccaaagactgagtggtagcaaggtttattgttaagagcaaaaggacaaaggttccacagggtggaagggggcctgagtgggttgccccgtgggctgccccgtgggctggaatggccagcttttattcccttatttgtcccctcccatgttccatttttgtcctatcagagtgcccttttttcaatcctccctgtgattggctacttttaggatcctgatgattggtgcgttttatggagcgctgattggtg

SEQ ID NO: 108235 - DNA, 601 bp, Human
ataacacccagagcaaaccaactctggagaccgccagagcagtgacaatttggtcagcaaaggagatcttttgtctcttcacccactcggtggaatttaccaacgctatgaagccattagcaaaatttccaataacaaatgtaaccactactagaatggaaaatatgatgggcagaaaagttatcatgtctgaacagacaaaaagaaatttttaaaatgctggtgttgtatccggagttggttcctgcaggtgggttcgtggtctcgctgacttcaagaatggaggcacggacctttgcartgatgttacagctcttaaagatggcatggccccagggctgagcagtagcaaggtttcagctcttaaagacggtgtggacccaaagactgagtggtagcaaggtttattgttaagagcaaaaggacaaaggttccacagggtggaagggggcctgagtgggttgccccgtgggctgccccgtgggctggaatggccagcttttattcccttatttgtcccctcccatgttccatttttgtcctatcagagtgcccttttttcaatcctccctgtgattggctacttttaggatcctgatga

SEQ ID NO: 108236 - DNA, 601 bp, Human
tctgaaaggtacattgcacgcctcaatttgatcttccaagtcatgtttccttcatattcttttgtccatacaatctgattcatgtttaccacaaaaagatgacaagccaaaaatagcaaaggccccaacagcaccaccagaatgacactcttaactctcctctttaagcgaagaaaaataaggttggagaaattggcaatcttgagcaaataaaatatgctgaggctagtagcaggccagttgctgaaatggccggttactgcccagatattataagcagtagttcttaattctacactayaaaaagctggattcaacacagttgaataccaatttaataataacacccagagcaaaccaactctggagaccgccagagcagtgacaatttggtcagcaaaggagatcttttgtctcttcacccactcggtggaatttaccaacgctatgaagccattagcaaaatttccaataacaaatgtaaccactactagaatggaaaatatgatgggcagaaaagttatcatgtctgaacagacaaaaagaaatttttaaaatgctggtgttgtatccggagttggttcctgcaggtgggttcgtg

SEQ ID NO: 108237 - DNA, 601 bp, Human
tcacagtttgcaaaacttttatgtggaccttggtactgggatcttgagatcctttgccatggagctgcatcttcttgagatgtttacacagagaacagactaacagcagaaaagatatcagggttacagtaaagggtactaagtttgctagcatggttacagtcgtatctgaaaggtacattgcacgcctcaatttgatcttccaagtcatgtttccttcatattcttttgtccatacaatctgattcatgtttaccacaaaaagatgacaagccaaaaatagcaaaggccccaacagcaycaccagaatgacactcttaactctcctctttaagcgaagaaaaataaggttggagaaattggcaatcttgagcaaataaaatatgctgaggctagtagcaggccagttgctgaaatggccggttactgcccagatattataagcagtagttcttaattctacactataaaaagctggattcaacacagttgaataccaatttaataataacacccagagcaaaccaactctggagaccgccagagcagtgacaatttggtcagcaaaggagatcttttgtctcttcacccactcggtgga

SEQ ID NO: 108238 - DNA, 601 bp, Human
caggctggaatgcagtggcgcggtctcggctcactgcaagctctgccacccacgttcacgccattctccggccacagccttccgagtagctgggaatacaggtgcccaccaccactcccagctaatttttttgtatttttagtggagacggggtttcaccatagtagccgggatggtctcgatatcctgacctcgtgatccgcccgcctcagccttccaaggtgccatctaattttgatgttttaccttgtctccaattcagacacctgacacagctgcatcaagactatatatcactatatatatatatagtgtgactatatatcactatatatatcactagtgtgatatttcccctaaaattgtggaatagccaaacttttcctctgaggaaggattctgcttggataagcctgaaacctcaacctgagaccagaacaggggaattcatgcaactgcagattttgtgatgagtttccttttcattgatttaccacatcaacttatccattttagccacccatttatttgttcattaaagtatcatttttggccatctattcttggtgctgggttctaggtcctgggaatcaacagaaag

SEQ ID NO: 108239 - DNA, 601 bp, Human
atacttatgcaaatagaccaaagtcttttatatgctttttaaagtattgtcataggtgccacctaattttttcttttctttttttttttttgtctgtcgcccaggctggaatgcagtggcgcggtctcggctcactgcaagctctgccacccacgttcacgccattctccggccacagccttccgagtagctgggaatacaggtgcccaccaccactcccagctaatttttttgtatttttagtggagacggggtttcaccatagtagccgggatggtctcgatatcctgacctcgtgatycgcccgcctcagccttccaaggtgccatctaattttgatgttttaccttgtctccaattcagacacctgacacagctgcatcaagactatatatcactatatatatatatagtgtgactatatatcactatatatatcactagtgtgatatttcccctaaaattgtggaatagccaaacttttcctctgaggaaggattctgcttggataagcctgaaacctcaacctgagaccagaacaggggaattcatgcaactgcagattttgtgatgagtttccttttcattgatttaccacatc

SEQ ID NO: 108240 - DNA, 601 bp, Human
ggtattaattaaaaacattttggtcaagtagctggttactaactcaattttttgaaatgaaatgccattttgtttacctaataatcaactagaaaatatcataacacaaatatataattcacaataaaaaaatacttatgcaaatagaccaaagtcttttatatgctttttaaagtattgtcataggtgccacctaattttttcttttctttttttttttttgtctgtcgcccaggctggaatgcagtggcgcggtctcggctcactgcaagctctgccacccacgttcacgccattctcyggccacagccttccgagtagctgggaatacaggtgcccaccaccactcccagctaatttttttgtatttttagtggagacggggtttcaccatagtagccgggatggtctcgatatcctgacctcgtgatccgcccgcctcagccttccaaggtgccatctaattttgatgttttaccttgtctccaattcagacacctgacacagctgcatcaagactatatatcactatatatatatatagtgtgactatatatcactatatatatcactagtgtgatatttcccctaaaattgtgga

SEQ ID NO: 108241 - DNA, 601 bp, Human
gtctcaatttccacatgtccctgccatttttgtcttgaactttacttctaaataaatgtcatcactttcattaacaggtattaattaaaaacattttggtcaagtagctggttactaactcaattttttgaaatgaaatgccattttgtttacctaataatcaactagaaaatatcataacacaaatatataattcacaataaaaaaatacttatgcaaatagaccaaagtcttttatatgctttttaaagtattgtcataggtgccacctaattttttcttttctttttttttttttgtytgtcgcccaggctggaatgcagtggcgcggtctcggctcactgcaagctctgccacccacgttcacgccattctccggccacagccttccgagtagctgggaatacaggtgcccaccaccactcccagctaatttttttgtatttttagtggagacggggtttcaccatagtagccgggatggtctcgatatcctgacctcgtgatccgcccgcctcagccttccaaggtgccatctaattttgatgttttaccttgtctccaattcagacacctgacacagctgcatcaagactatata

SEQ ID NO: 108242 - DNA, 601 bp, Human
ttcacatttcttcctgtctcaatttccacatgtccctgccatttttgtcttgaactttacttctaaataaatgtcatcactttcattaacaggtattaattaaaaacattttggtcaagtagctggttactaactcaattttttgaaatgaaatgccattttgtttacctaataatcaactagaaaatatcataacacaaatatataattcacaataaaaaaatacttatgcaaatagaccaaagtcttttatatgctttttaaagtattgtcataggtgccacctaattttttcttttctttttttttttttgtctgtcgcccaggctggaatgcagtggcgcggtctcggctcactgcaagctctgccacccacgttcacgccattctccggccacagccttccgagtagctgggaatacaggtgcccaccaccactcccagctaatttttttgtatttttagtggagacggggtttcaccatagtagccgggatggtctcgatatcctgacctcgtgatccgcccgcctcagccttccaaggtgccatctaattttgatgttttaccttgtctccaattcagacacctgacacagctg

SEQ ID NO: 108243 - DNA, 601 bp, Human
gaggctgtaatgaggtgtgatcctgccactgaactccagcctcagggatagaatgagaccctgttcaaaataataacaataataataaagtattagttggtacaataatcaggaagttgcaagtttattaaatatagtaaaataccctaatgttggatggaagtaaaataccagaagaaaagaaataaacctgagaagattcagggacctacagcataggtgatgttttaaggtgtgcagtgtccctagggcacatgtcaaaacaatcttttttaaagtaaatggcatgttgctctctctrtgtacttcctatcactacaaaagagatacaatgttttggggacctattgagattttggagccaacatattccacgtttgaaaatattgctctgactcattaataaagtttccaaaggctactggtctcaagtggaacccagaacaaaagagggctctacagcagatacaggctctggtccaagctgctatggccactgtgccagatgatccagcagaattcaaagcgactagagcattgtttcacatttcttcctgtctcaatttccacatgtccctgccatttttgtcttgaactttac

SEQ ID NO: 108244 - DNA, 601 bp, Human
tgtagttattacctcttcctgaatgtgtaattgaaatggatacgtatggcagctggcagaactatcacattcttcctgaactgtagagtaaggaacattattatagcaggaccaaggggaagcctctgaaattctcctccattggcaacacaatgtataaaatataataactgcattccccaaggaatggaactggtcactgtcatgacaaaacacttgaaagttacaggggatggtagtcctttctataacccgattcacttaacctatctggcctctaccaaagacagacaggttatastgaatgcagactaccataaacttcaatcaacactcacaaatgctttccaggatgtgctatcttcactgagcagagcagagcttttgatactttttacggggctcatgatttggtgaatgtttgttaatctacacccattatgcaggaaaatcaaaacaatttggcttgtattgtaagaataatagcactgcttcactgttttatgtcagggctatgtcacttctgttctcagtttaatttacattttttaaaacatcgtgctaatttaatatattagtaatattacaaaccgggccctgt

SEQ ID NO: 108245 - DNA, 601 bp, Human
ttgttacccaagctggagtacagtggcaggatcatagcccactgcagcctggaactcctgggctcaagcaatcctcctgcctcagcttcccaagtatttggaactataggcatgcaccaccccgccagctaattttttaaattttttgtagagacagagtttccatatgttgcgaagggaactcctgctctcaaaagatcctcccaccttggcctcccaaagtactaggactacaggcatgcgccatcacatccagcctgcagtgggagttcttgaaggtcagatgctgcccagagcttcrgctcatgtctatcccaaggtggatctaaccagtttgtagttattacctcttcctgaatgtgtaattgaaatggatacgtatggcagctggcagaactatcacattcttcctgaactgtagagtaaggaacattattatagcaggaccaaggggaagcctctgaaattctcctccattggcaacacaatgtataaaatataataactgcattccccaaggaatggaactggtcactgtcatgacaaaacacttgaaagttacaggggatggtagtcctttctataacccgattcacttaac

SEQ ID NO: 108246 - DNA, 601 bp, Human
ctataaaaagcagataataggctgggcacggtggctcaggcctgtaattccagcactttgggaggccgaggcaggtggatcacctgaggtcaggagttagaaaacagcatggccaacatggtgaaaccctgtctccactaaaaatacaaaaatttgccagttgtggttgtgcatgcctatgatcctaggtacttggttggctgcggcaggagaatcatttgaacccaggagacggaggttgtaattggtcgagatcacaccactgcactccaacggggagacagagcaacaccctgtttcaaaaaaaaaaaaaatgaaaggagatgaaaaaaaactggctttgtttaattttgttaggagttaatataatataccctttgtataactactttccattttacctgtttgctataggcaggaaccaaagattgttaattattgatttgatccctttttacttgatatttaagataccagtgagaacttgcacttcttttttttttcttcctccgagacagtctccgtttgttacccaagctggagtacagtggcaggatcatagcccactgcagcctggaactcctgggctcaagcaatcctc

SEQ ID NO: 108247 - DNA, 601 bp, Human
atgagtctaacacttaaatcttagttatttaattaaaatactcagaaattttataactattccttggacacttaaaaaacatgttttccattgaagaatctacacttctctatgtatgaatatccagctttatttttccctatttatttttgattactaaatggtttaagatgaatagatattaaaatcagtctccaatcttggattttatatcttttcagtttttacactataatggtttctaagaggggatcttcgagtcagactacaaagacaggaaaccagattccctgtttcatayagatatgtgagactccattttacaactactgcctgcctcagtataattacctataaaaagcagataataggctgggcacggtggctcaggcctgtaattccagcactttgggaggccgaggcaggtggatcacctgaggtcaggagttagaaaacagcatggccaacatggtgaaaccctgtctccactaaaaatacaaaaatttgccagttgtggttgtgcatgcctatgatcctaggtacttggttggctgcggcaggagaatcatttgaacccaggagacggaggttgtaattggtc

SEQ ID NO: 108248 - DNA, 601 bp, Human
gccaagcaggaaaccaccggagcatgctattgaatgagttcaaggctatcttaatggaaaacatgataatttccaaaacagctcaaattaactcctattcaaatactatgtccttgttataagataaaaattttcatactgatgttgatgtgaaagctgaattctcatttgctagcatgcaaatcaagtcatattcttattcatcattttgtaatttttttccttgtttaacctctatataatttgtattcagcaatgtcagttgtaagggaaattttccaacctaatacatagatcatamatcagatgcctacactgttatatgtagcttggtcaaaactagaatcatgaccactgttgattcattttttcaacgccggatttatggagagtgaatcccaacttttcctaccaaaagcgtccaaggttttcttcggaagcccaagaaggccaatattccttaaaatctggttgctgccaactaataattttgtataacttattattaacaagctcattaacataagcactttcacatgcacatatatacacccctgacggttgggaaaaattgttgtcctataatttctaaaatgaaaaa

SEQ ID NO: 108249 - DNA, 601 bp, Human
gcaggactaatatcaatgggcaagattccctttaaggtcctgaccttaatttctatgtgcacctgatttctggttgtgcagtaatgttcctgttccttttaagttctctgactaatgccaagcaggaaaccaccggagcatgctattgaatgagttcaaggctatcttaatggaaaacatgataatttccaaaacagctcaaattaactcctattcaaatactatgtccttgttataagataaaaattttcatactgatgttgatgtgaaagctgaattctcatttgctagcatgcaaatyaagtcatattcttattcatcattttgtaatttttttccttgtttaacctctatataatttgtattcagcaatgtcagttgtaagggaaattttccaacctaatacatagatcatacatcagatgcctacactgttatatgtagcttggtcaaaactagaatcatgaccactgttgattcattttttcaacgccggatttatggagagtgaatcccaacttttcctaccaaaagcgtccaaggttttcttcggaagcccaagaaggccaatattccttaaaatctggttgctgccaactaa

SEQ ID NO: 108250 - DNA, 601 bp, Human
atattaataatgaattatatacttcatatatttatttattcatattattagcttttctaatattttttcttaaagatttaaatactcttttgttatgaacgggtataactatgctagacatatttcctttaaccaaacattatgtcaaatgactttgagaaatatgattagttaacagcatactgtaaggcaaatttcagcattgtttaacaactccttaaaaggattcaaagaaaataataggttgaaatatcaaaatagtctataagtgtaatgtaggtgcccatgggaaaatacaaamtaccattaacgttatggaaaaaaaatgattagtagtaaacataccatgtccgactttttttagggcaggactaatatcaatgggcaagattccctttaaggtcctgaccttaatttctatgtgcacctgatttctggttgtgcagtaatgttcctgttccttttaagttctctgactaatgccaagcaggaaaccaccggagcatgctattgaatgagttcaaggctatcttaatggaaaacatgataatttccaaaacagctcaaattaactcctattcaaatactatgtccttgttat

SEQ ID NO: 108251 - DNA, 601 bp, Human
caggaactgtgttaggattaaaaactccttccctcctttgttaggtatgctcttctcttgggattgtaacaggtgcaagcagcacccttctgctgacgtaaaggtgccttgctgagaaattgtccaagtggggatttcttttggctactccgagcacatgtctccaacagttcattttgattgctgtatagtattctattgtacaagtatgccataatttacttatccattttatcactgatggatatttgagagacttctcaactttagctattaaaactcagtgatatgcatgtgtgtscacatatattctgataacagtgcaaatactgggtgttcaaatgtgatccatcaacttaatcagataatgccatagtcagacaaagtaattgctctgatttacaattctaggagcaatgtatgaaaattcccattgcttcatatgctttccaaaataagtaacatcagactaatttttacactttcgtatctatatgaaacattataaacctaacatttttgaagcctttttctattatagttcagaatgtatccttaattcaaaaattattacttttaaattctatgaccatgatttcat

SEQ ID NO: 108252 - DNA, 601 bp, Human
gttccgttaggacaactaaattcctctttaaagactcaacttcccagccataagttgtaaatgttgtaaatgaatcctacctcccacccctctttctttttgcaaaatgtgcgtttaccctatttggaaaagtttaagtctaagccattcaggatcagcttagattgtgcaatccaaccccagccaataagggaaggacacagaaacaggaactgtgttaggattaaaaactccttccctcctttgttaggtatgctcttctcttgggattgtaacaggtgcaagcagcacccttctgctracgtaaaggtgccttgctgagaaattgtccaagtggggatttcttttggctactccgagcacatgtctccaacagttcattttgattgctgtatagtattctattgtacaagtatgccataatttacttatccattttatcactgatggatatttgagagacttctcaactttagctattaaaactcagtgatatgcatgtgtgtgcacatatattctgataacagtgcaaatactgggtgttcaaatgtgatccatcaacttaatcagataatgccatagtcagacaaagtaattgctc

SEQ ID NO: 108253 - DNA, 601 bp, Human
ggttccgttaggacaactaaattcctctttaaagactcaacttcccagccataagttgtaaatgttgtaaatgaatcctacctcccacccctctttctttttgcaaaatgtgcgtttaccctatttggaaaagtttaagtctaagccattcaggatcagcttagattgtgcaatccaaccccagccaataagggaaggacacagaaacaggaactgtgttaggattaaaaactccttccctcctttgttaggtatgctcttctcttgggattgtaacaggtgcaagcagcacccttctgcygacgtaaaggtgccttgctgagaaattgtccaagtggggatttcttttggctactccgagcacatgtctccaacagttcattttgattgctgtatagtattctattgtacaagtatgccataatttacttatccattttatcactgatggatatttgagagacttctcaactttagctattaaaactcagtgatatgcatgtgtgtgcacatatattctgataacagtgcaaatactgggtgttcaaatgtgatccatcaacttaatcagataatgccatagtcagacaaagtaattgct

SEQ ID NO: 108254 - DNA, 601 bp, Human
atacatttttgtaaactttatataaatggaattatactgaatcattttttcaaacttaattcctctcatatctatgtagttcaaatttcttcatttttctttttatttatattctttgtaaacatgtcactctagctggttccgttaggacaactaaattcctctttaaagactcaacttcccagccataagttgtaaatgttgtaaatgaatcctacctcccacccctctttctttttgcaaaatgtgcgtttaccctatttggaaaagtttaagtctaagccattcaggatcagcttakattgtgcaatccaaccccagccaataagggaaggacacagaaacaggaactgtgttaggattaaaaactccttccctcctttgttaggtatgctcttctcttgggattgtaacaggtgcaagcagcacccttctgctgacgtaaaggtgccttgctgagaaattgtccaagtggggatttcttttggctactccgagcacatgtctccaacagttcattttgattgctgtatagtattctattgtacaagtatgccataatttacttatccattttatcactgatggatatttgagagac

SEQ ID NO: 108255 - DNA, 601 bp, Human
ttactgataacatttcccttttgtttcctccatccctaccatcccaattgttaggataatcactcatatgtctcaccttagaatttcaccaccagtgtaataaatttcaatttattaaaaatacatttttgtaaactttatataaatggaattatactgaatcattttttcaaacttaattcctctcatatctatgtagttcaaatttcttcatttttctttttatttatattctttgtaaacatgtcactctagctggttccgttaggacaactaaattcctctttaaagactcaacttyccagccataagttgtaaatgttgtaaatgaatcctacctcccacccctctttctttttgcaaaatgtgcgtttaccctatttggaaaagtttaagtctaagccattcaggatcagcttagattgtgcaatccaaccccagccaataagggaaggacacagaaacaggaactgtgttaggattaaaaactccttccctcctttgttaggtatgctcttctcttgggattgtaacaggtgcaagcagcacccttctgctgacgtaaaggtgccttgctgagaaattgtccaagtggggattt

SEQ ID NO: 108256 - DNA, 601 bp, Human
tagactgaataagcttcatttcatcttttaatagcatcattaccaagttaaattctcttgactgcttatttacattctcagctactgtcacaaaatctgggtgtttttattatagcagtcaaagtaactacactaaatatgttttatgccttaataaaattatctttctactaatttttctctaatattaaaaaaatttgcagtatcaaaatatttttccttacacatgtgtacacatgcatggtattataatctttgaatggtaaaaatatgtgtataattatttcatttaaagataaayttagaaaaattgtcctatacatttaatatctatactactataatttattggaaattcactaatttctgccactttgaaatgttatcataaataattaaattggaaataagaaaaaaatgtgtccagtaaaatataagtgctcaaaatctgatgtttcaaagtaagaataacattaggaatgtggaggtagtcttcctgcttatctcttcctttttctaattaatttaaaaaaaagtttaaaattttatcttggatttattactatcataatgctctattctttattcagcaaaaactcta

SEQ ID NO: 108257 - DNA, 601 bp, Human
ggaataacgcaaagccaacacatttccaatgatttacttgctattttttttctttcaccacattctaaaaattatggcaaaagtgacctaaagcaaataatactctttttttggctgtttagttttggtccagtttcatatgaacttacacaaatactctgtgcaattatagactgaataagcttcatttcatcttttaatagcatcattaccaagttaaattctcttgactgcttatttacattctcagctactgtcacaaaatctgggtgtttttattatagcagtcaaagtaactacwctaaatatgttttatgccttaataaaattatctttctactaatttttctctaatattaaaaaaatttgcagtatcaaaatatttttccttacacatgtgtacacatgcatggtattataatctttgaatggtaaaaatatgtgtataattatttcatttaaagataaatttagaaaaattgtcctatacatttaatatctatactactataatttattggaaattcactaatttctgccactttgaaatgttatcataaataattaaattggaaataagaaaaaaatgtgtccagtaaaa

SEQ ID NO: 108258 - DNA, 601 bp, Human
gaatcaggcctagacaaataccctcatatagtatttcatcaggaataacgcaaagccaacacatttccaatgatttacttgctattttttttctttcaccacattctaaaaattatggcaaaagtgacctaaagcaaataatactctttttttggctgtttagttttggtccagtttcatatgaacttacacaaatactctgtgcaattatagactgaataagcttcatttcatcttttaatagcatcattaccaagttaaattctcttgactgcttatttacattctcagctactgtcasaaaatctgggtgtttttattatagcagtcaaagtaactacactaaatatgttttatgccttaataaaattatctttctactaatttttctctaatattaaaaaaatttgcagtatcaaaatatttttccttacacatgtgtacacatgcatggtattataatctttgaatggtaaaaatatgtgtataattatttcatttaaagataaatttagaaaaattgtcctatacatttaatatctatactactataatttattggaaattcactaatttctgccactttgaaatgttatcataa

SEQ ID NO: 108259 - DNA, 601 bp, Human
cttattcttcctcatggatttacaatttttttttttttctcagatgaagtttctcccttgtcacccaggctggagtgcaatggcacaatctcggcttgcagaaacctctgcctccctgattcaatcaattctcctgcctcagcctcccaagtacctatgattacaggtgcccaccaccccacccgtcaatttttgtatttttagtagagacagggtttcactatgttggccaggctggtctggaactcctgacctcagggaatccactgccttggcctcctagagtgctgggattacaggmatgagccactgtgcttggcaccattcttatattattctcagaatcaggcctagacaaataccctcatatagtatttcatcaggaataacgcaaagccaacacatttccaatgatttacttgctattttttttctttcaccacattctaaaaattatggcaaaagtgacctaaagcaaataatactctttttttggctgtttagttttggtccagtttcatatgaacttacacaaatactctgtgcaattatagactgaataagcttcatttcatcttttaatagcatcattaccaagtta

SEQ ID NO: 108260 - DNA, 601 bp, Human
cacttaactttctaaatctaaatgtatttattgttacttgaactttgctgtttactaatgtaactttcccacaatgatatctcttagaaattacatagatgttacgaaattatgtatgtaaatatttcaaaaataaatcatttcataaaacagatgtaaatagagatgatgataataatgatgatgatgtcaactaaaagggagaatgttaccaaataactgtgatttgggtcttcttttcaaagtactggagttaagggtgatgggagaacactcttattcttcctcatggatttacaatttttttttttttctcagatgaagtttctcccttgtcacccaggctggagtgcaatggcacaatctcggcttgcagaaacctctgcctccctgattcaatcaattctcctgcctcagcctcccaagtacctatgattacaggtgcccaccaccccacccgtcaatttttgtatttttagtagagacagggtttcactatgttggccaggctggtctggaactcctgacctcagggaatccactgccttggcctcctagagtgctgggattacaggaatgagccactgtgcttggcaccatt

SEQ ID NO: 108261 - DNA, 601 bp, Human
ttgatcatgaaatggtttatttttcttattaaggaattttatttatactaaaatcaaaatcttttttatagtgtttcttggtttagtttaatgtcatctacaattgttttcttaagcaatgtatgttaaactacactacacttaactttctaaatctaaatgtatttattgttacttgaactttgctgtttactaatgtaactttcccacaatgatatctcttagaaattacatagatgttacgaaattatgtatgtaaatatttcaaaaataaatcatttcataaaacagatgtaaatakagatgatgataataatgatgatgatgtcaactaaaagggagaatgttaccaaataactgtgatttgggtcttcttttcaaagtactggagttaagggtgatgggagaacactcttattcttcctcatggatttacaatttttttttttttctcagatgaagtttctcccttgtcacccaggctggagtgcaatggcacaatctcggcttgcagaaacctctgcctccctgattcaatcaattctcctgcctcagcctcccaagtacctatgattacaggtgcccaccaccccacccgtca

SEQ ID NO: 108262 - DNA, 601 bp, Human
ttgaaagaaactggaaattaagttgatgtgagtagatgtttttggatattagcttgtctgttgctggctcctcaccacaaactctgcccacaggggaactcaatgagcagcactggatctcaaaatatcatggcaatagataaaatatagttcatctaccacagctacattgctgtattcaatgaattaattttcactttgcttatgttgtagaaatggggctctgtgcctctgaaccccatcattacctaaatgaaatagagaagatgtgggggaaggcttacttctctttgatttattyagccctaaaatcctctctttgtaaatcagagcttgatcatgaaatggtttatttttcttattaaggaattttatttatactaaaatcaaaatcttttttatagtgtttcttggtttagtttaatgtcatctacaattgttttcttaagcaatgtatgttaaactacactacacttaactttctaaatctaaatgtatttattgttacttgaactttgctgtttactaatgtaactttcccacaatgatatctcttagaaattacatagatgttacgaaattatgtatgtaaatatttcaa

SEQ ID NO: 108263 - DNA, 601 bp, Human
cttattgttttagtgttcagaataaacttttattctccttccataaatcattttctatagggaaactgaacaaactactcttaacaccatgttatttttaaaagtgttttagattttggggtttttatgttttttgttttagtatgctagaaatgaaaatggtaacagttttcttttcccaacacttggtcagagaatagaataaaaagtttgtcttggaacttaccttcaatttgaaagaaactggaaattaagttgatgtgagtagatgtttttggatattagcttgtctgttgctggstcctcaccacaaactctgcccacaggggaactcaatgagcagcactggatctcaaaatatcatggcaatagataaaatatagttcatctaccacagctacattgctgtattcaatgaattaattttcactttgcttatgttgtagaaatggggctctgtgcctctgaaccccatcattacctaaatgaaatagagaagatgtgggggaaggcttacttctctttgatttatttagccctaaaatcctctctttgtaaatcagagcttgatcatgaaatggtttatttttcttattaagga

SEQ ID NO: 108264 - DNA, 601 bp, Human
tagaattacacttatttttcattgtcaataatttttattgctccttgcatgttcaactttgcattttcagtcatttttattttctctgaaaaatattttcaatttctgtttatgaagttctactactctttggaaatgcactgaagacatgtttccattgagttccttcttccatgttttctgttaaaatcaggttgtatttagaatgcagttcttttcaacacacgacatactctatcttccacctctcgctacttttcagattttctattggtctttggtgtcctgtattattttatgytaatttggtttaatttatcatgcttgaagtttgagattactaaaaatatatggaggaatacattttatcacttttggaaaaatccttgcaacatttctcttgcttgattttctctcctctaatcttacagaactccagaagtatgttaggtgttctgactgtagcatcaatgtgataccctctagcttggtatatttccatctgtttctctctatgcttcattctgtttagctatcttccaattcactaattctctcttctactgcatctaacaggctaattctgtctattggattctca

SEQ ID NO: 108265 - DNA, 601 bp, Human
ggagaatgtcaaagttttgtcatatgaagtagataattaaacctagaagaaaaacctattgaaaaacgtggggttggcaggtaacatcatgtcaaatttccaaaagttacaactaaaatcagaacatttctacttaaaacctcttagagttatacatgaatgtatacaaatagtggatttttcccttcagtatataatgagcagagtaataataatttcatggaacatttctcctcattaacaatttttgtattgtaactagagtgcacacttagaaatgagccaaaacaaaactgggaarcatagcaatgtgtcataaatactcatgtaatcatcatgtagggcaagacatggaaaattgctaagagcctaggtttacctcaatgccactttccaatctgctacacgtttcttcacatctcctgtgataagcaacatccataatttatgttgatctttttaaaattttctttatactttaccaactaggtatgcgaccctaaactcaatagcttggtttggccttctttgaactgtgtataggtgcaattctatatgttcttattcatggcttcctgaaatcaacattctgtatcagaaa

SEQ ID NO: 108266 - DNA, 601 bp, Human
ttgtgttaggaattctggatccaagggaaaaatagatggagaatgtcaaagttttgtcatatgaagtagataattaaacctagaagaaaaacctattgaaaaacgtggggttggcaggtaacatcatgtcaaatttccaaaagttacaactaaaatcagaacatttctacttaaaacctcttagagttatacatgaatgtatacaaatagtggatttttcccttcagtatataatgagcagagtaataataatttcatggaacatttctcctcattaacaatttttgtattgtaactagastgcacacttagaaatgagccaaaacaaaactgggaagcatagcaatgtgtcataaatactcatgtaatcatcatgtagggcaagacatggaaaattgctaagagcctaggtttacctcaatgccactttccaatctgctacacgtttcttcacatctcctgtgataagcaacatccataatttatgttgatctttttaaaattttctttatactttaccaactaggtatgcgaccctaaactcaatagcttggtttggccttctttgaactgtgtataggtgcaattctatatgttctta

SEQ ID NO: 108267 - DNA, 601 bp, Human
ttccttttaccatgaggacatcatctggctagtacactgttcccagaagaagaatgagaaactaatggagtcagaatgccactacctgatccagcctaaatcagccaaactagctgcaagatgcagtatgtggcccatctccaatcaccagagccatctgccaaaccaagcttagaaaaatgaaatccaaagacttatgagacacaaatatctaaagcagttttggaggattttctcttgcagaaaaacataactgatataggtattctgctaaactaagagtgtgggtaacatgaccacmcttgttgtgttaggaattctggatccaagggaaaaatagatggagaatgtcaaagttttgtcatatgaagtagataattaaacctagaagaaaaacctattgaaaaacgtggggttggcaggtaacatcatgtcaaatttccaaaagttacaactaaaatcagaacatttctacttaaaacctcttagagttatacatgaatgtatacaaatagtggatttttcccttcagtatataatgagcagagtaataataatttcatggaacatttctcctcattaacaatttttgtattgtaac

SEQ ID NO: 108268 - DNA, 601 bp, Human
gggtgactaccttgaacttggactctaaattcactcctctaatttgcttcagtcaacaggaagttagtagactttacacagatatttaagacagcttccatgttggagtttcctgctcttttccttttaccatgaggacatcatctggctagtacactgttcccagaagaagaatgagaaactaatggagtcagaatgccactacctgatccagcctaaatcagccaaactagctgcaagatgcagtatgtggcccatctccaatcaccagagccatctgccaaaccaagcttagaaaaaygaaatccaaagacttatgagacacaaatatctaaagcagttttggaggattttctcttgcagaaaaacataactgatataggtattctgctaaactaagagtgtgggtaacatgaccacccttgttgtgttaggaattctggatccaagggaaaaatagatggagaatgtcaaagttttgtcatatgaagtagataattaaacctagaagaaaaacctattgaaaaacgtggggttggcaggtaacatcatgtcaaatttccaaaagttacaactaaaatcagaacatttctacttaaaa

SEQ ID NO: 108269 - DNA, 601 bp, Human
gggatggaaggaattattttcttattactcaccaaatggaaaacgagtttccaggaggtcatccaggtagaattagtactattttcctattcagcgttgtcagacaatgaataatgtttatcaaacatgtttcttatgcttaggtctttggtaaatttacattcaagtctgttttttgtttaaattttaattaaaatattcagcaattttgtaaatgtttctaagtaccctacattttgtcatataatcctgcagtatcctcccaccacaggcagggtgactaccttgaacttggactctraattcactcctctaatttgcttcagtcaacaggaagttagtagactttacacagatatttaagacagcttccatgttggagtttcctgctcttttccttttaccatgaggacatcatctggctagtacactgttcccagaagaagaatgagaaactaatggagtcagaatgccactacctgatccagcctaaatcagccaaactagctgcaagatgcagtatgtggcccatctccaatcaccagagccatctgccaaaccaagcttagaaaaatgaaatccaaagacttatgagacacaa

SEQ ID NO: 108270 - DNA, 601 bp, Human
atggatgaattcaaagctgtctttagggaaaatattattaatctcaaaacagctgaaactcattcctctttatagactatctgtccttgctatatgctgaaatgttttatactgatgttgaagtcaaaagtgaattctcgtgtgttagtatgcaaataaagccatattctttttcattgttttgcaatttttttcttgtttaacctctccataatttgtatccagcatcttcagttgttacatagggaaattttaaaacccaatacatatatcatacagtaaatgtctaaattgttaaagragcttggtcataaataggatcatatcaatatggatttatttttatgccagatttaaataccagattctaaaccttttgtcaaaatcatccaaggttatcttggaaagtcctgtgaggccaatacacctgaaaatctggtttctgataaccaatacatttatatgacattattgttaataagctcctaaacacatagacacacatgcactcacaccattaggggatggaaggaattattttcttattactcaccaaatggaaaacgagtttccaggaggtcatccaggtagaattagtact

SEQ ID NO: 108271 - DNA, 601 bp, Human
taatatccagacattaacttcgataaacacttgatttctaaatgtgcagtaacattttctgcctttaagttctctaatgtcaacaggaaagcaccagcatatgccaatggatgaattcaaagctgtctttagggaaaatattattaatctcaaaacagctgaaactcattcctctttatagactatctgtccttgctatatgctgaaatgttttatactgatgttgaagtcaaaagtgaattctcgtgtgttagtatgcaaataaagccatattctttttcattgttttgcaatttttttcttgtttaacctctccataatttgtatccagcatcttcagttgttacatagggaaattttaaaacccaatacatatatcatacagtaaatgtctaaattgttaaaggagcttggtcataaataggatcatatcaatatggatttatttttatgccagatttaaataccagattctaaaccttttgtcaaaatcatccaaggttatcttggaaagtcctgtgaggccaatacacctgaaaatctggtttctgataaccaatacatttatatgacattattgttaataagctcctaaacacat

SEQ ID NO: 108272 - DNA, 601 bp, Human
agaagaacactcttaattctcttctttaggtggagaaaaataaaattggagaaattggcaatcttgaacaaataaaatatgctgaggctcgtagcaagccaaatgctgaaatgattgattattgccgagacattagaaggaacaattcttacttctaaactatataaagctgaattaaacacagttgcataccaatgtaataatatgatcaaagtaaaccaattctggagaatgccagagcagtgacaatttggtcagttgaggagatcttttgtgtcttaacccagtcattgacattaaytagagctatgaagccattggcaacatttccaagaacaaatgcaaacactaccagaattgataaaatgatgagcagaacacatatgtttgaacaacaacaaaaaaaaaaatgcaggcttaataacactggttgtgattcccttaatatccagacattaacttcgataaacacttgatttctaaatgtgcagtaacattttctgcctttaagttctctaatgtcaacaggaaagcaccagcatatgccaatggatgaattcaaagctgtctttagggaaaatattattaatctcaaaacagc

SEQ ID NO: 108273 - DNA, 601 bp, Human
acagaaatataaaacgttctagacaccatcagtttcttttctgctaaaagacacaccatgctccccttgtgaatctatggagttgagggtttctgttatttcacccagcacgtcacctgacacaaaactgaaagagaggtctgttttagcttcctacttctcataatcaggatgaatgagtggaatgaaggatacatgattgcaagagtttggtaaagcaggaatacaagattgctctgctgtgtcctaggattccaagttgatgtgattatacacagaaagtaaatggcaaataacatamggaaggagataacagtttgcaaaggttttatatggaccttggtgctgagatcttgagatcctttgccatggagctgcatcatcttgagatgtttacacggagaacagactaacagcagaaaagatattagagtcagaatgaacagtgtgaagtttgctagcatggttggttatagtcatgtttgaaaggtgtattgcattcctcaattcgatcttccaagtcacatttccttcaaattcttttgtccacacactgtcatccatggttaccacagcaagattacaaatcaaaaataccaag

SEQ ID NO: 108274 - DNA, 601 bp, Human
ccctgtttatgttgggcttttttttttaaagaaagggaatatttgagtttttttgaggaatatcaggaatgggagacaaagaagaatattggaaattcagaggctcagaggttgctaagcaaaataaatggaaatacttgacatcagatgtcaacttcaaaaaagattttctttaactcaaaaggtggaagaaatgatttttctaactacacttaaaaaattataatagcactgaaatgatcatggttttgtttcttcattcctattatagaaatgatttttttctaagctattcacataytggtattaaatctagtattctttagtacagttttgttatacatatacaaaatttgccttcccaaaggcaaatacatatactctacatgtttgtcactgattttatttaatatgtacactaattttattgtgtacatcattatctaacaaaaattctatttgctttatactaaaagtaaagtaacaattcataatgaaataaaacctactacaaagatacagtctcatcattgatttagaattgaatgtctttaccatccagaaaatgagaggttcaaacaatgatagttaagtacatgta

SEQ ID NO: 108275 - DNA, 601 bp, Human
tcataacaccaagaatgaatatagtcacacagaatttagctgttccacaaggctgtagattaccttcttataatagaacttggtatcaatggatacatcagcacactttgtatcatttcaccatttacatcattataatagtcattaatatatttcctatcatcaatatatagatttcacaggcaatttttaacatttgaagaaagtttcattcgattatcatctatagtttctacaccctgtttatgttgggcttttttttttaaagaaagggaatatttgagtttttttgaggaatatyaggaatgggagacaaagaagaatattggaaattcagaggctcagaggttgctaagcaaaataaatggaaatacttgacatcagatgtcaacttcaaaaaagattttctttaactcaaaaggtggaagaaatgatttttctaactacacttaaaaaattataatagcactgaaatgatcatggttttgtttcttcattcctattatagaaatgatttttttctaagctattcacatactggtattaaatctagtattctttagtacagttttgttatacatatacaaaatttgccttccca

SEQ ID NO: 108276 - DNA, 601 bp, Human
atatatatataatatgaggagttgatttattttaaggttgagataacaatgttaaaatttcataacaccaagaatgaatatagtcacacagaatttagctgttccacaaggctgtagattaccttcttataatagaacttggtatcaatggatacatcagcacactttgtatcatttcaccatttacatcattataatagtcattaatatatttcctatcatcaatatatagatttcacaggcaatttttaacatttgaagaaagtttcattcgattatcatctatagtttctacaccctstttatgttgggcttttttttttaaagaaagggaatatttgagtttttttgaggaatatcaggaatgggagacaaagaagaatattggaaattcagaggctcagaggttgctaagcaaaataaatggaaatacttgacatcagatgtcaacttcaaaaaagattttctttaactcaaaaggtggaagaaatgatttttctaactacacttaaaaaattataatagcactgaaatgatcatggttttgtttcttcattcctattatagaaatgatttttttctaagctattcacatactggt

SEQ ID NO: 108277 - DNA, 601 bp, Human
attctttgtgctggcttttagatcctgtgagtcaagagaaagcaagacagctattacctctctttttatgctgattacatagtactagggaagatgtatgataaacaaaatgtatgtgtgtatatatatattatatatatataatatgaggagttgatttattttaaggttgagataacaatgttaaaatttcataacaccaagaatgaatatagtcacacagaatttagctgttccacaaggctgtagattaccttcttataatagaacttggtatcaatggatacatcagcacactttstatcatttcaccatttacatcattataatagtcattaatatatttcctatcatcaatatatagatttcacaggcaatttttaacatttgaagaaagtttcattcgattatcatctatagtttctacaccctgtttatgttgggcttttttttttaaagaaagggaatatttgagtttttttgaggaatatcaggaatgggagacaaagaagaatattggaaattcagaggctcagaggttgctaagcaaaataaatggaaatacttgacatcagatgtcaacttcaaaaaagattttctt

SEQ ID NO: 108278 - DNA, 601 bp, Human
tggcacacactgctgaccctgaccctgtgcaaatataccaaaatctttaatatgcttttcaaaaagcattagaataagtgccatctaattttgacgttccaccttgtctctacttcacacacctgatatagctacagcaaagctatattacagtgatatttcccctagaattttggaacagtcaaacttttgctctgagaaatgcttcttctttgataagcctataacctcaacctgaaactagaaaattcaagcaactgcagattttgtgatgagtttcattgtcattggtttaccacawcaaattatccatttatccaatcacttatgtgttcattaatatattcttttgaccaactattctttgtgctggcttttagatcctgtgagtcaagagaaagcaagacagctattacctctctttttatgctgattacatagtactagggaagatgtatgataaacaaaatgtatgtgtgtatatatatattatatatatataatatgaggagttgatttattttaaggttgagataacaatgttaaaatttcataacaccaagaatgaatatagtcacacagaatttagctgttccacaag

SEQ ID NO: 108279 - DNA, 601 bp, Human
agctagccccgagcagctggcacacactgctgaccctgaccctgtgcaaatataccaaaatctttaatatgcttttcaaaaagcattagaataagtgccatctaattttgacgttccaccttgtctctacttcacacacctgatatagctacagcaaagctatattacagtgatatttcccctagaattttggaacagtcaaacttttgctctgagaaatgcttcttctttgataagcctataacctcaacctgaaactagaaaattcaagcaactgcagattttgtgatgagtttcattktcattggtttaccacaacaaattatccatttatccaatcacttatgtgttcattaatatattcttttgaccaactattctttgtgctggcttttagatcctgtgagtcaagagaaagcaagacagctattacctctctttttatgctgattacatagtactagggaagatgtatgataaacaaaatgtatgtgtgtatatatatattatatatatataatatgaggagttgatttattttaaggttgagataacaatgttaaaatttcataacaccaagaatgaatatagtcacacagaa

SEQ ID NO: 108280 - DNA, 601 bp, Human
tcacaatacaaatatatcattcacagtagaaagtgattaggtacgtttacaaccagcttaaccagttgcaaagtttgctagcttttatttttacttcttttgagttcagttcttttgtatcagcaaagcattgaaggcagcataagtcatattgaaggagaaagagacattccctaaaaacaaaagtgtgtttagcagctactgggaagttccctaacattcttgtcatggggtcagctagccccgagcagctggcacacactgctgaccctgaccctgtgcaaatataccaaaatctttwatatgcttttcaaaaagcattagaataagtgccatctaattttgacgttccaccttgtctctacttcacacacctgatatagctacagcaaagctatattacagtgatatttcccctagaattttggaacagtcaaacttttgctctgagaaatgcttcttctttgataagcctataacctcaacctgaaactagaaaattcaagcaactgcagattttgtgatgagtttcattgtcattggtttaccacaacaaattatccatttatccaatcacttatgtgttcattaatatattctt

SEQ ID NO: 108281 - DNA, 601 bp, Human
tgaaataccttttttgtgtatctaataaccagctaaaaaatatcacaatacaaatatatcattcacagtagaaagtgattaggtacgtttacaaccagcttaaccagttgcaaagtttgctagcttttatttttacttcttttgagttcagttcttttgtatcagcaaagcattgaaggcagcataagtcatattgaaggagaaagagacattccctaaaaacaaaagtgtgtttagcagctactgggaagttccctaacattcttgtcatggggtcagctagccccgagcagctggcacwcactgctgaccctgaccctgtgcaaatataccaaaatctttaatatgcttttcaaaaagcattagaataagtgccatctaattttgacgttccaccttgtctctacttcacacacctgatatagctacagcaaagctatattacagtgatatttcccctagaattttggaacagtcaaacttttgctctgagaaatgcttcttctttgataagcctataacctcaacctgaaactagaaaattcaagcaactgcagattttgtgatgagtttcattgtcattggtttaccacaacaaatt

SEQ ID NO: 108282 - DNA, 601 bp, Human
aaggaagaaaagcaaagatggtagttctgccacaaaataactttggccaaaggtaaatagaaaacaaaagacagctaggatacattctcccttttctctcttccatggactaatatttgctgtggtttccccttgtaacccttctggaaaagtaccgggagccaagtgcatgtatctgatgatcaccatgctgtctgtctcacctcattgtgaagtgacaacggcaaagtcatgtcaacatcatgatacatggttttacatcttcttttgcctcagtttccacatttacccctcattgctrccctggacttgccttcccaaataaatgtcatcactgtaaactcagacactggctctagttctagacacccaaagctaagatatacattcagttgcatcacttttccatgcatttataatatggcaattaaaacattcatttagaaaggatactaaaatatatatataaataatgtgtaagaaaggtgactcgttactaactcaatttttaaaagcgaaatgccatctttgtgtatatagtaaccagctagaaaatatcataatagaaatatatcattcacagtagaaagtgattgggtac

SEQ ID NO: 108283 - DNA, 601 bp, Human
ttccataaatttaaatcactacttacaaatgctctctaggatgtggtatcttccctgagcagagcagagcttctggcactttgcatgtggctctcgattaagtgaatatttcttgtttttcacccacgggtgggtcgggagattaaaacagttggcctttgtttggtaagaacgaaagtgctgcttcactgttttatgtcagggcgatgtcacttctgctctcagtttaatttacattttgcaaaacatcatgttaatttattaataatgttacagtaattggtgcaataaccaggaaatkgaaaggtccctaaatatagtaaaatacttgaacgttaaatagaaataaaatactagcagaaagagatacacctgataatatttggaaacctgcaacatagatattgtttttaaggtctcatattcctggtctacatgtcgaaaaatccatttatttatttatatatttatttttgagacagagtcttgctctgttgcccaggctagagtgcactggtgccatctcggctcactgcaaacttcgcctcctgggttcaatcagttcaaatccttcagcctccttactagctgtatttacagc

SEQ ID NO: 108284 - DNA, 601 bp, Human
ccattgtataagtatgccacaatttgtttatccatttggaggtctgaaagacatttggaggacatgcataaagataaatttatattcttatttcataccatacacaaaaaataactcatatttgattatagagctatatgtaaaaggtgagattagtaactaagatactaaaacatactacctgtacaactgcaagtaatataagtgggttaatcaaccataattccatctgtatatttctctacttagatcattatttctataataataataatcccctgcatagtaatctatcaatatstataatgctattttaaataaaactaaattagatggtgggtcaccctcactctgatttagtggaaattcaagcaaaaatattattaatactccatcttttcccttagatttttggtattattacttctatttttcattttttgagacatggtctcactctgtagccccaactggagtgcagtggtttcggattggctcactgctctccactgctctctacagctcccagcctcaagctatcctcccaccttagcctcccaggtagctaggactgcaggtggacaccacctcacctagctaa

SEQ ID NO: 108285 - DNA, 601 bp, Human
tatgtaaatgagattatactgaatgtatttttccatcttgataattcctctcacatttgtgagattatctatgtagctcaaatttgttcattttctttgttgtattattctgttgtaaacatgtctgtctagttcattaattttgatcactgtatagtattccattgtataagtatgccacaatttgtttatccatttggaggtctgaaagacatttggaggacatgcataaagataaatttatattcttatttcataccatacacaaaaaataactcatatttgattatagagctatatrtaaaaggtgagattagtaactaagatactaaaacatactacctgtacaactgcaagtaatataagtgggttaatcaaccataattccatctgtatatttctctacttagatcattatttctataataataataatcccctgcatagtaatctatcaatatgtataatgctattttaaataaaactaaattagatggtgggtcaccctcactctgatttagtggaaattcaagcaaaaatattattaatactccatcttttcccttagatttttggtattattacttctatttttcatttt

SEQ ID NO: 108286 - DNA, 601 bp, Human
ttatgtaaatgagattatactgaatgtatttttccatcttgataattcctctcacatttgtgagattatctatgtagctcaaatttgttcattttctttgttgtattattctgttgtaaacatgtctgtctagttcattaattttgatcactgtatagtattccattgtataagtatgccacaatttgtttatccatttggaggtctgaaagacatttggaggacatgcataaagataaatttatattcttatttcataccatacacaaaaaataactcatatttgattatagagctataygtaaaaggtgagattagtaactaagatactaaaacatactacctgtacaactgcaagtaatataagtgggttaatcaaccataattccatctgtatatttctctacttagatcattatttctataataataataatcccctgcatagtaatctatcaatatgtataatgctattttaaataaaactaaattagatggtgggtcaccctcactctgatttagtggaaattcaagcaaaaatattattaatactccatcttttcccttagatttttggtattattacttctatttttcattt

SEQ ID NO: 108287 - DNA, 601 bp, Human
taaacagtaagagaaaaaattataacattaacatcgatgttaccacaccttggtcagaaaatagaatttgccagtaatccagacactcccaatatatgtcttcttgctgatatttcccgtttatctcctccctcctgattatcccaattgttatgatgatcactcatatgtttcactgtagagttttatcaccaatgtaacaaattacaatatattaaaaatatttttcttgaactttatgtaaatgagattatactgaatgtatttttccatcttgataattcctctcacatttgtgagtttatctatgtagctcaaatttgttcattttctttgttgtattattctgttgtaaacatgtctgtctagttcattaattttgatcactgtatagtattccattgtataagtatgccacaatttgtttatccatttggaggtctgaaagacatttggaggacatgcataaagataaatttatattcttatttcataccatacacaaaaaataactcatatttgattatagagctatatgtaaaaggtgagattagtaactaagatactaaaacatactacctgtacaactgcaagtaatata

SEQ ID NO: 108288 - DNA, 601 bp, Human
ggtgcactcctgttgtcctagctactctggaagctgagatgggagaattacttgagcctggatagcagaggttgcactgagccaagattctgcttgtgcactccagcctgggcaacagagagagaccctgtctcaaaacaataagaaaaattttaaattttaacttggatttcttagtaccataatgctctattctcctttattcagcaaatactctaataacaatggtatctataagaatatgctgtatcaccctaattttatatgtaggaatgtattttatgtttctgcttttttaacttttttttttttattggggagcataacttacatatggagcataataaaacctaataaacagtaagagaaaaaattataacattaacatcgatgttaccacaccttggtcagaaaatagaatttgccagtaatccagacactcccaatatatgtcttcttgctgatatttcccgtttatctcctccctcctgattatcccaattgttatgatgatcactcatatgtttcactgtagagttttatcaccaatgtaacaaattacaatatattaaaaatatttttcttgaactttatgtaaatg

SEQ ID NO: 108289 - DNA, 601 bp, Human
aatattaatttaagaaaagtttcagggcaggtctagtggctcacatctgtaatcccagcattttggaaggctgaggcagttggattgcctgagcacaggagttcaagtccagcctgggaaacatgccaaaaccctgtctctaccaaaaacagaaaaaattagcagggcgtggtggtgcactcctgttgtcctagctactctggaagctgagatgggagaattacttgagcctggatagcagaggttgcactgagccaagattctgcttgtgcactccagcctgggcaacagagagagaccmtgtctcaaaacaataagaaaaattttaaattttaacttggatttcttagtaccataatgctctattctcctttattcagcaaatactctaataacaatggtatctataagaatatgctgtatcaccctaattttatatgtaggaatgtattttatgtttctgcttttttaacttttttttttttattggggagcataacttacatatggagcataataaaacctaataaacagtaagagaaaaaattataacattaacatcgatgttaccacaccttggtcagaaaatagaatttgccag

SEQ ID NO: 108290 - DNA, 601 bp, Human
aaattggaaagagaaaaaaggtgtttagctgtcataaatattcaagttttgatgtttcaaattcatattagcattaagaaggtggatttacagttcttgcttatgtcttctttttaaaaaaatattaatttaagaaaagtttcagggcaggtctagtggctcacatctgtaatcccagcattttggaaggctgaggcagttggattgcctgagcacaggagttcaagtccagcctgggaaacatgccaaaaccctgtctctaccaaaaacagaaaaaattagcagggcgtggtggtgcackcctgttgtcctagctactctggaagctgagatgggagaattacttgagcctggatagcagaggttgcactgagccaagattctgcttgtgcactccagcctgggcaacagagagagaccctgtctcaaaacaataagaaaaattttaaattttaacttggatttcttagtaccataatgctctattctcctttattcagcaaatactctaataacaatggtatctataagaatatgctgtatcaccctaattttatatgtaggaatgtattttatgtttctgcttttttaactttttttt

SEQ ID NO: 108291 - DNA, 601 bp, Human
aattaaacattttacattaaaattataatgcacacttagaaatgaaccaaaacaaaaatgggaaataccgcagtgtatcataaacattcaagtaaccatgatgcaggcaagacaaggaacaccaaacacaacctaggtccacctccatgccactttccaagtccctaaacatttcttcatacctcctgagataagcaatatccaaaatttatggtgattatttccttaattttctttacactttaccaactaggtatgcaaccctaaactccatcgcttggtctggcctgctttgcactgygtgtaggtgcaatcctacatgttcttcttgtttgtggcttcttggactcaacattgtgtttctgaaatttagtcacatagttgcaagtacatgtgattttttttcacttctctatattgttccattgtgtggatttactgtaatgattgatctatccttaatatatatttggccagcttcttttttgaacagttacgaataattctactagagcattctttcatatatcatttgatgcaattcctctgtatatatacctttgagtagaattacagggtcattgtgcaaaatatcctcata

SEQ ID NO: 108292 - DNA, 601 bp, Human
gagatgaataataataatttctatgagacatatctcctaattaaacattttacattaaaattataatgcacacttagaaatgaaccaaaacaaaaatgggaaataccgcagtgtatcataaacattcaagtaaccatgatgcaggcaagacaaggaacaccaaacacaacctaggtccacctccatgccactttccaagtccctaaacatttcttcatacctcctgagataagcaatatccaaaatttatggtgattatttccttaattttctttacactttaccaactaggtatgcaacsctaaactccatcgcttggtctggcctgctttgcactgcgtgtaggtgcaatcctacatgttcttcttgtttgtggcttcttggactcaacattgtgtttctgaaatttagtcacatagttgcaagtacatgtgattttttttcacttctctatattgttccattgtgtggatttactgtaatgattgatctatccttaatatatatttggccagcttcttttttgaacagttacgaataattctactagagcattctttcatatatcatttgatgcaattcctctgtatatatacctttg

SEQ ID NO: 108293 - DNA, 601 bp, Human
cttcaactcccttagagttgtataacaatgtatacaaatagtttattattgccatcagtatataatgagatgaataataataatttctatgagacatatctcctaattaaacattttacattaaaattataatgcacacttagaaatgaaccaaaacaaaaatgggaaataccgcagtgtatcataaacattcaagtaaccatgatgcaggcaagacaaggaacaccaaacacaacctaggtccacctccatgccactttccaagtccctaaacatttcttcatacctcctgagataagcratatccaaaatttatggtgattatttccttaattttctttacactttaccaactaggtatgcaaccctaaactccatcgcttggtctggcctgctttgcactgcgtgtaggtgcaatcctacatgttcttcttgtttgtggcttcttggactcaacattgtgtttctgaaatttagtcacatagttgcaagtacatgtgattttttttcacttctctatattgttccattgtgtggatttactgtaatgattgatctatccttaatatatatttggccagcttcttttttgaacagttac

SEQ ID NO: 108294 - DNA, 601 bp, Human
aaattgcaaaggtttgttcttgtgaggtcgataattaaggctagaagaaatccattggaaagttctggggttggaggataacatcatctcaaatttcctcacgttgcaactaaataagaaagtgctcacttcaactcccttagagttgtataacaatgtatacaaatagtttattattgccatcagtatataatgagatgaataataataatttctatgagacatatctcctaattaaacattttacattaaaattataatgcacacttagaaatgaaccaaaacaaaaatgggaaatacygcagtgtatcataaacattcaagtaaccatgatgcaggcaagacaaggaacaccaaacacaacctaggtccacctccatgccactttccaagtccctaaacatttcttcatacctcctgagataagcaatatccaaaatttatggtgattatttccttaattttctttacactttaccaactaggtatgcaaccctaaactccatcgcttggtctggcctgctttgcactgcgtgtaggtgcaatcctacatgttcttcttgtttgtggcttcttggactcaacattgtgtttctgaaat

SEQ ID NO: 108295 - DNA, 601 bp, Human
cttattttcaaaacaactcaaattaacccattcattcactgtctgtccttgttataggctggaattattcatactgaagttgacatgaaacctgaattctcatttgctagtatgcaaacaaggacatattcactttcagtgtttgcaatttttccttgtgtaacctctccatcatttgtctttagtgacttcagttgttagggaagttttataacccaatacagagatcatatagtaaatgtctaaattcttaaaaggagcttggtcataattaagttcatcacctatatggacttttttwaatgacagatttaaatacacagaatccaaactgcttttatcaaaaatatctaagattttctggagaacctcagaatctggttgctgctaatacgtttgtataacttcattattcacaagctcataaatacacacacaaacacacacatgtgcacaccactcacgaatggaacaaattattttctcatcagttccaaaataaaaaaaggagtttccaggaggttgtctaggtgaagttagtcctattttcccactcagggctttcagctcatgaataatatttatttatcaaacatatctc

SEQ ID NO: 108296 - DNA, 601 bp, Human
gatgaatgggtgggttgaaggatagctgaatgcaatagcttcgcagaacatgaagacaggtttgttttccagactctcaaaactccaaactgacatgattatggacagaaagtaaatggcacataacaagaggaaggaggtcacagtttgcatagcttttatgtggaccttcatgctgggatcttgagatcctttgccatggagctgcatctttttgagatgtttacacagagaacagattaacagcagaaaagatatcagggtcagagtgaagggaactaagtttgctaggatggttacygttgtatttgaaaggtacattgcactcctcagtttgatcttccaagtcatgtttccttcatattcttttgtccatataatctgattcatgtttatcacaaaaagatgacaaaccaaaaatagcaaaggccccaatagtatcaccagaacaacactcttaactctcctctttaagtgaagaaaaataaggttggagaaattggcaatcttgagcaaataaaatatgctgaggctagtagcaagccagttgctgaaatggttgattactgcccagacattgtaagcagtaattcttacttct

SEQ ID NO: 108297 - DNA, 601 bp, Human
atataacacgtttgttttctgctagaagatacacaatgctgctcttgtgaatctatgaagatgaaggcttctctcctttcacccagtacctcacatgccacaaaactgaaagaaaagtctgctttagcttcttgtttccccaaatcaggatgaatgggtgggttgaaggatagctgaatgcaatagcttcgcagaacatgaagacaggtttgttttccagactctcaaaactccaaactgacatgattatggacagaaagtaaatggcacataacaagaggaaggaggtcacagtttgcawagcttttatgtggaccttcatgctgggatcttgagatcctttgccatggagctgcatctttttgagatgtttacacagagaacagattaacagcagaaaagatatcagggtcagagtgaagggaactaagtttgctaggatggttaccgttgtatttgaaaggtacattgcactcctcagtttgatcttccaagtcatgtttccttcatattcttttgtccatataatctgattcatgtttatcacaaaaagatgacaaaccaaaaatagcaaaggccccaatagtatcaccagaacaac

SEQ ID NO: 108298 - DNA, 601 bp, Human
ccacactgtgggcatgaggtctgactttcacaacctccacctagggactggatgatggaaggcagaacagcagagatggtagttctgcctcagggaaacaatggccaatgggaaatcaaatacagaagacaactgagcagatacattctccattctccctcctctctctcatccctggactaatgccggctgtggtttccccttgtagcccttctggaaaagtgctgggagccaagtgtacgcatctgatgaccgtcatgctgtctctctcacctcactgtgaagtggctgccagcagagycataccagacatcaccacacattgtttcacatttgttcctgtctcaatttccacatatccttgccatttttgtcttgaacttgatttctaaataaatgtcatcaccttaataacaggtaatacataaaaaacattttagtaaagtagctggttactaactcaatttttaaaatgaaatgccatttttgtttaaataataatcaactagaaaatatcataatacaaatatataattcacaatagaaaaaaatacatattcaaatagaccaaggttgtttatacgctttctaaaaatattgt

SEQ ID NO: 108299 - DNA, 601 bp, Human
tcataaagccagccatgactggagggcatgagtacatctgagcggcacaaagagtggtggtattggacacagacatgtgctttcttagattcccttcactatctcctattcccctggccagcaccttgcctgatccagatcatccttccatttgggacttgaatggaacaccacactgtgggcatgaggtctgactttcacaacctccacctagggactggatgatggaaggcagaacagcagagatggtagttctgcctcagggaaacaatggccaatgggaaatcaaatacagaagacmactgagcagatacattctccattctccctcctctctctcatccctggactaatgccggctgtggtttccccttgtagcccttctggaaaagtgctgggagccaagtgtacgcatctgatgaccgtcatgctgtctctctcacctcactgtgaagtggctgccagcagagtcataccagacatcaccacacattgtttcacatttgttcctgtctcaatttccacatatccttgccatttttgtcttgaacttgatttctaaataaatgtcatcaccttaataacaggtaatacataaaaa

SEQ ID NO: 108300 - DNA, 601 bp, Human
acttgcaagttacaggggatggtagtcctttctataaccggattcacttaacctatctggcctctaccaaaaccagatggattatagaatgagtgcagattaccataaacttcaatcaacactcacaaatgctttctaggatgtactgtcttcacagagcagagcatagcttctggcactttttacggggctcgtcatttggtgaatatttgttaatctacaccctttatgagggaaaatcaagacaatttgccttgtattgtaagaataatagcactgcttcactgttttatgtcaggamtatgtcacttctgttctctgtttaatttacatttttttaaaaacatcatgctaatttaatatattaataatattacagcccgggccctgtggcacatgattgtaattccagcactttaggaggctgacttgggcccaggagtttgaaaccagcctgggtaacatggtgaaatcccagccctacaaaaaataccaaaattagccaggcaaggtggtgtgtccctgcagtcccagctgctagcaatgctgaggagggagaatcaactgagcccagaaggttgaggctgcaatgagctatgat

SEQ ID NO: 108301 - DNA, 601 bp, Human
ctctgttacccaagctggagtacagtggcaggatcatagcccactacagccttgaaaccctgggctcaagcaatcctcctgcctcagtttcccaagtatttggaactataggcatgcagcaccacgccagctaatttttcaattttttgtagacatggagtttccatatgttgcaaagggaactcctgctctcaagggattctcccaccttggcctcccaaactactaagactacaggcatgagccatcacatccagcctgcagggggaggttttgaaggtcagatgctacctagagtttygtctcatgtccatcccaaggtggatctaatcagtttgtagttactacctcttcctgaacgtgtaattgaactggatacgtatggcagctggcaggactttcacattcttcgtgaactgtagagtaagggacattattatagcaggaccaagttgaagcctctgaaattctccactgctggcaacccaatgtataaaatataataaccgcattccctaaggaatggaactggtcactgccgtgacaaaacacttgcaagttacaggggatggtagtcctttctataaccggattcacttaa

SEQ ID NO: 108302 - DNA, 601 bp, Human
tccctctgttacccaagctggagtacagtggcaggatcatagcccactacagccttgaaaccctgggctcaagcaatcctcctgcctcagtttcccaagtatttggaactataggcatgcagcaccacgccagctaatttttcaattttttgtagacatggagtttccatatgttgcaaagggaactcctgctctcaagggattctcccaccttggcctcccaaactactaagactacaggcatgagccatcacatccagcctgcagggggaggttttgaaggtcagatgctacctagagytttgtctcatgtccatcccaaggtggatctaatcagtttgtagttactacctcttcctgaacgtgtaattgaactggatacgtatggcagctggcaggactttcacattcttcgtgaactgtagagtaagggacattattatagcaggaccaagttgaagcctctgaaattctccactgctggcaacccaatgtataaaatataataaccgcattccctaaggaatggaactggtcactgccgtgacaaaacacttgcaagttacaggggatggtagtcctttctataaccggattcact

SEQ ID NO: 108303 - DNA, 601 bp, Human
agactccgtctcgagaaaacaacaacaaaaaaagcagatgataataaatctgtctttggctagttttcttatgagttaacatactatttgtataactgctttccattttacctttttgctataggcaggaaccaaagattgttaattattgatttgaacctgttttacttgatatttaagacaccagtaagaactttcacttttttttttttcttcttagacagagtctccctctgttacccaagctggagtacagtggcaggatcatagcccactacagccttgaaaccctgggctcaarcaatcctcctgcctcagtttcccaagtatttggaactataggcatgcagcaccacgccagctaatttttcaattttttgtagacatggagtttccatatgttgcaaagggaactcctgctctcaagggattctcccaccttggcctcccaaactactaagactacaggcatgagccatcacatccagcctgcagggggaggttttgaaggtcagatgctacctagagttttgtctcatgtccatcccaaggtggatctaatcagtttgtagttactacctcttcctgaacgtgtaattga

SEQ ID NO: 108304 - DNA, 601 bp, Human
ttcttttcagtttttacagtatgatggtttctaagaggggatcttggagtcagactgccaggacaggaaaccagattccctgcttggtatagctatgatctgagactccattttacaactactccctgcctcagtattatcacctataaaaagcagatgattggccaggcccgtggctcccagcaatttggcaggctgaggcaggtggatcacctgaggttaggacttcaagaccagcatggccaacatggtgaaactctatatccactagaaatgcaaaaattagccaggtgtggtggtrcccgtctgtaatcccaggtactcagatggctgcagcaaaagaatcatttgaacccaggaggtggaggttgtagttagtcgagatcacaccactgcacaccagcctgggagacagagctagactccgtctcgagaaaacaacaacaaaaaaagcagatgataataaatctgtctttggctagttttcttatgagttaacatactatttgtataactgctttccattttacctttttgctataggcaggaaccaaagattgttaattattgatttgaacctgttttacttgatatttaagac

SEQ ID NO: 108305 - DNA, 601 bp, Human
tatttcttttcagtttttacagtatgatggtttctaagaggggatcttggagtcagactgccaggacaggaaaccagattccctgcttggtatagctatgatctgagactccattttacaactactccctgcctcagtattatcacctataaaaagcagatgattggccaggcccgtggctcccagcaatttggcaggctgaggcaggtggatcacctgaggttaggacttcaagaccagcatggccaacatggtgaaactctatatccactagaaatgcaaaaattagccaggtgtggtrgtgcccgtctgtaatcccaggtactcagatggctgcagcaaaagaatcatttgaacccaggaggtggaggttgtagttagtcgagatcacaccactgcacaccagcctgggagacagagctagactccgtctcgagaaaacaacaacaaaaaaagcagatgataataaatctgtctttggctagttttcttatgagttaacatactatttgtataactgctttccattttacctttttgctataggcaggaaccaaagattgttaattattgatttgaacctgttttacttgatatttaa

SEQ ID NO: 108306 - DNA, 601 bp, Human
tcttacttgggcttttcagtgcattttcaatctttatcaaacttagcctctcatatttaggactttgactaaattattctcttgagcctaatacttaaatattagttgtttaattaaaatactcagcaattttataactattccttgggcacttaaaaaacatgttttccattgaagagtctacacttctctgtgtatgaatagtcagttgtattttcctctatttaattcatttttgattacttaatggtttagatgaatagatgttaaaatcagtctccaatcttggatttttatttcytttcagtttttacagtatgatggtttctaagaggggatcttggagtcagactgccaggacaggaaaccagattccctgcttggtatagctatgatctgagactccattttacaactactccctgcctcagtattatcacctataaaaagcagatgattggccaggcccgtggctcccagcaatttggcaggctgaggcaggtggatcacctgaggttaggacttcaagaccagcatggccaacatggtgaaactctatatccactagaaatgcaaaaattagccaggtgtggtggtgccc

SEQ ID NO: 108307 - DNA, 601 bp, Human
tctcatttgccagcatgcaaatcaggtcatattcttattcatcattttgccatttattccttgtttaacctctctataatttgtgctgagcaatggcagttgtaagggaaattttctaacctaatacatagatcgtacatcagatgcctacactgttatatgcagctcggtcaaaactagaatcacgaccactgttgattcaccttttctgtgccagatttagtgagtcctaacttttcctaccaaaagcatccaacgttttcttgggaagcccaggaaggccaatattcctaaaaatctsgttgctgccaactaataattttgtataacttattgttaacaagctcattaacacaaacacgttcacacacacacatacacacacctcatagttgggaaatattattgtcctataatttctaaaatgaaaaaataattttcttacttgggcttttcagtgcattttcaatctttatcaaacttagcctctcatatttaggactttgactaaattattctcttgagcctaatacttaaatattagttgtttaattaaaatactcagcaattttataactattccttgggcacttaaaaaaca

SEQ ID NO: 108308 - DNA, 601 bp, Human
ataagataaaatgtttcatgctgatgttgaagtaaaagctgaattctcatttgccagcatgcaaatcaggtcatattcttattcatcattttgccatttattccttgtttaacctctctataatttgtgctgagcaatggcagttgtaagggaaattttctaacctaatacatagatcgtacatcagatgcctacactgttatatgcagctcggtcaaaactagaatcacgaccactgttgattcaccttttctgtgccagatttagtgagtcctaacttttcctaccaaaagcatccaasgttttcttgggaagcccaggaaggccaatattcctaaaaatctcgttgctgccaactaataattttgtataacttattgttaacaagctcattaacacaaacacgttcacacacacacatacacacacctcatagttgggaaatattattgtcctataatttctaaaatgaaaaaataattttcttacttgggcttttcagtgcattttcaatctttatcaaacttagcctctcatatttaggactttgactaaattattctcttgagcctaatacttaaatattagttgtttaattaaa

SEQ ID NO: 108309 - DNA, 601 bp, Human
tataagataaaatgtttcatgctgatgttgaagtaaaagctgaattctcatttgccagcatgcaaatcaggtcatattcttattcatcattttgccatttattccttgtttaacctctctataatttgtgctgagcaatggcagttgtaagggaaattttctaacctaatacatagatcgtacatcagatgcctacactgttatatgcagctcggtcaaaactagaatcacgaccactgttgattcaccttttctgtgccagatttagtgagtcctaacttttcctaccaaaagcatccarcgttttcttgggaagcccaggaaggccaatattcctaaaaatctcgttgctgccaactaataattttgtataacttattgttaacaagctcattaacacaaacacgttcacacacacacatacacacacctcatagttgggaaatattattgtcctataatttctaaaatgaaaaaataattttcttacttgggcttttcagtgcattttcaatctttatcaaacttagcctctcatatttaggactttgactaaattattctcttgagcctaatacttaaatattagttgtttaattaa

SEQ ID NO: 108310 - DNA, 601 bp, Human
taatgtcaagcaggaacgcaccgggccatgctactgaatgagttcaaggctgtcttaatggaaaacatgataatttccaaaacagctcaaattaactcctattcaaatgctgtgaccttgttataagataaaatgtttcatgctgatgttgaagtaaaagctgaattctcatttgccagcatgcaaatcaggtcatattcttattcatcattttgccatttattccttgtttaacctctctataatttgtgctgagcaatggcagttgtaagggaaattttctaacctaatacatagatcstacatcagatgcctacactgttatatgcagctcggtcaaaactagaatcacgaccactgttgattcaccttttctgtgccagatttagtgagtcctaacttttcctaccaaaagcatccaacgttttcttgggaagcccaggaaggccaatattcctaaaaatctcgttgctgccaactaataattttgtataacttattgttaacaagctcattaacacaaacacgttcacacacacacatacacacacctcatagttgggaaatattattgtcctataatttctaaaatgaaaaaata

SEQ ID NO: 108311 - DNA, 601 bp, Human
ttgttactctttttaaattctatgagtgtgattttatgcacatttattaataatgaattatatattttatatatgtattcattttcctttattcgtttttctaatattttttaaagttttaagtgctcttttattatgaacacatgtaattatactagacatacttcttttaaccaaatattatgccaaatgactttgagaaaatatgattagttaacagcatactgtaaggcaactttcagcattgtttaacaactacttaaaaggacccaaagaaaataatatgttgaaatatcaaatmagtatataagtgtaatgaaggtgcctatgggaaaatacaaattctaccattactgttatggataataatgatgagtagtaaacataccatgtctgaatttttttaaggcaggcctaatatcaatgggcaatattccctttaaggtcctgaccttaatttctatgtgcacctgatttctgattgtgcagtaatgttcttgttccttttaaattctctgactaatgtcaagcaggaacgcaccgggccatgctactgaatgagttcaaggctgtcttaatggaaaacatgataatttccaaa

SEQ ID NO: 108312 - DNA, 601 bp, Human
atatacaccatagaatactatgcaaccataaaaaaggatgagatcatgtcctttgcagggacatgtatgaagcaggaaactcaataatatttacataaagtattattaaaactaacattttataagcctttttctattataatttagaatgtatccttaattcaaaaattgttactctttttaaattctatgagtgtgattttatgcacatttattaataatgaattatatattttatatatgtattcattttcctttattcgtttttctaatattttttaaagttttaagtgctcttttrttatgaacacatgtaattatactagacatacttcttttaaccaaatattatgccaaatgactttgagaaaatatgattagttaacagcatactgtaaggcaactttcagcattgtttaacaactacttaaaaggacccaaagaaaataatatgttgaaatatcaaatcagtatataagtgtaatgaaggtgcctatgggaaaatacaaattctaccattactgttatggataataatgatgagtagtaaacataccatgtctgaatttttttaaggcaggcctaatatcaatgggcaata

SEQ ID NO: 108313 - DNA, 601 bp, Human
gtatgttcattgcggcactattcacaatagtgaagactgggatccaacccaaatgtccatcaatgatagattggctaaagaaaatgtggcacatatacaccatagaatactatgcaaccataaaaaaggatgagatcatgtcctttgcagggacatgtatgaagcaggaaactcaataatatttacataaagtattattaaaactaacattttataagcctttttctattataatttagaatgtatccttaattcaaaaattgttactctttttaaattctatgagtgtgattttatgcayatttattaataatgaattatatattttatatatgtattcattttcctttattcgtttttctaatattttttaaagttttaagtgctcttttattatgaacacatgtaattatactagacatacttcttttaaccaaatattatgccaaatgactttgagaaaatatgattagttaacagcatactgtaaggcaactttcagcattgtttaacaactacttaaaaggacccaaagaaaataatatgttgaaatatcaaatcagtatataagtgtaatgaaggtgcctatgggaaaatacaa

SEQ ID NO: 108314 - DNA, 601 bp, Human
tttttggctgtttaattttattccacttttatatgaacttacacaaatactctgtgcaattataaagtgtataagcttcatcttttaatagcattattaacaagtgaaattctctctactgtttatttttaatctcagctactgtcacaaaatctgggtgattttattacagcagtcaaagtagttacactaaatatgctttatgcctcaacaaaattatctttctactaattcttctctaatattcaaaaactttgtactatcaaaatatttttcctcacatatgtgtacacatgcatgrtataatctttgaatggtaaaaatgggcataattatttcatttagagataaatttataaaaattgtcctgtgtatttaatatctatattactataatttattggaaattcactaatttctgcctctttgaaatgttatcataaataatgaaattggaaataagaaaaaaaggtgtctagtgtaatacagatgctcagaatctgatgtttcttttttttttttttttttttttttgagacggagtcttgctctgtcacccaggctggagtgcagtggcgagatctcggctcactgcaagctc

SEQ ID NO: 108315 - DNA, 601 bp, Human
ttattctcagaatcaggcctagacaaataccctcacatagtatttcatcaagagtaacacaaaatcaacatatttctaatgatttgcaagatattttttcttttaccacattctaaaaattaccccaaaagtgacctctagcaaagaatactctctttttggctgtttaattttattccacttttatatgaacttacacaaatactctgtgcaattataaagtgtataagcttcatcttttaatagcattattaacaagtgaaattctctctactgtttatttttaatctcagctactgtsacaaaatctgggtgattttattacagcagtcaaagtagttacactaaatatgctttatgcctcaacaaaattatctttctactaattcttctctaatattcaaaaactttgtactatcaaaatatttttcctcacatatgtgtacacatgcatggtataatctttgaatggtaaaaatgggcataattatttcatttagagataaatttataaaaattgtcctgtgtatttaatatctatattactataatttattggaaattcactaatttctgcctctttgaaatgttatcataaata

SEQ ID NO: 108316 - DNA, 601 bp, Human
cttacttctgtttgatttatttagccctaaaatcctctctttagaaataagagcttgatcatgaaatggtttatttatttttcttactaagcaattttatttatactaaaatcaaaatctttttatagtgttccttggattagtttaatatcatctataattgttttcttaagcaatgtattttaaactacactacactacacttaactttctaaatctcaatgtattcagcctgacatgaactttgctgtttactaatgtaactttcccacaatgatatctcttggaaattacatagacrttacccaaattatgtatgtaaatatttcagaaataaatcatttaataagacagatgtaaatgtagatgatgataataatgatgatgatgtcacctgaaagggagaatgttactaaataattgtgattcgagtcttcttttcaaagcactagagttaagggtggtgggagaacactattattcatcctcatggctttacattttgtgtgtgtgtgtgtgtgagatggagtttcgctcttgtcacccaggctgcagtgcaatggcacaatctcagctaactgcaacctccgcctccaaggtt

SEQ ID NO: 108317 - DNA, 601 bp, Human
ttctcagtactgatatttcatttttttagtcttattgttttagtgttcagaataatcttttattctctttctgaacattattttctataggaaaactgaacaaactactcttaacactctgttctttttaaaaatgtttctgatttttttgattttttttttttgttttagtatgttagaaatgaaaacggtaacaattttcttcttttcccaacactttagtcagagaatagaataaaagctttgtgttagaatttaccttcaatttgaaagaaactggaaattaagttgatgtgagtasctttttttggatattagcttgtctgttgctgggtccccaccacaaactctgctcaaagggaactcaaagagcagcactggatttcaaaatatcattgcaatagataaaatatagttcattaaccacagatacatcattgtattccatgacataattttcactttgcttatgttgttgaaaaggtgctctgtgcctttgaattacatcattatccaaatgatatagacaagatgtgggggagagcttacttctgtttgatttatttagccctaaaatcctctctttagaaataagagcttg

SEQ ID NO: 108318 - DNA, 601 bp, Human
cagtctctttattgctatttgcatatatcttatcaattatacatttaatccaacaagacaatattgttttatacagtcaacatttatttagaattacacacttatttttcgtcattaatttttattgctccttgcatgttcaactttgtattttcagtaatttttattatatctgaaaaatatcattttcaatttctgtttatgaaggtctactactctttggaaacacactgaagacatgattccattgaattcctccttccatattttctgttaaaatcaggttgtatttagaatgcarttcttatcaacatactctatcttctacctctagctacttttcagattttctactggtctttggtgtcctgtattattttttgttaacttgattttagttatcatgcctgaagtttgtgattactaaagatatatgctgggatacattttcacttttggaaaaatccctgcaacatttctctcgctctgttttctctcctctaatcttacagaactctacaagtatgttaggtgttttgatgatagcatcagtgtgttaccctctagccttgcattttccatttctttctctctatgcttc

SEQ ID NO: 108319 - DNA, 601 bp, Human
atagaaaagcccaaaacacagtttgactaaatttattcctgtcacctttatctccagtctctttattgctatttgcatatatcttatcaattatacatttaatccaacaagacaatattgttttatacagtcaacatttatttagaattacacacttatttttcgtcattaatttttattgctccttgcatgttcaactttgtattttcagtaatttttattatatctgaaaaatatcattttcaatttctgtttatgaaggtctactactctttggaaacacactgaagacatgattccwttgaattcctccttccatattttctgttaaaatcaggttgtatttagaatgcagttcttatcaacatactctatcttctacctctagctacttttcagattttctactggtctttggtgtcctgtattattttttgttaacttgattttagttatcatgcctgaagtttgtgattactaaagatatatgctgggatacattttcacttttggaaaaatccctgcaacatttctctcgctctgttttctctcctctaatcttacagaactctacaagtatgttaggtgttttgatgatagc

SEQ ID NO: 108320 - DNA, 601 bp, Human
tgtttttccattttatgattttattgtaattatttattcatccttatttgatgtacatatgggcagcttcttttctgagctgttagaataattctacaatgagcattctttcacatatcatttgctacaattcctttgcatatatatagctgggtgtagaattacagcgtccttgattatgacattcaaattctcctcacagacatagaaaagcccaaaacacagtttgactaaatttattcctgtcacctttatctccagtctctttattgctatttgcatatatcttatcaattatacrtttaatccaacaagacaatattgttttatacagtcaacatttatttagaattacacacttatttttcgtcattaatttttattgctccttgcatgttcaactttgtattttcagtaatttttattatatctgaaaaatatcattttcaatttctgtttatgaaggtctactactctttggaaacacactgaagacatgattccattgaattcctccttccatattttctgttaaaatcaggttgtatttagaatgcagttcttatcaacatactctatcttctacctctagctacttttc

SEQ ID NO: 108321 - DNA, 601 bp, Human
tttcacttctctatgtttttccattttatgattttattgtaattatttattcatccttatttgatgtacatatgggcagcttcttttctgagctgttagaataattctacaatgagcattctttcacatatcatttgctacaattcctttgcatatatatagctgggtgtagaattacagcgtccttgattatgacattcaaattctcctcacagacatagaaaagcccaaaacacagtttgactaaatttattcctgtcacctttatctccagtctctttattgctatttgcatatatcktatcaattatacatttaatccaacaagacaatattgttttatacagtcaacatttatttagaattacacacttatttttcgtcattaatttttattgctccttgcatgttcaactttgtattttcagtaatttttattatatctgaaaaatatcattttcaatttctgtttatgaaggtctactactctttggaaacacactgaagacatgattccattgaattcctccttccatattttctgttaaaatcaggttgtatttagaatgcagttcttatcaacatactctatcttctacct

SEQ ID NO: 108322 - DNA, 601 bp, Human
tggtctgcttggaactctgtatagatacaatcctatatgttcgtattcatggcttcctgtgctcaacattatggatctgaaatgtaatcacataactgcatgtacatgtgattcatttcttttcacttctctatgtttttccattttatgattttattgtaattatttattcatccttatttgatgtacatatgggcagcttcttttctgagctgttagaataattctacaatgagcattctttcacatatcatttgctacaattcctttgcatatatatagctgggtgtagaattacagsgtccttgattatgacattcaaattctcctcacagacatagaaaagcccaaaacacagtttgactaaatttattcctgtcacctttatctccagtctctttattgctatttgcatatatcttatcaattatacatttaatccaacaagacaatattgttttatacagtcaacatttatttagaattacacacttatttttcgtcattaatttttattgctccttgcatgttcaactttgtattttcagtaatttttattatatctgaaaaatatcattttcaatttctgtttatgaaggtc

SEQ ID NO: 108323 - DNA, 601 bp, Human
ttacacagagatttaagacggtttccatattggagtttcttgctcttttccattcaccatgagaacatcatctggtgagtacactgttcccagaagaagaatgagaaactaatggagtcagaatgccactgctttatccagcctaaatcagccaaagtagcttcaagatgcagaatgtggcccatctccaatcaccacagccatccaccaaacctagctgacaaaaatgaaatccaaagacacatgagacacaaatatctaatgcagttttggaggattttctcttgcagaaaaacttaartgatataggtattctgctaagccaagcgtgtgggaaacatgtccacccctgttgtgtcaggaattcaggatccaagggaaaaatagatggaaaatgtcaatgttttgtcacatgaagtagataattaaaactagaagaaatatctactgaaaaatctggggttggcaggaaacatcttgtcaaattttcagtagtcacaactaaaatcaaaaattttctaattaaaatcttttagagctgtacatgaatgtatacagtgtatttttccctttggtatataatgagcagagtaataataat

SEQ ID NO: 108324 - DNA, 601 bp, Human
acttggactctgaattcactcatgtaatttgcttcagtgaacagcaaattagtagactttacacagagatttaagacggtttccatattggagtttcttgctcttttccattcaccatgagaacatcatctggtgagtacactgttcccagaagaagaatgagaaactaatggagtcagaatgccactgctttatccagcctaaatcagccaaagtagcttcaagatgcagaatgtggcccatctccaatcaccacagccatccaccaaacctagctgacaaaaatgaaatccaaagacayatgagacacaaatatctaatgcagttttggaggattttctcttgcagaaaaacttaagtgatataggtattctgctaagccaagcgtgtgggaaacatgtccacccctgttgtgtcaggaattcaggatccaagggaaaaatagatggaaaatgtcaatgttttgtcacatgaagtagataattaaaactagaagaaatatctactgaaaaatctggggttggcaggaaacatcttgtcaaattttcagtagtcacaactaaaatcaaaaattttctaattaaaatcttttagagctgta

SEQ ID NO: 108325 - DNA, 601 bp, Human
ctggttgtgattcccttaatatccagaccttaatgtcgataaacacttgacttttaaatgtgcagtaacattttctgcctttaaattcatgactaatttcaacaggaaagcaccatcatatgctaatggatgaattcaaagctgtctttatagaaatagaaaatattcttattctcaaaacagctcaaattcactcctcttcatacactgtctgtcttactatatgctgaaatattttatattgaggatgaagtgaaaagtaaattctcatgtgttagtatgcaaataaaggcattttttwaattgttttgcaattgttgtccttgctaacctctccataatttgtgtccagcatcgtcagttgttacatagggaaattttaaaacccaatacacatatcatacagtacaggtttaaattgtttaaggagcttggtcataactaggataataccaatatggtttgtttaataccagaatctaaaccttttatcaatatcatccaagattattttggaaagtcctgggaggccaatacaccttaaaatctggtttctgataaccaatacatttatatgacatcattgttaataagctcctca

SEQ ID NO: 108326 - DNA, 601 bp, Human
tttgaaagctgtattgcattcctcaatttgatcatccaagacaaatttccttcatattcttttgtccacacactctcacccgtggttatcagagcaagattacaaatgaaaaataccaagggccccaacagcatcaccaaaccaacattcttaatcctcttctttaggtggagaaaaataaggttggagaaattggcagtcttgagcaaatgaaatatgctgaggctagtaacacccagatgctgaaatgcttggttattgctgagacattagaaccaaaaattcttacttctaatctatrtgaagccaaattaaacacagttgcataccaatgtaataatatgacccagagtaaaccaattctggacaccaccagagcagtgagaaatttggtcagctgatgagatcttttgtgtcttaacccactcaaggacacctactagagctatgaagccattggcaacatttccaagaacaaatgcaaacactaccagaattgataaaatgatgagcagaaaacatatcatgtttgaacaaatgaaaagtaaagtaaaaaatgcagccttaataacactggttgtgattcccttaatatccagac

SEQ ID NO: 108327 - DNA, 601 bp, Human
caccttggtgctgagatgttgagatcctttgccatggagctgcatcttcttgacatgtttacatggagaatagattaacagcagaaaagatattagtgtcagagtgcagggtgtgacgtttgctggcatggttacagtcaagtttgaaagctgtattgcattcctcaatttgatcatccaagacaaatttccttcatattcttttgtccacacactctcacccgtggttatcagagcaagattacaaatgaaaaataccaagggccccaacagcatcaccaaaccaacattcttaatcctyttctttaggtggagaaaaataaggttggagaaattggcagtcttgagcaaatgaaatatgctgaggctagtaacacccagatgctgaaatgcttggttattgctgagacattagaaccaaaaattcttacttctaatctatatgaagccaaattaaacacagttgcataccaatgtaataatatgacccagagtaaaccaattctggacaccaccagagcagtgagaaatttggtcagctgatgagatcttttgtgtcttaacccactcaaggacacctactagagctatgaagccattg

SEQ ID NO: 108328 - DNA, 601 bp, Human
gttgatgtgattagacacagaaagtaaatggcaaataacataaggaaggagatcacagtttgcaaagcttttatgtgcaccttggtgctgagatgttgagatcctttgccatggagctgcatcttcttgacatgtttacatggagaatagattaacagcagaaaagatattagtgtcagagtgcagggtgtgacgtttgctggcatggttacagtcaagtttgaaagctgtattgcattcctcaatttgatcatccaagacaaatttccttcatattcttttgtccacacactctcacccrtggttatcagagcaagattacaaatgaaaaataccaagggccccaacagcatcaccaaaccaacattcttaatcctcttctttaggtggagaaaaataaggttggagaaattggcagtcttgagcaaatgaaatatgctgaggctagtaacacccagatgctgaaatgcttggttattgctgagacattagaaccaaaaattcttacttctaatctatatgaagccaaattaaacacagttgcataccaatgtaataatatgacccagagtaaaccaattctggacaccaccagagcagt

SEQ ID NO: 108329 - DNA, 601 bp, Human
tatgtgtgtgtgtgtgatagatagatagatagatagatagatagatagatagatgacttttctaggtatctgttttgaaattattcaaatatatacactaaggaaaaacgaatggaaatataaaatgttccagataccgtcagtttgttttcagctaaaagatacacaatgctccctttgtgaatctatggagttgagggtttctgtcctttcactcagcatttcacctgtcacaaagctgaaagaaaggtctgttttggcttcctacttcccatagtcaggatgaatgagtggaacaaargatacatgaatccaagagtttggtaaagcaggaatacaagtttgctctgctgagtcctaggattccaagttgatgtgattagacacagaaagtaaatggcaaataacataaggaaggagatcacagtttgcaaagcttttatgtgcaccttggtgctgagatgttgagatcctttgccatggagctgcatcttcttgacatgtttacatggagaatagattaacagcagaaaagatattagtgtcagagtgcagggtgtgacgtttgctggcatggttacagtcaagtttgaaagctgta

SEQ ID NO: 108330 - DNA, 601 bp, Human
agaggttcaaacaatgatagttaagtacatatatgtggtacaaattacaatggaaaacaacaatgatttcctgataaaagctgtaagttcctaattataaatagaggtaataaattcttcacatgaaataccataggatgaactatcataaaatatacctacatatatatgtgaaatatactcggcttcataatttgtggtcaatgttgttattcacacacatgcacacatatacccacacacatatatgtgtgtgtgtgtgatagatagatagatagatagatagatagatagatagataacttttctaggtatctgttttgaaattattcaaatatatacactaaggaaaaacgaatggaaatataaaatgttccagataccgtcagtttgttttcagctaaaagatacacaatgctccctttgtgaatctatggagttgagggtttctgtcctttcactcagcatttcacctgtcacaaagctgaaagaaaggtctgttttggcttcctacttcccatagtcaggatgaatgagtggaacaaaggatacatgaatccaagagtttggtaaagcaggaatacaagtttgctctgctgag

SEQ ID NO: 108331 - DNA, 601 bp, Human
aaagatccattctcatcattaatttagaattgaatgtttttaccatccaaaaaattagaggttcaaacaatgatagttaagtacatatatgtggtacaaattacaatggaaaacaacaatgatttcctgataaaagctgtaagttcctaattataaatagaggtaataaattcttcacatgaaataccataggatgaactatcataaaatatacctacatatatatgtgaaatatactcggcttcataatttgtggtcaatgttgttattcacacacatgcacacatatacccacacacayatatgtgtgtgtgtgtgatagatagatagatagatagatagatagatagatagatgacttttctaggtatctgttttgaaattattcaaatatatacactaaggaaaaacgaatggaaatataaaatgttccagataccgtcagtttgttttcagctaaaagatacacaatgctccctttgtgaatctatggagttgagggtttctgtcctttcactcagcatttcacctgtcacaaagctgaaagaaaggtctgttttggcttcctacttcccatagtcaggatgaatgagtggaacaa

SEQ ID NO: 108332 - DNA, 601 bp, Human
tcattagttttacaacttagtctacagattctgaattatagagaacagctcatgatggaattggggagaatattggcatcatccggagatgatacatttgtatcaggatgaaattggaaaagggagcacatttctgaatcatcaagattagtggtttgaaaacacgtctaagtgctttgactcacctcatatggatagatggagtctattcccctccacatccaaactagccttcatgatgtgttaagtaaatgttctgtcacagaactgacacagaagaacttccaatgtttaaaaagcyggcgccttcttgtcacatgtgcccttggggccttgagccaaatgctggagaacctatgtcaagaaacaaaataaaaatagaaagagatgcttgaggagcctcagctcactgcccacccacaatgaaacatatgattaatacatttcctatcatcaatatatagattagacagataattttcaatatttgcagaatgtttcattcaattgtgatccatagtttatataccctgtttacattgagtttattttaagagagggaataattgaatttttttgagaaatattaagaatgggagac

SEQ ID NO: 108333 - DNA, 601 bp, Human
gacaaagctttggatagtttatattcagaagttggggctccccttttctggccttctcctttctcagattttctcctgacctcctgctgctcgtgttatgccaaactcagtcctctgttacttcaacccagtaagtctacagttttcttctgacgttttagtcctctgcctggtgcacactagggccagctataaaatcaggaaactcactccttgctattcccttcttccaagtgctgacctctctctagtatctgcctattttgttcattctccattgccaatgaatggctgttttttwaaatattttatccagaatttataaaaagtatctgtgggaggcttggtcctatgggttttatttgatctttagtgtaagaaaaaaatgttgtatgtatatttttctacttatcatgtttccctctttctttggcccactatttcatgtagaatacattgacagtcattagttttacaacttagtctacagattctgaattatagagaacagctcatgatggaattggggagaatattggcatcatccggagatgatacatttgtatcaggatgaaattggaaaagggagcacatttctgaa

SEQ ID NO: 108334 - DNA, 601 bp, Human
gtgcaatttaagaccttagactaatattaaattcagtgagttgatgaaaatcttcggataatttctagttaagttggaatactgaaatgtggtcaccaatcaaaggttatataataaataaatataacttttattcttatattttatggagtggctatttgtttggattacactatgaaacatgggggttttgtagaccaattcaagcaagtgtaaaaaggatgtatatgactatagaaagttgtaatatatgcgcttgagaattttgcacatctgccaaaatagttatttttaatagtcytcaattacataacttccagttttctccttgaaagagaattactttgattagtgtaattaataaaagtaggagttagaaccaaggtagaaaccagaatggacaaggaatatgactgttatgaaaggtaatggaatgtagtttaggttttcaagaatagagtatctttgcctaaagtaatatgttttgttgctatctctgtcttcactgtgcttgatgataactgaaatctcaatttaattattttagctgggctacatgaagtctgccctatacatgcatggtatagggaccagacaaagc

SEQ ID NO: 108335 - DNA, 601 bp, Human
ttattttctctagcctatcagcttaaatttaatttccaagattcctggtgcaatttaagaccttagactaatattaaattcagtgagttgatgaaaatcttcggataatttctagttaagttggaatactgaaatgtggtcaccaatcaaaggttatataataaataaatataacttttattcttatattttatggagtggctatttgtttggattacactatgaaacatgggggttttgtagaccaattcaagcaagtgtaaaaaggatgtatatgactatagaaagttgtaatatatgygcttgagaattttgcacatctgccaaaatagttatttttaatagtcttcaattacataacttccagttttctccttgaaagagaattactttgattagtgtaattaataaaagtaggagttagaaccaaggtagaaaccagaatggacaaggaatatgactgttatgaaaggtaatggaatgtagtttaggttttcaagaatagagtatctttgcctaaagtaatatgttttgttgctatctctgtcttcactgtgcttgatgataactgaaatctcaatttaattattttagctgggct

SEQ ID NO: 108336 - DNA, 601 bp, Human
aggctgggaaaggtagtggaggctaaagggaaggagtggctggttaatggttaccaaaaaaaaaaaaaaatagaaagaattaataagacctactatttgatagcacagcagggtgactataatcaatgataattcagttgtacattttaaaatgactgaaagagtataactgaattgtttgtaacaaaaaagagtaaatgtttgaggggatggctaccccattcttcattatgtgacattgcatgcctgtatcaacacatctcatgtacccaataaatgtatgcacctagtatgtatccaygaaacttaaaaatacattttaaaaaaagaaattcctaaacttcctatatctgtttactgataaggtaaattaatatgtccacataatgttaaaataccaaaaaatgtaaaattatgctttcaaataaactgaatacaaattatgaaaaactccacatattgacagtaattattttctctagcctatcagcttaaatttaatttccaagattcctggtgcaatttaagaccttagactaatattaaattcagtgagttgatgaaaatcttcggataatttctagttaagttggaatactga

SEQ ID NO: 108337 - DNA, 601 bp, Human
tagcactgttcacaatagccatgatttggaagcaacctgagtgtccagcaacagattaatagataaagataatatggtacatatacacaatggagtacaattgagccattaaaaaatgagatcctgtcatttgcagcaatatatggatagaattggagattattatgttaagttgaatacatcagaaacaactgcaatgtttgcacagaaggcatggacatagagagtacatggatgctaaacaaaggctgggaaaggtagtggaggctaaagggaaggagtggctggttaatggttaccaaaaaaaaaaaaaaatagaaagaattaataagacctactatttgatagcacagcagggtgactataatcaatgataattcagttgtacattttaaaatgactgaaagagtataactgaattgtttgtaacaaaaaagagtaaatgtttgaggggatggctaccccattcttcattatgtgacattgcatgcctgtatcaacacatctcatgtacccaataaatgtatgcacctagtatgtatccatgaaacttaaaaatacattttaaaaaaagaaattcctaaacttcctatatctgttt

SEQ ID NO: 108338 - DNA, 601 bp, Human
ttagagctaccatatgttccaccaatctcactggtgtgtatatacccaaaagaaaggaaataagtgtatcaaacaggtatctacactcccatgtttgttgtagcactgttcacaatagccatgatttggaagcaacctgagtgtccagcaacagattaatagataaagataatatggtacatatacacaatggagtacaattgagccattaaaaaatgagatcctgtcatttgcagcaatatatggatagaattggagattattatgttaagttgaatacatcagaaacaactgcaatgtatgcacagaaggcatggacatagagagtacatggatgctaaacaaaggctgggaaaggtagtggaggctaaagggaaggagtggctggttaatggttaccaaaaaaaaaaaaaaatagaaagaattaataagacctactatttgatagcacagcagggtgactataatcaatgataattcagttgtacattttaaaatgactgaaagagtataactgaattgtttgtaacaaaaaagagtaaatgtttgaggggatggctaccccattcttcattatgtgacattgcatgcctgtatcaac

SEQ ID NO: 108339 - DNA, 601 bp, Human
actcacaaaagccacacataaaattaaatagctgaagattaactcaaccaaagagatgaaagatctctataatgaaaactataaaacactaatgcaagaaattgaaaaggacacccaacaaaagaaaagatggtccatgtccatggattagaagtatcaacattgttaaaatggccatactacccaaagaatctacagattcaatgtaattcctatcaaaatactaaaaacattcttcacagacatagagaaaacaatcctaaaatttatatggagccacaactgacccagaatagccaaragtatcctaagaaaaaagaacaaaagtggaggaatcatgttacctgacttcatattatactacagaggctgtagtaaccaaaacagcatgttactggcattaagacagacacatagaccaacggaatagaatagacaacttggaaacaaatccacacacctacagtgaactcatttttgaaaaagatgccaagaacgtacactggaaaaagacagtctcttcaataaatggtgctgggacaactgaatatccctatgcagaagaatgaaactagtcccatatatctatacaaatatcaaa

SEQ ID NO: 108340 - DNA, 601 bp, Human
caaaacctgataagaccaaaaacaggtaatgagataaattctgcaataaaatgtctcccagtttaaaaaaaaaaaaaaaaaaaagcctgggagcagacggctttagatctgaattctaccaaacatttaaagaactgatgccaatcctactcaaactcttctgaaaaaatagagaaagagggactacttccaggctcattcttttttttttttttttttttttttgaggcagagtctcactctgtcacccaggctggagttcagtggcatgctctccactcactgcaagcgccacctcccrggttcacgccattctcctgcctcagcctcccgagtagctgggactacaggcgcccaccaccacgcccggctaaatttttgtatttttagtagagacggggtttcactgtgttagccaggatggtcttgatctcctgacctcgtgatccaccgaactcagcctcccaaagtgctgggattacaggcgtgagccaccaggcccggcccaggcttattcttgaaaatcttattaccctgataccaaaaccagacaaagacacattgaaaaaggaaaactacaagtaaatatccctgatgaaca

SEQ ID NO: 108341 - DNA, 601 bp, Human
cagagatgaaaatggagatattacaactgatacaacagaaattcaaagaaatattagtgactagtatgaacaactatatatcaataaattggaatctctaaaacaaatggacaaattcctagacacatacaacctacaaagatcgaaccataaagaagcccaaaacctgataagaccaaaaacaggtaatgagataaattctgcaataaaatgtctcccagtttaaaaaaaaaaaaaaaaaaaagcctgggagcagacggctttagatctgaattctaccaaacatttaaagaactgatgycaatcctactcaaactcttctgaaaaaatagagaaagagggactacttccaggctcattcttttttttttttttttttttttttgaggcagagtctcactctgtcacccaggctggagttcagtggcatgctctccactcactgcaagcgccacctcccgggttcacgccattctcctgcctcagcctcccgagtagctgggactacaggcgcccaccaccacgcccggctaaatttttgtatttttagtagagacggggtttcactgtgttagccaggatggtcttgatctcctgacct

SEQ ID NO: 108342 - DNA, 601 bp, Human
catatgttagatcacaaaacaagtcttaaacaatccaaaaaactgaaatattgccaagcatcaactctggccacaatgggataaaactagaaatcaataacaagaataattttggaaactatataaacacatggaaatgaaacagtatgctcctgaatgaccagtaggtcaacaaataaatttaaaaggaaatggaaaattgctagaaacaaatgatagtggaaacaaaacataccaaaatctatgaaatacagcaaaaacaatactaagaaggaaatttacagctataaaagcctacatsagaaaagaagaaaaattcaaataaacaacctaattgtgtatcttaaagaactagaaaaacaaaagtaacccaaacccaaaattagtagaacacaaataataaaaattacagcagaaataaatgaaattgaaatgaagaaaacaatacaaaagatcaatgaaacaaaaacttgttttcttgaaaagttaaacaacattgacaaacgtttaggcagactaagaaaaaaagatccaaattaataaaatcagagatgaaaatggagatattacaactgatacaacagaaattcaaagaaatatt

SEQ ID NO: 108343 - DNA, 601 bp, Human
tatcatatcaccagagaaaataaccttcactaatgaaaaataggaaggaaggaaagaaagaatagcagactacaacataaccagaaaagaaataataaaatgacagaagtaagaccttactaccagtaataacgttgaatgaaaatggactaaactctccaatcaaaagacatagtttggctaaatggaaaaacaaaacaaaaaaaaaactccaatctgttgcctctaagaaacacactttgcctataaagacatgcacagagagaaaataaagggatggaaaaagatattccatgtcaakgcaaaccaaaaaaaaaaaaaaaaaacaaaacaaaaaagtagagtacctatactaatattagacaaaatagttttcaagacaaaaactatgaggacataaagaaggtcaccatataacgataaaagggtcaattcaccaaaaggatatagcaattgtaaatatatgtgcactcaacactggagcacccagatatataaagcaaatattattagagcaaagcaaagagaaaagcctcaattcaataatagatggagacttcaacattccactttcagcattggacagatcctccagacagaa

SEQ ID NO: 108344 - DNA, 601 bp, Human
ggttagaagatagcatttgcaagcctcatggtaatctcaaacctaacagcatagaatggatacacaaaaaaataaaaagcaagaaactatatcatatcaccagagaaaataaccttcactaatgaaaaataggaaggaaggaaagaaagaatagcagactacaacataaccagaaaagaaataataaaatgacagaagtaagaccttactaccagtaataacgttgaatgaaaatggactaaactctccaatcaaaagacatagtttggctaaatggaaaaacaaaacaaaaaaaaaactycaatctgttgcctctaagaaacacactttgcctataaagacatgcacagagagaaaataaagggatggaaaaagatattccatgtcaaggcaaaccaaaaaaaaaaaaaaaaaacaaaacaaaaaagtagagtacctatactaatattagacaaaatagttttcaagacaaaaactatgaggacataaagaaggtcaccatataacgataaaagggtcaattcaccaaaaggatatagcaattgtaaatatatgtgcactcaacactggagcacccagatatataaagcaaatattatta

SEQ ID NO: 108345 - DNA, 601 bp, Human
aacaaccctgcgtgttctgcacatgtaccccagaacttaaagtataattttaaaaaatagctacaacaggctttgaagacatagacagtacaataagatattaatagtgaaaacaaaaagttaaaacctgagaagatggagttaaggtgcagagtcctcatttgttttgtttttgtgcttgtttgtttgcttatgtaaacagtactaagtggttattagcttgaaatgatgggttagaagatagcatttgcaagcctcatggtaatctcaaacctaacagcatagaatggatacacaaaamaataaaaagcaagaaactatatcatatcaccagagaaaataaccttcactaatgaaaaataggaaggaaggaaagaaagaatagcagactacaacataaccagaaaagaaataataaaatgacagaagtaagaccttactaccagtaataacgttgaatgaaaatggactaaactctccaatcaaaagacatagtttggctaaatggaaaaacaaaacaaaaaaaaaactccaatctgttgcctctaagaaacacactttgcctataaagacatgcacagagagaaaataaagggatgga

SEQ ID NO: 108346 - DNA, 601 bp, Human
caacggatgtaatcaatgctctctttatggaaaatatgataatttccaaaacagctcaaattaactcttgttcaaacacaatgtccttgctgtaagataaaattttccacatcgttgttgaagtaaaacctgaattctcatctactagcatgccaatgaagagttttttaaatgttctgcaattttttccttgtttaaactctccataatttgtgttcagcaatttaacaacccaatacacagatgacacattggttttattacctggtaaagggagcttgggcataactaggatcatcamcaaagtagatttatattttcaacgccagtaatatgtagaatgaatcccgtcttttcctaccaaaagcatttaaggttttcttgggaacctcagaaaggccaataatccttaaatcctggtggctactaatacttttgtataacttattgtttacaagctcattcatacaaacacattcacaaacatacacacatacatacatactcaccccctcatggatagaaggaatttctgtcctctaatttccaaaatggaaaattaattacagggacatcatccaggtagaaatagccctgcttt

SEQ ID NO: 108347 - DNA, 601 bp, Human
cctagacaagtaccctcacatggtatttcatcaagaataatgtaaaaccaacatattttcaacgatttatttgcttttttttcttttactacattttaaaattcgataagaaacacgacctccaacaattaggattctattttgggattttttttggcatttttgaatacaaacatggacaaatagtctatgcaataatacagtatatcaactttagtttatcttttaatagcatcattagcaagccaaattcttgcaaatgctttttccccttcttagctatggtgactaaatctggatyattttactatagcagtcaaagtagaattatatatgcacaaacatactcaaagatcatgctaaatatgttttataccttaaaaaatttgcctttctatggtatttttctctaatgtagagccaaaaaatttatagtaacaaaatatttaacccaacttacaggtgtacatgtgaatagtattgtgaaattaaaatgctaaaaatatgagtataaatatttcatttagagacacatttttggatatatttatttaatttaatatccatcgtagtataatttattggaaattcatgaatttct

SEQ ID NO: 108348 - DNA, 601 bp, Human
cttcctcatggcctcacgattcttctatgattctcagcattaggcctagacaagtaccctcacatggtatttcatcaagaataatgtaaaaccaacatattttcaacgatttatttgcttttttttcttttactacattttaaaattcgataagaaacacgacctccaacaattaggattctattttgggattttttttggcatttttgaatacaaacatggacaaatagtctatgcaataatacagtatatcaactttagtttatcttttaatagcatcattagcaagccaaattcttgyaaatgctttttccccttcttagctatggtgactaaatctggatcattttactatagcagtcaaagtagaattatatatgcacaaacatactcaaagatcatgctaaatatgttttataccttaaaaaatttgcctttctatggtatttttctctaatgtagagccaaaaaatttatagtaacaaaatatttaacccaacttacaggtgtacatgtgaatagtattgtgaaattaaaatgctaaaaatatgagtataaatatttcatttagagacacatttttggatatatttatttaatt

SEQ ID NO: 108349 - DNA, 391 bp, Human
tatagaaaaaccagtaagaaatataaaatgtttcatacaccaccagtttgttttctgctagaagacacacaatgcccctctcatgaatctatggagatgaaggcttctctcctttcacccagtacctcacttgccgcaaaactgaaagaaaagtctgctttagcttcttgtttccccaaatcaggatgaatgggtggattgaaggatagctgaatctaatagctttgcagaacatgaagacaggtttgttttccagactcccaaaactccaaactgatatcattatggacagaaagtaaayggcacataacaagaggaaaaagatcacagtttgcaaaacttttatgtggaccttggtgctgggatcttcagatcctttaccatggagctg

SEQ ID NO: 108350 - DNA, 500 bp, Human
tcatacacacataaacacacacacacatatatatatatttttttctagactaatattaggtcaaaggcttttctaggtatacgttgggaaattattcatacacatacagtatagaaaaaccagtaagaaatataaaatgtttcatacaccaccagtttgttttctgctagaagacacacaatgcccctctcatgaatctatggagatgaaggcttctctcctttcacccagtacctcacttgccgcaaaactgaaagaaaagtctgctttagcttcttgtttccccaaatcaggatgaatsggtggattgaaggatagctgaatctaatagctttgcagaacatgaagacaggtttgttttccagactcccaaaactccaaactgatatcattatggacagaaagtaaacggcacataacaagaggaaaaagatcacagtttgcaaaacttttatgtggaccttggtgctgggatcttcagatcctttaccatggagctg

SEQ ID NO: 108351 - DNA, 601 bp, Human
gtattcctgtggttcaaataacaatagaaaagagcaatatttatcctgggataaactgctacttcttaataattataaatagacatcataaattctacaaatgaaatataaaatacatgaatgaaatatacatggcttcaaaattctaagaaatttttgtcatattttgtataatttggcagtttgtatgaaaaaaacagaaaagagcatgttattgtcaatgttcttaagttttcatacacacataaacacacacacacatatatatatatttttttctagactaatattaggtcaaagrcttttctaggtatacgttgggaaattattcatacacatacagtatagaaaaaccagtaagaaatataaaatgtttcatacaccaccagtttgttttctgctagaagacacacaatgcccctctcatgaatctatggagatgaaggcttctctcctttcacccagtacctcacttgccgcaaaactgaaagaaaagtctgctttagcttcttgtttccccaaatcaggatgaatgggtggattgaaggatagctgaatctaatagctttgcagaacatgaagacaggtttgttttccagac

SEQ ID NO: 108352 - DNA, 601 bp, Human
attcctcagtaccgcttatggtagacatacattaaatttactctgcatatgcttctcactcaaattctactgtgtgcattgttttctaacaataattctcattgctttttactaaacataaaatagaaattcataatggaataaaacaccaaagatacatcctcattattgatttagaattgaatgactttaccatccaataaattcgaggttcaagcaatgaattctaagcacaatgtggtgtattcctgtggttcaaataacaatagaaaagagcaatatttatcctgggataaactgytacttcttaataattataaatagacatcataaattctacaaatgaaatataaaatacatgaatgaaatatacatggcttcaaaattctaagaaatttttgtcatattttgtataatttggcagtttgtatgaaaaaaacagaaaagagcatgttattgtcaatgttcttaagttttcatacacacataaacacacacacacatatatatatatttttttctagactaatattaggtcaaaggcttttctaggtatacgttgggaaattattcatacacatacagtatagaaaaaccagta

SEQ ID NO: 108353 - DNA, 601 bp, Human
taatattcctcagtaccgcttatggtagacatacattaaatttactctgcatatgcttctcactcaaattctactgtgtgcattgttttctaacaataattctcattgctttttactaaacataaaatagaaattcataatggaataaaacaccaaagatacatcctcattattgatttagaattgaatgactttaccatccaataaattcgaggttcaagcaatgaattctaagcacaatgtggtgtattcctgtggttcaaataacaatagaaaagagcaatatttatcctgggataarctgctacttcttaataattataaatagacatcataaattctacaaatgaaatataaaatacatgaatgaaatatacatggcttcaaaattctaagaaatttttgtcatattttgtataatttggcagtttgtatgaaaaaaacagaaaagagcatgttattgtcaatgttcttaagttttcatacacacataaacacacacacacatatatatatatttttttctagactaatattaggtcaaaggcttttctaggtatacgttgggaaattattcatacacatacagtatagaaaaacc

SEQ ID NO: 108354 - DNA, 601 bp, Human
ttcaaatagaccaaagttgtttatatgatttttcaaactattataataggtgccatctaattttggtgttctaccttgtctccaactcagacacctgatacagctgcatcaagactatattattgtcatatttcccctaaaattgtggaatagccaaacttttccttaggagaaggattctgcttggataagcctgtaatcttaacctgagactggaacaggggaattcatgcaactgcagattttgtgtgagtttccttttcactggtttaccacatcaacttatccattttagccaccyatttatttgttcattaaagtatcatttttgaccatctattcttggtgctggtttcgagttcctgggagtcaacagaaagcaagacagacattatctctttttttacagtccttacattgtactgaggaagatatatgattaaaaaaatacacaaatcaggtggggggatgattcatcttaaggtttaaatcacattgtttaaatttcataacaccaagaattaatacagtcaagtagaatttagctgtgaacaagactgtacatttctttcttataatagaacttcctattaaagaatat

SEQ ID NO: 108355 - DNA, 601 bp, Human
caaataattgacaatagaaaaaaatacatattcaaatagaccaaagttgtttatatgatttttcaaactattataataggtgccatctaattttggtgttctaccttgtctccaactcagacacctgatacagctgcatcaagactatattattgtcatatttcccctaaaattgtggaatagccaaacttttccttaggagaaggattctgcttggataagcctgtaatcttaacctgagactggaacaggggaattcatgcaactgcagattttgtgtgagtttccttttcactggttwaccacatcaacttatccattttagccacctatttatttgttcattaaagtatcatttttgaccatctattcttggtgctggtttcgagttcctgggagtcaacagaaagcaagacagacattatctctttttttacagtccttacattgtactgaggaagatatatgattaaaaaaatacacaaatcaggtggggggatgattcatcttaaggtttaaatcacattgtttaaatttcataacaccaagaattaatacagtcaagtagaatttagctgtgaacaagactgtacatttcttt

SEQ ID NO: 108356 - DNA, 601 bp, Human
tgccatcagggtcataccagacatcaccacacattgtttcacatttgttccggtctcaatttccacacgtccttgccatttttgtcttgaacttgacttctaaataaatggtagcacttcaataacaggtattacattaaaaacattttggtaaagtagctggttactaactcaattttttgaaatgaaatgtcatttttgtttaaataatcaactagaaaatatcataatacaaataattgacaatagaaaaaaatacatattcaaatagaccaaagttgtttatatgatttttcaaacyattataataggtgccatctaattttggtgttctaccttgtctccaactcagacacctgatacagctgcatcaagactatattattgtcatatttcccctaaaattgtggaatagccaaacttttccttaggagaaggattctgcttggataagcctgtaatcttaacctgagactggaacaggggaattcatgcaactgcagattttgtgtgagtttccttttcactggtttaccacatcaacttatccattttagccacctatttatttgttcattaaagtatcatttttgaccatcta

SEQ ID NO: 108357 - DNA, 601 bp, Human
aataatcaggaagtggcaagtttcttaactatagtaaaatactctaacgatgaatggaagtaaaataccagaagaaaagaaaccaacctgagaagattcagggacctacagcataggtgatgttttaaagcattcagtgtccctagaccacacgttgaaacaatcttttttacagtatatggcatgttgctctctctataaatttcctatcactacaaaagagacacaatgttttgggggcctattgggattttggagacaacatattccacatttgagaatattgctctgactcattaaygaagtttcccaggctgctggtctcaagtggaatccagaacaaatgagggctctacagaagatatagactctgctccaagctgctctggccactgtgccagatgatccagcaggattcaaagatgctagaacatacatagtggtcattataggactctgtgcatgtctctgacaagcctgttggagaggggagagcaaatccctatggaattagtgtaagaccattctctcttcagcagacaagtatcctctgtctgacaaacaaaatagcaagtgcagaatattaatccaagcatagagt

SEQ ID NO: 108358 - DNA, 601 bp, Human
tacagaaaatacaaaaattagccaggcgtgatgttgtgcccctgcagtcccagctgctagcaatgcggaggtgggagaattacttgagcccagaaggttgaggctgtaatgagctgtgatcctgccactgaactccagcctcagggacagaatgagaccctgtctcaaaataatagcaataataataataatatattacttggtacaataatcaggaagtggcaagtttcttaactatagtaaaatactctaacgatgaatggaagtaaaataccagaagaaaagaaaccaacctgagaasattcagggacctacagcataggtgatgttttaaagcattcagtgtccctagaccacacgttgaaacaatcttttttacagtatatggcatgttgctctctctataaatttcctatcactacaaaagagacacaatgttttgggggcctattgggattttggagacaacatattccacatttgagaatattgctctgactcattaatgaagtttcccaggctgctggtctcaagtggaatccagaacaaatgagggctctacagaagatatagactctgctccaagctgctctggccactg

SEQ ID NO: 108359 - DNA, 601 bp, Human
aaatcctagccctacagaaaatacaaaaattagccaggcgtgatgttgtgcccctgcagtcccagctgctagcaatgcggaggtgggagaattacttgagcccagaaggttgaggctgtaatgagctgtgatcctgccactgaactccagcctcagggacagaatgagaccctgtctcaaaataatagcaataataataataatatattacttggtacaataatcaggaagtggcaagtttcttaactatagtaaaatactctaacgatgaatggaagtaaaataccagaagaaaagaaaycaacctgagaagattcagggacctacagcataggtgatgttttaaagcattcagtgtccctagaccacacgttgaaacaatcttttttacagtatatggcatgttgctctctctataaatttcctatcactacaaaagagacacaatgttttgggggcctattgggattttggagacaacatattccacatttgagaatattgctctgactcattaatgaagtttcccaggctgctggtctcaagtggaatccagaacaaatgagggctctacagaagatatagactctgctccaagctg

SEQ ID NO: 108360 - DNA, 601 bp, Human
ctctactggcaacaaaatatataaaatataataaccgcattccctaaggaatggaactggtcagtgccgtgacaaaacacttgaaagttacaggggatggtagtcctttctataagccgattcactaaacctatctggcctctatcaaaaccagacgggttatagaatgaatgcagactaccagaaacttaaatcaacactcacaaatgctttccaggatgtgctgtcttcactaagcagagcagagcttctggtactttttactgggcttgtgatttgctgaatggttcttaatctacamccattatgaggaaaaatcaaaacaatttgccttgtatcataataataacactgtgtcactgttttatatcacggctatgtcacttctgtttaatttacattttttaaaacatcgtgattatttaatatattaataatattacagaccaggccctgtggcacatgactgtaatcccatcattttaggaggccgacacgggaagatcatttgagcccaggattttgagaccagcctgggtaacactgtgaaatcctagccctacagaaaatacaaaaattagccaggcgtgatgttgtgccc

SEQ ID NO: 108361 - DNA, 601 bp, Human
tactacctcttcctgaaagtataattgaaatagatatgtatggcagccggcaggactcacattcttcgtgaactgtagagtaaaggacattattatagcaggaccaaagggaagcctctgaaattctcctctactggcaacaaaatatataaaatataataaccgcattccctaaggaatggaactggtcagtgccgtgacaaaacacttgaaagttacaggggatggtagtcctttctataagccgattcactaaacctatctggcctctatcaaaaccagacgggttatagaatgaatrcagactaccagaaacttaaatcaacactcacaaatgctttccaggatgtgctgtcttcactaagcagagcagagcttctggtactttttactgggcttgtgatttgctgaatggttcttaatctacacccattatgaggaaaaatcaaaacaatttgccttgtatcataataataacactgtgtcactgttttatatcacggctatgtcacttctgtttaatttacattttttaaaacatcgtgattatttaatatattaataatattacagaccaggccctgtggcacatgactgtaat

SEQ ID NO: 108362 - DNA, 601 bp, Human
atccttatttgatatatatttggacagcttattttttgagcttttatgaataatgctacaatgaacattctttcacatatcatttgctacaattcctctgtgtatatatatctgggtgtagaattacagggtccttgattatgatgttcaaattcttctcacagacatagaaaagcccaaaacacagtttgactaaatttattcctgttacctttatctccagcctctttattgctatttgcatatatcttatcaattatacattcaatccaagaagacactattgttttatatagtcaamatttatttagaattacacacttagttttcattgtcattaatttttttttttttttttgagacatagtctccctgtcacccaggctggagtgcagtggcacgatctctgctcactgaaagctccgccttccgggtttagccattctcctgcctcagcctccggagtagctgggactgcaggtgcccgccaccacgccaggctaatttttttttatttttagtagagacggggtttcaccgtgttagccagcatggattgtcattaatttgtaatgctccttgcgtgttcaactttgtattt

SEQ ID NO: 108363 - DNA, 601 bp, Human
aatagcttggtttggcctgatttgatctatgtataggtgcaatcctatatgttcttattcatggcttcctggaatcaacattttgtatccaaaatttaaccccatcattgcatgtacatgtgatccatatcttttcacttctctatatttttttcattttttgattttactgtaattatttatccatccttatttgatatatatttggacagcttattttttgagcttttatgaataatgctacaatgaacattctttcacatatcatttgctacaattcctctgtgtatatatatctggktgtagaattacagggtccttgattatgatgttcaaattcttctcacagacatagaaaagcccaaaacacagtttgactaaatttattcctgttacctttatctccagcctctttattgctatttgcatatatcttatcaattatacattcaatccaagaagacactattgttttatatagtcaacatttatttagaattacacacttagttttcattgtcattaatttttttttttttttttgagacatagtctccctgtcacccaggctggagtgcagtggcacgatctctgctcactg

SEQ ID NO: 108364 - DNA, 601 bp, Human
catgtagggcaagacatggaacattgctaagagcctaagtttacctcaatgccactttctaattccctacacctttcttcatgtctcctgtgataagcaacatccctaatttatgatggtctttttttaatattctttatactttaccaataaggtattcgaccctaaactcaatagcttggtttggcctgatttgatctatgtataggtgcaatcctatatgttcttattcatggcttcctggaatcaacattttgtatccaaaatttaaccccatcattgcatgtacatgtgatccatwtcttttcacttctctatatttttttcattttttgattttactgtaattatttatccatccttatttgatatatatttggacagcttattttttgagcttttatgaataatgctacaatgaacattctttcacatatcatttgctacaattcctctgtgtatatatatctgggtgtagaattacagggtccttgattatgatgttcaaattcttctcacagacatagaaaagcccaaaacacagtttgactaaatttattcctgttacctttatctccagcctctttattgctatttgcat

SEQ ID NO: 108365 - DNA, 601 bp, Human
cacaattatctaactcagttttctcttgcagaaaaacataagtgatgtaggtattctgctaaatcaggagtgtgggaaatatgcccaccattgttgtgtcaggaattcaggatcgaaggaaaaaatagagaatgtccaagttttgtcatatgaagtgggtaattaaacctaaaagaaaaacctattcagaaatctgtggttggcaggtaacatcatgtcaagtttcctaaagttgcaactaaaatcagaaagtttctacttaaaatctcttagagttacacatgaatgtatacaaatagtkgatttttcccttcagtatataatgagcagagtaataataattttcatggaccatttctcctaattaataatttttatcatatagctagactgcacacttagaaatgaaccaaaacaaaaatggaaaacatagcaatgtgtcataaacactcatgtaaccatcatgtagggcaagacatggaacattgctaagagcctaagtttacctcaatgccactttctaattccctacacctttcttcatgtctcctgtgataagcaacatccctaatttatgatggtctttttttaatattcttta

SEQ ID NO: 108366 - DNA, 601 bp, Human
aacactcttaattctcttctttaggtggagagaaataaggttggagaaattggcaatcttgagcaaacaaaatatgctgaggctagcagcaagccacatgctgaaatggttcgttacagcccaggcattagaagcaacaattcttacttctaaaccatataaagcagaattaaacacagttgcataccaaaggaataacatgacccagagtaaaccaattctggagaccaccagagcagtgagaatttgctcagctgaggagatctttcgtgtgttaacccagtcaatgacatttactagrgctatgaagccattggcaacatttccaagaacaaatgcaaacactaccagaattgatgaaatgatgagcagaaaacacatcatgtttgaacagataaaaaaatgcaggcttagtaacacttgttctgagtcctttaacatccagatgttaacttcgatgaacacttgattactaaatgtgcaataacattttctgcctttaaattcagtgactagtgtcaacaggcaagcaccagcatatgctaatagatgaattcaaaactgtctttatagaaatagaaaaggtcattattctcaaaac

SEQ ID NO: 108367 - DNA, 601 bp, Human
tcaaatgaaatactatacaatgaactataataaaatataaatactatatatgtgaaatatactcagcttcataatttatggtcaacgttgttattcacacacatgcacacatatacacccataaatatatatatgacttttctaggtatctgttttgaaattactcacatacaaacactatggaaaaactgatagaaatataaaatgttccagacaccatcagtttgttttctgctagaagacccacgatgctccccttgtgaatctatggagttgagggtttctcttctttcactcagcrtgtcatctgccacaaaactgaaagaaaggtctgttttagcttcctacttcccataatcaggatgaatgagtggaatgaaggatacatgattgcaacagtttggcaaagcaggagtacaagtttgctctgctgtgtcctaagattccaagttgatgtgattatacacagaaagtaaatggcaaataacatgaggaaggaggtcacagtttgcaaagcttttatatggaccttggtgctgggatcttgagatcctttgctatggagccgcatcttcttgagatgtttacaaagagaacagat

SEQ ID NO: 108368 - DNA, 601 bp, Human
ttcaccatttacaccattataataatacatatcattaatacatttcctatcaattatatagatttcacagatttttatgtaatttttacataatttttaacatttgaggaaagtttcatttgattatcttctatagtttctataccctcctttgattggcctgtttttttaagatagagaatatttgagtttttttgaggaatattaggaatgggagacaaaggagaaaattggaaattcaggggctcaaggtggctaagaaaaacaaatggaaatacttgacatcagatgtcaacttcamaaaaggtttcctttaattcaaaaagtggaagcaatgacttttctaactacagataaaaaaattataacagcactgaaatgatcatcagcatgtttcttcattcctattatagaaatgatttttattctaggctattcacatactggtattaaatctagtattctttagtactgttttggtatacatatacaaaatttactcatatgtttttcactccaattttattgtgtgcatcattaactaacaacaattctatttgctttctactaagcataaaataagaattcataatgaaataaa

SEQ ID NO: 108369 - DNA, 601 bp, Human
ttggtatcaatggatacatcaacacactgtgtaatttcaccatttacaccattataataatacatatcattaatacatttcctatcaattatatagatttcacagatttttatgtaatttttacataatttttaacatttgaggaaagtttcatttgattatcttctatagtttctataccctcctttgattggcctgtttttttaagatagagaatatttgagtttttttgaggaatattaggaatgggagacaaaggagaaaattggaaattcaggggctcaaggtggctaagaaaaayaaatggaaatacttgacatcagatgtcaacttcacaaaaggtttcctttaattcaaaaagtggaagcaatgacttttctaactacagataaaaaaattataacagcactgaaatgatcatcagcatgtttcttcattcctattatagaaatgatttttattctaggctattcacatactggtattaaatctagtattctttagtactgttttggtatacatatacaaaatttactcatatgtttttcactccaattttattgtgtgcatcattaactaacaacaattctatttgctttct

SEQ ID NO: 108370 - DNA, 601 bp, Human
acagctaggatacattctcccttttctctcttccacggactaatatttgttgtggcttccccttgtaacccttctggaaaagtatggggagccaagtgcatgcatctgatgaccaccatgctgtctgtctcactaattgtgaagtggccaccagcaaaatcatatcaacatcacgacacatggttttacatcttcttttgcctcagtttccacatttacccctcattgctgccctggacttgccctcccaaataaatgtcatcactgtaaactcagacattggctctagttttagacaccmaaagctaagatatacattcagttgcatcacttttccatgcgtttataacatggcaattaaaacattcatttagaaaggatactaaaaaaatatacaaataatgtgtaagaaaggtgactggttacaaactcaatttttaaaaatgaaatgcctttttgtgtatatgataaccagctagaaaatatcataatacaaatatatcattcatagtagaaagtgattaggtacatttccaaccaacttaatcagttgcaaagtttgctagcttttatttttacttcttttgagtttacttctttt

SEQ ID NO: 108371 - DNA, 601 bp, Human
aagatggtagttctgcctcaaacaaactttggccaaagggaaatagaagacagaagacagctaggatacattctcccttttctctcttccacggactaatatttgttgtggcttccccttgtaacccttctggaaaagtatggggagccaagtgcatgcatctgatgaccaccatgctgtctgtctcactaattgtgaagtggccaccagcaaaatcatatcaacatcacgacacatggttttacatcttcttttgcctcagtttccacatttacccctcattgctgccctggacttgccytcccaaataaatgtcatcactgtaaactcagacattggctctagttttagacaccaaaagctaagatatacattcagttgcatcacttttccatgcgtttataacatggcaattaaaacattcatttagaaaggatactaaaaaaatatacaaataatgtgtaagaaaggtgactggttacaaactcaatttttaaaaatgaaatgcctttttgtgtatatgataaccagctagaaaatatcataatacaaatatatcattcatagtagaaagtgattaggtacatttccaaccaactta

SEQ ID NO: 108372 - DNA, 601 bp, Human
atctttggagcagaaagtgaacgttttataaagtagggaaggaaatgagcaggacagcagttgtaaaagtggccacgtgggcatcctttccacatcccctcctaatggatgtgaggtctaaggggaacccctggaggtgagagttccatgagggcatacttttgtctgcaaatcaactgtcaagtctcaaggagagatccctcgtggagcacatagttagatgaactcgcccgaagggactgtctggtggggggaaagtaaacagttctatgtgcatgtctaaaaagttaagtagaaagcrgggaaacatagggaaaggggagaggaaaagagaaaaaataaattaaaaaaaaactatctcttagaaaaatgggggtattggttagtgtgactttcccaaacagccaccaaggggttggataatgtaaggaagaaaagcaaagatggtagttctgcctcaaacaaactttggccaaagggaaatagaagacagaagacagctaggatacattctcccttttctctcttccacggactaatatttgttgtggcttccccttgtaacccttctggaaaagtatggggagccaagtgcatgcat

SEQ ID NO: 108373 - DNA, 601 bp, Human
gcccgtaggagaggagaaagcaaacccctagggaattactgcagaactattccctcttcagtggaggagtatccgctgtctgaaaaataaaaatgcaagtgcagaacattaatccaagcaaaaagcccctcaagcacaagaccccgtgcaactacacaaggcatctgcttataaaaccagccacagttggagggcatgagcacatctgagtggcacaaggaggggactatattggacacaaacatgtgcttcctcagattcccttgactgtctcctgttcccatggtcagcaccttgcctratccagatcatccttccacctgggacttgaatgtatctgtgggcatgaagtcttgtaacagaaaagcttagttgctcacttcatgtaaagtctaattaacaagaacaaggtctgatataaaaatagagaatttatttggaagttagcttgctggaaggggcacaaagcatcctgccttccaacgtgacacttcatctttggagcagaaagtgaacgttttataaagtagggaaggaaatgagcaggacagcagttgtaaaagtggccacgtgggcatcctttccacatcccctcctaatg

SEQ ID NO: 108374 - DNA, 601 bp, Human
agagaagcacggcgtttattgagcctctagggattttggagtccaaaaataccacagtagaggatattgctctgatgtgttaataaagtcctttttaaatccctgttcagttaacctacctagcctctgccaaaaccagatgggttacagaatgaatgcaaagactcctggtttcaagtggaatccagaacatataatatctctacagcagatacagggtctggcccaacctgctcggcccattgtgccagatgatccagcagaattcaaagctgctagaggcatgcaacgtgggcatcayaggactctgtgcctgtctccatcaagcccgtaggagaggagaaagcaaacccctagggaattactgcagaactattccctcttcagtggaggagtatccgctgtctgaaaaataaaaatgcaagtgcagaacattaatccaagcaaaaagcccctcaagcacaagaccccgtgcaactacacaaggcatctgcttataaaaccagccacagttggagggcatgagcacatctgagtggcacaaggaggggactatattggacacaaacatgtgcttcctcagattcccttgactgtctcc

SEQ ID NO: 108375 - DNA, 601 bp, Human
ttacattttggaaaacatcatgttaatttaatatattaataacgttacggtaattggtacaataaccaggaaatggaaagttacctaattatagtaaaatacttaaacattaaatagaaataaaatatcagaagaaagagacatgcctgaaaatatttagagaacaccaacgcagatattgttttcaggggtcccatattcctggtccacatgttgaaaaatcaattaattaattaattaatttatatttgagatagagtctcgctctgttgcccaggccggaatgcagtgttgcaatccyggctcactgcaaacttcgcctcctgggttcaatcaattcaaatccttcagcctcctgagtagctgggtttacgggcattggccaccatgcctggctaaatttttttgtatttttttttaagtagagatggggtttcaccatgttgctcaggctagtctcaaactcctggcctccagtgatctgcctgcgttggtctcccaaagtgctggtattacaggcgtgaaccaccatgccgagcagaaacatcctgtttaaggtaaatggcttcctatatacttcctatcactaaaagagaagcac

SEQ ID NO: 108376 - DNA, 601 bp, Human
aacaagagcactgcttcactgttttatgtcagggctttgtcacttctgctctcagtttaatttacattttggaaaacatcatgttaatttaatatattaataacgttacggtaattggtacaataaccaggaaatggaaagttacctaattatagtaaaatacttaaacattaaatagaaataaaatatcagaagaaagagacatgcctgaaaatatttagagaacaccaacgcagatattgttttcaggggtcccatattcctggtccacatgttgaaaaatcaattaattaattaattwatttatatttgagatagagtctcgctctgttgcccaggccggaatgcagtgttgcaatcccggctcactgcaaacttcgcctcctgggttcaatcaattcaaatccttcagcctcctgagtagctgggtttacgggcattggccaccatgcctggctaaatttttttgtatttttttttaagtagagatggggtttcaccatgttgctcaggctagtctcaaactcctggcctccagtgatctgcctgcgttggtctcccaaagtgctggtattacaggcgtgaaccaccatgccgagca

SEQ ID NO: 108377 - DNA, 601 bp, Human
taaaaacaagagcactgcttcactgttttatgtcagggctttgtcacttctgctctcagtttaatttacattttggaaaacatcatgttaatttaatatattaataacgttacggtaattggtacaataaccaggaaatggaaagttacctaattatagtaaaatacttaaacattaaatagaaataaaatatcagaagaaagagacatgcctgaaaatatttagagaacaccaacgcagatattgttttcaggggtcccatattcctggtccacatgttgaaaaatcaattaattaattwattaatttatatttgagatagagtctcgctctgttgcccaggccggaatgcagtgttgcaatcccggctcactgcaaacttcgcctcctgggttcaatcaattcaaatccttcagcctcctgagtagctgggtttacgggcattggccaccatgcctggctaaatttttttgtatttttttttaagtagagatggggtttcaccatgttgctcaggctagtctcaaactcctggcctccagtgatctgcctgcgttggtctcccaaagtgctggtattacaggcgtgaaccaccatgccg

SEQ ID NO: 108378 - DNA, 601 bp, Human
tacggtgctttctcaaagacctgtagccatttcccagataacagtacccagaggaaaggacacacatccacaccatctgagacttttaggtatagggctcttacagtagatagttagtcaggcatgagcggggcagaagaaggctctcaccacccaccaggaatgtcaggtggccatcaggtgatggcctggcagttgtcacactgcctctctaaaaatgataattgctcacaggcaccagggagaggcaatttcacaataagtaaagatgcttaaaattgctagtcagcagctcaggaakagggcgagtaggctgaggcatacgtgttaagagagaaaacggtagaaaacaaccttctgggggcattccaccaaaaaagggaagaatgcctcatgcaagcatgtgtacaactccagtaaacacactgcacatgctcacctccaaagtgttagcaggccaccacacatgtgagcagcccaccctaaggggctgaatcatgggaaaaggaacacaagaccctaagggaagaatcgtgggaaaaggaacacaagaccccagaagtataccaacatataaaaccacaagtcaaaggtctaacac

SEQ ID NO: 108379 - DNA, 601 bp, Human
tcaggagagggcagcatcctgaaatctaaataaactaagttcaatgcagctaatagagcatgcaacatgatgactaaccttgggaacatagactctctggtgatcttgcaaatgtcagaatcaatgaactgatgacagcatcagcttcttggaatgagttcataagccaatagttaaagaggcttcatactttgaaaaatacttataaaccaagagcaagccttttcacttcaaaggctgaaaaactgattcctgaggtcagcctttgaagtggaaaatcaaagaacctcaacctgttgtmaggactgagccaattccgagaacaagaattcaataattgaaggaaagtgtaagtccccttgaaaaggatgctgaaaattcaccacaagaatattcaggacgtattcatacggtgctttctcaaagacctgtagccatttcccagataacagtacccagaggaaaggacacacatccacaccatctgagacttttaggtatagggctcttacagtagatagttagtcaggcatgagcggggcagaagaaggctctcaccacccaccaggaatgtcaggtggccatcaggtgatggcctggc

SEQ ID NO: 108380 - DNA, 601 bp, Human
taccctcaatctcatttagtggaaattcaagcaaaaatattattgattctccctagatttttattttttgagacatggtctcactctggagcctaaactggagtgcagtggtttgagattggctaactgcaatctatagctcccagcctcaatctgtttcccaccttggcctcccaagtagctaggactacaggtggacaccactatacctggctaattgttgtatttttactagagactgggtttcaccatgtttcccaggttggtctccaataattgggctcaagaaatctgcctgccyaagcctcccaaggtgctcaattacaggcttaagccacagcatccaccctggtactgttacttcaaaatgtacatttgacatttgaaggaaaaatatttacataatgtgctatatgccaacatgcgtgaataaataaataatataaatggataatcagccttattcctgtctgttgaatcacttggctacattgtcagtaaagagattacatgagatcaccaacacaacaggcatcattgtagagattgaagaattgagaccttgggcagtctgatattttcagtttagagacaaaagaga

SEQ ID NO: 108381 - DNA, 601 bp, Human
gggctaccctcaatctcatttagtggaaattcaagcaaaaatattattgattctccctagatttttattttttgagacatggtctcactctggagcctaaactggagtgcagtggtttgagattggctaactgcaatctatagctcccagcctcaatctgtttcccaccttggcctcccaagtagctaggactacaggtggacaccactatacctggctaattgttgtatttttactagagactgggtttcaccatgtttcccaggttggtctccaataattgggctcaagaaatctgccygcctaagcctcccaaggtgctcaattacaggcttaagccacagcatccaccctggtactgttacttcaaaatgtacatttgacatttgaaggaaaaatatttacataatgtgctatatgccaacatgcgtgaataaataaataatataaatggataatcagccttattcctgtctgttgaatcacttggctacattgtcagtaaagagattacatgagatcaccaacacaacaggcatcattgtagagattgaagaattgagaccttgggcagtctgatattttcagtttagagacaaaa

SEQ ID NO: 108382 - DNA, 601 bp, Human
ttaaaattactattttaaataaaactaaattagatgctgggctaccctcaatctcatttagtggaaattcaagcaaaaatattattgattctccctagatttttattttttgagacatggtctcactctggagcctaaactggagtgcagtggtttgagattggctaactgcaatctatagctcccagcctcaatctgtttcccaccttggcctcccaagtagctaggactacaggtggacaccactatacctggctaattgttgtatttttactagagactgggtttcaccatgtttccyaggttggtctccaataattgggctcaagaaatctgcctgcctaagcctcccaaggtgctcaattacaggcttaagccacagcatccaccctggtactgttacttcaaaatgtacatttgacatttgaaggaaaaatatttacataatgtgctatatgccaacatgcgtgaataaataaataatataaatggataatcagccttattcctgtctgttgaatcacttggctacattgtcagtaaagagattacatgagatcaccaacacaacaggcatcattgtagagattgaagaattgag

SEQ ID NO: 108383 - DNA, 601 bp, Human
tatctgtgtatttctctacttagatcattatgtctataataataataatcccctgcctatcaatctattgatattaaaattactattttaaataaaactaaattagatgctgggctaccctcaatctcatttagtggaaattcaagcaaaaatattattgattctccctagatttttattttttgagacatggtctcactctggagcctaaactggagtgcagtggtttgagattggctaactgcaatctatagctcccagcctcaatctgtttcccaccttggcctcccaagtagctagractacaggtggacaccactatacctggctaattgttgtatttttactagagactgggtttcaccatgtttcccaggttggtctccaataattgggctcaagaaatctgcctgcctaagcctcccaaggtgctcaattacaggcttaagccacagcatccaccctggtactgttacttcaaaatgtacatttgacatttgaaggaaaaatatttacataatgtgctatatgccaacatgcgtgaataaataaataatataaatggataatcagccttattcctgtctgttgaatcacttgg

SEQ ID NO: 108384 - DNA, 601 bp, Human
ttgcaaaaagtgaaaaaccagtcctaaaatatatctgaaaatacccagtgaccagatcaccaaaataaatcttgataaaataacacatttggaggattacactttctggtttcaaagctaactacaaagctgcactaatcagaattctgtggtactggcattacagtagacaaaagaacaatgaaacacaactgagagtccagaaattaacactgacattgatggtaattgatttcaaaaatggtaccactgcagttcaataggaattaatcattttttcaacaaatgatactgagaacaytgaatatccacatgcataaagataaatttctattcttatttcacaccatacacaaaaaataactcatatttaattgattatagagctaaatgtaaaaagtgagattagtaactaagatactaaaacatactaactgtacaattgcaagtaatacaagtgggttaatcaaccataattctatctgtgtatttctctacttagatcattatgtctataataataataatcccctgcctatcaatctattgatattaaaattactattttaaataaaactaaattagatgctgggctaccctc

SEQ ID NO: 108385 - DNA, 601 bp, Human
ggtcaacttatatactcagtgcaatccctatcaaatcccaacaagcctgttttgcaaaaagtgaaaaaccagtcctaaaatatatctgaaaatacccagtgaccagatcaccaaaataaatcttgataaaataacacatttggaggattacactttctggtttcaaagctaactacaaagctgcactaatcagaattctgtggtactggcattacagtagacaaaagaacaatgaaacacaactgagagtccagaaattaacactgacattgatggtaattgatttcaaaaatggtaccaytgcagttcaataggaattaatcattttttcaacaaatgatactgagaacattgaatatccacatgcataaagataaatttctattcttatttcacaccatacacaaaaaataactcatatttaattgattatagagctaaatgtaaaaagtgagattagtaactaagatactaaaacatactaactgtacaattgcaagtaatacaagtgggttaatcaaccataattctatctgtgtatttctctacttagatcattatgtctataataataataatcccctgcctatcaatctattga

SEQ ID NO: 108386 - DNA, 601 bp, Human
gagtaataaaaggccaaaattatatattcaattcatcacagagttgtacaagcaaggagggccagctgaactgaaatccagcacaaggagagtctttgcaggtgaagggtcaacttatatactcagtgcaatccctatcaaatcccaacaagcctgttttgcaaaaagtgaaaaaccagtcctaaaatatatctgaaaatacccagtgaccagatcaccaaaataaatcttgataaaataacacatttggaggattacactttctggtttcaaagctaactacaaagctgcactaatcagrattctgtggtactggcattacagtagacaaaagaacaatgaaacacaactgagagtccagaaattaacactgacattgatggtaattgatttcaaaaatggtaccactgcagttcaataggaattaatcattttttcaacaaatgatactgagaacattgaatatccacatgcataaagataaatttctattcttatttcacaccatacacaaaaaataactcatatttaattgattatagagctaaatgtaaaaagtgagattagtaactaagatactaaaacatactaactgtacaat

SEQ ID NO: 108387 - DNA, 601 bp, Human
aatggggtctccctatgttgcccagtatggtcttgaaaacatgggctcatacgatcttcccaccttggtctcccaaaatgcttggatacaggcgtgaactgcacctagctgagaacttccatttttgagcagaatacagaaggttcagaaaggcaagatatccttctgcaacaactaggataagagtaataaaaggccaaaattatatattcaattcatcacagagttgtacaagcaaggagggccagctgaactgaaatccagcacaaggagagtctttgcaggtgaagggtcaacttayatactcagtgcaatccctatcaaatcccaacaagcctgttttgcaaaaagtgaaaaaccagtcctaaaatatatctgaaaatacccagtgaccagatcaccaaaataaatcttgataaaataacacatttggaggattacactttctggtttcaaagctaactacaaagctgcactaatcagaattctgtggtactggcattacagtagacaaaagaacaatgaaacacaactgagagtccagaaattaacactgacattgatggtaattgatttcaaaaatggtaccactgcagttcaa

SEQ ID NO: 108388 - DNA, 601 bp, Human
cagatgataataatactctgggtagtccttatgaggtgctagtatagtatatgtataactgctttcaattttacatgttcagtgcaggcaggaaccgaggattattagttattctttcgattctgtgttacttgatacttaaaagataccagtgaaaacttccacttttccttttttgttttgagaaaggatgttgctctgtcgcctaggctggagtgcagtggtagttcacttcagctttgtactcctgggctcaagagatcctcccacctcagcttctggagtagctgtgactatgggygtgcaccaacacagccagctaatttttcagtttttttgtagaaatggggtctccctatgttgcccagtatggtcttgaaaacatgggctcatacgatcttcccaccttggtctcccaaaatgcttggatacaggcgtgaactgcacctagctgagaacttccatttttgagcagaatacagaaggttcagaaaggcaagatatccttctgcaacaactaggataagagtaataaaaggccaaaattatatattcaattcatcacagagttgtacaagcaaggagggccagctgaactgaa

SEQ ID NO: 108389 - DNA, 601 bp, Human
ggaacttggtcataaccagaatcatgaccactgtgaatttattttttcaatgtcagatttatgtagacagaatccaaagttttcttattaaaagactccaaggttttcttgggaagcccaggaaggccaacattccttaaaatctggttgctgctaactaatacttttgtataactttattcttaacaagctcattaacacaaacttatgtgcccacacacatacatgctcctcatggatgggaggaattattgtcctgtaatttccaaaatggaaaatgaatttcaggcaggtcatccamgttgaaatagccctaatttcccaatcatgttttcagcccattttcaatatttataaacttgtgtctcatgcttaggcttttgagtaagtcattttcttgagtctagttaatatttaaatatgaattgtttaattaaaatatttagcaattttgtaaatattccttgggcacttaaaaaacatgtgtattccattgaagagcctacacttctctgtatgtaaattttcacttttatttttctctaatgtattttttattatttaatggtttaagatgaatagatgttaaaaatcggtcttc

SEQ ID NO: 108390 - DNA, 601 bp, Human
aactgtcatatggaacttggtcataaccagaatcatgaccactgtgaatttattttttcaatgtcagatttatgtagacagaatccaaagttttcttattaaaagactccaaggttttcttgggaagcccaggaaggccaacattccttaaaatctggttgctgctaactaatacttttgtataactttattcttaacaagctcattaacacaaacttatgtgcccacacacatacatgctcctcatggatgggaggaattattgtcctgtaatttccaaaatggaaaatgaatttcaggyaggtcatccaagttgaaatagccctaatttcccaatcatgttttcagcccattttcaatatttataaacttgtgtctcatgcttaggcttttgagtaagtcattttcttgagtctagttaatatttaaatatgaattgtttaattaaaatatttagcaattttgtaaatattccttgggcacttaaaaaacatgtgtattccattgaagagcctacacttctctgtatgtaaattttcacttttatttttctctaatgtattttttattatttaatggtttaagatgaatagatgttaaa

SEQ ID NO: 108391 - DNA, 601 bp, Human
tttaaaacccaacacgtaattcctacattggatgtctaaactgtcatatggaacttggtcataaccagaatcatgaccactgtgaatttattttttcaatgtcagatttatgtagacagaatccaaagttttcttattaaaagactccaaggttttcttgggaagcccaggaaggccaacattccttaaaatctggttgctgctaactaatacttttgtataactttattcttaacaagctcattaacacaaacttatgtgcccacacacatacatgctcctcatggatgggaggaattaktgtcctgtaatttccaaaatggaaaatgaatttcaggcaggtcatccaagttgaaatagccctaatttcccaatcatgttttcagcccattttcaatatttataaacttgtgtctcatgcttaggcttttgagtaagtcattttcttgagtctagttaatatttaaatatgaattgtttaattaaaatatttagcaattttgtaaatattccttgggcacttaaaaaacatgtgtattccattgaagagcctacacttctctgtatgtaaattttcacttttatttttctctaatgtatt

SEQ ID NO: 108392 - DNA, 601 bp, Human
agatgaaatttttcatgctgttgttgaagtgaaaggtgaattctcatttgctagcatgcaaatacagacatattttccttcattgttttgcaatatttttccttgtttaacctctccataatttgtgttcagcaatgtcagttgttatggaaattttaaaacccaacacgtaattcctacattggatgtctaaactgtcatatggaacttggtcataaccagaatcatgaccactgtgaatttattttttcaatgtcagatttatgtagacagaatccaaagttttcttattaaaagactycaaggttttcttgggaagcccaggaaggccaacattccttaaaatctggttgctgctaactaatacttttgtataactttattcttaacaagctcattaacacaaacttatgtgcccacacacatacatgctcctcatggatgggaggaattattgtcctgtaatttccaaaatggaaaatgaatttcaggcaggtcatccaagttgaaatagccctaatttcccaatcatgttttcagcccattttcaatatttataaacttgtgtctcatgcttaggcttttgagtaagtcattttct

SEQ ID NO: 108393 - DNA, 601 bp, Human
tctgaccagtgtcaaacaggaaagcaccagggtgtgctaatggatgagtttgaggctgtctttatggagaacacaataattcccaaaacagctcaattaaatttctattcaaacactatgtcctggctataagatgaaatttttcatgctgttgttgaagtgaaaggtgaattctcatttgctagcatgcaaatacagacatattttccttcattgttttgcaatatttttccttgtttaacctctccataatttgtgttcagcaatgtcagttgttatggaaattttaaaacccaacacrtaattcctacattggatgtctaaactgtcatatggaacttggtcataaccagaatcatgaccactgtgaatttattttttcaatgtcagatttatgtagacagaatccaaagttttcttattaaaagactccaaggttttcttgggaagcccaggaaggccaacattccttaaaatctggttgctgctaactaatacttttgtataactttattcttaacaagctcattaacacaaacttatgtgcccacacacatacatgctcctcatggatgggaggaattattgtcctgtaatttcc

SEQ ID NO: 108394 - DNA, 601 bp, Human
tctctgaccagtgtcaaacaggaaagcaccagggtgtgctaatggatgagtttgaggctgtctttatggagaacacaataattcccaaaacagctcaattaaatttctattcaaacactatgtcctggctataagatgaaatttttcatgctgttgttgaagtgaaaggtgaattctcatttgctagcatgcaaatacagacatattttccttcattgttttgcaatatttttccttgtttaacctctccataatttgtgttcagcaatgtcagttgttatggaaattttaaaacccaacwcgtaattcctacattggatgtctaaactgtcatatggaacttggtcataaccagaatcatgaccactgtgaatttattttttcaatgtcagatttatgtagacagaatccaaagttttcttattaaaagactccaaggttttcttgggaagcccaggaaggccaacattccttaaaatctggttgctgctaactaatacttttgtataactttattcttaacaagctcattaacacaaacttatgtgcccacacacatacatgctcctcatggatgggaggaattattgtcctgtaattt

SEQ ID NO: 108395 - DNA, 601 bp, Human
atcactggacaagattctctgtaaggtcctgaccttaaattctatgtgcacctgatttctgaatgtgcagtaatgttctttttccttttacattctctgaccagtgtcaaacaggaaagcaccagggtgtgctaatggatgagtttgaggctgtctttatggagaacacaataattcccaaaacagctcaattaaatttctattcaaacactatgtcctggctataagatgaaatttttcatgctgttgttgaagtgaaaggtgaattctcatttgctagcatgcaaatacagacatattytccttcattgttttgcaatatttttccttgtttaacctctccataatttgtgttcagcaatgtcagttgttatggaaattttaaaacccaacacgtaattcctacattggatgtctaaactgtcatatggaacttggtcataaccagaatcatgaccactgtgaatttattttttcaatgtcagatttatgtagacagaatccaaagttttcttattaaaagactccaaggttttcttgggaagcccaggaaggccaacattccttaaaatctggttgctgctaactaatacttttgtat

SEQ ID NO: 108396 - DNA, 601 bp, Human
ctaaaagaactcaaaggaaaaaaatgttaaaatgtaaaagtagtctataagtttaacgtaggtgtccacaggaaaaaataaattctaccattactagcacaaaaaaagattggtaataaacctaccatgtctgaatttttttaaggcaggcgtattatcactggacaagattctctgtaaggtcctgaccttaaattctatgtgcacctgatttctgaatgtgcagtaatgttctttttccttttacattctctgaccagtgtcaaacaggaaagcaccagggtgtgctaatggatgagtytgaggctgtctttatggagaacacaataattcccaaaacagctcaattaaatttctattcaaacactatgtcctggctataagatgaaatttttcatgctgttgttgaagtgaaaggtgaattctcatttgctagcatgcaaatacagacatattttccttcattgttttgcaatatttttccttgtttaacctctccataatttgtgttcagcaatgtcagttgttatggaaattttaaaacccaacacgtaattcctacattggatgtctaaactgtcatatggaacttggtcataac

SEQ ID NO: 108397 - DNA, 601 bp, Human
atgattagtttgtagcatattgtaagggaaatttcaggattgtttaacaactcctaaaagaactcaaaggaaaaaaatgttaaaatgtaaaagtagtctataagtttaacgtaggtgtccacaggaaaaaataaattctaccattactagcacaaaaaaagattggtaataaacctaccatgtctgaatttttttaaggcaggcgtattatcactggacaagattctctgtaaggtcctgaccttaaattctatgtgcacctgatttctgaatgtgcagtaatgttctttttccttttacrttctctgaccagtgtcaaacaggaaagcaccagggtgtgctaatggatgagtttgaggctgtctttatggagaacacaataattcccaaaacagctcaattaaatttctattcaaacactatgtcctggctataagatgaaatttttcatgctgttgttgaagtgaaaggtgaattctcatttgctagcatgcaaatacagacatattttccttcattgttttgcaatatttttccttgtttaacctctccataatttgtgttcagcaatgtcagttgttatggaaattttaaaacccaa

SEQ ID NO: 108398 - DNA, 601 bp, Human
tttcttgaagtttcaaatactcttgttatgagcaggtgtaattatactacacatatttctttaatcaatcattatgtcaaatgaatttgagaaattatgattagtttgtagcatattgtaagggaaatttcaggattgtttaacaactcctaaaagaactcaaaggaaaaaaatgttaaaatgtaaaagtagtctataagtttaacgtaggtgtccacaggaaaaaataaattctaccattactagcacaaaaaaagattggtaataaacctaccatgtctgaatttttttaaggcaggcstattatcactggacaagattctctgtaaggtcctgaccttaaattctatgtgcacctgatttctgaatgtgcagtaatgttctttttccttttacattctctgaccagtgtcaaacaggaaagcaccagggtgtgctaatggatgagtttgaggctgtctttatggagaacacaataattcccaaaacagctcaattaaatttctattcaaacactatgtcctggctataagatgaaatttttcatgctgttgttgaagtgaaaggtgaattctcatttgctagcatgcaaatacagaca

SEQ ID NO: 108399 - DNA, 601 bp, Human
agacattatcaaaatcatgtacaatgaaaaataaatcatttaatgagataggtgtagatgattgatgatgatgttgatgtcagctaaaagggactattttattctgtaaatgtgacttcaatcatgtttcctaagtgctggaattcagggcgatgggagaacactattttaacttttcttcatggccttataattcttatattattctcagtatcaggcctagacaaacaccctcaggtaatatttcatcaagaataacttaaaaccaacatattcccaatgatttacttgatattgtttyattttaccacattctaaagtgtggtacaataaaaaatacttcgccttaatcaggtaatgccatattcagccaaagtaattgtactttataatcctaagagtagtgtatgaaaatttctattgtgtcatatcctttccaaaattagtaacatcagattaaattttacactgatatttacatacactattattaaagttaacattttagaaacatttttctattataattcagaatgtatttttagttcaaaaaattatgttgctttttaattacatgactgatttcatgcacatttattaa

SEQ ID NO: 108400 - DNA, 601 bp, Human
ccaaaatgataatcttttaaaaatgtcttagacattatcaaaatcatgtacaatgaaaaataaatcatttaatgagataggtgtagatgattgatgatgatgttgatgtcagctaaaagggactattttattctgtaaatgtgacttcaatcatgtttcctaagtgctggaattcagggcgatgggagaacactattttaacttttcttcatggccttataattcttatattattctcagtatcaggcctagacaaacaccctcaggtaatatttcatcaagaataacttaaaaccaacayattcccaatgatttacttgatattgtttcattttaccacattctaaagtgtggtacaataaaaaatacttcgccttaatcaggtaatgccatattcagccaaagtaattgtactttataatcctaagagtagtgtatgaaaatttctattgtgtcatatcctttccaaaattagtaacatcagattaaattttacactgatatttacatacactattattaaagttaacattttagaaacatttttctattataattcagaatgtatttttagttcaaaaaattatgttgctttttaatt

SEQ ID NO: 108401 - DNA, 601 bp, Human
aatctaaatgtattcagcttgacttgaactttacttttactaatgcaaatttcccaaaatgataatcttttaaaaatgtcttagacattatcaaaatcatgtacaatgaaaaataaatcatttaatgagataggtgtagatgattgatgatgatgttgatgtcagctaaaagggactattttattctgtaaatgtgacttcaatcatgtttcctaagtgctggaattcagggcgatgggagaacactattttaacttttcttcatggccttataattcttatattattctcagtatcaggyctagacaaacaccctcaggtaatatttcatcaagaataacttaaaaccaacatattcccaatgatttacttgatattgtttcattttaccacattctaaagtgtggtacaataaaaaatacttcgccttaatcaggtaatgccatattcagccaaagtaattgtactttataatcctaagagtagtgtatgaaaatttctattgtgtcatatcctttccaaaattagtaacatcagattaaattttacactgatatttacatacactattattaaagttaacattttagaaacatttttc

SEQ ID NO: 108402 - DNA, 601 bp, Human
acttgcttaagcaatgcattttaaactaaacttcacttaatttctaaatctaaatgtattcagcttgacttgaactttacttttactaatgcaaatttcccaaaatgataatcttttaaaaatgtcttagacattatcaaaatcatgtacaatgaaaaataaatcatttaatgagataggtgtagatgattgatgatgatgttgatgtcagctaaaagggactattttattctgtaaatgtgacttcaatcatgtttcctaagtgctggaattcagggcgatgggagaacactattttaayttttcttcatggccttataattcttatattattctcagtatcaggcctagacaaacaccctcaggtaatatttcatcaagaataacttaaaaccaacatattcccaatgatttacttgatattgtttcattttaccacattctaaagtgtggtacaataaaaaatacttcgccttaatcaggtaatgccatattcagccaaagtaattgtactttataatcctaagagtagtgtatgaaaatttctattgtgtcatatcctttccaaaattagtaacatcagattaaattttacactgat

SEQ ID NO: 108403 - DNA, 601 bp, Human
agtttaaggtcatctacaattacttgcttaagcaatgcattttaaactaaacttcacttaatttctaaatctaaatgtattcagcttgacttgaactttacttttactaatgcaaatttcccaaaatgataatcttttaaaaatgtcttagacattatcaaaatcatgtacaatgaaaaataaatcatttaatgagataggtgtagatgattgatgatgatgttgatgtcagctaaaagggactattttattctgtaaatgtgacttcaatcatgtttcctaagtgctggaattcagggcratgggagaacactattttaacttttcttcatggccttataattcttatattattctcagtatcaggcctagacaaacaccctcaggtaatatttcatcaagaataacttaaaaccaacatattcccaatgatttacttgatattgtttcattttaccacattctaaagtgtggtacaataaaaaatacttcgccttaatcaggtaatgccatattcagccaaagtaattgtactttataatcctaagagtagtgtatgaaaatttctattgtgtcatatcctttccaaaattagtaacat

SEQ ID NO: 108404 - DNA, 601 bp, Human
atggggctctgtgactttgaactccatcattacccaagcgagacagagaagatgtgagggcttacttctgtttgatttatttaatctaaaatcctctctttaggaataagagcttgatcatgaaacagtttaattgcctttctaattaaggaattttatttacactaaaatcaaactctttcttatagcattcaatggattagtttaaggtcatctacaattacttgcttaagcaatgcattttaaactaaacttcacttaatttctaaatctaaatgtattcagcttgacttgaactttrcttttactaatgcaaatttcccaaaatgataatcttttaaaaatgtcttagacattatcaaaatcatgtacaatgaaaaataaatcatttaatgagataggtgtagatgattgatgatgatgttgatgtcagctaaaagggactattttattctgtaaatgtgacttcaatcatgtttcctaagtgctggaattcagggcgatgggagaacactattttaacttttcttcatggccttataattcttatattattctcagtatcaggcctagacaaacaccctcaggtaatatttcatca

SEQ ID NO: 108405 - DNA, 601 bp, Human
tagaaatggggctctgtgactttgaactccatcattacccaagcgagacagagaagatgtgagggcttacttctgtttgatttatttaatctaaaatcctctctttaggaataagagcttgatcatgaaacagtttaattgcctttctaattaaggaattttatttacactaaaatcaaactctttcttatagcattcaatggattagtttaaggtcatctacaattacttgcttaagcaatgcattttaaactaaacttcacttaatttctaaatctaaatgtattcagcttgacttgarctttacttttactaatgcaaatttcccaaaatgataatcttttaaaaatgtcttagacattatcaaaatcatgtacaatgaaaaataaatcatttaatgagataggtgtagatgattgatgatgatgttgatgtcagctaaaagggactattttattctgtaaatgtgacttcaatcatgtttcctaagtgctggaattcagggcgatgggagaacactattttaacttttcttcatggccttataattcttatattattctcagtatcaggcctagacaaacaccctcaggtaatattt

SEQ ID NO: 108406 - DNA, 601 bp, Human
ttggagaagtttctttttaaaatgatgctaaatgatagaaatactttgctaagccaagagagtgggaaatatgtctacccttgttgtgtcaagaatcctgaagccaagggaaaaatagatgaggaatatcaaagttttgtcatgtgaggtgcataattaaagctgaaagaaaaaaactgaaataaagctacggaaaaatacggggttggcaggtgacatgatgtcaaatttctacaagttgtaactaaaataagaaagtttctacttcaactctctagagttgtataagaatgcatataartagtttcttttccccttagtacgtaatgagaagattaataatttctatgagacatttctcctaattcaaaatttttatattaaaattataatgcatacatagaaatgtgccaaaacaaaactggaaaactgggaaatagagcaatgtatcataaacagtcgagtaaccatcatgtagggcaagacaaggaacactgcaaacagcctagttccacctccatgacactttccaagcctctatacctttcttcatatctcctgaggtaagcaatatccattatttgtgatgatcatttccttg

SEQ ID NO: 108407 - DNA, 601 bp, Human
cagaacatggcccatctcatattaccagagtgatccacccaaacccagcttaggaaaatggaatctaaagacatgtgagatataaatatctaatgtagttttggagaagtttctttttaaaatgatgctaaatgatagaaatactttgctaagccaagagagtgggaaatatgtctacccttgttgtgtcaagaatcctgaagccaagggaaaaatagatgaggaatatcaaagttttgtcatgtgaggtgcataattaaagctgaaagaaaaaaactgaaataaagctacggaaaaatayggggttggcaggtgacatgatgtcaaatttctacaagttgtaactaaaataagaaagtttctacttcaactctctagagttgtataagaatgcatataaatagtttcttttccccttagtacgtaatgagaagattaataatttctatgagacatttctcctaattcaaaatttttatattaaaattataatgcatacatagaaatgtgccaaaacaaaactggaaaactgggaaatagagcaatgtatcataaacagtcgagtaaccatcatgtagggcaagacaaggaacactgcaaa

SEQ ID NO: 108408 - DNA, 601 bp, Human
ctcatcctttgatatattatcttgcagtgtcctcctgccataggcagggtgactaccttgaccttggaatctgagctcactcatgtaatttgctttgatgaactggaaattagtaaattttgtatacgtctttgagatggcttccacattggagtttcttgctcttctccatttaccacaagcacatccccacactagtacaccattcccagaagcagaatgagaatgagatcaccccctccagatgtagcctaaattggccaaactctaacttcaagatgcagaacatggcccatctcawattaccagagtgatccacccaaacccagcttaggaaaatggaatctaaagacatgtgagatataaatatctaatgtagttttggagaagtttctttttaaaatgatgctaaatgatagaaatactttgctaagccaagagagtgggaaatatgtctacccttgttgtgtcaagaatcctgaagccaagggaaaaatagatgaggaatatcaaagttttgtcatgtgaggtgcataattaaagctgaaagaaaaaaactgaaataaagctacggaaaaatacggggttggcaggtgacatg

SEQ ID NO: 108409 - DNA, 601 bp, Human
agcatatgctaatggatgagttcaatgctgcatttatggaaaattttcttattcccaaaatagctgaaattgaatcctattccactgtctgttcttgctatacgctgaaatttttaaaactgatgttgaagtgaaaggtgaattcccgtttgctagtatgcaaaaaaagacatattctttttcattgttttgcaatgtttttccttgtttaacctctccataatttgtattcagcattttcagttgtttcatagggaaattttaaaacccaatacatatgtcatacagtaaatgtctaaaytgttaaaagagcttggtcatacctaggatcgtataaatatggatttattttttaatgctagatttaaatatacagaacccaaaccttttatcaaaatcatccaaggttttcttgggaaccacaagaaggccaatacgccttaaaatcaggttgctgctaaccaatacttttatatgactttattgttaacaagctcataaacacaaaaacacacacttaaacccattggggttggaaggaattattttcttttaatttaaaaaaatgaaaaaatgagtttccagaaggtcatccaggtgg

SEQ ID NO: 108410 - DNA, 601 bp, Human
ataagtagaaattttaacatgtctgaagagacaaaaagaaaggaaaaatgcaggcctaataacacagattgtgattcctttaatatctagaccttaaattggatatacacttcattcctaaatgtgtaataatattctttgtgcttctaaattatttgactaatgtcaacagaaaagcaccagcatatgctaatggatgagttcaatgctgcatttatggaaaattttcttattcccaaaatagctgaaattgaatcctattccactgtctgttcttgctatacgctgaaatttttaaaastgatgttgaagtgaaaggtgaattcccgtttgctagtatgcaaaaaaagacatattctttttcattgttttgcaatgtttttccttgtttaacctctccataatttgtattcagcattttcagttgtttcatagggaaattttaaaacccaatacatatgtcatacagtaaatgtctaaactgttaaaagagcttggtcatacctaggatcgtataaatatggatttattttttaatgctagatttaaatatacagaacccaaaccttttatcaaaatcatccaaggttttcttgggaac

SEQ ID NO: 108411 - DNA, 601 bp, Human
tagcatttgtataactgctttccattttacctgtctgggacaggaaaaaacaaagatggttagttactgatttgatcctgtgttactagatatttagaaggtgccagtgaaaacttccatttcttttctccttttctttttttttttttttttttctgagacaggctcttgctctctcacccaagctggagtgcagtggcacaatcatacctcgccgtagtcttgaactcctggacacaagtgatactcttgccttcctgcctcagcttgccaagtaactggaactacaggcatgcaccascaagcctgctaattttaacatttttgtggagacaaatttccaagaacgaatgcaaacacacagagttgacaaaatgataagtagaaattttaacatgtctgaagagacaaaaagaaaggaaaaatgcaggcctaataacacagattgtgattcctttaatatctagaccttaaattggatatacacttcattcctaaatgtgtaataatattctttgtgcttctaaattatttgactaatgtcaacagaaaagcaccagcatatgctaatggatgagttcaatgctgcatttatggaaaa

SEQ ID NO: 108412 - DNA, 601 bp, Human
tcacaactgctctctgcctcagtatgatcaccaaaaaacacagatgataatattatctttgggtagtctttgtgaggagttagtatagcatttgtataactgctttccattttacctgtctgggacaggaaaaaacaaagatggttagttactgatttgatcctgtgttactagatatttagaaggtgccagtgaaaacttccatttcttttctccttttctttttttttttttttttttctgagacaggctcttgctctctcacccaagctggagtgcagtggcacaatcatacctcgcygtagtcttgaactcctggacacaagtgatactcttgccttcctgcctcagcttgccaagtaactggaactacaggcatgcaccaccaagcctgctaattttaacatttttgtggagacaaatttccaagaacgaatgcaaacacacagagttgacaaaatgataagtagaaattttaacatgtctgaagagacaaaaagaaaggaaaaatgcaggcctaataacacagattgtgattcctttaatatctagaccttaaattggatatacacttcattcctaaatgtgtaataatattctt

SEQ ID NO: 108413 - DNA, 601 bp, Human
acggtggctcacgcctgtaatcccagcactttgggaagccaaggtgggtgaataacctcaggtatggagttcaaggccagcctggccaagatggtgaaaaaatactaaaatacaaaaaatactaaaaatacaaaaattagcctggtgtggtgatgcacacctgtaatcccagctattcaggaggctgaggcaggagaattgagtgaacccggaggcggaggttgcggtgagctgagatcacaccactgcactccaacctagaccacgaagtgagactgtctcaaaaataaataaaatattrttaaacttaacattttacaaacctttttctattataattcagaatgcatctttagttgaaaaattacatcactcttaattctatgactataatttcatgcacatttattagggattaattatatatttcatacatttatttgttcatatttcattattaatttttctaattttttcttgaagtttcaaatacttttttgttatgaacaagtgtaattatactggagatatttcctttaatcaatcattacgtcaaatgactttgagaaaatatgattagttcatggcatattgtagggga

SEQ ID NO: 108414 - DNA, 601 bp, Human
atattactatgctatccatgtaaatcaaatttattcactttccttttcatatatattctttgtaaacatgtccctctagtttgttcattttgattgctgtatagcattctgtaagtatgtcataatttatttatccattttattactgatggtcatttgggagacttctcaactttagctattaaaactcagcgatatatacttgtatatgtattctgatatgagtgcaaatcctgggtcttaggatgtgatccttcatcttattcaaataatgtcacactcagacaaagtaattgcactratttataatcctaggagcagtgtatgaaaattcccactgcttcatatgctctccaaaattagtagagtaatttttgcactttcatatttatataaaatataattaaacttggccaggcacggtggctcacgcctgtaatcccagcactttgggaagccaaggtgggtgaataacctcaggtatggagttcaaggccagcctggccaagatggtgaaaaaatactaaaatacaaaaaatactaaaaatacaaaaattagcctggtgtggtgatgcacacctgtaatcccagctattcagga

SEQ ID NO: 108415 - DNA, 601 bp, Human
ttcgggaacctaacatatgtagggaaagcaataaaacctaaatgcacagtaaaaggaaaaaagaatgtaacattaacactcatattccacactttcgtcaaaaagtagaatttgccagcaatgaagacattccccatatatgctttcttgttgatatgatttcccttttgtttcctccctcccaagtatcccagttatgataatcacttatatgtttcgctttacagttttgccaccaatgtaataaattataagaatttatttcaaattataagaattataaaaacttaaaataaaattycttttatgagaagttataatttcttttataaaatgttataatttctttggtaaggagttataagaatttataatttcttttataagcaattataagaatttatttgcaaaaatacaaaaatattcttgcaaatttcatataaatgtgattatattgaatgtttttgatgttaataattactattatatctgtatatattactatgctatccatgtaaatcaaatttattcactttccttttcatatatattctttgtaaacatgtccctctagtttgttcattttgattgctgtatagca

SEQ ID NO: 108416 - DNA, 601 bp, Human
gtacatgtaagaatatattgtttcagcctagttttatattcattaatttacttaatatttctgcttttaaaatattttcattattcgggaacctaacatatgtagggaaagcaataaaacctaaatgcacagtaaaaggaaaaaagaatgtaacattaacactcatattccacactttcgtcaaaaagtagaatttgccagcaatgaagacattccccatatatgctttcttgttgatatgatttcccttttgtttcctccctcccaagtatcccagttatgataatcacttatatgtttygctttacagttttgccaccaatgtaataaattataagaatttatttcaaattataagaattataaaaacttaaaataaaatttcttttatgagaagttataatttcttttataaaatgttataatttctttggtaaggagttataagaatttataatttcttttataagcaattataagaatttatttgcaaaaatacaaaaatattcttgcaaatttcatataaatgtgattatattgaatgtttttgatgttaataattactattatatctgtatatattactatgctatccatgtaa

SEQ ID NO: 108417 - DNA, 601 bp, Human
tctttattcagcaaaactctaattacgatggtacatgtaagaatatattgtttcagcctagttttatattcattaatttacttaatatttctgcttttaaaatattttcattattcgggaacctaacatatgtagggaaagcaataaaacctaaatgcacagtaaaaggaaaaaagaatgtaacattaacactcatattccacactttcgtcaaaaagtagaatttgccagcaatgaagacattccccatatatgctttcttgttgatatgatttcccttttgtttcctccctcccaagtctcccagttatgataatcacttatatgtttcgctttacagttttgccaccaatgtaataaattataagaatttatttcaaattataagaattataaaaacttaaaataaaatttcttttatgagaagttataatttcttttataaaatgttataatttctttggtaaggagttataagaatttataatttcttttataagcaattataagaatttatttgcaaaaatacaaaaatattcttgcaaatttcatataaatgtgattatattgaatgtttttgatgttaataattactattata

SEQ ID NO: 108418 - DNA, 601 bp, Human
caatgtattttaaactaaactatacttaaaaatgtatttggttcaacttgaaattttccattttctaatctaactttcccataataataatcttttaaacatttattagacattatccaaattatttatgtaaacatttcaaaaataaatcatttaatgagatagatatagatgatgattggtgatgatgataatgtcagttaaaaggggccatgctcttctataaatgtgacttcaatcatgttttctaagtgctgcgtttcagggtgatgggctcatgaacttgtttcttatattattytcagcatcaggcacagacaaagatcctcagacagtatttcattaagaataagttaaaaccaatgtatttccaatgatttactggctatttttttttcttttaccacattctgaaaatcatgacaaaagtgccctacaacaaagagtattctcctttgggctgtttaattttcactgtactttcatatgaacttcatatatacaaatcctctatacaattatatagcatacaaactgtattttatcttttaatagtatcattagcaggcaaaattctctcaactgcttatttacaatctca

SEQ ID NO: 108419 - DNA, 601 bp, Human
gttcctaagatcagtttaaggttatctataatgatttgcttaagcaatgtattttaaactaaactatacttaaaaatgtatttggttcaacttgaaattttccattttctaatctaactttcccataataataatcttttaaacatttattagacattatccaaattatttatgtaaacatttcaaaaataaatcatttaatgagatagatatagatgatgattggtgatgatgataatgtcagttaaaaggggccatgctcttctataaatgtgacttcaatcatgttttctaagtgctrcgtttcagggtgatgggctcatgaacttgtttcttatattattttcagcatcaggcacagacaaagatcctcagacagtatttcattaagaataagttaaaaccaatgtatttccaatgatttactggctatttttttttcttttaccacattctgaaaatcatgacaaaagtgccctacaacaaagagtattctcctttgggctgtttaattttcactgtactttcatatgaacttcatatatacaaatcctctatacaattatatagcatacaaactgtattttatcttttaatagta

SEQ ID NO: 108420 - DNA, 601 bp, Human
gcagaagtggagctctgtaccttcaaacttcttcactatcaggtgagatatagaagatgtgagggcttacttctatttgatttatttagtcctaaaattctcactttagatgtgccagcaacctgtgtgggctgatgacttggggcaggatgggagaatgccaggggatagatgcacaaaggactggacacctccttgcctcctcccatcctcctcaaaacttcagcacaactctgaagcaaagtgtgcttgtgggagaacccagagttgcttaagatttaatttctgccatcaggttaayggagcacctagggaaattaagctgagttttaaaaatatccagaaagttaaatttgttgtacatgtgagtttctgaactgcgattaggctttactttacctggcatcagggagtgttataaatcaattatttaaatattcatgtaaggtgtaaaaaggagtagaagtacacgtatcaaatttccataaataaactttgcaatataaacgtaatttatactattaattctttgtcaataaaatgtggaaaggttaaaaaataaataaaataaaaccttcactttagaagtaagagcttgatc

SEQ ID NO: 108421 - DNA, 601 bp, Human
ataaataaattatagcacctcaaccctagctacaccattctattttacaaattaaattttactctttttttattagcagaagtggagctctgtaccttcaaacttcttcactatcaggtgagatatagaagatgtgagggcttacttctatttgatttatttagtcctaaaattctcactttagatgtgccagcaacctgtgtgggctgatgacttggggcaggatgggagaatgccaggggatagatgcacaaaggactggacacctccttgcctcctcccatcctcctcaaaacttcarcacaactctgaagcaaagtgtgcttgtgggagaacccagagttgcttaagatttaatttctgccatcaggttaatggagcacctagggaaattaagctgagttttaaaaatatccagaaagttaaatttgttgtacatgtgagtttctgaactgcgattaggctttactttacctggcatcagggagtgttataaatcaattatttaaatattcatgtaaggtgtaaaaaggagtagaagtacacgtatcaaatttccataaataaactttgcaatataaacgtaatttatactattaat

SEQ ID NO: 108422 - DNA, 601 bp, Human
ttatattttgttctccttctataaatcattatctatggagaagcagaacaaagcactcttaccaccaagttttttaaaaaaagttgggttctttgttcagttggttggctttgtttttttgtttttcgtatgcttgacatgaaaatgctaacaattttcttcttttcccaagactttggtcacaaaatagaataaaagcttggtctacacatccttccgcaagttggaagaacctggaaattgatgtgatgttagtagtttttttttttgggtggggatagcagcttgtctgttgatgagycttcaccacaaactctccccacagggaaattcaatgagctgtgctggatctcaagatgccattccaataaataaattatagcacctcaaccctagctacaccattctattttacaaattaaattttactctttttttattagcagaagtggagctctgtaccttcaaacttcttcactatcaggtgagatatagaagatgtgagggcttacttctatttgatttatttagtcctaaaattctcactttagatgtgccagcaacctgtgtgggctgatgacttggggcaggatgggagaat

SEQ ID NO: 108423 - DNA, 601 bp, Human
tttgctattattgttttagtagcagaaattatattttgttctccttctataaatcattatctatggagaagcagaacaaagcactcttaccaccaagttttttaaaaaaagttgggttctttgttcagttggttggctttgtttttttgtttttcgtatgcttgacatgaaaatgctaacaattttcttcttttcccaagactttggtcacaaaatagaataaaagcttggtctacacatccttccgcaagttggaagaacctggaaattgatgtgatgttagtagtttttttttttgggkggggatagcagcttgtctgttgatgagtcttcaccacaaactctccccacagggaaattcaatgagctgtgctggatctcaagatgccattccaataaataaattatagcacctcaaccctagctacaccattctattttacaaattaaattttactctttttttattagcagaagtggagctctgtaccttcaaacttcttcactatcaggtgagatatagaagatgtgagggcttacttctatttgatttatttagtcctaaaattctcactttagatgtgccagcaacctgtgtggg

SEQ ID NO: 108424 - DNA, 601 bp, Human
ttttttgctattattgttttagtagcagaaattatattttgttctccttctataaatcattatctatggagaagcagaacaaagcactcttaccaccaagttttttaaaaaaagttgggttctttgttcagttggttggctttgtttttttgtttttcgtatgcttgacatgaaaatgctaacaattttcttcttttcccaagactttggtcacaaaatagaataaaagcttggtctacacatccttccgcaagttggaagaacctggaaattgatgtgatgttagtagtttttttttttrggtggggatagcagcttgtctgttgatgagtcttcaccacaaactctccccacagggaaattcaatgagctgtgctggatctcaagatgccattccaataaataaattatagcacctcaaccctagctacaccattctattttacaaattaaattttactctttttttattagcagaagtggagctctgtaccttcaaacttcttcactatcaggtgagatatagaagatgtgagggcttacttctatttgatttatttagtcctaaaattctcactttagatgtgccagcaacctgtgt

SEQ ID NO: 108425 - DNA, 601 bp, Human
ttgattatttattttttgctattattgttttagtagcagaaattatattttgttctccttctataaatcattatctatggagaagcagaacaaagcactcttaccaccaagttttttaaaaaaagttgggttctttgttcagttggttggctttgtttttttgtttttcgtatgcttgacatgaaaatgctaacaattttcttcttttcccaagactttggtcacaaaatagaataaaagcttggtctacacatccttccgcaagttggaagaacctggaaattgatgtgatgttagtagyttttttttttgggtggggatagcagcttgtctgttgatgagtcttcaccacaaactctccccacagggaaattcaatgagctgtgctggatctcaagatgccattccaataaataaattatagcacctcaaccctagctacaccattctattttacaaattaaattttactctttttttattagcagaagtggagctctgtaccttcaaacttcttcactatcaggtgagatatagaagatgtgagggcttacttctatttgatttatttagtcctaaaattctcactttagatgtgcca

SEQ ID NO: 108426 - DNA, 601 bp, Human
agcatcaatgcctcttatcctcttagcttggcattctttgtcttgtggtctctttaggcttctttctttatagttgtcttccaattcactaattctctcttctatgtctaactggttgttaactctgtctattggattctcaatattgattatttattttttgctattattgttttagtagcagaaattatattttgttctccttctataaatcattatctatggagaagcagaacaaagcactcttaccaccaagttttttaaaaaaagttgggttctttgttcagttggttggctttgtttttttgtttttcgtatgcttgacatgaaaatgctaacaattttcttcttttcccaagactttggtcacaaaatagaataaaagcttggtctacacatccttccgcaagttggaagaacctggaaattgatgtgatgttagtagtttttttttttgggtggggatagcagcttgtctgttgatgagtcttcaccacaaactctccccacagggaaattcaatgagctgtgctggatctcaagatgccattccaataaataaattatagcacctcaaccctagctacaccattctatttta

SEQ ID NO: 108427 - DNA, 601 bp, Human
tatcccttttaatcttccagaaatccagaagtatgttagatgctctgattgtagcatcaatgcctcttatcctcttagcttggcattctttgtcttgtggtctctttaggcttctttctttatagttgtcttccaattcactaattctctcttctatgtctaactggttgttaactctgtctattggattctcaatattgattatttattttttgctattattgttttagtagcagaaattatattttgttctccttctataaatcattatctatggagaagcagaacaaagcactcttaycaccaagttttttaaaaaaagttgggttctttgttcagttggttggctttgtttttttgtttttcgtatgcttgacatgaaaatgctaacaattttcttcttttcccaagactttggtcacaaaatagaataaaagcttggtctacacatccttccgcaagttggaagaacctggaaattgatgtgatgttagtagtttttttttttgggtggggatagcagcttgtctgttgatgagtcttcaccacaaactctccccacagggaaattcaatgagctgtgctggatctcaagatgcca

SEQ ID NO: 108428 - DNA, 601 bp, Human
ccctattttatcccttttaatcttccagaaatccagaagtatgttagatgctctgattgtagcatcaatgcctcttatcctcttagcttggcattctttgtcttgtggtctctttaggcttctttctttatagttgtcttccaattcactaattctctcttctatgtctaactggttgttaactctgtctattggattctcaatattgattatttattttttgctattattgttttagtagcagaaattatattttgttctccttctataaatcattatctatggagaagcagaacaaagyactcttaccaccaagttttttaaaaaaagttgggttctttgttcagttggttggctttgtttttttgtttttcgtatgcttgacatgaaaatgctaacaattttcttcttttcccaagactttggtcacaaaatagaataaaagcttggtctacacatccttccgcaagttggaagaacctggaaattgatgtgatgttagtagtttttttttttgggtggggatagcagcttgtctgttgatgagtcttcaccacaaactctccccacagggaaattcaatgagctgtgctggatctca

SEQ ID NO: 108429 - DNA, 601 bp, Human
ttacatagttgcatgtacatgtgattcatttcttttcacctctatatactgttccactgtatggatttactgtaatctttcatatcattcaatcatccttagttaatatatatttgggcagtctatttttgagctattatgaataatactactatcagcattatttcacatatcatttgatgcaattcctattatggggtcattaaatgtggtgttcaaattatcctcacagacatagaaaagtgcaaaaaataatttatctaaatttgttcctgtcacctttacctccagtctctttatygctatttgcatatatcttatcaataatatatttaactcagcaagacgctattattttattcagtcaacattcatttagaattatgcacatatttatcatttctgttaatttttattccttcttgcatgcttaaccttgtattttcaatattttttatctgaaaaatatcatttggatttctgtttatgaaggtcctctattcttttgaaacacactaaagacatgattccattgaattctactttccatttttctgttgaaaatcaggttgtcatttagaaagttgttccttttaaaata

SEQ ID NO: 108430 - DNA, 601 bp, Human
ttataatgagaacatgtccacactaacacactgttcccagaataagaatgagtaactcatggaatcatatggctcctgcctgatccagccttaaatcggccaaactctaactagatccaagaggcaaaacttggaccatctcaaatcaccagagccatccaccaaaccccagcttaagaaaacagaatccaaaaacatgtgagatataaatatctaatgtggttttggagaagtttcttttgcagaaaaagctaagtgatataggtactctgctaatccaagagtttgagaaatatgtgcrcccttgttgtgtcagaaattcaggagccaaaggaaaaataggttggaaatatcaaagtttttgtaatatgaggtgaatatctaaaactagaagaaaacttttggaaagatctggaggctgtaggtaacagcatctcaaatttctccattttgcaactaaaataagaattcactttagctctcttgagttgtataagaatgtacgtaaatggtggattttccccctaggtatataatgagcagagcaattaataatttttacgtgacatttctcccaatttgtaattttttaaataaaatt

SEQ ID NO: 108431 - DNA, 601 bp, Human
tcatgcttaggcttttggtaatgctacctgcaagcttgtaaacattcctgagtaccagacctttgtcacataattttgcagtgtcctcccaccacaggcatagtgacaaccttgcactagggctctgagttcgatcatgtaatttgctttgatgaacagaaaattactacactttacatcgaaatttgagatgacctccacattaggctttcttgttcctttccggtttataatgagaacatgtccacactaacacactgttcccagaataagaatgagtaactcatggaatcatatggcycctgcctgatccagccttaaatcggccaaactctaactagatccaagaggcaaaacttggaccatctcaaatcaccagagccatccaccaaaccccagcttaagaaaacagaatccaaaaacatgtgagatataaatatctaatgtggttttggagaagtttcttttgcagaaaaagctaagtgatataggtactctgctaatccaagagtttgagaaatatgtgcgcccttgttgtgtcagaaattcaggagccaaaggaaaaataggttggaaatatcaaagtttttgtaatatgagg

SEQ ID NO: 108432 - DNA, 601 bp, Human
gacacaaaaaatatattgttaaaagagcctggtgaaatctaggatcaaaatcactacggatttatttttaaagccagatttaaatacacaaaatctaaactttttatcaaaatcacccaagattttcttggaaaccacaggaaagccaatactccttataatttggttgctgttaaccaatacttctatatggcatcactattaacaagctcataaacacacacacagacacacacacactttcactcttcaaggatgaaaggaattgctttcttgtaacttatgacatggaaaatgagtwtccaggagctcgtcctggtggaattagtcctatttttcccatgccagattttcagccaatgaataatattcatgaaacatatctctcatgcttaggcttttggtaatgctacctgcaagcttgtaaacattcctgagtaccagacctttgtcacataattttgcagtgtcctcccaccacaggcatagtgacaaccttgcactagggctctgagttcgatcatgtaatttgctttgatgaacagaaaattactacactttacatcgaaatttgagatgacctccacattaggctttcttg

SEQ ID NO: 108433 - DNA, 601 bp, Human
tcttgctataggctgaaatttttcatactgatgttgaagggaaagctgaattctcatttgctagcattcaaataaagacatatcctctttcattgctttgcaattttttccttgtttcacctttccataatttgtgttcagcccttcagttgttagggaaattttaatacccagtacatagatgacacaaaaaatatattgttaaaagagcctggtgaaatctaggatcaaaatcactacggatttatttttaaagccagatttaaatacacaaaatctaaactttttatcaaaatcaccyaagattttcttggaaaccacaggaaagccaatactccttataatttggttgctgttaaccaatacttctatatggcatcactattaacaagctcataaacacacacacagacacacacacactttcactcttcaaggatgaaaggaattgctttcttgtaacttatgacatggaaaatgagtatccaggagctcgtcctggtggaattagtcctatttttcccatgccagattttcagccaatgaataatattcatgaaacatatctctcatgcttaggcttttggtaatgctacctgca

SEQ ID NO: 108434 - DNA, 601 bp, Human
attaattcttattcataaagtctctattcttgctataggctgaaatttttcatactgatgttgaagggaaagctgaattctcatttgctagcattcaaataaagacatatcctctttcattgctttgcaattttttccttgtttcacctttccataatttgtgttcagcccttcagttgttagggaaattttaatacccagtacatagatgacacaaaaaatatattgttaaaagagcctggtgaaatctaggatcaaaatcactacggatttatttttaaagccagatttaaatacacaraatctaaactttttatcaaaatcacccaagattttcttggaaaccacaggaaagccaatactccttataatttggttgctgttaaccaatacttctatatggcatcactattaacaagctcataaacacacacacagacacacacacactttcactcttcaaggatgaaaggaattgctttcttgtaacttatgacatggaaaatgagtatccaggagctcgtcctggtggaattagtcctatttttcccatgccagattttcagccaatgaataatattcatgaaacatatctctcatg

SEQ ID NO: 108435 - DNA, 601 bp, Human
tatgggaaatactgttagtcccaaaacaactcaaattaattcttattcataaagtctctattcttgctataggctgaaatttttcatactgatgttgaagggaaagctgaattctcatttgctagcattcaaataaagacatatcctctttcattgctttgcaattttttccttgtttcacctttccataatttgtgttcagcccttcagttgttagggaaattttaatacccagtacatagatgacacaaaaaatatattgttaaaagagcctggtgaaatctaggatcaaaatcactayggatttatttttaaagccagatttaaatacacaaaatctaaactttttatcaaaatcacccaagattttcttggaaaccacaggaaagccaatactccttataatttggttgctgttaaccaatacttctatatggcatcactattaacaagctcataaacacacacacagacacacacacactttcactcttcaaggatgaaaggaattgctttcttgtaacttatgacatggaaaatgagtatccaggagctcgtcctggtggaattagtcctatttttcccatgccagattttcagc

SEQ ID NO: 108436 - DNA, 601 bp, Human
aacattctttatacttttaaattctgtgaacaatgtcaacagaaaagcaccagcttaaactaatgaatgagttcaatgctgcctttatgggaaatactgttagtcccaaaacaactcaaattaattcttattcataaagtctctattcttgctataggctgaaatttttcatactgatgttgaagggaaagctgaattctcatttgctagcattcaaataaagacatatcctctttcattgctttgcaattttttccttgtttcacctttccataatttgtgttcagcccttcagttgttrgggaaattttaatacccagtacatagatgacacaaaaaatatattgttaaaagagcctggtgaaatctaggatcaaaatcactacggatttatttttaaagccagatttaaatacacaaaatctaaactttttatcaaaatcacccaagattttcttggaaaccacaggaaagccaatactccttataatttggttgctgttaaccaatacttctatatggcatcactattaacaagctcataaacacacacacagacacacacacactttcactcttcaaggatgaaaggaattgcttt

SEQ ID NO: 108437 - DNA, 601 bp, Human
taaattagatgaagttggattcaacacagttgaataccaatgtaataatattacccagagcaaaccaactctggagactgccagagcagcaataatttgatcagctgaggagatcttttgtctcttgacccaggcaatgaaatttatcagtgctataaagccattggcaaaatttccaagaataaatgcaaccactactagaatggaaaaaacaatgtgtagaaaactcatcatgtctaaacaaaaaagcaagtaaaaaattcaggcctaatgtcactgatggtgactcctctgatattcaagactttaaattaaatatgcacttgattcctgaatgttcaataacattctttatacttttaaattctgtgaacaatgtcaacagaaaagcaccagcttaaactaatgaatgagttcaatgctgcctttatgggaaatactgttagtcccaaaacaactcaaattaattcttattcataaagtctctattcttgctataggctgaaatttttcatactgatgttgaagggaaagctgaattctcatttgctagcattcaaataaagacatatcctctttcattgctttgcaattttttcct

SEQ ID NO: 108438 - DNA, 601 bp, Human
atttatatacgtgtgtttcatcacaaggtgacaaaccaaaaagaacaaagaccccaacactatcaccagaactacactcttagccttcctttttaagtgatgaaaaataagtctggagaaattgacgatcttgagcaaataaaatatgctgaggctagtagcaagccagatgctgaaatgattggttactgcccaggcattagaaataaaaattattacttttaaattagatgaagttggattcaacacagttgaataccaatgtaataatattacccagagcaaaccaactctggagacygccagagcagcaataatttgatcagctgaggagatcttttgtctcttgacccaggcaatgaaatttatcagtgctataaagccattggcaaaatttccaagaataaatgcaaccactactagaatggaaaaaacaatgtgtagaaaactcatcatgtctaaacaaaaaagcaagtaaaaaattcaggcctaatgtcactgatggtgactcctctgatattcaagactttaaattaaatatgcacttgattcctgaatgttcaataacattctttatacttttaaattctgtgaacaatgt

SEQ ID NO: 108439 - DNA, 601 bp, Human
aaaggtgcattgcattcctcagtttgatcttccaagttacgtttccttcacattcttctgtccacacatttatatacgtgtgtttcatcacaaggtgacaaaccaaaaagaacaaagaccccaacactatcaccagaactacactcttagccttcctttttaagtgatgaaaaataagtctggagaaattgacgatcttgagcaaataaaatatgctgaggctagtagcaagccagatgctgaaatgattggttactgcccaggcattagaaataaaaattattacttttaaattagatgcagttggattcaacacagttgaataccaatgtaataatattacccagagcaaaccaactctggagactgccagagcagcaataatttgatcagctgaggagatcttttgtctcttgacccaggcaatgaaatttatcagtgctataaagccattggcaaaatttccaagaataaatgcaaccactactagaatggaaaaaacaatgtgtagaaaactcatcatgtctaaacaaaaaagcaagtaaaaaattcaggcctaatgtcactgatggtgactcctctgatattcaagactttaaat

SEQ ID NO: 108440 - DNA, 601 bp, Human
tggtatcaagtttgctagcatggctacagtcaagttggaaaggtgcattgcattcctcagtttgatcttccaagttacgtttccttcacattcttctgtccacacatttatatacgtgtgtttcatcacaaggtgacaaaccaaaaagaacaaagaccccaacactatcaccagaactacactcttagccttcctttttaagtgatgaaaaataagtctggagaaattgacgatcttgagcaaataaaatatgctgaggctagtagcaagccagatgctgaaatgattggttactgcccargcattagaaataaaaattattacttttaaattagatgaagttggattcaacacagttgaataccaatgtaataatattacccagagcaaaccaactctggagactgccagagcagcaataatttgatcagctgaggagatcttttgtctcttgacccaggcaatgaaatttatcagtgctataaagccattggcaaaatttccaagaataaatgcaaccactactagaatggaaaaaacaatgtgtagaaaactcatcatgtctaaacaaaaaagcaagtaaaaaattcaggcctaatgt

SEQ ID NO: 108441 - DNA, 601 bp, Human
cagaaagtaaatggcaagtaatatgaggaaggaggtcacagtttgcagagcttttatgtggatcttggtgctgggatcttgagatcctttgccatggagctgcatcttcttcagatgtttacacagagagtagattaacagcagaaaagatatcagggtcagagtgaatggtatcaagtttgctagcatggctacagtcaagttggaaaggtgcattgcattcctcagtttgatcttccaagttacgtttccttcacattcttctgtccacacatttatatacgtgtgtttcatcacaagktgacaaaccaaaaagaacaaagaccccaacactatcaccagaactacactcttagccttcctttttaagtgatgaaaaataagtctggagaaattgacgatcttgagcaaataaaatatgctgaggctagtagcaagccagatgctgaaatgattggttactgcccaggcattagaaataaaaattattacttttaaattagatgaagttggattcaacacagttgaataccaatgtaataatattacccagagcaaaccaactctggagactgccagagcagcaataatttgatcagct

SEQ ID NO: 108442 - DNA, 601 bp, Human
atatgattagacacagaaagtaaatggcaagtaatatgaggaaggaggtcacagtttgcagagcttttatgtggatcttggtgctgggatcttgagatcctttgccatggagctgcatcttcttcagatgtttacacagagagtagattaacagcagaaaagatatcagggtcagagtgaatggtatcaagtttgctagcatggctacagtcaagttggaaaggtgcattgcattcctcagtttgatcttccaagttacgtttccttcacattcttctgtccacacatttatatacgtgtktttcatcacaaggtgacaaaccaaaaagaacaaagaccccaacactatcaccagaactacactcttagccttcctttttaagtgatgaaaaataagtctggagaaattgacgatcttgagcaaataaaatatgctgaggctagtagcaagccagatgctgaaatgattggttactgcccaggcattagaaataaaaattattacttttaaattagatgaagttggattcaacacagttgaataccaatgtaataatattacccagagcaaaccaactctggagactgccagagcagcaat

SEQ ID NO: 108443 - DNA, 601 bp, Human
tgtgggaaatataaaatgttccagacaccatcaatttgttttctgctagaaaacacacaatgcacctcttgtgaatctatggagttgactggttctgtccttttgcccagcaagtcacctgccacaaaactgaaagaaaggtctgctttagcgtcttgttcccccaaatcagaatgaatgagtggaatgatggatatatgattccaaaagcttggcaaagcattaagacaatttcttttggtagcatcttaaaattccaaaacgatatgattagacacagaaagtaaatggcaagtaataygaggaaggaggtcacagtttgcagagcttttatgtggatcttggtgctgggatcttgagatcctttgccatggagctgcatcttcttcagatgtttacacagagagtagattaacagcagaaaagatatcagggtcagagtgaatggtatcaagtttgctagcatggctacagtcaagttggaaaggtgcattgcattcctcagtttgatcttccaagttacgtttccttcacattcttctgtccacacatttatatacgtgtgtttcatcacaaggtgacaaaccaaaaagaacaaaga

SEQ ID NO: 108444 - DNA, 601 bp, Human
tgggagtctacagtaagcaagatctatatgatctctacttttatggtatttacattgtaccaggtaagatatatgataaacaaacaaatcagatgtggagatgatttatcttaaggtttagataatattgttaaaattgcataacaccagaaattaatacagtcacacagaatttagctgttgaactaggttatacattttcttcttgtaatagaacttgctattagtgaatatgtcaacacactttctctcatttcattatttacaccaagattataataaaacatatctttaagacatytcctatcattaatatatagatttcatagatgccatagtttctataccctctttagattgagcttctttttaaagtaaggaaaatttgagctttttgaggaattttaaggatggaagataaaggaggaaattgacaattcaggagctcagaggtggcttagacaaaaaactgaaatatataacatcagatctcaacttcaaaaaggtttttgtttaattcaaaaactggaagagatgacttttctaattgcgtatggaaacttataacagcactgaaaagagctcatgatcatgtttcttc

SEQ ID NO: 108445 - DNA, 601 bp, Human
taaagattatattttagtaagatagttggtaactaaattttttaaatgaaatgtcatttttgtttatataataaccagctagaaataccacaatataaatatatcattcgcaatagaaaagatatgtgcacttatacaaaaatcttttatatgcttagtaaaaagtattgtaataaatgccatctttttattttccactttgtctttgtgtcacacatctgatatagctgcatcactgctatattatagtgatatttcccctagaattgtggaatagccaaacttttgctctgagaaattyttcttcttcttggataatcctgtaacttcaatctgaaaccagaacagaaatgtgcacccaactgtagattttgtgatgtgttacattttcattggttcaccaccccaatatagttcatattcattcattcaccaattaacttgttcatcaaagtatcatttttcaatacctattctatgtgctatctttatgtcttgggagtctacagtaagcaagatctatatgatctctacttttatggtatttacattgtaccaggtaagatatatgataaacaaacaaatcagatgtggagatgat

SEQ ID NO: 108446 - DNA, 601 bp, Human
tattattcattcatttttccatcagtttataatatggtgattaaagtggtcatttagaaaggatattaaaaatactaaataaagattatattttagtaagatagttggtaactaaattttttaaatgaaatgtcatttttgtttatataataaccagctagaaataccacaatataaatatatcattcgcaatagaaaagatatgtgcacttatacaaaaatcttttatatgcttagtaaaaagtattgtaataaatgccatctttttattttccactttgtctttgtgtcacacatctgrtatagctgcatcactgctatattatagtgatatttcccctagaattgtggaatagccaaacttttgctctgagaaattcttcttcttcttggataatcctgtaacttcaatctgaaaccagaacagaaatgtgcacccaactgtagattttgtgatgtgttacattttcattggttcaccaccccaatatagttcatattcattcattcaccaattaacttgttcatcaaagtatcatttttcaatacctattctatgtgctatctttatgtcttgggagtctacagtaagcaagatcta

SEQ ID NO: 108447 - DNA, 601 bp, Human
atgtcccagccatttctgcagtggacctccttccaaataaatgtcatcactttaatatcagacatttgctctacttctagacccctgatgataagatattcattcagtgttataattattattcattcatttttccatcagtttataatatggtgattaaagtggtcatttagaaaggatattaaaaatactaaataaagattatattttagtaagatagttggtaactaaattttttaaatgaaatgtcatttttgtttatataataaccagctagaaataccacaatataaatatatcrttcgcaatagaaaagatatgtgcacttatacaaaaatcttttatatgcttagtaaaaagtattgtaataaatgccatctttttattttccactttgtctttgtgtcacacatctgatatagctgcatcactgctatattatagtgatatttcccctagaattgtggaatagccaaacttttgctctgagaaattcttcttcttcttggataatcctgtaacttcaatctgaaaccagaacagaaatgtgcacccaactgtagattttgtgatgtgttacattttcattggttcaccaccc

SEQ ID NO: 108448 - DNA, 601 bp, Human
gtcgtcagcagagtcatatcacacattacagcacatagtgtcacatcttctcttgactcaatttccacatgtcccagccatttctgcagtggacctccttccaaataaatgtcatcactttaatatcagacatttgctctacttctagacccctgatgataagatattcattcagtgttataattattattcattcatttttccatcagtttataatatggtgattaaagtggtcatttagaaaggatattaaaaatactaaataaagattatattttagtaagatagttggtaactaaattttttaaatgaaatgtcatttttgtttatataataaccagctagaaataccacaatataaatatatcattcgcaatagaaaagatatgtgcacttatacaaaaatcttttatatgcttagtaaaaagtattgtaataaatgccatctttttattttccactttgtctttgtgtcacacatctgatatagctgcatcactgctatattatagtgatatttcccctagaattgtggaatagccaaacttttgctctgagaaattcttcttcttcttggataatcctgtaacttcaatctgaa

SEQ ID NO: 108449 - DNA, 601 bp, Human
agcagaattcaaacccgctagaggcatgcatgcatagtgggcattataagactctgtgcatgcttctcacaagcccacaggagaggggagagcaaacccctagccaattagtgcaagaccattccctctttagcagaggagtgccctctgtctcaaaaacaaaacagcaggtgcagaaaattaacccatgtataaagcccttctaagcgtgtgcgtctctaagcacaagaccctgtgcaacagtggaaattatatgctcatagtcagccatgattggagggcatgagcacatctgaatggmacaaggagtggactgcatgggacacaaacatgtgcttcctcagatttacttgactgtctcctattcccctggtcagcaccttgcctgacccacatcacccttccatttgggacttgaatggatcaccacattgtgggcatgaggtctgactttcataacctccatcaagggattggatgatggaaagcagaacagcagagatggtagttctgcctcagggaaaccctggccagtgggaaatagaagacagaagacagctgagcagatatattctccgtcctctgttgcttccatgggcta

SEQ ID NO: 108450 - DNA, 601 bp, Human
tggttgtccatttttgatccctattcagttaacctatctggcttctgccaaagccagatggattatcagatgaatgcacattagcataaacttaaatcacacttgcagatgctctctaggatgtggtaccttcactgagaaaacatggtttctggttctttgtatgaggcgtttgatttggtgaatgctttttaatctacatcgattgggagagaaaatcaaaatgatttgttttggtgaggtaagaacaaaagcactgcttcactgttttatgtcatggctatgtcacttctgttttcartttaattggcattttgcaaaacatcatgctaactcaatatattaataatattgcattaactgttacccataagcaggaagtgatgagtttctcaaatatagtaaaataccataacattgaacagaactaaataccagaagaagaaagatgaacaagaagattcagtgacctataacatagatgatgattttaggggtccagtgctcctagtccacatgctgaaacacccttttaaagtaaacagcatgttgctctctatacatctatttcctgtcactaaaaatgagacacaatatttgt

SEQ ID NO: 108451 - DNA, 601 bp, Human
caaaagttccaggaggtggttgtccatttttgatccctattcagttaacctatctggcttctgccaaagccagatggattatcagatgaatgcacattagcataaacttaaatcacacttgcagatgctctctaggatgtggtaccttcactgagaaaacatggtttctggttctttgtatgaggcgtttgatttggtgaatgctttttaatctacatcgattgggagagaaaatcaaaatgatttgttttggtgaggtaagaacaaaagcactgcttcactgttttatgtcatggctatstcacttctgttttcagtttaattggcattttgcaaaacatcatgctaactcaatatattaataatattgcattaactgttacccataagcaggaagtgatgagtttctcaaatatagtaaaataccataacattgaacagaactaaataccagaagaagaaagatgaacaagaagattcagtgacctataacatagatgatgattttaggggtccagtgctcctagtccacatgctgaaacacccttttaaagtaaacagcatgttgctctctatacatctatttcctgtcactaaaaat

SEQ ID NO: 108452 - DNA, 601 bp, Human
tcttctggcaagaaaatgagtaaaacatactaaccgcattgtccaaggaatagaattggtcaccgacatgacaaaaaactcaaaagttccaggaggtggttgtccatttttgatccctattcagttaacctatctggcttctgccaaagccagatggattatcagatgaatgcacattagcataaacttaaatcacacttgcagatgctctctaggatgtggtaccttcactgagaaaacatggtttctggttctttgtatgaggcgtttgatttggtgaatgctttttaatctacatcgattgggagagaaaatcaaaatgatttgttttggtgaggtaagaacaaaagcactgcttcactgttttatgtcatggctatgtcacttctgttttcagtttaattggcattttgcaaaacatcatgctaactcaatatattaataatattgcattaactgttacccataagcaggaagtgatgagtttctcaaatatagtaaaataccataacattgaacagaactaaataccagaagaagaaagatgaacaagaagattcagtgacctataacatagatgatgattttaggggtccagtgc

SEQ ID NO: 108453 - DNA, 601 bp, Human
cctcttctggcaagaaaatgagtaaaacatactaaccgcattgtccaaggaatagaattggtcaccgacatgacaaaaaactcaaaagttccaggaggtggttgtccatttttgatccctattcagttaacctatctggcttctgccaaagccagatggattatcagatgaatgcacattagcataaacttaaatcacacttgcagatgctctctaggatgtggtaccttcactgagaaaacatggtttctggttctttgtatgaggcgtttgatttggtgaatgctttttaatctacatcgattgggagagaaaatcaaaatgatttgttttggtgaggtaagaacaaaagcactgcttcactgttttatgtcatggctatgtcacttctgttttcagtttaattggcattttgcaaaacatcatgctaactcaatatattaataatattgcattaactgttacccataagcaggaagtgatgagtttctcaaatatagtaaaataccataacattgaacagaactaaataccagaagaagaaagatgaacaagaagattcagtgacctataacatagatgatgattttaggggtccagt

SEQ ID NO: 108454 - DNA, 601 bp, Human
gctttggctcatgttcaacctaaggtggatgtaatgggtttatatttattatctcttccagaatgttaaatgaaattaacagtttcaacagctagcagaactctcacattgcttccagacctgtatattaagggacattactgtaagtaggaccaaaaagagtcctcggtaattctcctcttctggcaagaaaatgagtaaaacatactaaccgcattgtccaaggaatagaattggtcaccgacatgacaaaaaactcaaaagttccaggaggtggttgtccatttttgatccctattcwgttaacctatctggcttctgccaaagccagatggattatcagatgaatgcacattagcataaacttaaatcacacttgcagatgctctctaggatgtggtaccttcactgagaaaacatggtttctggttctttgtatgaggcgtttgatttggtgaatgctttttaatctacatcgattgggagagaaaatcaaaatgatttgttttggtgaggtaagaacaaaagcactgcttcactgttttatgtcatggctatgtcacttctgttttcagtttaattggcattttgcaaaacatca

SEQ ID NO: 108455 - DNA, 601 bp, Human
gtaaacaacactgaagattcaccacaaaaatattcaggaaatattcacttgaccctttctcaagcacctgtagccatttcacctgtagccataacagtacccagaggaaaggacatatatccatactctcagaattttaaacatggggcctgaactaacactaataatatttgagaactaaaaaaagacactgtgtttcacagaatggagtgggaggctttgttttcggttgttcgtttttttttgtttttagagacagagtcttgtttggttgcccaggctagagtgcagcccaggctgkagtgaaatggcacaatcatagcttactgcagactcaaattcctgggctaaactgatccccctgccagaacttcctgggtagttggaactacaggcacgcagtactacaatcagtttattttctttaacaaacagggtcttgctgtcttgcccaggctgatctggaactcctggcctcaagtgctcctcccacctcagcctcccaaattgtttggattacaggtgtgagccacctcaccagtcctggagtatgagtttttgaaagtcagatgctgcataaagctttggctcatgttcaacc

SEQ ID NO: 108456 - DNA, 601 bp, Human
ctctggactgagccagttcagagaagcagagttcaatgattgaaggaaagcttacatgccctcggtaaacaacactgaagattcaccacaaaaatattcaggaaatattcacttgaccctttctcaagcacctgtagccatttcacctgtagccataacagtacccagaggaaaggacatatatccatactctcagaattttaaacatggggcctgaactaacactaataatatttgagaactaaaaaaagacactgtgtttcacagaatggagtgggaggctttgttttcggttgttcgtttttttttgtttttagagacagagtcttgtttggttgcccaggctagagtgcagcccaggctggagtgaaatggcacaatcatagcttactgcagactcaaattcctgggctaaactgatccccctgccagaacttcctgggtagttggaactacaggcacgcagtactacaatcagtttattttctttaacaaacagggtcttgctgtcttgcccaggctgatctggaactcctggcctcaagtgctcctcccacctcagcctcccaaattgtttggattacaggtgtgagccacctca

SEQ ID NO: 108457 - DNA, 601 bp, Human
ttagccagttctctggactgagccagttcagagaagcagagttcaatgattgaaggaaagcttacatgccctcggtaaacaacactgaagattcaccacaaaaatattcaggaaatattcacttgaccctttctcaagcacctgtagccatttcacctgtagccataacagtacccagaggaaaggacatatatccatactctcagaattttaaacatggggcctgaactaacactaataatatttgagaactaaaaaaagacactgtgtttcacagaatggagtgggaggctttgttttyggttgttcgtttttttttgtttttagagacagagtcttgtttggttgcccaggctagagtgcagcccaggctggagtgaaatggcacaatcatagcttactgcagactcaaattcctgggctaaactgatccccctgccagaacttcctgggtagttggaactacaggcacgcagtactacaatcagtttattttctttaacaaacagggtcttgctgtcttgcccaggctgatctggaactcctggcctcaagtgctcctcccacctcagcctcccaaattgtttggattacaggtgtg

SEQ ID NO: 108458 - DNA, 601 bp, Human
aaaaaaccagacataattgattagagattgaagaatttagaccttgggcaatctgatattttcagtttacagacaagaggaagaactagcaaaggagactaagaaattgtgccagtgaacaaggataaaatcaggagagggcagcatcctgaaatgcaaataaaccaggttcagtgctgctcatagagcatgcaacatgaaaactaaccattggcaacacagacttatcggtgatcttgcaaatgtcagatttaatggagtggtgacagtaacagcctcatttaaatgggttgatggaccratagttgaagaggcctcatactttgctaaataattataaaccaagaggggacaagagttgcaaaagctgactcctgaggtcagcctttgacattgaaaatcaaaaacccttagccagttctctggactgagccagttcagagaagcagagttcaatgattgaaggaaagcttacatgccctcggtaaacaacactgaagattcaccacaaaaatattcaggaaatattcacttgaccctttctcaagcacctgtagccatttcacctgtagccataacagtacccagaggaaaggacata

SEQ ID NO: 108459 - DNA, 601 bp, Human
caccaaaaaaaccagacataattgattagagattgaagaatttagaccttgggcaatctgatattttcagtttacagacaagaggaagaactagcaaaggagactaagaaattgtgccagtgaacaaggataaaatcaggagagggcagcatcctgaaatgcaaataaaccaggttcagtgctgctcatagagcatgcaacatgaaaactaaccattggcaacacagacttatcggtgatcttgcaaatgtcagatttaatggagtggtgacagtaacagcctcatttaaatgggttgatrgaccgatagttgaagaggcctcatactttgctaaataattataaaccaagaggggacaagagttgcaaaagctgactcctgaggtcagcctttgacattgaaaatcaaaaacccttagccagttctctggactgagccagttcagagaagcagagttcaatgattgaaggaaagcttacatgccctcggtaaacaacactgaagattcaccacaaaaatattcaggaaatattcacttgaccctttctcaagcacctgtagccatttcacctgtagccataacagtacccagaggaaagg

SEQ ID NO: 108460 - DNA, 601 bp, Human
aaaaagggttacataatttgatatatgtaactatatgtatataaataaataacatatatgaataatcagccttattcctctctattgaaccatgtggctacattatctgtaaggagactgcatgagatcaccaaaaaaaccagacataattgattagagattgaagaatttagaccttgggcaatctgatattttcagtttacagacaagaggaagaactagcaaaggagactaagaaattgtgccagtgaacaaggataaaatcaggagagggcagcatcctgaaatgcaaataaaccasgttcagtgctgctcatagagcatgcaacatgaaaactaaccattggcaacacagacttatcggtgatcttgcaaatgtcagatttaatggagtggtgacagtaacagcctcatttaaatgggttgatggaccgatagttgaagaggcctcatactttgctaaataattataaaccaagaggggacaagagttgcaaaagctgactcctgaggtcagcctttgacattgaaaatcaaaaacccttagccagttctctggactgagccagttcagagaagcagagttcaatgattgaaggaa

SEQ ID NO: 108461 - DNA, 601 bp, Human
aaaaaaagggttacataatttgatatatgtaactatatgtatataaataaataacatatatgaataatcagccttattcctctctattgaaccatgtggctacattatctgtaaggagactgcatgagatcaccaaaaaaaccagacataattgattagagattgaagaatttagaccttgggcaatctgatattttcagtttacagacaagaggaagaactagcaaaggagactaagaaattgtgccagtgaacaaggataaaatcaggagagggcagcatcctgaaatgcaaataaacyaggttcagtgctgctcatagagcatgcaacatgaaaactaaccattggcaacacagacttatcggtgatcttgcaaatgtcagatttaatggagtggtgacagtaacagcctcatttaaatgggttgatggaccgatagttgaagaggcctcatactttgctaaataattataaaccaagaggggacaagagttgcaaaagctgactcctgaggtcagcctttgacattgaaaatcaaaaacccttagccagttctctggactgagccagttcagagaagcagagttcaatgattgaagg

SEQ ID NO: 108462 - DNA, 601 bp, Human
aatcccctgcctatcaatctacatggctattttaaataaaacttaattagctatctggtcaccatcactctgatttagcagaaattcaagtaaaaacattattgatgctccgaccttctccatagatttttagtattgtgacttttaaatgtaactttgacatttgaaaaaaagggttacataatttgatatatgtaactatatgtatataaataaataacatatatgaataatcagccttattcctctctattgaaccatgtggctacattatctgtaaggagactgcatgagatcaccaaaaaaaccagacataattgattagagattgaagaatttagaccttgggcaatctgatattttcagtttacagacaagaggaagaactagcaaaggagactaagaaattgtgccagtgaacaaggataaaatcaggagagggcagcatcctgaaatgcaaataaaccaggttcagtgctgctcatagagcatgcaacatgaaaactaaccattggcaacacagacttatcggtgatcttgcaaatgtcagatttaatggagtggtgacagtaacagcctcatttaaatgggttgatggacc

SEQ ID NO: 108463 - DNA, 601 bp, Human
tgaaagactgaagtggtcattaacagaagagggaaaggctatagaagaaacaacgctggagactagagggaagatcactattttgatttggacatgttagttcaagttcttgttacgacatccaaatgaagatgtcaaatgacttcttagagaaaggattctagagaccaggattgacttctgagctgaagaattaaatattggcatcaacagcacacagaaagtaactaaggttatgactagatgaacttacctaagaagtgggagtaaaaacagaatgataaaaacatgagtgtagacyattatttcataccatatataaaaattaactcataattaattgatcatagagaaaaatataaaaacagattactgagatactaagacattaactgtaccaagtacaataagtcaaaatgggttaatcaatcattattctatctgtatatttccttacttatatcatttttttctataatgataatcccctgcctatcaatctacatggctattttaaataaaacttaattagctatctggtcaccatcactctgatttagcagaaattcaagtaaaaacattattgatgctccgaccttct

SEQ ID NO: 108464 - DNA, 601 bp, Human
gagagtacatcaggagaaaatgatgtgcagaactagaaagaataattaggagttgatggcaattatcttggctaggtatggcagcagtttagatgagtatggcaaaagtgatgacaagggattggattctgtatgtttttgagggtagaaccaacaagagggtagaaccaacaaaatttgctgatgccttagagatgagttctgaaagagagaaaatgttaactccgtgtttttggtctaagcatctgaaagactgaagtggtcattaacagaagagggaaaggctatagaagaaacaackctggagactagagggaagatcactattttgatttggacatgttagttcaagttcttgttacgacatccaaatgaagatgtcaaatgacttcttagagaaaggattctagagaccaggattgacttctgagctgaagaattaaatattggcatcaacagcacacagaaagtaactaaggttatgactagatgaacttacctaagaagtgggagtaaaaacagaatgataaaaacatgagtgtagaccattatttcataccatatataaaaattaactcataattaattgatcatagagaaa

SEQ ID NO: 108465 - DNA, 601 bp, Human
agtgatagtgtttagtgttgatttctgagaaagagcattccgagaagaagggacacaagtacgaagtccctgaggcaattcttggtacattcaagaaattacacaaagtccagtgttgctagcatgggatagccaggcattttaggacagacaggcagacaaaatccgatcattcaaatgattataggactttgtaaggattttggccttactctaatgagatgagaagccactgaaaaatctaaagctgaagaatggcatgatcaaatttgcatcttcataggctctctttggctgctaycttgagagtacatcaggagaaaatgatgtgcagaactagaaagaataattaggagttgatggcaattatcttggctaggtatggcagcagtttagatgagtatggcaaaagtgatgacaagggattggattctgtatgtttttgagggtagaaccaacaagagggtagaaccaacaaaatttgctgatgccttagagatgagttctgaaagagagaaaatgttaactccgtgtttttggtctaagcatctgaaagactgaagtggtcattaacagaagagggaaaggctatagaagaaac

SEQ ID NO: 108466 - DNA, 601 bp, Human
ggcctcaatgattcagtgatgtttgatgagtgatagtgtttagtgttgatttctgagaaagagcattccgagaagaagggacacaagtacgaagtccctgaggcaattcttggtacattcaagaaattacacaaagtccagtgttgctagcatgggatagccaggcattttaggacagacaggcagacaaaatccgatcattcaaatgattataggactttgtaaggattttggccttactctaatgagatgagaagccactgaaaaatctaaagctgaagaatggcatgatcaaatttgmatcttcataggctctctttggctgctatcttgagagtacatcaggagaaaatgatgtgcagaactagaaagaataattaggagttgatggcaattatcttggctaggtatggcagcagtttagatgagtatggcaaaagtgatgacaagggattggattctgtatgtttttgagggtagaaccaacaagagggtagaaccaacaaaatttgctgatgccttagagatgagttctgaaagagagaaaatgttaactccgtgtttttggtctaagcatctgaaagactgaagtggtcattaa

SEQ ID NO: 108467 - DNA, 601 bp, Human
acagtctcttcactaaatggtgctgggaaaattggatatccatttgcagaaaaatgaaactagatgcctatttatcaccatatacaaagatcaaatcaaggaggcctcaatgattcagtgatgtttgatgagtgatagtgtttagtgttgatttctgagaaagagcattccgagaagaagggacacaagtacgaagtccctgaggcaattcttggtacattcaagaaattacacaaagtccagtgttgctagcatgggatagccaggcattttaggacagacaggcagacaaaatccgatyattcaaatgattataggactttgtaaggattttggccttactctaatgagatgagaagccactgaaaaatctaaagctgaagaatggcatgatcaaatttgcatcttcataggctctctttggctgctatcttgagagtacatcaggagaaaatgatgtgcagaactagaaagaataattaggagttgatggcaattatcttggctaggtatggcagcagtttagatgagtatggcaaaagtgatgacaagggattggattctgtatgtttttgagggtagaaccaacaagagggtagaa

SEQ ID NO: 108468 - DNA, 601 bp, Human
cttttcagattttcgattggtctttgatatcctgtggcatttgtttttaattggttttagttatctcatctaaattttaatggcttctgaaaatatacggatgtctcagaatagccaaagttatcctgagcaaaaagaacaaaactggaggaatcacatcacctgacttcaaagtatattacagagctatagtaaccaaaacagcatggtactggcataaaaacagacacatagagcagcgaaatagaatagagaatgtggaaacaaatccacacctatagagaactcatgacaaaggtgscaagaacatactctggggaaaggacagtctcttcactaaatggtgctgggaaaattggatatccatttgcagaaaaatgaaactagatgcctatttatcaccatatacaaagatcaaatcaaggaggcctcaatgattcagtgatgtttgatgagtgatagtgtttagtgttgatttctgagaaagagcattccgagaagaagggacacaagtacgaagtccctgaggcaattcttggtacattcaagaaattacacaaagtccagtgttgctagcatgggatagccaggcattttagga

SEQ ID NO: 108469 - DNA, 601 bp, Human
ttgaaacacactgaagacatgattccattgaattctagcttcaattttgtctgttgaaaataagattgtcatttagacagttgtttctttttacataaagtttttcctctacctacttttcagattttcgattggtctttgatatcctgtggcatttgtttttaattggttttagttatctcatctaaattttaatggcttctgaaaatatacggatgtctcagaatagccaaagttatcctgagcaaaaagaacaaaactggaggaatcacatcacctgacttcaaagtatattacagarctatagtaaccaaaacagcatggtactggcataaaaacagacacatagagcagcgaaatagaatagagaatgtggaaacaaatccacacctatagagaactcatgacaaaggtgccaagaacatactctggggaaaggacagtctcttcactaaatggtgctgggaaaattggatatccatttgcagaaaaatgaaactagatgcctatttatcaccatatacaaagatcaaatcaaggaggcctcaatgattcagtgatgtttgatgagtgatagtgtttagtgttgatttctgagaaa

SEQ ID NO: 108470 - DNA, 601 bp, Human
tttggttttgaaacacactgaagacatgattccattgaattctagcttcaattttgtctgttgaaaataagattgtcatttagacagttgtttctttttacataaagtttttcctctacctacttttcagattttcgattggtctttgatatcctgtggcatttgtttttaattggttttagttatctcatctaaattttaatggcttctgaaaatatacggatgtctcagaatagccaaagttatcctgagcaaaaagaacaaaactggaggaatcacatcacctgacttcaaagtataytacagagctatagtaaccaaaacagcatggtactggcataaaaacagacacatagagcagcgaaatagaatagagaatgtggaaacaaatccacacctatagagaactcatgacaaaggtgccaagaacatactctggggaaaggacagtctcttcactaaatggtgctgggaaaattggatatccatttgcagaaaaatgaaactagatgcctatttatcaccatatacaaagatcaaatcaaggaggcctcaatgattcagtgatgtttgatgagtgatagtgtttagtgttgatttc

SEQ ID NO: 108471 - DNA, 601 bp, Human
gaatgtgttgtaatgattcattcatctttagttgatacatatttggggggtttcttttttgaagagttatgaataattctagtatgaccattctttcatatatcatttgattcatttcctttggatatatacatagaaagataattacagggtcatcaaatatagctttcaaattctcttcacagacatagaaaattccaaatttaaattaactaaattcactttttgatacctttacttacagactatatatggctatttctatatatcttattaaatacttaacccaaaaagacaccaycactttatacagtcaaaatttatttagacttatgcacatatttaccacttctattatttattattccttcatgcatgttcagctttatatttttagtaattttccttttatctaaaaaatattcttttgaatttctatttgttaaagtccgctttggttttgaaacacactgaagacatgattccattgaattctagcttcaattttgtctgttgaaaataagattgtcatttagacagttgtttctttttacataaagtttttcctctacctacttttcagattttcgattggtctttg

SEQ ID NO: 108472 - DNA, 601 bp, Human
tacgtttctgaaatttactcacatacttgcatctttatgtgattcatttcttttcacttctctatattattccattgtatgaatgtgttgtaatgattcattcatctttagttgatacatatttggggggtttcttttttgaagagttatgaataattctagtatgaccattctttcatatatcatttgattcatttcctttggatatatacatagaaagataattacagggtcatcaaatatagctttcaaattctcttcacagacatagaaaattccaaatttaaattaactaaattcwctttttgatacctttacttacagactatatatggctatttctatatatcttattaaatacttaacccaaaaagacaccaccactttatacagtcaaaatttatttagacttatgcacatatttaccacttctattatttattattccttcatgcatgttcagctttatatttttagtaattttccttttatctaaaaaatattcttttgaatttctatttgttaaagtccgctttggttttgaaacacactgaagacatgattccattgaattctagcttcaattttgtctgttgaaaat

SEQ ID NO: 108473 - DNA, 601 bp, Human
atggcttcttggactcacctttacgtttctgaaatttactcacatacttgcatctttatgtgattcatttcttttcacttctctatattattccattgtatgaatgtgttgtaatgattcattcatctttagttgatacatatttggggggtttcttttttgaagagttatgaataattctagtatgaccattctttcatatatcatttgattcatttcctttggatatatacatagaaagataattacagggtcatcaaatatagctttcaaattctcttcacagacatagaaaattccraatttaaattaactaaattcactttttgatacctttacttacagactatatatggctatttctatatatcttattaaatacttaacccaaaaagacaccaccactttatacagtcaaaatttatttagacttatgcacatatttaccacttctattatttattattccttcatgcatgttcagctttatatttttagtaattttccttttatctaaaaaatattcttttgaatttctatttgttaaagtccgctttggttttgaaacacactgaagacatgattccattgaattctagct

SEQ ID NO: 108474 - DNA, 601 bp, Human
ttttgcctactttaaacctttaagccatatgtaggtgtagtcctgtatgttcctgttcatggcttcttggactcacctttacgtttctgaaatttactcacatacttgcatctttatgtgattcatttcttttcacttctctatattattccattgtatgaatgtgttgtaatgattcattcatctttagttgatacatatttggggggtttcttttttgaagagttatgaataattctagtatgaccattctttcatatatcatttgattcatttcctttggatatatacatagaaagakaattacagggtcatcaaatatagctttcaaattctcttcacagacatagaaaattccaaatttaaattaactaaattcactttttgatacctttacttacagactatatatggctatttctatatatcttattaaatacttaacccaaaaagacaccaccactttatacagtcaaaatttatttagacttatgcacatatttaccacttctattatttattattccttcatgcatgttcagctttatatttttagtaattttccttttatctaaaaaatattcttttgaatttctatttg

SEQ ID NO: 108475 - DNA, 601 bp, Human
gcgatctcagctcactgcaacctccacctcccgggttcaagcaattctcctccctcagccttccaagtagctgggactacaggcgcatgccaccacacccagctaactttttgtatttttagtacagacagggttttgccatgttggccaggttggtcttgaactcctgacctcaggtgatccacccgcctcggcctcccaaagtgctgggattacaggcgtgagccaccgcgcctggccttgattttctttatacattaacaactaggtatgcaaccctaaactttatgatacggttttrcctactttaaacctttaagccatatgtaggtgtagtcctgtatgttcctgttcatggcttcttggactcacctttacgtttctgaaatttactcacatacttgcatctttatgtgattcatttcttttcacttctctatattattccattgtatgaatgtgttgtaatgattcattcatctttagttgatacatatttggggggtttcttttttgaagagttatgaataattctagtatgaccattctttcatatatcatttgattcatttcctttggatatatacatagaaagataatt

SEQ ID NO: 108476 - DNA, 601 bp, Human
caggagtgcagtggcgcgatctcagctcactgcaacctccacctcccgggttcaagcaattctcctccctcagccttccaagtagctgggactacaggcgcatgccaccacacccagctaactttttgtatttttagtacagacagggttttgccatgttggccaggttggtcttgaactcctgacctcaggtgatccacccgcctcggcctcccaaagtgctgggattacaggcgtgagccaccgcgcctggccttgattttctttatacattaacaactaggtatgcaaccctaaactytatgatacggttttgcctactttaaacctttaagccatatgtaggtgtagtcctgtatgttcctgttcatggcttcttggactcacctttacgtttctgaaatttactcacatacttgcatctttatgtgattcatttcttttcacttctctatattattccattgtatgaatgtgttgtaatgattcattcatctttagttgatacatatttggggggtttcttttttgaagagttatgaataattctagtatgaccattctttcatatatcatttgattcatttcctttggatatata

SEQ ID NO: 108477 - DNA, 601 bp, Human
tgatcatttccttgattttctttttttttgagacagagtctcgctctatcacccaggcaggagtgcagtggcgcgatctcagctcactgcaacctccacctcccgggttcaagcaattctcctccctcagccttccaagtagctgggactacaggcgcatgccaccacacccagctaactttttgtatttttagtacagacagggttttgccatgttggccaggttggtcttgaactcctgacctcaggtgatccacccgcctcggcctcccaaagtgctgggattacaggcgtgagccaycgcgcctggccttgattttctttatacattaacaactaggtatgcaaccctaaactttatgatacggttttgcctactttaaacctttaagccatatgtaggtgtagtcctgtatgttcctgttcatggcttcttggactcacctttacgtttctgaaatttactcacatacttgcatctttatgtgattcatttcttttcacttctctatattattccattgtatgaatgtgttgtaatgattcattcatctttagttgatacatatttggggggtttcttttttgaagagttatgaat

SEQ ID NO: 108478 - DNA, 601 bp, Human
tgtataaatggtgaattttttgcaaggtatacaatgagcagaataattaatattctttatggagcatttttccagttaataatttttaaatacaattataatgcacacttagaaatgggtgaaaactaagatggtaaacatagcaatgtgtcataaacactcatgcaaccatcaagcagggcaaaacatgtcacattgcaaatagcctaggtccacctccatgccactctccaagcccctacacctttcttcacataccctgaggagagcaatagccataatttagaatgatcatttcctygattttctttttttttgagacagagtctcgctctatcacccaggcaggagtgcagtggcgcgatctcagctcactgcaacctccacctcccgggttcaagcaattctcctccctcagccttccaagtagctgggactacaggcgcatgccaccacacccagctaactttttgtatttttagtacagacagggttttgccatgttggccaggttggtcttgaactcctgacctcaggtgatccacccgcctcggcctcccaaagtgctgggattacaggcgtgagccaccgcgcctggcct

SEQ ID NO: 108479 - DNA, 601 bp, Human
tcagtttgcctgcacttgatccatcctaaattggccaaagtctaactagctccaagatgcagaacttggcccatctcaagtcaccagagctatccaccaaacccagcttagaaaacctgaatccaaagatatatgagataaaaatatctaacgtagttttggagggtttctctagtagaaaaacctaactggtacagctactatgctacaccaagagtgtggggaaatatatttgcccctgttttgtcaggaattcaggagccaaaagaaaaatagatggggagtggcaaagttttgtcaygtgaggtagataattaaaggtaataaaaaaatgtttgaaaggatttgtgtgctgcaggtagcatcatctgaaatttccatatgttgcagctaaaataaagttcctacttcaactctctaagagttgtataaaaatgtgtataaatggtgaattttttgcaaggtatacaatgagcagaataattaatattctttatggagcatttttccagttaataatttttaaatacaattataatgcacacttagaaatgggtgaaaactaagatggtaaacatagcaatgtgtcataaacactcat

SEQ ID NO: 108480 - DNA, 601 bp, Human
tcttttactcagcacctaatctgacacaaaatcaaaagaaaggtgtgttttagcttcttggttctccaaattaggatgaatgagtcgaatgcaagatatatgtttccaacagccttgctaaccatgacaaccgggtcattccgcagcctcctaggactccaaaccgaaacgattaggaatagaaagaaaatggcacataacaagaggaaggagatcagagtttgcaaagcttttatgtggaccttggtgctgagatcttgcgatccttctccatggagctgcatcttcttgagatgtttayacagagaacagattagcatcagaaaagatatcagggacagagtaaagggtatgaagctccatagggtagttacagtcaaatatgaaagatgtactgtattcctcaatttcatcttcccagtcatgtttccttcatattcttctgcccacatactctcatccatgtttgccacaagaagatgacaaaccaaaaatatcaaagtccccaacagtatcaccagaatgacactcctaactctcctctttaaatgaagaaaaagaaggttggagaaattggcaatcttgagcaaataaaatatgc

SEQ ID NO: 108481 - DNA, 601 bp, Human
actttaggtaaaagacttttctaggtatgctttcagaaaatactcaaaaacatacactacagaaaaaacagtaaaaagtataaaatgttccagacactatcagtttgttttctcctagaatacacacacaatgtcccacttgtgaatctagagagttgagagtttcaggtcttttactcagcacctaatctgacacaaaatcaaaagaaaggtgtgttttagcttcttggttctccaaattaggatgaatgagtcgaatgcaagatatatgtttccaacagccttgctaaccatgacaacygggtcattccgcagcctcctaggactccaaaccgaaacgattaggaatagaaagaaaatggcacataacaagaggaaggagatcagagtttgcaaagcttttatgtggaccttggtgctgagatcttgcgatccttctccatggagctgcatcttcttgagatgtttacacagagaacagattagcatcagaaaagatatcagggacagagtaaagggtatgaagctccatagggtagttacagtcaaatatgaaagatgtactgtattcctcaatttcatcttcccagtcatgtttcct

SEQ ID NO: 108482 - DNA, 601 bp, Human
actcaaaaactggaagaaatgacttttctaactgcatgttgagacttatgacaacataagtcatcacggtgtttctttcttcatccttattatagaaatgacttttttctcaaatgttcacatatttgtattaagtctattattcctcagtactgtttatggtagacatatacaaaatgtgttctaaatatatttgtcatccttgaatattattctgtgcatctttttctgaaaataattatgctggctataaactaaacataaaattagaattcatgatgaaataaaaactaccccaaaratgaaacctcattattgatttagaattgagtgtgcttactatcaaaaaatttagatgtttaagcacactgtggtacatatgtgtggtaaaaatcagtggaaaagagcaaagattttgagataatgtgtcacttcttaacaattataagtaaagatcacacagttttcaagtgaaacatgataatatgaaatgtatatgtgaaatatacatgggttcatgattctgaaaaacttcttaccatattttctataatttggcatcttgtgaaaatatgattaacattatgttattgtcaatgtc

SEQ ID NO: 108483 - DNA, 601 bp, Human
agaacttgctattactgaatatatcaacacactgtctcattgtattatttgcaactagattataatacaacatatattttagatgttttctatcattaatacatagatttcatagatgccattttaacatttgcaaaaagtttaattcaaatgatttttataatttctatactatttttacatagagtatttttctaaggtagggaagactcaagttcttttatgtgaagtttaaaaagaatttcaagtatggaagatagaggagatcattggcaattcagggactctgaggtggtttagaaaaaaaaaacctgaaatacttgacatcagatctcaacttcaaaaaaggttttctttaactcaaaaactggaagaaatgacttttctaactgcatgttgagacttatgacaacataagtcatcacggtgtttctttcttcatccttattatagaaatgacttttttctcaaatgttcacatatttgtattaagtctattattcctcagtactgtttatggtagacatatacaaaatgtgttctaaatatatttgtcatccttgaatattattctgtgcatctttttctgaaaataattatg

SEQ ID NO: 108484 - DNA, 601 bp, Human
atcagcagagtcatatcatacatcacaagacatggtttcacatttgctttgcctcaatttccacatgtcctggccattgctgccctggacttatcttccaaataaatgttatcactttaacatcagacattggctctagttctagacacccaaggctaagatactcgtttagtgttataattgttatttatgcatttttctgtgggtttttaatatggcaatttaaatgttcatttagaaagggttttaaaatattctataaaagtcacgttttagtaaggtagttggtaactaactcagttttttttaatgaaatgccatttttgtttatacactaaccagctggaaatatcacaatacaaatatatcattcacaactgaaaaattgtatgcaaagataccaaaatcttttatattgatgtgctttttaaaatgtatcacaataggtacaagctgattttgatgttccacattatcttcccatcacacatcgaatatggcttcatcagggctatcttagagtggtatttcccctacaattgtataatggccatacttctgctctgagaaatacttcttcttagataattctgtaacctca

SEQ ID NO: 108485 - DNA, 601 bp, Human
ttctgtcagggctgtcacttctgctttcagtttaattgacattttgcaaaacatcatgttaattcaatatattaataatattacataaagtggtacccataagcaggaagtggcaagttccttaagtatagtaaaatattataacattgaacagaagtaaaatactggaagaagagacataaacttcagcagattcaaagacctataacatagatgaagtttataggggtccaatgcttctggtccttttgtcaaaacatcctttttacagtaaatggcatgttgccctatatatatatayttcctatcactaaaagggaaatacagttttatgggggcttattggggttttgaattcaacatataccacatttaaggatatttctctgactcactaaaggagtttgcaagggctgcttgtctcaagtcaaacccgaaacaaaaacgggctctatagcagatatagagtctggcccaagttgcttggccattgtgccagatgatgtaacagaattcaaagttgctacaggcatgcatagtgggcattataggactctgtgcatgcctctcacaagcccataggagtggggagagcaaactc

SEQ ID NO: 108486 - DNA, 601 bp, Human
atcctcctgcctgagtcttctgggtagctgtaactacaggcacacactaccacaaacaactaatttttttttttttttttacagattcttactatgttgccaaggctgatctgaaactctcagcctaaagtgatcctcccacttcggcctcctaaattattaggattacaggtatgagctgcctcaataggactggagtatgagtttttgaagatcagatggtacatagagctttggcccatgtccaacccaaaggggttctaatgagttcatcgtagttaccccttcctgaaagtgtaaktgaagttgacaggttcaacagctgtcaggactcttacatttcttcctgacctgtataccaagggacattattgtaagcaggaccaaggggaggcttctgaaattctactttcctggcaataaaatgaataaaacataataactgcattctccaggaaacagaattggtcgctgccacaacaaaaaactcaaaagttccagggggcggtcgtccattttatatctttattcagttaacctaactggcctctgtcaaaaccagatggattataggatgaatgcacattagcataaacttaag

SEQ ID NO: 108487 - DNA, 601 bp, Human
atatatataaatacatatgaataatcagccttattcctctctattgaaccatttggctacattatcagtaaggagactccatgagatcaccaacaaaacaagcccgattgattaaaggttgaagaactgagaccttgggcagtgtgatattttcaatttagagacaagagagaactagcaaaggagactgagaagtggtgcccagtaaataaggaaaaaatcaggagagggcagcatcctggaatgcaaataaactatattcagtactgctcacagagcatgcaacatgaagaccgaccaytggcaacacagactccctggtgatcttccaaatgtcagattcaatgaagtggtgacaacagccttattgaaatgggttgataggccaatagttgaagaggcttcatactttgctaaataattataaaccaagagggggaaagagttgaaaaagctgattcctgaggtcagcctttaacattgaaaatggaaaaccctcagccagttctcagggctgagccaattcagagaagcagaattcaatgattgaagggaatcttaagtcctcttgatgatggacattgaaaatgcactgcaagaa

SEQ ID NO: 108488 - DNA, 601 bp, Human
atgtgttttccactgaagaaactagacttctctacatgtgatatttgaatatatttttttctttttaatttatttttgattacttaatggcttaagattaatagatgctaaaataagactccaaccttggattgtatttcttttcagttttgataatataattgtttctaagaaatgatcttcaagtctgatggccaggacagaaacccagatactctgtttcatatagatatgaacttagactatattttacaactactatcagccttaggatagccatctgtaaaacgcacacaataayaataccctccttgagtaggctttatgagaagttagtacactacttgtataactgcttgcaatttcacctgtctgatacaggcagaaaccaagtgttgctaggttttcatttgatcctgtgttacttgatatgtagaagttacctgtgaaaacttccactcttgagtagatacagcaggttccagcaggcaaaatattcttctgcagcagctaggataagataaataaaaggccaaaattatattttcaattcatcggagagctgtgcaaacaaggagggccagctaaactaaaatccagc

SEQ ID NO: 108489 - DNA, 601 bp, Human
catggatgggagaaattattgtcctataattttcaaaatgaagaataaatttcagggaggtcatgtaggttgaaaagtccttattttcccactcatgctttttagcccattttcaatatttatcaaactgatctctcatgcttaggtctataagtaagttatccttttgggtctattaagtctttaaatattaattatttaattaaaaatattaagcaattttgtaaatattccttgagcacttaaaaaacatgtgttttccactgaagaaactagacttctctacatgtgatatttgaakatatttttttctttttaatttatttttgattacttaatggcttaagattaatagatgctaaaataagactccaaccttggattgtatttcttttcagttttgataatataattgtttctaagaaatgatcttcaagtctgatggccaggacagaaacccagatactctgtttcatatagatatgaacttagactatattttacaactactatcagccttaggatagccatctgtaaaacgcacacaataacaataccctccttgagtaggctttatgagaagttagtacactacttgtat

SEQ ID NO: 108490 - DNA, 601 bp, Human
gtctaatatcactgggcatgatcccccttaaggtcctgaccttaaactctatgtgtacctgaattctgaatgtgcactaatatttttgatgcttttaaattcagttgtgtgaccaatgtcaagcagtaaagcaccagcacatgcttatagatgagttcaatgctgtctttatggaaaatatgttattctcagaacagctcaagttaactactattcatacactgttctttctattttttcttttgaaaaaatttgaataaaatttttcataatgacgttgaagtaaaagctgatttttcayttgcaagcatgcaaatgaagacatattctctttcattgttttgcaattttttccctctttaacttctccataatttttgttcagcaacatcagttgttaggaaaattttaaaacccaatacatagattatatattggatatctacatttttgaagggagtttggtcgtaactagaatcatggccaaagtgaatttgttttcctcagtaccagatttatgtagacagaatccaacttttcctatcaaatgcattcaagatttttttgggaaccccaggaaggccagtactctttaaaatct

SEQ ID NO: 108491 - DNA, 601 bp, Human
gcaagtctaatatcactgggcatgatcccccttaaggtcctgaccttaaactctatgtgtacctgaattctgaatgtgcactaatatttttgatgcttttaaattcagttgtgtgaccaatgtcaagcagtaaagcaccagcacatgcttatagatgagttcaatgctgtctttatggaaaatatgttattctcagaacagctcaagttaactactattcatacactgttctttctattttttcttttgaaaaaatttgaataaaatttttcataatgacgttgaagtaaaagctgatttytcacttgcaagcatgcaaatgaagacatattctctttcattgttttgcaattttttccctctttaacttctccataatttttgttcagcaacatcagttgttaggaaaattttaaaacccaatacatagattatatattggatatctacatttttgaagggagtttggtcgtaactagaatcatggccaaagtgaatttgttttcctcagtaccagatttatgtagacagaatccaacttttcctatcaaatgcattcaagatttttttgggaaccccaggaaggccagtactctttaaa

SEQ ID NO: 108492 - DNA, 601 bp, Human
ccaccattactagtatggaaaaaaatgattggtagtaaacttcccatgaactgaacaaacacaccttaaaaaaaggcaagtctaatatcactgggcatgatcccccttaaggtcctgaccttaaactctatgtgtacctgaattctgaatgtgcactaatatttttgatgcttttaaattcagttgtgtgaccaatgtcaagcagtaaagcaccagcacatgcttatagatgagttcaatgctgtctttatggaaaatatgttattctcagaacagctcaagttaactactattcatacastgttctttctattttttcttttgaaaaaatttgaataaaatttttcataatgacgttgaagtaaaagctgatttttcacttgcaagcatgcaaatgaagacatattctctttcattgttttgcaattttttccctctttaacttctccataatttttgttcagcaacatcagttgttaggaaaattttaaaacccaatacatagattatatattggatatctacatttttgaagggagtttggtcgtaactagaatcatggccaaagtgaatttgttttcctcagtaccagatttatgta

SEQ ID NO: 108493 - DNA, 601 bp, Human
tggcatgttgcaagggaaatttggagtgtttaacaggccctgaaaggactcatacaaagtgttgaaatataaaaatgtttatacatttaatataggtgtcatgggaaaatacaaattccaccattactagtatggaaaaaaatgattggtagtaaacttcccatgaactgaacaaacacaccttaaaaaaaggcaagtctaatatcactgggcatgatcccccttaaggtcctgaccttaaactctatgtgtacctgaattctgaatgtgcactaatatttttgatgcttttaaattcagytgtgtgaccaatgtcaagcagtaaagcaccagcacatgcttatagatgagttcaatgctgtctttatggaaaatatgttattctcagaacagctcaagttaactactattcatacactgttctttctattttttcttttgaaaaaatttgaataaaatttttcataatgacgttgaagtaaaagctgatttttcacttgcaagcatgcaaatgaagacatattctctttcattgttttgcaattttttccctctttaacttctccataatttttgttcagcaacatcagttgttaggaaa

SEQ ID NO: 108494 - DNA, 601 bp, Human
attatctaatcagctcaaatttgtttattttctttgttatatacatttcttgtaaacatgtctctctagttggttcattttgattactgtatagtactatactattatataggtatgccataatttatttatctattttatcactgatagacatttgagaaacttctcaactttagctatgaaaacacagtgatattcatgtgtgtgtatacattttctggtaagagtacctgtactgagtcttaagatgtgctccttcatcttcatcagataatgccatactaagccaaagaattatatyaatttatacttctaggagcagtgtttgaaaattctcattacttcttgttcttttcaaaatgagtaatatcagaataattttcacacttttatatttatataaaaattattaaacttaacattttataattctttttctattcaattttaaaacgtaactttagttcaaaaattacatattactcttttatcattctatgattgtgattttatacacatttctcaagaatgaattgtatattttatgcacttattcgtattctattattaaattttctaatcatttttcatgaagtttcaa

SEQ ID NO: 108495 - DNA, 601 bp, Human
tgttgtaatagtcactcatatgtttcactttagagttttgtcaccaatgtaataaattgcaatgtattaaagatatatttttgaaaactttatataaatggaattaaaatgaatgtttttcactatggatagatcctcttacacttgtgagtattatctaatcagctcaaatttgtttattttctttgttatatacatttcttgtaaacatgtctctctagttggttcattttgattactgtatagtactatactattatataggtatgccataatttatttatctattttatcactgatrgacatttgagaaacttctcaactttagctatgaaaacacagtgatattcatgtgtgtgtatacattttctggtaagagtacctgtactgagtcttaagatgtgctccttcatcttcatcagataatgccatactaagccaaagaattatattaatttatacttctaggagcagtgtttgaaaattctcattacttcttgttcttttcaaaatgagtaatatcagaataattttcacacttttatatttatataaaaattattaaacttaacattttataattctttttctattcaatttt

SEQ ID NO: 108496 - DNA, 601 bp, Human
tggtcaaaaaatagaattttccagccatccagacactccccatatatgccttctgttgatcccattctcctcttgttttcctcctccctactatccatattgttgtaatagtcactcatatgtttcactttagagttttgtcaccaatgtaataaattgcaatgtattaaagatatatttttgaaaactttatataaatggaattaaaatgaatgtttttcactatggatagatcctcttacacttgtgagtattatctaatcagctcaaatttgtttattttctttgttatatacatttyttgtaaacatgtctctctagttggttcattttgattactgtatagtactatactattatataggtatgccataatttatttatctattttatcactgatagacatttgagaaacttctcaactttagctatgaaaacacagtgatattcatgtgtgtgtatacattttctggtaagagtacctgtactgagtcttaagatgtgctccttcatcttcatcagataatgccatactaagccaaagaattatattaatttatacttctaggagcagtgtttgaaaattctcattacttcttgt

SEQ ID NO: 108497 - DNA, 601 bp, Human
acttttggatgccagcaggaacaaattctgtgcaggccccgcagcagcatctgggggggtgcccgcacccctgaaacctcgagggggagggtgttacagtgctcttttagctctgctatctgcagacgtcttaagtgttagtagctcagtgggccctttgccttttcgcttgaggcggctgcctcttgccagcaagggcagaggttcagtgtaacaacttttcgtatctgcattcctggctcctgagctcttgtccagcttccaagaaaaatgaggttgcacaaccgaattggagaatggkaaatgagggagattttattttgatggaagtgactctcagcaggaaggggagctggaaagggaatgtgaagcaggaaggtaatcttcccctgaagtccggctgtctccagccagactcttctcgaaagtcacgccttcaacctgtccctctgaagtcaagccacttctctccaacgtcccaccatagtctacaacattgagctgcttctcctctcgatcttcagccacttctcactaccggtggagcctggggttttatgggcataggatgaggggtggggcaggccaaaaaaggcaacat

SEQ ID NO: 108498 - DNA, 601 bp, Human
ttagggctggcaggggtgaaatccactcgctgggacccactgcgcccagccctcatgggagggagcacacaggtgaacaggtgcaggagcacttttggatgccagcaggaacaaattctgtgcaggccccgcagcagcatctgggggggtgcccgcacccctgaaacctcgagggggagggtgttacagtgctcttttagctctgctatctgcagacgtcttaagtgttagtagctcagtgggccctttgccttttcgcttgaggcggctgcctcttgccagcaagggcagaggttcagtktaacaacttttcgtatctgcattcctggctcctgagctcttgtccagcttccaagaaaaatgaggttgcacaaccgaattggagaatggtaaatgagggagattttattttgatggaagtgactctcagcaggaaggggagctggaaagggaatgtgaagcaggaaggtaatcttcccctgaagtccggctgtctccagccagactcttctcgaaagtcacgccttcaacctgtccctctgaagtcaagccacttctctccaacgtcccaccatagtctacaacattgagctgcttctcc

SEQ ID NO: 108499 - DNA, 601 bp, Human
tgggataacacaattattctttctcctggctttatgattctcatattattctcagcatcagggcttagactgaaataatacctttgatggaggacatttcccttaccccttcatgggagggaactggggctcactgacgctagaaccagccagctgctttagggctggcaggggtgaaatccactcgctgggacccactgcgcccagccctcatgggagggagcacacaggtgaacaggtgcaggagcacttttggatgccagcaggaacaaattctgtgcaggccccgcagcagcatctrggggggtgcccgcacccctgaaacctcgagggggagggtgttacagtgctcttttagctctgctatctgcagacgtcttaagtgttagtagctcagtgggccctttgccttttcgcttgaggcggctgcctcttgccagcaagggcagaggttcagtgtaacaacttttcgtatctgcattcctggctcctgagctcttgtccagcttccaagaaaaatgaggttgcacaaccgaattggagaatggtaaatgagggagattttattttgatggaagtgactctcagcaggaaggggagc

SEQ ID NO: 108500 - DNA, 601 bp, Human
atgtatttagcttgacttgaactttaccgtttactaatgtaacttgcccataatgatattctttatttaaattacgtaggcattatccaatttatgaatgtacatatttcaaaaagtaaattatttaatgggatagatgtagatagagatgatgatgatagctacaaggtagactgctagctaataaatgtgaccattcatttttctaagtgctacaattcagggtaatgggataacacaattattctttctcctggctttatgattctcatattattctcagcatcagggcttagactgraataatacctttgatggaggacatttcccttaccccttcatgggagggaactggggctcactgacgctagaaccagccagctgctttagggctggcaggggtgaaatccactcgctgggacccactgcgcccagccctcatgggagggagcacacaggtgaacaggtgcaggagcacttttggatgccagcaggaacaaattctgtgcaggccccgcagcagcatctgggggggtgcccgcacccctgaaacctcgagggggagggtgttacagtgctcttttagctctgctatctgcag

SEQ ID NO: 108501 - DNA, 601 bp, Human
tttaaggtcatccataaataactattttcttaagcaatgtattttaaactaaactaaacttaatttctaaatctaaatgtatttagcttgacttgaactttaccgtttactaatgtaacttgcccataatgatattctttatttaaattacgtaggcattatccaatttatgaatgtacatatttcaaaaagtaaattatttaatgggatagatgtagatagagatgatgatgatagctacaaggtagactgctagctaataaatgtgaccattcatttttctaagtgctacaattcaggrtaatgggataacacaattattctttctcctggctttatgattctcatattattctcagcatcagggcttagactgaaataatacctttgatggaggacatttcccttaccccttcatgggagggaactggggctcactgacgctagaaccagccagctgctttagggctggcaggggtgaaatccactcgctgggacccactgcgcccagccctcatgggagggagcacacaggtgaacaggtgcaggagcacttttggatgccagcaggaacaaattctgtgcaggccccgcagcagca

SEQ ID NO: 108502 - DNA, 601 bp, Human
aaatacaccattgtattccatgaattaacttttattttgcttataatgtagaaatggggctctttgccttcaaactgcatcattactcaagtgagagatcaaagaggtgaggggaaacttacatttgatttgtttagtcctaaaatcctctttttaaaaataagagattagggtgtggtggcacgtgcctgtcatctcagctactcaggaggctgaggcaggagaatcgtttgaacccaagaggcggaggttgcaatgagctgagatggagccactgcactccagcctgggctagagagcragactccgtctcaaaagaaaaataaataaataataaaaataataaacaaaaataatagattgatcatgaaatggtttatctctctgattgaagaattgtatttacgttaaaaactaaatgtttattatagtgttccttggattagtttaaggtcatccataaataactattttcttaagcaatgtattttaaactaaactaaacttaatttctaaatctaaatgtatttagcttgacttgaactttaccgtttactaatgtaacttgcccataatgatattctttatttaaattacgtag

SEQ ID NO: 108503 - DNA, 601 bp, Human
tccaataaataaaatatagtacctcaattacaaatacaccattgtattccatgaattaacttttattttgcttataatgtagaaatggggctctttgccttcaaactgcatcattactcaagtgagagatcaaagaggtgaggggaaacttacatttgatttgtttagtcctaaaatcctctttttaaaaataagagattagggtgtggtggcacgtgcctgtcatctcagctactcaggaggctgaggcaggagaatcgtttgaacccaagaggcggaggttgcaatgagctgagatggmgccactgcactccagcctgggctagagagcaagactccgtctcaaaagaaaaataaataaataataaaaataataaacaaaaataatagattgatcatgaaatggtttatctctctgattgaagaattgtatttacgttaaaaactaaatgtttattatagtgttccttggattagtttaaggtcatccataaataactattttcttaagcaatgtattttaaactaaactaaacttaatttctaaatctaaatgtatttagcttgacttgaactttaccgtttactaatgtaacttgcc

SEQ ID NO: 108504 - DNA, 601 bp, Human
tctcaaaatgccattccaataaataaaatatagtacctcaattacaaatacaccattgtattccatgaattaacttttattttgcttataatgtagaaatggggctctttgccttcaaactgcatcattactcaagtgagagatcaaagaggtgaggggaaacttacatttgatttgtttagtcctaaaatcctctttttaaaaataagagattagggtgtggtggcacgtgcctgtcatctcagctactcaggaggctgaggcaggagaatcgtttgaacccaagaggcggaggttgcartgagctgagatggagccactgcactccagcctgggctagagagcaagactccgtctcaaaagaaaaataaataaataataaaaataataaacaaaaataatagattgatcatgaaatggtttatctctctgattgaagaattgtatttacgttaaaaactaaatgtttattatagtgttccttggattagtttaaggtcatccataaataactattttcttaagcaatgtattttaaactaaactaaacttaatttctaaatctaaatgtatttagcttgacttgaactttaccgtttac

SEQ ID NO: 108505 - DNA, 601 bp, Human
caataaaagcttcgtctaggccttatcctgcaagttggaagaaacaggaaattgatttcatgtgattagctttttgttttgttttgttttgttttgtttttggcatagcagcttgatgagtccaaaccacaaactctccttacagggaaattcaatgaacagcactggatctcaaaatgccattccaataaataaaatatagtacctcaattacaaatacaccattgtattccatgaattaacttttattttgcttataatgtagaaatggggctctttgccttcaaactgcatcattacycaagtgagagatcaaagaggtgaggggaaacttacatttgatttgtttagtcctaaaatcctctttttaaaaataagagattagggtgtggtggcacgtgcctgtcatctcagctactcaggaggctgaggcaggagaatcgtttgaacccaagaggcggaggttgcaatgagctgagatggagccactgcactccagcctgggctagagagcaagactccgtctcaaaagaaaaataaataaataataaaaataataaacaaaaataatagattgatcatgaaatggtttatctctctg

SEQ ID NO: 108506 - DNA, 601 bp, Human
ataaacactcatgtaaccatcaaataaggcaagacgtggaacattgcaaagagcctaggtccacctccatgctgcttttcaagcccctaaatgtttcttcacatctggtaacaattttctacttttcccaacacttgggtcacacaatacaataaaagcttcgtctaggccttatcctgcaagttggaagaaacaggaaattgatttcatgtgattagctttttgttttgttttgttttgttttgtttttggcatagcagcttgatgagtccaaaccacaaactctccttacagggaaatkcaatgaacagcactggatctcaaaatgccattccaataaataaaatatagtacctcaattacaaatacaccattgtattccatgaattaacttttattttgcttataatgtagaaatggggctctttgccttcaaactgcatcattactcaagtgagagatcaaagaggtgaggggaaacttacatttgatttgtttagtcctaaaatcctctttttaaaaataagagattagggtgtggtggcacgtgcctgtcatctcagctactcaggaggctgaggcaggagaatcgtttgaaccc

SEQ ID NO: 108507 - DNA, 601 bp, Human
gtactctgcaaaaccaagcgtgtgggaaatatgtccacccttgttgtgtcaggaatagaggagccaaaagaaaaatagataaggaatggcaaagttttgtcatgcaaggtagataattaaaggtagaggctgggcgcggtggctcacgcctgtaatcccagcactttgggaggctgaggtgggcagatcaagagatcaggggatcgagaccatcctggctaacacggtgaaaccccgtctctacaaaaaatacaaaaaattagccaggcgtggtggcgggcacctgtagtcccagctactygggaggctgaggcaggagaatggtgtgaaccccggaggcggagcttgcagtgagcggagatggcgccaccgcactccagcctgggcgacagagcaagactccgtctcaaaaaaaaaaaaaaaaaaaagtagaaaaaaacctttggaaagatctgggtacttcaggtagcgtcttctcttatttctacatgttgtaactaaaataaagttcccacttcaactctcttagagttgtatgtaaagatatataaatggtgaattttttcctaggtatataatgagcagagtaatcaataatttt

SEQ ID NO: 108508 - DNA, 601 bp, Human
ccacattggagtttcttttccttttctgtttattatgagaacattgcctggctactactctgttcccagaaggagaatgagaaaataatggagtcagtttgtccctgcctgatccagcctactttgtccaaactctaactaattccaagatgcagaacttggcccatctcatatcaccagagccatccagcaaacccagcttagaaaaactgaatccaaagacatgtgagatatcaatatgtaatgtagtgttggagaggtttctctggcagaaaaacctaactgatataggtactctgcwaaaccaagcgtgtgggaaatatgtccacccttgttgtgtcaggaatagaggagccaaaagaaaaatagataaggaatggcaaagttttgtcatgcaaggtagataattaaaggtagaggctgggcgcggtggctcacgcctgtaatcccagcactttgggaggctgaggtgggcagatcaagagatcaggggatcgagaccatcctggctaacacggtgaaaccccgtctctacaaaaaatacaaaaaattagccaggcgtggtggcgggcacctgtagtcccagctacttgggaggctg

SEQ ID NO: 108509 - DNA, 601 bp, Human
aaatattcaacatttttgtaaatattcctgagtatcccattatttgacatataatcttgcagtattttcccaccacacacagggtgactaccttgcccctggactctgagtacactcacatagcttgctttgattaacagaaaattggtagacttcacacagaggtttgagatggtttccacattggagtttcttttccttttctgtttattatgagaacattgcctggctactactctgttcccagaaggagaatgagaaaataatggagtcagtttgtccctgcctgatccagcctacwttgtccaaactctaactaattccaagatgcagaacttggcccatctcatatcaccagagccatccagcaaacccagcttagaaaaactgaatccaaagacatgtgagatatcaatatgtaatgtagtgttggagaggtttctctggcagaaaaacctaactgatataggtactctgcaaaaccaagcgtgtgggaaatatgtccacccttgttgtgtcaggaatagaggagccaaaagaaaaatagataaggaatggcaaagttttgtcatgcaaggtagataattaaaggtagaggctg

SEQ ID NO: 108510 - DNA, 601 bp, Human
ttttcccactcagggttttcagcccataaaaatatattaaacatatctctcatacttagacccttggtaaagttactctcaagtctattgaatgtctaaatatttgttatttcattaaaatattcaacatttttgtaaatattcctgagtatcccattatttgacatataatcttgcagtattttcccaccacacacagggtgactaccttgcccctggactctgagtacactcacatagcttgctttgattaacagaaaattggtagacttcacacagaggtttgagatggtttccacaytggagtttcttttccttttctgtttattatgagaacattgcctggctactactctgttcccagaaggagaatgagaaaataatggagtcagtttgtccctgcctgatccagcctactttgtccaaactctaactaattccaagatgcagaacttggcccatctcatatcaccagagccatccagcaaacccagcttagaaaaactgaatccaaagacatgtgagatatcaatatgtaatgtagtgttggagaggtttctctggcagaaaaacctaactgatataggtactctgcaaaacc

SEQ ID NO: 108511 - DNA, 601 bp, Human
tactacaaggatacagagactaaaacagcatggtagtggtacaaaaacaggcacgtagaccaagggaacagaatagagacccgagaaataatgccacccacctacaaccatctaatcttcaacaaagttaacaaaaacaagccatgaggagagactccctgctctataaatggtgctgggataactggatagccatgtgcagaagatggaaactggacacctttcttatacatacacaaaactcaatgcaagctgggttaaataataaaatgtaaaacctaaaactatttttttaaaaaayggaaaaataacctagtaaacaccattcctgcataggacctggcaaagatttcatggcaaagacaccaaaatcaattgcaacagaaacaaaaattgaaaagtggaacctcattaaactgaagagcttctgcacaagaaaagaaactatcaacagagtaaacagacaacctgcagaatgggagaaaatatttcgtaaactatgcaaatgacaaaggcgtaatatccggaacatataaggaatttacatttacaagcaaaaaacaaataccaccattaaaaatttgataaaggacatgaacaa

SEQ ID NO: 108512 - DNA, 601 bp, Human
agaaaatatgattagctatcagcatattgtaagggaaaattagattgtttagattgtttaacaacccttgaaagaactcattaaaaaagtgttaaaatattaaaatgattatacatttaatataggcatcataggaaaatacaaattctatcattactagtttggaaaaaaaaaagattggtagtaaacttcccatgtctgaacaaacacacattaaaaaagggcaagcccagtatcactggtcatgatcccctttaaggtcttgatcttaaactctctgcgatcctgatttctgaatgtkcagtaaaattcttggttcttctaaattcaattctgggaccaatgtcaaataggaaagcgctagggcatactaatggatgagttcaatgctgcctttatggaaaaaatgtaattttcaaaacggctcaaattacctactatttaaacaacgtctcttcttgctataggcttttttcataataattttgaagtaaaagctgatttctcatttgcaagcatgcaaatgaagacatattctctttcactgttttgcaatattttcctcgtgtagtcataatttgtgttcagcaacatcacttgc

SEQ ID NO: 108513 - DNA, 601 bp, Human
gatattttcttcaatcaaacattatgtcaaatgactttgagaaaatatgattagctatcagcatattgtaagggaaaattagattgtttagattgtttaacaacccttgaaagaactcattaaaaaagtgttaaaatattaaaatgattatacatttaatataggcatcataggaaaatacaaattctatcattactagtttggaaaaaaaaaagattggtagtaaacttcccatgtctgaacaaacacacattaaaaaagggcaagcccagtatcactggtcatgatcccctttaaggtgttgatcttaaactctctgcgatcctgatttctgaatgtgcagtaaaattcttggttcttctaaattcaattctgggaccaatgtcaaataggaaagcgctagggcatactaatggatgagttcaatgctgcctttatggaaaaaatgtaattttcaaaacggctcaaattacctactatttaaacaacgtctcttcttgctataggcttttttcataataattttgaagtaaaagctgatttctcatttgcaagcatgcaaatgaagacatattctctttcactgttttgcaatattttc

SEQ ID NO: 108514 - DNA, 601 bp, Human
agaggcctcccctcagggacacattctctttctcagggatgttccttgctgagaaaaagaattcagtgatatttctccatttgcttttgaaagaagagaaatatggctctgttccacctagctaaccagcagtcagaggttaaggttatctccctttttccctaaacattgctgttatcctgttcttttttcaaggtgcccagatttcatattgttcaaacacacaggctctacaatttgtgcagttaatgcaatcatcacagggtcctgaggcaacatacatcctcctcagcttatgaaratgatgggattaagagattaacgtaaagacaggcataggaaatcacaaaggtattgattggggaagtgataagtgtccatgaaatcttcacaatttatgttcagagattgcagtaaagacaggcataagaaattataaaagtattaatttggggaactaataaatgtccatgaaatcttcacaatttatgttcttctgccatggcttcagctggtccctccgtttggggtctctgacttccagcagcagggagggtgtatgtgtccaggaatttatctatctcttctaggttttctagtt

SEQ ID NO: 108515 - DNA, 601 bp, Human
agacagagtacaaaagagagaaattttaaagctggtgtctgggggagacatcacatgttggcaggttcagtgatgccccctaagccataaaaccagcaagttcttattagtgattttcaaaaggggagggagtgtacaaatagggtgtgggtcacagagatcacatgcttcacaaggtaataaaatatcaaaaggcaaatggaggcagggcgagatcacaggaccacaagaccggggcaaaattaaaattgctaatgaagtttcgggcatgaattgtcatggataacatcttatcaggagrcagggtttgagagcagacaaccggtttgaccaaaatttattaggcaggaatttcctcatcctaataagcctgggagtgctacgggagaccagagcttatttcatccctcagctaagactgtaaaagacagccgtccccaaagcggccatttcagaggcctcccctcagggacacattctctttctcagggatgttccttgctgagaaaaagaattcagtgatatttctccatttgcttttgaaagaagagaaatatggctctgttccacctagctaaccagcagtcagaggttaaggtta

SEQ ID NO: 108516 - DNA, 601 bp, Human
tctagggctgaaggctgttgtttagacttttttgttccagagggtgtttctttgatgtagtattctcccttttttcctatggatgtggcttcctgacagctgagctgtagtaattgttatctctcttctggatctagtcaccaagaaagtccaccaggctccaggctgatattggggttgtctgcacagagtcctgtgatgtaaaccatctgttggtctctcaactgtggataccagcacctgttctggtggaggtggcaggggggtgaaatggactctgtgagggttcttagctttgggrgtttaatgctctatttttgtgtggttggcctcctaccaggaggtagttctttctagagagcatcagctgtgatagtatgaagaggcaccggcagtgggtaagtcactagaactctcaagagtttatgccctttgtgctcagaataccagggtgggtagggaagtaccatcaggtggggcagagctaagcatgtctgagctcagactcactctctcctgctgtggctgctaggggggatggggctgaggtttccaggttaatggagttatgcacctagaaggaagctgcctctgctgagtc

SEQ ID NO: 108517 - DNA, 601 bp, Human
taattcaggctttttactttcagcatttattatgcatctagttcatgtttagtactgtgatagttttaaacacatttaaaaagacttgcaagtttatattaaatagtaatacatgtaaatattccggagactttggaaatattttctctgtacatgtgagaagaggtagaaatctatctattgtctcataaagcagtcattgtgtttgaatgagttcatccacatggcaagaattcttattctgtgcctctcccctgcccagtagggcatattgcttcatcagcaccaaataccttcacatttttttcacatatactcactctcccagcaacatctactccatgatcctcactacagggaccaatgtagataaaggatgacatactgtctagccaagacggggaaatcagcagcatgatacagtcattcttcttcaatagctaaaaaagtaagtaaagtgagcaaagcaccaatgaaacaaattcagcaacagctaccaaacaaagtagaaaaatatgcctcataaacgtcaaagatggcagagaaagatgtaaggtgttccactatgaagaactgatccctcaccttcagtcccctgaag

SEQ ID NO: 108518 - DNA, 601 bp, Human
ctattattttactttttacaagtacatgcccagcaaacatgcgcgcacacacacaaacacacaaacgcatacatttatttgggatctaaatctttttctcttttcacttaaataattcaggctttttactttcagcatttattatgcatctagttcatgtttagtactgtgatagttttaaacacatttaaaaagacttgcaagtttatattaaatagtaatacatgtaaatattccggagactttggaaatattttctctgtacatgtgagaagaggtagaaatctatctattgtctcayaaagcagtcattgtgtttgaatgagttcatccacatggcaagaattcttattctgtgcctctcccctgcccagtagggcatattgcttcatcagcaccaaataccttcacatttttttcacatatactcactctcccagcaacatctactccatgatcctcactacagggaccaatgtagataaaggatgacatactgtctagccaagacggggaaatcagcagcatgatacagtcattcttcttcaatagctaaaaaagtaagtaaagtgagcaaagcaccaatgaaacaaattcagca

SEQ ID NO: 108519 - DNA, 601 bp, Human
atcctcatcatcttgtggttgaaatgatgactgaacaataactcaagctagttgtgttctatatatttttaattaatataattagtattcctagatctttttaaattgctctactctagccctagggaaaaatgatttcagaaggctgaatacgtatgctgattcaagatatgatttctcacacacccaacctctataattttggattatagagcaatatagagtaattctggcaccatctctttggcaatgctgtttaaaaacaaagttactattacacacagcccaggatattgacttygcattgcacataaatacatttatataatactttttctttaatatagaagccatagccttgatttttttgaaaaatgatgaagaatatggtaattatgagactctcaattgactcaaaagttcagagctaaaatcaaggtagagtttgaacacaccttacaaaaagttgagatccaaattgcataaaatttatgaaacttttgatttaaggactaagttttctggtaacctctttgggaacatcaggataataaaagatgattaagtaataatggtatctcggccgggcacggtggctcat

SEQ ID NO: 108520 - DNA, 601 bp, Human
tgagtcactgggcctggtcataaattctgttttctaagcaaacttatcttacatcagagggcagaatggttagggaaaatatctagtgaaaaagaccaccaacaaaggagcaccatctctcaattgtcacactaatgtgcagtgacactttggcaactgactcccagttactggcatacagtttcatctaccagttggagccaaatggcagatttgggatttttcttaatccgagttattattcagaacaacatattcaacacaaatatttaaccactagtgtcagattttatttttacakgataactcctcaagcctttaaccgcaagagtgcatacaaggtaaaattaaaaacaaaattaagcctgctgactttcactgtgattgtggtttgatatcatgcaggatagatcacaactgctgattcatattaggaaagagagcccccaactgtcacaagcacattgtgtttgaaaatacaaaaccttaccaaatcacttagtacttaaaattaacaacatcctcatcatcttgtggttgaaatgatgactgaacaataactcaagctagttgtgttctatatatttttaattaatataat

SEQ ID NO: 108521 - DNA, 601 bp, Human
tttaaaagtttcaaaataaaaacgtttttaaaaatcaccaataataatagaaggtaattatcatgacatgtatcaatggttttatagtatccctgtttataacagagttaaccaaaaactatacagatgctcaaagaggtgaatgactaagaaaattcacataatcaagaggatagaatactaaacagcaacgaattcacatctaccgactttgtcaattcatggaaatatctaaggaaataacatgaaatgaaaaaacaagcagaatataatccacaattacaacaaagaaaatatgtgwtatgcatatatttacataggcatagcacatatatttaagtttttacaaaaactaaacatgtatttagttacttaggaatattactttcccttctgggtaagactgcccacgttaatacatgtaatataaataaataaataaataacacgtgtataataaattctgtttattttcttttattttgagatagagtttcactcttgtcacccaggctggagtgcagtggcatgatcttggcccactgcaacctctgcctcctgggttcacgctattctccggtctcagcctctctagtagcgg

SEQ ID NO: 108522 - DNA, 601 bp, Human
cttgtttcacctaagattttctttactatgtcactaggcagtgggatttccttcaaaaggctcaactgaaatatggtctactatggctgaagctgggtatagatgtgtttaacttttgtgtggattttaaaagtttcaaaataaaaacgtttttaaaaatcaccaataataatagaaggtaattatcatgacatgtatcaatggttttatagtatccctgtttataacagagttaaccaaaaactatacagatgctcaaagaggtgaatgactaagaaaattcacataatcaagaggataraatactaaacagcaacgaattcacatctaccgactttgtcaattcatggaaatatctaaggaaataacatgaaatgaaaaaacaagcagaatataatccacaattacaacaaagaaaatatgtgatatgcatatatttacataggcatagcacatatatttaagtttttacaaaaactaaacatgtatttagttacttaggaatattactttcccttctgggtaagactgcccacgttaatacatgtaatataaataaataaataaataacacgtgtataataaattctgtttattttct

SEQ ID NO: 108523 - DNA, 601 bp, Human
acgtgagccaccacacccagtcaatgcaagattcttaaaatagatggtaggaaatctcatttaaaatggccctttggggttttgtatgtagcagagcagttctttcattgctatctattgatagtcaaccctcaacacaagggttcattttttaaaaaaataataaaatgttcctaaactaattttggggtgtgtgtggagagactaccctgagaaattcacagtaaatacatttgtatttgaaaatgagctacctaatggcagggaatgaatgacacacacgtttgtttgcttcccatgscttttgctcagcaaatatttgatccattaaataaatagatatagattattgattatgtgccaggcatccttctagacaaaggggttggggcaaaaaatgggaggtgcttccttaattgaacggaggattgaacgaacgaactgatgaacactgtaccttttctgatttttctgaactaagtcatcagtacttttttgcttctcttgtttcacctaagattttctttactatgtcactaggcagtgggatttccttcaaaaggctcaactgaaatatggtctactatggctgaagctgggt

SEQ ID NO: 108524 - DNA, 601 bp, Human
gtcacgtagctacaaaactgagaatccggaatttgaacttgggcaggtgattccaaagcctgtgctcagatttttgctgtcttagctacaaggatgttcactacagcattgatcataacagcgaaagtttagaaacaaactaaatattcaccagtggggcataagttaaacaataaaatatctattgacaggacacaaaacagaaattaaaaatcaagttttagagataacatgtttgcatggacaaacaaaataagatatttgactcaggggggtaaaaaggctcaaaactgtgtagtaygattgcagtctactaaatgtttcctttggatggtgagattttaattttctttttggtgctttgttgtatgatccaaattttctaaatgaactagaattccttttgtacgcaggaaaaaattaataataacaaattgcactctatagcagcacagtccgatcaaaatataatgcaagtcatatatataattttaatcttctgctagttacaataatgtaaaaagaaacaggtgaaattaatttttatttatatatttatttatttttgagatgggggtctcaccctatcacccaggttaga

SEQ ID NO: 108525 - DNA, 601 bp, Human
ttcccaagaaattataaatcaacacaatctttttggaaggcaatttggtatatatatcaaatacttaaaacagctttagacttagtaatttcctttttgggtatgtattaataataataataatagcagcttttacatagcacttactatgtgccaggaattattctaaagacccatggtcacgtagctacaaaactgagaatccggaatttgaacttgggcaggtgattccaaagcctgtgctcagatttttgctgtcttagctacaaggatgttcactacagcattgatcataacagcraaagtttagaaacaaactaaatattcaccagtggggcataagttaaacaataaaatatctattgacaggacacaaaacagaaattaaaaatcaagttttagagataacatgtttgcatggacaaacaaaataagatatttgactcaggggggtaaaaaggctcaaaactgtgtagtatgattgcagtctactaaatgtttcctttggatggtgagattttaattttctttttggtgctttgttgtatgatccaaattttctaaatgaactagaattccttttgtacgcaggaaaaaatta

SEQ ID NO: 108526 - DNA, 601 bp, Human
caataggcattttatacaggatctcaagcaaactggttttacgagcatatttgggaaatgagcagagtgtgacggatgaccaagtgttgtgccaaaattttatatacaatgctgttttctgagggtaaatcaccggctaaaatctatccagttgagggcaagtgatcatgagagatctgtgtatgtgaacatagtactttcctcttaggagcaagaatcttaaccaatgttagggagatttctgaacatctgaaatggtataggactcctagtagaggaattcagtgaatgtctgttaatkatgggaaggtgagagttcttagggaaaggggcaagagaaataaattctccctcatacttacaacataacaatgagaaatacatactacaatcatctttcaaagcactaatgacagtattgatttatgactagtgtaagttttagaagagttgttttatttttcttaatatgcatttcccaagaaattataaatcaacacaatctttttggaaggcaatttggtatatatatcaaatacttaaaacagctttagacttagtaatttcctttttgggtatgtattaataataataataatag

SEQ ID NO: 108527 - DNA, 601 bp, Human
aagaatgcaatttacataagatatggtatccatatgcaataacttgggtactccactagaagacaaagaaatcacatgcttgtatctatacttgagagtcaccgtgaacatatagattacaaatgcagattggtttggctctttgttcactgttgtcaggattctctgaatatgaaatatctctcagtcacgttaagagcaaaacaaaatataatttcccctcaatttacatatagtggcatccctgaaaagttcagtatatattaaaactgttggggggaaatattttgtatttgtatayaaaaaagattttggttttaggctcagataattgtaagctcatcttaccctatggaggacattagaaaattgtgggcggaggggacagtggctcattcctttaatcctagagctacgggaggctgaggcaggaggatcacttgagctcaggagttcgagaccagcctgggctacatagtgagacacctgtctctacttaaaaaaaaaaaaaaaaaaaacctaaaattgtggggaataatgtaagcatgacaagataagtgataggaagggcgcagtggctcacgcctgtaatcccagcact

SEQ ID NO: 108528 - DNA, 601 bp, Human
acccattttaggctagccagtgaataattcaactgtgtcctttactgcctgaaagtccgtaacttctctgaggctttctcctacatgccagtgacttatcttgaactggggcataattgtggtcccccaattctacctctctaagttatcatattatttactactaatataaaactaattttaacaaaaagttcataagaaaacaatgtcattttcttgagggactgaagaacttacatacaatataggtaactatataaaagtgtataaagttacatataatatatgtaacaatataaargtatatttaaaaatgtacatcctatatacttatgtattatttaatatactacatacaatatatttgcattcatatgtttcatttaataagcacataataactcttaatctttgtccttgagagtatctgttacatgtaataagcacatcttagtgcctaggatacaaagctgaacaaagcctggtccttggcctctatgtgaacatagagttactggaagacgctcaagaggagaagaggtgtggaaggagattctgactctgcccagggaatagaaaaaggcttcctggaggaagcaac

SEQ ID NO: 108529 - DNA, 601 bp, Human
ttcaccatgttggccaggctggtcttgcactcctggcctcaagtgatccacccgcctcagcctcccaaagtgctggagttacaggtgtgaaccaccgcaaccagcctaaacacttcttaatgaaggcaggggtgagtgtgatggtggtgaacctcctataattactcttttcttattacatgtttggtcagtgttttagggggctgaaggcaaggggtgggggtagacccattttaggctagccagtgaataattcaactgtgtcctttactgcctgaaagtccgtaacttctctgaggcyttctcctacatgccagtgacttatcttgaactggggcataattgtggtcccccaattctacctctctaagttatcatattatttactactaatataaaactaattttaacaaaaagttcataagaaaacaatgtcattttcttgagggactgaagaacttacatacaatataggtaactatataaaagtgtataaagttacatataatatatgtaacaatataaaagtatatttaaaaatgtacatcctatatacttatgtattatttaatatactacatacaatatatttgcattcata

SEQ ID NO: 108530 - DNA, 601 bp, Human
gctcactgcaacctccacctcccgggttcaagcgattctcctgcctcagcctcccaggtagctggaattacaggcacctgccacgatgcccggctaatttttgtaattttagtagagatggggtttcaccatgttggccaggctggtcttgcactcctggcctcaagtgatccacccgcctcagcctcccaaagtgctggagttacaggtgtgaaccaccgcaaccagcctaaacacttcttaatgaaggcaggggtgagtgtgatggtggtgaacctcctataattactcttttcttatwacatgtttggtcagtgttttagggggctgaaggcaaggggtgggggtagacccattttaggctagccagtgaataattcaactgtgtcctttactgcctgaaagtccgtaacttctctgaggctttctcctacatgccagtgacttatcttgaactggggcataattgtggtcccccaattctacctctctaagttatcatattatttactactaatataaaactaattttaacaaaaagttcataagaaaacaatgtcattttcttgagggactgaagaacttacatacaatataggta

SEQ ID NO: 108531 - DNA, 601 bp, Human
tcacccaggctgtagtgcagtggtgtgatctcggctctcagctcactgcaacctccacctcccgggttcaagcgattctcctgcctcagcctcccaggtagctggaattacaggcacctgccacgatgcccggctaatttttgtaattttagtagagatggggtttcaccatgttggccaggctggtcttgcactcctggcctcaagtgatccacccgcctcagcctcccaaagtgctggagttacaggtgtgaaccaccgcaaccagcctaaacacttcttaatgaaggcaggggtgagkgtgatggtggtgaacctcctataattactcttttcttattacatgtttggtcagtgttttagggggctgaaggcaaggggtgggggtagacccattttaggctagccagtgaataattcaactgtgtcctttactgcctgaaagtccgtaacttctctgaggctttctcctacatgccagtgacttatcttgaactggggcataattgtggtcccccaattctacctctctaagttatcatattatttactactaatataaaactaattttaacaaaaagttcataagaaaacaatgtca

SEQ ID NO: 108532 - DNA, 601 bp, Human
gatccctcccaccttttttctttgtcaaaattctgtgacagacccttgaattattcctggactgttcaaataaagccagaggcatttatttaaacactttttttttttttttgagacagagtcttgctctgtcacccaggctgtagtgcagtggtgtgatctcggctctcagctcactgcaacctccacctcccgggttcaagcgattctcctgcctcagcctcccaggtagctggaattacaggcacctgccacgatgcccggctaatttttgtaattttagtagagatggggtttcacyatgttggccaggctggtcttgcactcctggcctcaagtgatccacccgcctcagcctcccaaagtgctggagttacaggtgtgaaccaccgcaaccagcctaaacacttcttaatgaaggcaggggtgagtgtgatggtggtgaacctcctataattactcttttcttattacatgtttggtcagtgttttagggggctgaaggcaaggggtgggggtagacccattttaggctagccagtgaataattcaactgtgtcctttactgcctgaaagtccgtaacttctctgaggctttctc

SEQ ID NO: 108533 - DNA, 601 bp, Human
ctggcccctgcttaactcttgggggaaaaaaggccttcttcacatgatccctcccaccttttttctttgtcaaaattctgtgacagacccttgaattattcctggactgttcaaataaagccagaggcatttatttaaacactttttttttttttttgagacagagtcttgctctgtcacccaggctgtagtgcagtggtgtgatctcggctctcagctcactgcaacctccacctcccgggttcaagcgattctcctgcctcagcctcccaggtagctggaattacaggcacctgccacsatgcccggctaatttttgtaattttagtagagatggggtttcaccatgttggccaggctggtcttgcactcctggcctcaagtgatccacccgcctcagcctcccaaagtgctggagttacaggtgtgaaccaccgcaaccagcctaaacacttcttaatgaaggcaggggtgagtgtgatggtggtgaacctcctataattactcttttcttattacatgtttggtcagtgttttagggggctgaaggcaaggggtgggggtagacccattttaggctagccagtgaataattcaactg

SEQ ID NO: 108534 - DNA, 601 bp, Human
agtacacacggggttttgccacgttggccaggctgttctcaaactcctggccttaagcaatcggcctgccttggccttccaaagtgctgggattacaggcctgagccactgtgcctggcccctgcttaactcttgggggaaaaaaggccttcttcacatgatccctcccaccttttttctttgtcaaaattctgtgacagacccttgaattattcctggactgttcaaataaagccagaggcatttatttaaacactttttttttttttttgagacagagtcttgctctgtcacccaggcwgtagtgcagtggtgtgatctcggctctcagctcactgcaacctccacctcccgggttcaagcgattctcctgcctcagcctcccaggtagctggaattacaggcacctgccacgatgcccggctaatttttgtaattttagtagagatggggtttcaccatgttggccaggctggtcttgcactcctggcctcaagtgatccacccgcctcagcctcccaaagtgctggagttacaggtgtgaaccaccgcaaccagcctaaacacttcttaatgaaggcaggggtgagtgtgatggtgg

SEQ ID NO: 108535 - DNA, 601 bp, Human
taattttttttttttttgcatttttttagtacacacggggttttgccacgttggccaggctgttctcaaactcctggccttaagcaatcggcctgccttggccttccaaagtgctgggattacaggcctgagccactgtgcctggcccctgcttaactcttgggggaaaaaaggccttcttcacatgatccctcccaccttttttctttgtcaaaattctgtgacagacccttgaattattcctggactgttcaaataaagccagaggcatttatttaaacactttttttttttttttgakacagagtcttgctctgtcacccaggctgtagtgcagtggtgtgatctcggctctcagctcactgcaacctccacctcccgggttcaagcgattctcctgcctcagcctcccaggtagctggaattacaggcacctgccacgatgcccggctaatttttgtaattttagtagagatggggtttcaccatgttggccaggctggtcttgcactcctggcctcaagtgatccacccgcctcagcctcccaaagtgctggagttacaggtgtgaaccaccgcaaccagcctaaacacttcttaa

SEQ ID NO: 108536 - DNA, 601 bp, Human
tgactatccccgtgaaaaggattttaacgagtgggctcaactgagtcaccaacaatggacaagggaataaatatttaacaaggactaaaaattaaggtgaaactaccttcaacagttcatctgtgtatttccaaaactgtgcccttctggaccactcacagcaagaatagttagacatatcatctgccttcacctaaaataagtacaacatttctgagtatagaggggggaaaagacacttaaaatggaagggtttcatatctctgcttaagctttttttttctttttctttttctttttyttttttttttttagacagagactcactgtgggccaggctggagtacagtggcacagtctcggctcactgtaacctccacctcctgggttcaagtgattctcccgcctcagactccagagtagctgggattacaggtgtgcaccaccatgcctggctaattttttttttttttgcatttttttagtacacacggggttttgccacgttggccaggctgttctcaaactcctggccttaagcaatcggcctgccttggccttccaaagtgctgggattacaggcctgagccactgtgcctgg

SEQ ID NO: 108537 - DNA, 601 bp, Human
ccccatgttagaggtggagcctggtgggagacgtttgggtcatgggagtggatctctcatggcttggtgttgtcctcacaataatgagtgagttctcacgagatctggttgtttaaaagcgtgtggcacctcccaccccctctttctcttgtttctgctttcaccatgtgacgtgcctggtcctgcttcaccttctgccatgagtaaaagcctcctgatgcctccctagaaactgagcagatgctggggccacgcttgtgcagcctgcagaacgcttagccaattaaacctcttttctttrtaaattacccagtatttctttctagcaacccaagaacagcctaacacaagctgtaaataaatctctccagttaaacaatgggaaaactgctgtagaatcgccacatgttaaatgaccctacgcttcccacatgtctctaggtgtctatgttttcataagagtgactatccccgtgaaaaggattttaacgagtgggctcaactgagtcaccaacaatggacaagggaataaatatttaacaaggactaaaaattaaggtgaaactaccttcaacagttcatctgtgtatttccaaaactg

SEQ ID NO: 108538 - DNA, 601 bp, Human
agtgtaaaaaatgtttggaagtttctgcaattgactgacatggtgttatgctagaactgtatgccatagagtttggaaacacattttgtacccttagaagtacatgttcttacaactcgaaagatggccaagtccaactaaaaagttcgtcaaggctagaatgtgacatttcccaatttatctttctgtttcttcataaattgaaaggaactgacagtaacacatgacaaaccagctaggcttatctctaccacactaagattattcatctgagtcccaaagagcaatggaaaaaattacrtgtctgccccaattgaacaatctttatctgaaatttaactgtgcacatttagtattattagtaaggtgtgaatagtttagatatttgttcccccaaatttcatgctgaaatgtcatcccccatgttagaggtggagcctggtgggagacgtttgggtcatgggagtggatctctcatggcttggtgttgtcctcacaataatgagtgagttctcacgagatctggttgtttaaaagcgtgtggcacctcccaccccctctttctcttgtttctgctttcaccatgtgacgtgcctggtcc

SEQ ID NO: 108539 - DNA, 601 bp, Human
cccttgaccagctctgaacccctaagacttgagtgggctttcctgggtggaggcgttttgcatatgtctctgcagtttacagctggagagaaacatgcattcctgagaaacatgtggaatccctacagagagaggacaagaaagcctactacgacttctctagttttgccaccatatatctgtatcctgctgttcctgcaccataccctttgctgtaataaatcttagccttgaatatgattctatattgagtcgtgagtgagtccttccagcaaatcactagtaggtggtcatggtactmcccaaaacaactgccttcttgagccactcccctttttgacatctgtgacatcactcttaattttccttctacctcattactgattttttcccatctccattcttggctcctctactctatcagactaactgtgtgacggtgctatagctcgattctggccttcttttctttatctctactctcttgctagattattttattagtcctgcaggtttcaataccatttctatgttgatgactcccaactttctttctgcagccaaacttctctcttgagctccacttatatacccaaccgtc

SEQ ID NO: 108540 - DNA, 601 bp, Human
ggaacacctgcagtcacagcaatgaccctgacccaaatcctgagcactaaactccctgaaatgcttactaattagttatgttatttttgtgccctcaaggcagtggtcaaaatatatcaagacagtatcattgtttaaagttgacatgaagattcctgatgcatcctagtacctagtttggggtctgcatcctggctggttacatagctacacgaccagctcccttgaccagctctgaacccctaagacttgagtgggctttcctgggtggaggcgttttgcatatgtctctgcagtttasagctggagagaaacatgcattcctgagaaacatgtggaatccctacagagagaggacaagaaagcctactacgacttctctagttttgccaccatatatctgtatcctgctgttcctgcaccataccctttgctgtaataaatcttagccttgaatatgattctatattgagtcgtgagtgagtccttccagcaaatcactagtaggtggtcatggtactccccaaaacaactgccttcttgagccactcccctttttgacatctgtgacatcactcttaattttccttctacctcatta

SEQ ID NO: 108541 - DNA, 601 bp, Human
atcaagaaaacaaatctgtcattttcctatcaagcaaaaacccttaggattatatctccccgtggatgaagcaaaacgtgtttaacagcctgtataaggtcctccataatctaccccacactcaccttctcctttctcccctccagccacactgaacttcttttgctcctcaaagtcaatatgctccttcacctccaggcctttgaacgtgctatttattgcctcgcctttcccttttcacctggctgatctcttatccttcaggtctcagccgtgagacctctgtcatattctcgcacayagctaatgacatctgcgtttattggtttgtcaactccttcagggcaggtgccatgtctaacttatttacccctatagtctcatgctagcacatgccatgaactatattaggcattcaataaatgtttactaaataagtggaatgaatctatctggagagaaatataatttcactaactatactttgggatatagaaattaactttatggctctcagttttgactttcacctgcattcaacattaaccatgacctctagaggaaagagttaacatagccagtatgttttactcagttcttg

SEQ ID NO: 108542 - DNA, 601 bp, Human
cttttcacactgatagctctcagggattattatttttacacacttaatattacattttgtggcgctctggtttatttaccctggtgtgtttgtattttctcactactttttgtcccagaaatgactgttgcaccaaatttcttaaagagaatctctgggctgggcacggtggtgcatgcctgtaatcccagcactttgggaggctgaggcaggcagatcacaaggtcaggagttcgagaccaacctggacaacatggtgaaaccccatctctactataaatacaaaaattagctgggcatrgtggcacacccctgtaatcccagctactcgggggctgaggcaggagaatcgcttgaactcaggaagcggaggttgcagtgagctgggatcgcaccattgcactccagcctgggtgacagagcgagactcttgtctcaaaaaaaaaaaaaaaaaaagagagagagagagagaatctctgttgcaatgcaaaactaactgtaaaattatcagaaatttttcaatcaagaaaacaaatctgtcattttcctatcaagcaaaaacccttaggattatatctccccgtggatgaagcaaaacgtg

SEQ ID NO: 108543 - DNA, 601 bp, Human
tctgaataattaatgcttgtcagtttctgtataggttggcattcatagaatttgtctccaaaattgctgattaaaaaaaaaatcattcctttctgtgtgatctgtgctctgttgaaggcaaaaaagaaactacatataatcaccattgaaacatttctaataagttttagacataaaaataaattcacttgaaggtttaaatgaacaattccattcaattacggcattcaaataaaaacttttcacactgatagctctcagggattattatttttacacacttaatattacattttgtggygctctggtttatttaccctggtgtgtttgtattttctcactactttttgtcccagaaatgactgttgcaccaaatttcttaaagagaatctctgggctgggcacggtggtgcatgcctgtaatcccagcactttgggaggctgaggcaggcagatcacaaggtcaggagttcgagaccaacctggacaacatggtgaaaccccatctctactataaatacaaaaattagctgggcatggtggcacacccctgtaatcccagctactcgggggctgaggcaggagaatcgcttgaactcag

SEQ ID NO: 108544 - DNA, 601 bp, Human
ccttggcatacaaggcttcttgcagcacagtcccaccatgtcctccctggactgctcctgccacccaagcacagcatgtgttttcccagtcgctttacctggaattcctaccacctccatctctctgcctggtaatatccaaacctttgttcaaatgtcagcctccctgataagcctttctcaactttaccaatcaccctgtaggccagcttacaaagcatccctacactgcactgttgactgtaacgaacaaagccccattacaatgcttttcccattacggcagttgggtgtaaggccyactgccctagttcataaagggaaagacctgggtctgttcttctttgcatccccttacaaaagttctggtagacagtaggaactcaatgaatatttgttgaatgaatacataaatcgctaaaagacacatttgggttaccgaaccgaatctatcacctaccaagatatcattttgggacatcaatttcttcatctgtaaaatctatttgctcttgcctataaaatgggaatgtaaggaacttatcgcagtttttaaatagcttaaagaaggaaaatgtgtaaagggcctagcacagtgcat

SEQ ID NO: 108545 - DNA, 601 bp, Human
gctaagatacattagaaatcgtcatcaaattcttatccttggctgtatgtacaagggaagtctcatctccttggcatacaaggcttcttgcagcacagtcccaccatgtcctccctggactgctcctgccacccaagcacagcatgtgttttcccagtcgctttacctggaattcctaccacctccatctctctgcctggtaatatccaaacctttgttcaaatgtcagcctccctgataagcctttctcaactttaccaatcaccctgtaggccagcttacaaagcatccctacactgcrctgttgactgtaacgaacaaagccccattacaatgcttttcccattacggcagttgggtgtaaggcccactgccctagttcataaagggaaagacctgggtctgttcttctttgcatccccttacaaaagttctggtagacagtaggaactcaatgaatatttgttgaatgaatacataaatcgctaaaagacacatttgggttaccgaaccgaatctatcacctaccaagatatcattttgggacatcaatttcttcatctgtaaaatctatttgctcttgcctataaaatgggaatgt

SEQ ID NO: 108546 - DNA, 601 bp, Human
ctgtggtttccagtgagcacaaattaagggaacttagatgctaagatacattagaaatcgtcatcaaattcttatccttggctgtatgtacaagggaagtctcatctccttggcatacaaggcttcttgcagcacagtcccaccatgtcctccctggactgctcctgccacccaagcacagcatgtgttttcccagtcgctttacctggaattcctaccacctccatctctctgcctggtaatatccaaacctttgttcaaatgtcagcctccctgataagcctttctcaactttaccaakcaccctgtaggccagcttacaaagcatccctacactgcactgttgactgtaacgaacaaagccccattacaatgcttttcccattacggcagttgggtgtaaggcccactgccctagttcataaagggaaagacctgggtctgttcttctttgcatccccttacaaaagttctggtagacagtaggaactcaatgaatatttgttgaatgaatacataaatcgctaaaagacacatttgggttaccgaaccgaatctatcacctaccaagatatcattttgggacatcaatttcttcatc

SEQ ID NO: 108547 - DNA, 601 bp, Human
gtatttggcttgatatatagaatatatttaatattttctaacagatgcaattttgatcagttttagagggctcagaacctttgcaaaggatcacgtgtacatcaactagatgtagttgatggggactcaaggatggggactcaaactccttggcaaccccagagagcctagcacattcacctgcagagggcacatcctcggtttattcttgcaaaggttcctggtcaatgtggcagacttcaggctactcactgctggtagtggaacctttattcctataaaatcccatgcggaaacccartgtaaaaagttaatccatctcagcatttgttttccagagtatgatggtaacaactcccatgaggatgcggggaattacatcaagagccagttccttgacctcagtatgcaacaagatatcaaaagaatttacagtcacatgacctgtgctacagatacacagaatatcaaatttgtgtttgatgcagctacacagatattattatcaaagaaaacctcaaggactgcggcctcttcaaatcctcactattccattcctcaggtataaatgctataaacaggcttggaatctgggtaatta

SEQ ID NO: 108548 - DNA, 601 bp, Human
ttcaccttgtccctcaatgaagtctgaatctcagctgtgaagaaggaggctcctgaatacaggcaaatcagtagaggtggttaagggtttctgggcattttgagatagttggagtaactctgtctgcccagagcatagtaaggatgtgggtgtggggagggccaacagtgggatcttttgcctaacccaacacccacgtgatccaccaagatactctgttgcttacacaagctcctagtatttggcttgatatatagaatatatttaatattttctaacagatgcaattttgatcagtttyagagggctcagaacctttgcaaaggatcacgtgtacatcaactagatgtagttgatggggactcaaggatggggactcaaactccttggcaaccccagagagcctagcacattcacctgcagagggcacatcctcggtttattcttgcaaaggttcctggtcaatgtggcagacttcaggctactcactgctggtagtggaacctttattcctataaaatcccatgcggaaacccagtgtaaaaagttaatccatctcagcatttgttttccagagtatgatggtaacaactcccatgag

SEQ ID NO: 108549 - DNA, 601 bp, Human
aggtagaactattatttctattttacaaaataggaactaggcacagatagggtaagacagtagttcaagatcacagccactgaacagcagaaccaggatttgaacccaggcaatctgtgttcttcgggctctgtgttctcaaccattattaaacagtcttattatagtgttacagctcttttaaaatttgtctaataggctttctggtttttgctggaaagccccccaaagggaaaaaaataagttgtattattattattattattttgagacagagtttcgcgcttgttgcctaggctgragtgcaataccacgatctcagctcactgcaacctctacctcctgggttcaagcaattctcctgcctcagcctcccaagtagctgggattacaggcatgcgccaacacactcggctaattttgtatttttagtagagacggggcttcaccattttggccaggctggtcgaactcctgacctcaggtgatctgcctgccttggcctcccaaagtggtgggattacaggtgtgagccaccatgcctgcctgtatcattattgtttataaatatttgtgtatttgtgagtatgggcataaatgg

SEQ ID NO: 108550 - DNA, 601 bp, Human
tgtttattaacttatttagccctctcgacaacctacgaggtagaactattatttctattttacaaaataggaactaggcacagatagggtaagacagtagttcaagatcacagccactgaacagcagaaccaggatttgaacccaggcaatctgtgttcttcgggctctgtgttctcaaccattattaaacagtcttattatagtgttacagctcttttaaaatttgtctaataggctttctggtttttgctggaaagccccccaaagggaaaaaaataagttgtattattattattatttttttgagacagagtttcgcgcttgttgcctaggctggagtgcaataccacgatctcagctcactgcaacctctacctcctgggttcaagcaattctcctgcctcagcctcccaagtagctgggattacaggcatgcgccaacacactcggctaattttgtatttttagtagagacggggcttcaccattttggccaggctggtcgaactcctgacctcaggtgatctgcctgccttggcctcccaaagtggtgggattacaggtgtgagccaccatgcctgcctgtatcattattgttta

SEQ ID NO: 108551 - DNA, 601 bp, Human
aagctctctagacttgaagcttcagtcctgaatctaccaggtacttgctttgtggccttgggcaagttacttaaccactggcaagtcagtatctaaagctgtaaattggtatttacctcatagggtgttgtgtagattcattgagatacagcaggaacattgcctagccctgtgcctgacatcaaagatgccctcaataaacagtagtttgagggttttaaacacaaagcatatggcagggccacgcttcaaggctgccaaatatcacaatttatgtaactgcagtaagagtagcatatayttccatagcacttatgtgccaatcatattctgagcactttatgtttattaacttatttagccctctcgacaacctacgaggtagaactattatttctattttacaaaataggaactaggcacagatagggtaagacagtagttcaagatcacagccactgaacagcagaaccaggatttgaacccaggcaatctgtgttcttcgggctctgtgttctcaaccattattaaacagtcttattatagtgttacagctcttttaaaatttgtctaataggctttctggtttttgctggaaagc

SEQ ID NO: 108552 - DNA, 601 bp, Human
aaactgcaaactcctgggccccatccagaacaggaatcttgaggcgtgagttcaggagtctgcatttttcacaaatacctcagctgactctaattcacgccattaagaaaaaactcttcagtgaaataacaatatacatagaatactgtacattgaatccagtacaatgaatacatggaatacaatatgcagagaaagctatatgctgaagagctcactgtagattttgttttttttttgagagacaaagtctcactctgtcacccaggctggagtgtagtggcacgatcttggttcaccrcagcctctgcctcctgggttcaagtgattctcatgcctcagcctcccgagtacctgggattacaggtatccgccatcacacctggctaattgttttgtatttttagtagagacgggttttcaccaagctggtcttgaactcctgacttcaaatgatccgcccgcctcagcctcccaaagtgctgggattacaggcgccactgtggattttcataaactaaacacacatttgtgtagacagcagcctcaaagcacccttgtgcctatttccaggcactgtcccctgtggtgcatccatgca

SEQ ID NO: 108553 - DNA, 601 bp, Human
tgtccacccaccagaaatgatcctttatatagcaagtgtttagagtaaagacagctggtcatgtctcagatcctcctggggaacactggtgaccactggggaagtcagataagcatgtttatgaggggttatctgtgctacaggcattgtttcttggccttgctgcaagaacaccttggcatgcaggactcaagcatcggtcatcgtggtggtttcgcttcaagatggtgttacccttgcagtgcaccaggctgttttcctaccatcccaatgtgtgagcctagtcattctcaagtcattyttttgctctacttatagagtcctattgatgcccagtattaagcacatcaacagcagaccaggtctgcagctttgctatgttcttacaggtatatcttcagatgacctgcagcagaattacctgaggtatttgtaaaaaactgcaaactcctgggccccatccagaacaggaatcttgaggcgtgagttcaggagtctgcatttttcacaaatacctcagctgactctaattcacgccattaagaaaaaactcttcagtgaaataacaatatacatagaatactgtacattgaatccagta

SEQ ID NO: 108554 - DNA, 601 bp, Human
ttcttgtcgctcacgctggagtgcaatggtgtgatctcggctcactgcaacctccacctcccggattcaagcaattctcctgcctcagcctcccgagtagctggaattacatgcatgcaccaccacgcctggctaatgtttgcatttttagtagagatgggggtttcaccatgttggccaggctggtcttgaactcctgacctcaggtgatccacccgcctcagcctcccaaggtgctaggattacaggcgtgaactaccatacccggccaaaatatagaaacattttaaaacatctctcwtgatacgcatgagaaggattcagagaaatctttttttttctctctctctctctttttttaaacagggtctcactctgtcacccagactatagtgcagtggtgtgatctcagctcaccactgcctccacctcctgggctcaaagaatcctcccacatcagcctcctgagtagctgggactgcaggcacataccaccatacccagctaatttttgtactttttgtaaagacagggtcttgctatgttgcccaggctggtcttgaactcctgggctcaagtgatccactcgcctcaccctccc

SEQ ID NO: 108555 - DNA, 601 bp, Human
tctggcatttttaaactgtgcattaaaatacagaaaagtggtttttttggggggatggagtttcattcttgtcgctcacgctggagtgcaatggtgtgatctcggctcactgcaacctccacctcccggattcaagcaattctcctgcctcagcctcccgagtagctggaattacatgcatgcaccaccacgcctggctaatgtttgcatttttagtagagatgggggtttcaccatgttggccaggctggtcttgaactcctgacctcaggtgatccacccgcctcagcctcccaaggtsctaggattacaggcgtgaactaccatacccggccaaaatatagaaacattttaaaacatctctcatgatacgcatgagaaggattcagagaaatctttttttttctctctctctctctttttttaaacagggtctcactctgtcacccagactatagtgcagtggtgtgatctcagctcaccactgcctccacctcctgggctcaaagaatcctcccacatcagcctcctgagtagctgggactgcaggcacataccaccatacccagctaatttttgtactttttgtaaagacagggtc

SEQ ID NO: 108556 - DNA, 601 bp, Human
aagtagaatagagccaggtctggcatttttaaactgtgcattaaaatacagaaaagtggtttttttggggggatggagtttcattcttgtcgctcacgctggagtgcaatggtgtgatctcggctcactgcaacctccacctcccggattcaagcaattctcctgcctcagcctcccgagtagctggaattacatgcatgcaccaccacgcctggctaatgtttgcatttttagtagagatgggggtttcaccatgttggccaggctggtcttgaactcctgacctcaggtgatccacccrcctcagcctcccaaggtgctaggattacaggcgtgaactaccatacccggccaaaatatagaaacattttaaaacatctctcatgatacgcatgagaaggattcagagaaatctttttttttctctctctctctctttttttaaacagggtctcactctgtcacccagactatagtgcagtggtgtgatctcagctcaccactgcctccacctcctgggctcaaagaatcctcccacatcagcctcctgagtagctgggactgcaggcacataccaccatacccagctaatttttgtact

SEQ ID NO: 108557 - DNA, 601 bp, Human
aaacaagctccttgttatttaacaaaataaactgaaaacttacgtccatataaaaattatacagctatttacatttttatttatcattgccaaaacttgaaaggaaccaagaggtccttcagtaggtgaggggataaataacctgtggtacactcagacaatggaatacgagtcagtgttgaaaagaaatgatctatcaagccatgaagatacatggaggaaacttaaatgcatattactaagtaaaagaagccaatctgaaaaggctatactatatgagtccaagcatatgacattttgraacaggcgaaattatggagacaataaaaagatcagtggttgccaaaggctagtgaggagggaaggatgaaaagatggcacatagggtatttagggcagtgaaactcctctgtatgatactacaatgtcattatacatttgtccaaacccctacttcagtgtaggtttattagttgtaacaaatgtaccactctggtgggggatattgatcatgggagaggctatgcgcgtgtggggatagggacaaggggtatgtgggaaatctctgtaccttcctctcaattttgctttagataatttt

SEQ ID NO: 108558 - DNA, 601 bp, Human
cattccggttcagtgttgaggttttgtttcttgctgccctattggtctcactccgtcagccaggcaggaatgcagtggtgcaatcatggctcactatagccttgacctcccagggctcaagtcagccacctcagcctcctgagtatctgggactacaagcatggaccactacgcctggctaatttgtgtattttttttttttttttgtagagatggggttttgccatgctgtctaggctggtcttgaaatcctgagctcaagcaatccacccacctcagcctcccaagatgttaggattaygggcatgagccactgtgcctggcctggtgttcttatttgttatgagtgcctgcaggtgtcacagagctgtaatttaagaagaggttaattcagaccccttttgaccccagaaaagacagtttgttggaggtctgcacagccctattgtctatttattgctaccataagaactcatcctttagtggcaaggaataatggcaattaatttactagtttccccataagctactgtggagaagaaaggcttttctttcagtcatcctacttcctgagttttaccctaaaaagctctcattctaa

SEQ ID NO: 108559 - DNA, 601 bp, Human
ttcaaaaaaaaaaaaaaaaaaaggcacaatcattacaactagcactatacagttattgtccatttgaggtttctttttttacagtatgtcatggacattccggttcagtgttgaggttttgtttcttgctgccctattggtctcactccgtcagccaggcaggaatgcagtggtgcaatcatggctcactatagccttgacctcccagggctcaagtcagccacctcagcctcctgagtatctgggactacaagcatggaccactacgcctggctaatttgtgtattttttttttttttttgtagagatggggttttgccatgctgtctaggctggtcttgaaatcctgagctcaagcaatccacccacctcagcctcccaagatgttaggattacgggcatgagccactgtgcctggcctggtgttcttatttgttatgagtgcctgcaggtgtcacagagctgtaatttaagaagaggttaattcagaccccttttgaccccagaaaagacagtttgttggaggtctgcacagccctattgtctatttattgctaccataagaactcatcctttagtggcaaggaataatggcaattaa

SEQ ID NO: 108560 - DNA, 601 bp, Human
aaaaattagccgggcgtggtggtgtgtgcctgtaatcccagctactcaggaggcttgggcaggagaatcgcttgaacccgggaagcagaggttgcagtgagtggagatcgtgccattgcactccagtctgggtgacagagcgagactccgtttcaaaaaaaaaaaaaaaaaaaggcacaatcattacaactagcactatacagttattgtccatttgaggtttctttttttacagtatgtcatggacattccggttcagtgttgaggttttgtttcttgctgccctattggtctcactccrtcagccaggcaggaatgcagtggtgcaatcatggctcactatagccttgacctcccagggctcaagtcagccacctcagcctcctgagtatctgggactacaagcatggaccactacgcctggctaatttgtgtattttttttttttttttgtagagatggggttttgccatgctgtctaggctggtcttgaaatcctgagctcaagcaatccacccacctcagcctcccaagatgttaggattacgggcatgagccactgtgcctggcctggtgttcttatttgttatgagtgcctgca

SEQ ID NO: 108561 - DNA, 601 bp, Human
gaacttccctttttggtcccttgaggaagaggtcaaacataaccagatcatctttttgaaggacaattcagctgtactaagagcgagatcgagcattaccttaaagtacaaatgaatacttaaagagatttcttggccaaggtgggcagatcacaaggtcaggagttccagagcagcctggccaatatggggaaacctcgtctctactaaagttacaaaaaattagccgggcgtggtggtgtgtgcctgtaatcccagctactcaggaggcttgggcaggagaatcgcttgaacccgggargcagaggttgcagtgagtggagatcgtgccattgcactccagtctgggtgacagagcgagactccgtttcaaaaaaaaaaaaaaaaaaaggcacaatcattacaactagcactatacagttattgtccatttgaggtttctttttttacagtatgtcatggacattccggttcagtgttgaggttttgtttcttgctgccctattggtctcactccgtcagccaggcaggaatgcagtggtgcaatcatggctcactatagccttgacctcccagggctcaagtcagccacctcagcctc

SEQ ID NO: 108562 - DNA, 601 bp, Human
ttttaaaaactggacataattatcatgccccaatcattataattcttccatgttcccctttaggtttttttttttttttcctccatatagctacaggaaacttgtttttaaatccccaaagtgaaaacctctagggacctcatactataaaaagctgagaacttccctttttggtcccttgaggaagaggtcaaacataaccagatcatctttttgaaggacaattcagctgtactaagagcgagatcgagcattaccttaaagtacaaatgaatacttaaagagatttcttggccaaggygggcagatcacaaggtcaggagttccagagcagcctggccaatatggggaaacctcgtctctactaaagttacaaaaaattagccgggcgtggtggtgtgtgcctgtaatcccagctactcaggaggcttgggcaggagaatcgcttgaacccgggaagcagaggttgcagtgagtggagatcgtgccattgcactccagtctgggtgacagagcgagactccgtttcaaaaaaaaaaaaaaaaaaaggcacaatcattacaactagcactatacagttattgtccatttgaggtttctt

SEQ ID NO: 108563 - DNA, 601 bp, Human
aaatgtgttttaggccagacacagtggctcacgcctgtaatcccagcactttgggaggccgaggcaggtggatcatttgaggtcaggagttctctgcaaaaagtacaaaaattagctgggtgtggtggtgtgccatgaatacactcatttctatttctgacatcactttcatgctttgacaaaatgaagtccaaatgaaaacatgttgttgagtaaactttcctttgtttgggtgattgatcatatgtgaactggatcccatggctctaactgcttttccttcaatgactccccatggcaytgagatggcacctgatcccctcagcatgcacaccagacctcttgggatctgtcttcttcctgccttgggtttcccaccccaatcccatacaccaggccctagccattcttctttatgtgtagttcccaaaggaggtaactccctgccttgacacctttaatacctgctctttcttctgcatggatagtccttagcccaccccatcaaagcggccaacctccccttgccttttcaaggctcagctaaaagcctcctgccatccaacaccttcctgatccttctgctcagccccatccccta

SEQ ID NO: 108564 - DNA, 601 bp, Human
caaaaattagctgggcatggtggtgcgtgtaatcccagctacttgggaggctgaggcatgagaatcacttgaacctgggaagtggaggttgcagtaagccgagatcgcaccgctgcactccagcctgggtgacagagcgagactcagtctcaaaaaaaaaaaaaaaaaaaaaagtttcatgtggccaagtcttgatttcataaaaatattgtcatattttccttttgctcccctgctgtgtctaccaggtaaatcatggccattccctaaggcccaggtcatcttcttagtaaagacctcrgtggtgggttgtattattggttgcccaacatctggtgccctaatgaactcaggcatatcatgtgacctgctctggccagtgaaatgtgggcagaaatggtaatgtaccacttctgggcagagctttaagggctgatgcatgatttgccatctcctttccctctgacataagacaggcaatgattggatagagggtgctctgtcagcttcggtcctggagggaaggtgacagggagcagagtcacaactgttcaataatggacatatgagtgacatctaaatctttatttttctgttataa

SEQ ID NO: 108565 - DNA, 601 bp, Human
cacggccaggtgtggtggctcatgcctgtaatcccagcactttggaagactgaggagggcagatcacttgtggtcaggagtttgagaccagcctggctaacacagtgaaactgtcaccactaaaaatacaaaaattagctgggcatggtggtgcgtgtaatcccagctacttgggaggctgaggcatgagaatcacttgaacctgggaagtggaggttgcagtaagccgagatcgcaccgctgcactccagcctgggtgacagagcgagactcagtctcaaaaaaaaaaaaaaaaaaaaaagtttcatgtggccaagtcttgatttcataaaaatattgtcatattttccttttgctcccctgctgtgtctaccaggtaaatcatggccattccctaaggcccaggtcatcttcttagtaaagacctcagtggtgggttgtattattggttgcccaacatctggtgccctaatgaactcaggcatatcatgtgacctgctctggccagtgaaatgtgggcagaaatggtaatgtaccacttctgggcagagctttaagggctgatgcatgatttgccatctcctttccctctgacataaga

SEQ ID NO: 108566 - DNA, 601 bp, Human
accgaaaagaaagtagggtaagcacgttctcactcataagtgggagttcaacaatgagaacacatggacacagggaggggaacatcacacacctgggcctgttggagggttgggggcaaggggagggagagcattaggacaaatacctaatgcatgcagggcttaaaacctagatgacaggttgataaggtgcagcaaaccaccatggcacatgtatacctatgtaacgaacctgcatgctctgcacacgtatcccagaacttaaattaaaaaaaaacaaaaactgacaaaaaaaaaaaaagacagtagggtggctggactggcaagggaaggaaagacatggacaaaatccatttgtaccatacacaccctgtctctgggacacacaccttttttcatggcaaaccacctggcatgcactgcgatttctgtagagtttcaggtttgggccagtccacatgaacacccagtctgtttctgaactcgcaaagctgagagcctgtacagatgtgatgccctctagcctgccccaggtcagccacaggatcccaatgaagcttaactgtcatattctgtgtagtgggctgggaattcctgactt

SEQ ID NO: 108567 - DNA, 601 bp, Human
gattgtgccactgcactccagcctgggacacagcaagacctgtctcttaaaaaattaataataatgaatgcatccctacaggattgaaaatggcacactgtcagggataagaggctaaatgataggatgataaagctgagtaattattttcacctttccatctttccagtttttttaatttaaaaaaaaaaaaaccaaaccctatcattcattaagtgcagatactatgtgccaggcactctgctaagcactttatgttatttgatcttcacacctgtgaggtgtgtgatagccacaatgyatagttgaggaaacttaagtggcagaaacagggttcaaatccaagtctgtctgattccaaagatctgtgctcttctgaggatctaaggctgcctcaatgtccctgaaagtactagacaggccaaagccaaccccactctggggaaaaagtccccaggcagttctttcagcagcatgctgctacggtttgctcctggagcaagactgggctttcttcctggctatgactgattacagaacaagacaactgaatccgaggccaccccaccgggacattccacattgggtgttaatgtcacaa

SEQ ID NO: 108568 - DNA, 601 bp, Human
cactttgggaggctgaggtgggaggattacttgaggccaggagtttgagaccagcttgggcaacacagtgtgatgccatctctacaaaaactttaaaaattagctgggtgtggtggcatgtgtctgtaatcctagctacgcggtataagattctccccggggcctgaaagcttaaggagatgaataactcctcccttctcaggcccagtcccaaggcgcaagtccacttgtgtcagcagcgtgtgtcagcaagatagcagaagcaggaagagagccggcaggaagacacctaccctggacraagacatgtacccctgatcgagaaacaggccacctgggtacaacatagcagttacgtcagactaggacacttcctgtttacaagagactataaaacctctgccctgtcctcacttggggctgatgccattttaggcttcagcctgcctgtacccaggtgctcattaaaacagcatgttgcttcacaccgcctcgtgttttctgttggcgcgctctcagggttccaaccaatacaagaaccttacactcaggagactgaggtgcaaggatcccttgatcccaggagtttgaggttacagtg

SEQ ID NO: 108569 - DNA, 601 bp, Human
tatatgaatgcactaccatttattcaatcaattctctattgttaggtgtccaatgataaggaattttatgtaaattatagcatgttcactaaaattacgtacagaatttataacattaaaatattttatagtatggaaaaagaatgcaaaattatataattacaaccatgtaaaacagactttctattaaaaacctatagcttcgtagcatataaagccttaaattaaataatggatgaggccaggtgtggtggctcatgcctgtaatcccagcactttgggaggctgaggtgggaggatyacttgaggccaggagtttgagaccagcttgggcaacacagtgtgatgccatctctacaaaaactttaaaaattagctgggtgtggtggcatgtgtctgtaatcctagctacgcggtataagattctccccggggcctgaaagcttaaggagatgaataactcctcccttctcaggcccagtcccaaggcgcaagtccacttgtgtcagcagcgtgtgtcagcaagatagcagaagcaggaagagagccggcaggaagacacctaccctggacgaagacatgtacccctgatcgagaaaca

SEQ ID NO: 108570 - DNA, 601 bp, Human
aaaataaataaataaataaataaaatttaaaaagagtaactcagaagggagattgtttttaaagcaggagatcctgaattctgtatttaaatgctgatgtgacacagccccttgggagcatccttgatatgtgtgagtcctgtcaggtgaactgggaaccacaacccaaagaaagcgtctaagtcttagctctgtgtgatctgggcaagaaagggcagagacaaaagctcactgaggatttgctttgtgcagatattatgtgtgctgctctggctcaggtaatctcaagtaatcccttgtygtgacccactgagacggattattaaccaaactttacaaatgaaaaaactgatcttcaaaaatattaagtaaagggcttatgatcacactgccgatcagaggctgtgatttgagcccctgagccaagaactgaactctggtctatttgacttcaattctagtgctcctcccactaacaaaaactgcttgtctcttaagaggcttggtttcctaaccagtaaaaatgacgaagtccctttcaattttaaaattgtctggcacttttaatacagtttaccttagagatgtgggtatgtttgat

SEQ ID NO: 108571 - DNA, 601 bp, Human
cccggaggcggagcttgcagtgagccaagatcgcgccactgcattccagccctggcgacagagcgagactccgtctcaaaaataaataaataaataaataaaatttaaaaagagtaactcagaagggagattgtttttaaagcaggagatcctgaattctgtatttaaatgctgatgtgacacagccccttgggagcatccttgatatgtgtgagtcctgtcaggtgaactgggaaccacaacccaaagaaagcgtctaagtcttagctctgtgtgatctgggcaagaaagggcagagacraaagctcactgaggatttgctttgtgcagatattatgtgtgctgctctggctcaggtaatctcaagtaatcccttgttgtgacccactgagacggattattaaccaaactttacaaatgaaaaaactgatcttcaaaaatattaagtaaagggcttatgatcacactgccgatcagaggctgtgatttgagcccctgagccaagaactgaactctggtctatttgacttcaattctagtgctcctcccactaacaaaaactgcttgtctcttaagaggcttggtttcctaaccagtaaaa

SEQ ID NO: 108572 - DNA, 601 bp, Human
gtagtcccagctactcgggaggctgaggcaggagaatggtgtgaaccccggaggcggagcttgcagtgagccaagatcgcgccactgcattccagccctggcgacagagcgagactccgtctcaaaaataaataaataaataaataaaatttaaaaagagtaactcagaagggagattgtttttaaagcaggagatcctgaattctgtatttaaatgctgatgtgacacagccccttgggagcatccttgatatgtgtgagtcctgtcaggtgaactgggaaccacaacccaaagaaagcrtctaagtcttagctctgtgtgatctgggcaagaaagggcagagacaaaagctcactgaggatttgctttgtgcagatattatgtgtgctgctctggctcaggtaatctcaagtaatcccttgttgtgacccactgagacggattattaaccaaactttacaaatgaaaaaactgatcttcaaaaatattaagtaaagggcttatgatcacactgccgatcagaggctgtgatttgagcccctgagccaagaactgaactctggtctatttgacttcaattctagtgctcctcccactaac

SEQ ID NO: 108573 - DNA, 601 bp, Human
aaagttaaattatagttgatggttgactgggagggtgtcataactcgcagtacaaggaaagaaaaaaaaacaacagcaataaaagtaactcagggccaggcacggtggctcacgcctgtaatcccagcactctaggaggccgaggcgggcagatcacgaggtcaggagatcgagaccatcctggctaacacagtgaaatcccgtctctactaaatatacaaaaaattagccgggcgtggtggcgggcgcctgtagtcccagctactcgggaggctgaggcaggagaatggtgtgaaccccsgaggcggagcttgcagtgagccaagatcgcgccactgcattccagccctggcgacagagcgagactccgtctcaaaaataaataaataaataaataaaatttaaaaagagtaactcagaagggagattgtttttaaagcaggagatcctgaattctgtatttaaatgctgatgtgacacagccccttgggagcatccttgatatgtgtgagtcctgtcaggtgaactgggaaccacaacccaaagaaagcgtctaagtcttagctctgtgtgatctgggcaagaaagggcagagacaaaa

SEQ ID NO: 108574 - DNA, 601 bp, Human; identical to SEQ ID NO: 32400

SEQ ID NO: 108575 - DNA, 601 bp, Human; identical to SEQ ID NO: 32401

SEQ ID NO: 108576 - DNA, 601 bp, Human; identical to SEQ ID NO: 32402

SEQ ID NO: 108577 - DNA, 601 bp, Human; identical to SEQ ID NO: 32403

SEQ ID NO: 108578 - DNA, 601 bp, Human; identical to SEQ ID NO: 32404

SEQ ID NO: 108579 - DNA, 601 bp, Human; identical to SEQ ID NO: 32405

SEQ ID NO: 108580 - DNA, 601 bp, Human; identical to SEQ ID NO: 32406

SEQ ID NO: 108581 - DNA, 601 bp, Human; identical to SEQ ID NO: 32407

SEQ ID NO: 108582 - DNA, 601 bp, Human; identical to SEQ ID NO: 32408

SEQ ID NO: 108583 - DNA, 601 bp, Human; identical to SEQ ID NO: 32409

SEQ ID NO: 108584 - DNA, 601 bp, Human; identical to SEQ ID NO: 32410

SEQ ID NO: 108585 - DNA, 601 bp, Human; identical to SEQ ID NO: 32411

SEQ ID NO: 108586 - DNA, 601 bp, Human; identical to SEQ ID NO: 32412

SEQ ID NO: 108587 - DNA, 601 bp, Human; identical to SEQ ID NO: 32413

SEQ ID NO: 108588 - DNA, 601 bp, Human; identical to SEQ ID NO: 32414

SEQ ID NO: 108589 - DNA, 601 bp, Human
ctagaccatctggctggtaggtcctaattgcttagctttctctttgatggcgtcctcagtgtaatttatgaatcgttgctgattatagtagatatagtttatttagtctacttaaaaaaaatttatagttacttaacagaacaacatggatttaaactctgcagctatttgattttgtgctttaaacttatttggcacttctcataggaccttaatagcatttatgtaaacctaacgtttaaaggactcatgaggagtttcctttggcctgcagtgtcttgtttttacctttttttttttwggttggtgaaatgccagggtgcaggggatagccagttggattagagcataagtactgctccaattatttggcagagtgtctagtaaaagtcctctacaatatcaccatacatttgcttggggatggctaagcgtggactgatgggcaagctcttggaaaggcttgagctccttgcatccttttatgcttctaaggaacaccaaattttactcttgccgtgagaggcacaaagtaaacttggcattcagaggtggaagcaggcttgccctcgggggcggacccccggggtattgagtttca

SEQ ID NO: 108590 - DNA, 601 bp, Human
agctactatattaaaatattactcaacgaaatctacaatctgctgaaatccaaattctgatcatctaaattctgctgaaataatgagaatatttgtttcaacttattttgaaaagaaaattactcaagacagttttatcaatgctattaggctgccacattgtagaagggaataaagaggcttttttgataatcttcctataccccctcaatcaggagctccctacaactgggtcaacataaagcattaaatatctttaaatagggcagacattaaaaaaaatgcacagaacataaaatamcaataaaaatattgttctgcttattgaggatttattggatgctggtctgtaaaaactgtgtttgttacaaaattatgccatatattcgtcattgtatctccataaagataaaattttcatctcatttcacatatgagattcatgagatacaaagaggttaaaaataccattcaggctaataaaaataattagtgttagagtaaggattcatatctagttttagtcaagtaaaaaactttggtaatcatgcaaatatgtttcttccagtatgggacagtatatattaaaattctgtcatat

SEQ ID NO: 108591 - DNA, 601 bp, Human; identical to SEQ ID NO: 32415

SEQ ID NO: 108592 - DNA, 601 bp, Human
gacgacagaaggtatataaagctcctgttcagatttagaagttaaagctacgatgtgagatgtttcaggcatgtttgtagaattacctttataatctacttcaggagttatagggtttgtgttaatgttttcattttggtttctgcctgtcttgttttgaataactgaatcccaggaagaagtactgttagcccacagacgggtatagtttgcttttgttccaggagacaaagaaaaaactgttgtcatcagaaaggcaagatgtaggtaatgtcctgtgtgttccatgtccgtgggcatrcttggcaatctgttgggatagcaatataatttgttagtttgtgaaagaataatggatcctagttttggtaattgtagttaaaagatagtgttgagatgttacaagtaaactacaagcttatgcctaatattcgctaccctgaattccttctcaactaaatttcttttctattcagctatgtatgaagaagcattttaatttctattaacacttttagatgctagaagttagcattacaaataaatattaatcattttaagtggactatcatggctttatatagttttcttcctttgaagc

SEQ ID NO: 108593 - DNA, 601 bp, Human
tcgtgggtcggtgggtcgtgggccgtgggtcggcggggccagacaactcagcggcgcgcggcgggggcggggctccgaactttgtctctaagtttccggttctgtgctcagcggctccaccctcggtgcgcatgcgcgccttgccagccctctgttccagctccacacccggccccgagcgcgagcctggaggagggggaggagaaggggcggagcagtcggtgggcgcggcggctgctggaggctagcgcgacccgactcttaagttttcttttcctctccagaggggccgattagggakaggtaaggagagagcttaccgttagccgcgaagaactaagagggggtctgaagaggaccagggagggaaggcagagcttgtgggagtttctaaaaggcccggcggcgggtgaccaggaggtctcagttttcctcccagtttgtgggaagggttgagggaagtgaggggagatactgggtgaggcgtaggagctactgtgcacccggcgtgagtcacccgcacacccccgccccgtacaggcgtgtctctctgtgacccgagtttggccaacaggcattttcagttccacccccaaccccc

SEQ ID NO: 108594 - DNA, 601 bp, Human
ttttaacagggcacatgatttacattcttgtttctttttttaactgcagaagtgtttcacatgtagcctgacctattgtaccagaaagaagccaatccatttaggactgtaaaaatcaggaaatacttagaacagcacttgaatgtcaagttattctatcaacacagacaaaaggctttttctcccaaagtaccccaagacaaggccaatactaaccagacgccaaaataagaccaataattacccacaataatcattttctccggcatgcggaccagtcgatatccccaaggtcaaataygagcaaactgtgccataggtatgaaatgcacgctttgttcgaggttgtacggggcactgaccggaactttacactccaggatcgtttcgaaaaatgcttattcaatccacagtttaagttatgcaataattcgcttaaaagtatgtgttcaacggacaagagaagttgaaggtaagaatttaatactaaaggaagtaggtttgggaaagatcaaatgggagaaaagtctgctctgaatcaaaagtcggaaaataccctgtccgatgagaaacaggaggctggcaaagtgggaaaggaagg

SEQ ID NO: 108595 - DNA, 601 bp, Human
tcccttcccttctgaggtgaccacaactgagtaagctaggtctctgacacttctagttaagaaagcttagagaccctctcagttcacaaaacatttcggcaagtaataaagactagcctgatgagtataaaatcaaatcatcttaggaactggctgcttttaacagggcacatgatttacattcttgtttctttttttaactgcagaagtgtttcacatgtagcctgacctattgtaccagaaagaagccaatccatttaggactgtaaaaatcaggaaatacttagaacagcacttgaawgtcaagttattctatcaacacagacaaaaggctttttctcccaaagtaccccaagacaaggccaatactaaccagacgccaaaataagaccaataattacccacaataatcattttctccggcatgcggaccagtcgatatccccaaggtcaaatacgagcaaactgtgccataggtatgaaatgcacgctttgttcgaggttgtacggggcactgaccggaactttacactccaggatcgtttcgaaaaatgcttattcaatccacagtttaagttatgcaataattcgcttaaaagta

SEQ ID NO: 108596 - DNA, 601 bp, Human
gggttttcaaagtaaagctcttggagtattttagcctgagaacctcatgtcattttctttggagactaaagatgtacaatttattgctttcactatcccacccccatttttttttcttggtccatcctatctatgataaaggcacacctgaatgacatttaatggttacgaaataaatgatttcgagtttcagagccaaatccagccaagactgactagaaaccactgtgatgaggtaagaattgggagagtagagaaatggattccaaactgcagtgaggtctacagcatttcaaggactggacgtgagggggatcccacaccaagacgaatgagaattcccttcccttctgagttgaccacaactgagtaagctaggtccctgacatttctagttaacaaaactaaatgggagactctctctcaggaggatcctgcaccaagacgaatgagaatttcccttcccttctgaggtgaccacaactgagtaagctaggtctctgacacttctagttaagaaagcttagagaccctctcagttcacaaaacatttcggcaagtaataaagactagcctgatgagtataaaatcaaatcatctt

SEQ ID NO: 108597 - DNA, 601 bp, Human
tggtaagttctatcaattgtactcacacataaaggttaaaagtaagattgtgctagtttaaaaatctcacaaaaaaatcacctagcccagtcattgataaaacagatacacaacgttaaaccacatttagcaacatgtctaaagaaaagctcattaaaaagtacaaaaggggatgctccccttcttgctacagccttaacatcaggcaataactccaaaaccaaatcatgtctggtgcctttaatgatcccgaccagaaccagaagtctactgaagatttaggtaggatcagttttggggrattaggggagcagcagctagggttttcaaagtaaagctcttggagtattttagcctgagaacctcatgtcattttctttggagactaaagatgtacaatttattgctttcactatcccacccccatttttttttcttggtccatcctatctatgataaaggcacacctgaatgacatttaatggttacgaaataaatgatttcgagtttcagagccaaatccagccaagactgactagaaaccactgtgatgaggtaagaattgggagagtagagaaatggattccaaactgcagtgagg

SEQ ID NO: 108598 - DNA, 601 bp, Human
cttcagatagcacccagctcaggcccctcacactgacctccatccaggccctccagctactcagacctccttcagagtcctaataaccaagggaggagcaccaagctcatcctcaccagctccaagtctccctcctcctcctcccagggaaatgccattgggacccacaaccccaggctcagagacaaggggacccagggtaatagaggtacctgcaaatgctgccttccaaaagggacctggtgggttctgttctccctggcaacacatctggctgttccagccaccagcgagagcccargactggtaactgtccacaggcaacagggagtcatgtcgcggttctccaggagcacccagagtctgcaccacagacacgtccaggtaactggccataggctggtaggttcccggatatcccggatagaaggcaaactcagtggggcggctggggtactcttccccggccgtgggagtctccgcggggtacgcggccagggtggctgcctgggcacagggtttcagcgagctccgggacactcggcaggagtagtacccgcctccaaagtaaccataaggcacgggagctggggacgtcccc

SEQ ID NO: 108599 - DNA, 601 bp, Human
ctgggaaaacagggttggcaccactctgccactccgtttgtgcctgggaagggctaagtatgcaaggctacaaacatctacttcactgggatcccaaatgctcaacaaaccatgacctgctttggtcagaaccaccagaaatattaagggaagactcagagagtttgggggaggaaattaatggtgaattacccaggcactttctcaaatctctttttctctggaaggaaggactgactaggggcagcctgctggcttcattttcacacgacagaaaaatcatcgtattaaggatgggtgyttccaagaccagtgggtacaccctatggggtggacaaggagggaggaagagacagcctctacaattgtccacctacccagctgtcagctgagaaaaatgctaaacggacatcacagccacacaacgaatctgcccgttcccctctcctcagtcttcctgctgttaccagggtgagaggtgtaatggaagggggtctgagagaaagcttccctgcaaagggatcgccttccaaatttattcataattagctcaattcatgaaagcggtttctaaagtgctctacagagctctagatagaaa

SEQ ID NO: 108600 - DNA, 601 bp, Human
tctacgtccaggtaggctcttccagaagaagaaataacagtcatacatttgacatggaagaagattttgttagcacagtagttactgagaatgtaaaattggttcccagggtgcatgttagaacctgtaggagcatttttttgttgtcatcaggtggggtggagacacactgtcatttagtgggcagaggcaaatatgccagatgtctgcaaagcatgggacagtcaagcacagtaaagaactgacctatgttctgtgtcacttttactacctcattggatattcatgaaggtaaatccatttataaataagagcccagaacacataaaaacaaggtacttttttttttttttttagcagttttaacattaacatatcctggagtttctaaaactatattttgtttatgctaaaattttgctgtttttgttttttaaaaaaaacattttggaaaaccacatttgtatttgtaattaacagcccagaacacataaaaacagggtactgggggttttttttagcagtttttttatgagatggtgttttgctcagttgcccaggttggagtgcaatggcacaatctcagctcactgcaaactcc

SEQ ID NO: 108601 - DNA, 601 bp, Human
attctcctgcctcagcctcctgagcaactgggaccacaggcgcctgccaccacacccgactaattttttgtatttttagtagagatggggtttcaccgtgttagccaggatggtctcgatctcctgacctcgtgatctgcccgcctcggcctcccaaagtgctgggattacaggcgtgagccaccgtgcctggccccacactgggctaatttttatatttttagtagagatgaagttttaccatgttggccaggctggtctcgaactcctgacctcaagtgatctgcctgcctcggccccscaaagtgttaggattataggcatgagccactgctcctggcctttttgagagagggtttcactcccatcacccaggctggagtgcaatgacatgatctcggctcactgcaacctctgtctcccaggctcaagtagattctcctatcttagactacaggtgcaggccactgcatccggctatttttttttagagacaaggttttgccaggttgcccaggctggtcttgagctcctgggctcaagggattctcccgcttcagcatcccaaagtgctgggattacaggcacaagccaccacccc

SEQ ID NO: 108602 - DNA, 601 bp, Human
tttattcatctaagcattttttttttttttttttttttgagacagagtctccctgtcgcccaggctggaatgcagtggcgcgatctcggctcactgcaagctccacctcccaggttcatgccattctcctgcctcagcctctctgagtagctgggactacaggcgcccgccaccatgcctggctaattttttgtatttttagtagagacggggtttcaccgtggtctcaatctcccatctaagcgttttttttttttttttttgagatggagtcttgctctgtcatccaggttggagtgcwgtggtgcaatctcggctcactgcaacctccacctcccaggttcaagcaattctcctgcctcagcctcctgagcaactgggaccacaggcgcctgccaccacacccgactaattttttgtatttttagtagagatggggtttcaccgtgttagccaggatggtctcgatctcctgacctcgtgatctgcccgcctcggcctcccaaagtgctgggattacaggcgtgagccaccgtgcctggccccacactgggctaatttttatatttttagtagagatgaagttttaccatgttggcca

SEQ ID NO: 108603 - DNA, 601 bp, Human
agtaccttgttagtgatgaagtaataaagcctctaagatgtttttgttgtatgacctctgtatattaatttttaaaagtacatatgaatgcattttttgatgtgttctttatgcattttcatattataaattttaaatcatgcagtttaacaaggatgtgattcattatgtggttttccttcccaatttttacttttctaatttttataaataatacacttttctattaggctagtgaatttgaaagttttgaacatgatgtgttactaatatgctgaattctatttattttatttgactraaagcatattgagccttgctttagaaaataagttaccaaatttttttgcattgagttgtcacccagtttgtagtgctgtcttaattgaattgcccatgtaaattactagattaaattgaggacagaaaagttttttactcatcctaagctgtttttttctggaaagtaatgacaatttgaagaaatgagaacctccagatatatttggcaaattattaaagattcagcactaaaattgttgctcccttgagtgtatcatttgcataggtctcacatgggttttggctctcttatgcaagg

SEQ ID NO: 108604 - DNA, 601 bp, Human
aagtacatatgaatgcattttttgatgtgttctttatgcattttcatattataaattttaaatcatgcagtttaacaaggatgtgattcattatgtggttttccttcccaatttttacttttctaatttttataaataatacacttttctattaggctagtgaatttgaaagttttgaacatgatgtgttactaatatgctgaattctatttattttatttgactaaaagcatattgagccttgctttagaaaataagttaccaaatttttttgcattgagttgtcacccagtttgtagtkctgtcttaattgaattgcccatgtaaattactagattaaattgaggacagaaaagttttttactcatcctaagctgtttttttctggaaagtaatgacaatttgaagaaatgagaacctccagatatatttggcaaattattaaagattcagcactaaaattgttgctcccttgagtgtatcatttgcataggtctcacatgggttttggctctcttatgcaaggtttgtggttaacatcattgatcagactgtgctttctaattctaaaaaattgagcagtgttggtattctttcagta

SEQ ID NO: 108605 - DNA, 601 bp, Human
ctggaaaactacctggaagttgtcaggcatttgcttactggtagtggaggttacagctgtacatgaagcatgtactgactgtacttttaaattggtttgtcaagtatactttgaatcatatacctgatggatgtccaaaaatatttaagactctttgaaaagaagatagttacttttaaattagttaccctaaatttcatatcttaatacatgtacataattatgacatcacttccttttaaaatgtgcagctgtagaatgttagtggtgttttaatgtggtagattaatattacttctastgagctgaactgtccctgtaattagtacttggttccttctgccatcagagtttttattgcccaaagtatagtgtttagggaatactacgaaaatcacctttgcagcctgagccacagaagaggaaatgagtttgcaggtcaagtaaactttggtctgagaattactttagtatctggaaagaatgagtgcaagtttaggtaaatctggtaataccctgtttttggaaatagtgcagtagttaatagtggttatataagtttgtattttaatttgaagttaatgctaaagtctgttatact

SEQ ID NO: 108606 - DNA, 601 bp, Human
cctttgcagcctgagccacagaagaggaaatgagtttgcaggtcaagtaaactttggtctgagaattactttagtatctggaaagaatgagtgcaagtttaggtaaatctggtaataccctgtttttggaaatagtgcagtagttaatagtggttatataagtttgtattttaatttgaagttaatgctaaagtctgttatactttatcacgatttttgaaaattaaaaactttaaaaaacgcgattttaaaaacatttgattgatatttgtaaaatttctaagtatttaaaacaaagttytaatgatggacatacgagaagtataccatactttttatctgaataatttgcagcttggggataacttaagtaacatcaaagaatgaaaacgggactgtgtgcacacaaagagttcagtgtgttctccacggcaccacgttagcaatttatcttaagaattgaacgagtttattaaatttatctccaaatcgtctgcctttgagccagatttatttttataacctgaggtgcgggtaaatcctacaattttcaggggcgctttaccagatattctaaaaggctggggatgattagaaatgg

SEQ ID NO: 108607 - DNA, 601 bp, Human
ctccacggcaccacgttagcaatttatcttaagaattgaacgagtttattaaatttatctccaaatcgtctgcctttgagccagatttatttttataacctgaggtgcgggtaaatcctacaattttcaggggcgctttaccagatattctaaaaggctggggatgattagaaatggcataatgcagttacttgtgtactagaacaggcagtttaactggcagccattttatgacgctgataatacattaaaaaacgggattttggagaagactgaatctaaactaatagaaatctgaaayaccaaagcctatttccttccccctctctgctcttctggggaactctggtgccgacataaaaggcagttcgatagggcacgcagcagctctttgagcccctggcatcttgatgcaggtccagctcagtcacaaaatggctgttcctttgtgccgcagcgctgacagacatactgcattgcactgtgtactcgccaaacagcaggaagttgccgtgccgagttcaaaggccggccggcgccggcgcggggtgctgattggctgtgcgcgcgcctggtaacagcagggtcaacggcggcgcct

SEQ ID NO: 108608 - DNA, 601 bp, Human
tttatcttaagaattgaacgagtttattaaatttatctccaaatcgtctgcctttgagccagatttatttttataacctgaggtgcgggtaaatcctacaattttcaggggcgctttaccagatattctaaaaggctggggatgattagaaatggcataatgcagttacttgtgtactagaacaggcagtttaactggcagccattttatgacgctgataatacattaaaaaacgggattttggagaagactgaatctaaactaatagaaatctgaaataccaaagcctatttccttcccmctctctgctcttctggggaactctggtgccgacataaaaggcagttcgatagggcacgcagcagctctttgagcccctggcatcttgatgcaggtccagctcagtcacaaaatggctgttcctttgtgccgcagcgctgacagacatactgcattgcactgtgtactcgccaaacagcaggaagttgccgtgccgagttcaaaggccggccggcgccggcgcggggtgctgattggctgtgcgcgcgcctggtaacagcagggtcaacggcggcgccttcggcagcctccgccccgtgac

SEQ ID NO: 108609 - DNA, 601 bp, Human
gggaactctggtgccgacataaaaggcagttcgatagggcacgcagcagctctttgagcccctggcatcttgatgcaggtccagctcagtcacaaaatggctgttcctttgtgccgcagcgctgacagacatactgcattgcactgtgtactcgccaaacagcaggaagttgccgtgccgagttcaaaggccggccggcgccggcgcggggtgctgattggctgtgcgcgcgcctggtaacagcagggtcaacggcggcgccttcggcagcctccgccccgtgacgtcagacggctcccckggggggcggggagagaacgcagtgacgtctggccgcgtgcgcatgtcgggcgctttctcctccccctacccagggagccgcacgccgaggggaaaaggaagggaactctagttgggactttccggtgggcggcttctttcctggacgcgtttgctcctggcagtcttgtccgcccttgcctgtagcggtccgcaccctgtagtgtgttcttttgcccatttccgggaatggtttatcctctttgagaagcggctgcttttggagaaaaagtgcaggcactatttataaattttaaaggca

SEQ ID NO: 108610 - DNA, 601 bp, Human
ctgtagcttccaacttaaagtatacctgccacaagaacgaaagtaataatctcacctccctttttgtgtagagactgaattctaattagttgtgttaatagtatttgctgaatacctttcaattcctaaaactggggtcaaagtagtcaacattgcagttaattatttttgaagaggatatgaactattctgttatttaagatattttaacctaaataccattatgagttaaaatgcataccatgatataacaatttacctattaactgttgacaatcttgcagccaattaagttttttawagaaccagtgttcttaggtatgtttgttgagccttctactttttttccctttgatgtggggaatagcatcaagcagcaagaaaagagtgttgatcgatttctctctctttctctctctctctctgtatccttgccgtttaaaatatgcactttccaactagtatttggccgttagggagttagtatctttgtaaagattaagtcagcagaggaaggtgggcaaataatatttttgataaagacttttggttgtgacagttgtagcaagttattgcttgaggagtgaatctggaagtttat

SEQ ID NO: 108611 - DNA, 601 bp, Human
aagtttatttgaattttaactaaaactcacagattttatcattagtttactctcccttacccccaaataaaacaactgacagttatgagagacctcctgagaccacctggtatttccaaactcctatcatttctcccataaaatttgatacactaagtttgtttctggtataaaaattgagtgactgctctgtgtcagccattaaattttttcttgctatgagccatcttttttttttttttttttaagatcctttagtttttagctgcttcttggtaaccttagaactttgcttccttgragaacttggctttcttgatatggtgtcacttgaacaaagaaacttaaaaaaaaattcctctaagagtattttgtgtacaggtgaaagtaactttgtggcttggttacactgggtgtgtcacagctgagtaactccctcctgcacttcagcttgactaagcgttgagttcacatgtatacctttgcaaagctgccattcacaacttgttttggaactttagggttatcagtataaagcctgagtaacaaaacttagtcatccaatgtccaggctggattgtatttttattttgtgatcagt

SEQ ID NO: 108612 - DNA, 601 bp, Human
ggcttggttacactgggtgtgtcacagctgagtaactccctcctgcacttcagcttgactaagcgttgagttcacatgtatacctttgcaaagctgccattcacaacttgttttggaactttagggttatcagtataaagcctgagtaacaaaacttagtcatccaatgtccaggctggattgtatttttattttgtgatcagtaattcagcacaatgctggaacacattactcacatttgtcttatgacccttttctgtaatcaatggaatctttaattgataaagcaagtctagggggwgagaccttttttaaaaaaagctcctatatactgaatatatttgagccctgattatgaagtgagggacaaggcttttctttttgaaataaatgatggaggacatagatatgtggtagccattcatgctacataatttagcattttattgttaatatgtttggttatgggtcttcttgtttggtatttcaacatgttctggactggatatcatactgaaaagtatttcagttctcattactgagtccctgtagtttggggaaaatgtgatcactgatcttgaaggagagaatgtttcagaag

SEQ ID NO: 108613 - DNA, 601 bp, Human
gttacactgggtgtgtcacagctgagtaactccctcctgcacttcagcttgactaagcgttgagttcacatgtatacctttgcaaagctgccattcacaacttgttttggaactttagggttatcagtataaagcctgagtaacaaaacttagtcatccaatgtccaggctggattgtatttttattttgtgatcagtaattcagcacaatgctggaacacattactcacatttgtcttatgacccttttctgtaatcaatggaatctttaattgataaagcaagtctagggggtgagacmttttttaaaaaaagctcctatatactgaatatatttgagccctgattatgaagtgagggacaaggcttttctttttgaaataaatgatggaggacatagatatgtggtagccattcatgctacataatttagcattttattgttaatatgtttggttatgggtcttcttgtttggtatttcaacatgttctggactggatatcatactgaaaagtatttcagttctcattactgagtccctgtagtttggggaaaatgtgatcactgatcttgaaggagagaatgtttcagaagcatccg

SEQ ID NO: 108614 - DNA, 601 bp, Human
gaagaggatgtttctatattaaatgtcatggcagatccagttctaggcatacctttaaaatgtatacacaggctgggcgtggtagctcactcctgtaatcccagcagtttgggaggcccaggcaggcggatcacttgaggtagggagttcgagaacagcctggccaacatggtgaaaccctgtctctactaaaaatacaaagattagctggacatgatggtgggtgcctgtagtcccagctgcttgggaggctgaggccggacaatctcctgaagctgggaggcggaggttgcagttagaygaactgacacaccactgcactccagcctgggagacagggtgaccaaaaaaaaaaaaagaaaaaagataaaaaatgtatatgcaggtgggctttctcccctcaagattctgaattccttgtaagtgtcttctagtcgctttaagctcttgtggtcgtctcttccttagtgtactctccttacatcctttggaagtttagattctagaattatttacttggaatgcagttacattccattctaaacttcctttcccttgggtttataaaaacattggtgggttgtgaattgtgaccgacatt

SEQ ID NO: 108615 - DNA, 601 bp, Human
gttgcccaggctggtctctaattcttgggctcacctagacctccgaaagtgctgggattacagatgtgagccaccgtacctggccttcactttggattttatcaggaaggaatattgtacatggtgaacattttgtagaaaaataccaaagtagatttatatttattgagtgcttactctgggtaagggactgttttaagggttttacgtgtgtgtgtgtgtgtgtatgtatatatgtatatatatacacatatatacatatatataaattttttcttttgagacagggtttcactcccayctctcacactggagtgcagtggtacaatttcggttcactgcaacctccaccctccaggctcaagcagttctcctgccttagcctccctagtagctgggactacaggcacatgccactgcacttggctaattttttgaattttttgtagagagggggtttcgccacgtttcccaggctggtgttgaactgggcatgaaccaccatgcctggctatatgtatattttatttaatatgaaagtcagtatagcaaaaatgttagtaaccctcctaaagttaaccaactcactaaatgaatgatt

SEQ ID NO: 108616 - DNA, 601 bp, Human
accgtacctggccttcactttggattttatcaggaaggaatattgtacatggtgaacattttgtagaaaaataccaaagtagatttatatttattgagtgcttactctgggtaagggactgttttaagggttttacgtgtgtgtgtgtgtgtgtatgtatatatgtatatatatacacatatatacatatatataaattttttcttttgagacagggtttcactcccatctctcacactggagtgcagtggtacaatttcggttcactgcaacctccaccctccaggctcaagcagttctyctgccttagcctccctagtagctgggactacaggcacatgccactgcacttggctaattttttgaattttttgtagagagggggtttcgccacgtttcccaggctggtgttgaactgggcatgaaccaccatgcctggctatatgtatattttatttaatatgaaagtcagtatagcaaaaatgttagtaaccctcctaaagttaaccaactcactaaatgaatgattacatagtcctcttcctttaaaggcctgtgggtgaccttaggtcctgctgatcttatttatttttttgagacg

SEQ ID NO: 108617 - DNA, 601 bp, Human
ccgttctgttccttcagttccattgtgtgcttaccaaggattagtagatacatcttgaatttgtttatgctggttgtacggtcatgtgttgcttagcaatggagatacattctgagaagtatgtcgttaggtgatcttgtagttgtatgaacatctcacacaaacctaggtatagcctactgcacacttatgctgtagcctgttgctcctaggccacaactgtatagagcatgttacagtactgaatgctgtaggtgattgtaatacaatggtaaatatttgtgtatctaaacagaaaagrtacagttaaaatacagtattacagtcttatgggatcactgttgtatatgacaccagtcattgacctaaacttccttatgtggtgcatgatacttgtaactttgcattttaattaaatagcaagtcagtaggtgaaatgattgtgagagattgtttcagtgaaaactaagttgaatgctttaggaagactaaataatagcatgtatactacctcctaagaatctagaacttgttctgattgctttgtatgtgttagtttatgtaattctcaccactcctgaggtacatatgcttatcgcta

SEQ ID NO: 108618 - DNA, 601 bp, Human
gatcttgtagttgtatgaacatctcacacaaacctaggtatagcctactgcacacttatgctgtagcctgttgctcctaggccacaactgtatagagcatgttacagtactgaatgctgtaggtgattgtaatacaatggtaaatatttgtgtatctaaacagaaaagatacagttaaaatacagtattacagtcttatgggatcactgttgtatatgacaccagtcattgacctaaacttccttatgtggtgcatgatacttgtaactttgcattttaattaaatagcaagtcagtaggygaaatgattgtgagagattgtttcagtgaaaactaagttgaatgctttaggaagactaaataatagcatgtatactacctcctaagaatctagaacttgttctgattgctttgtatgtgttagtttatgtaattctcaccactcctgaggtacatatgcttatcgctatttgctagatgagaaaattgagtcacaaggagagtagatggtagaattgggattcaaacagtggcagtttgactccagcattgattaagcatcttgtgaaaagttgctgtcaaattaatgggtaagaggaaa

SEQ ID NO: 108619 - DNA, 601 bp, Human
gctgaggctggcagatcacttgaggccaggagttcgagaccagcctggccaacatggtgaaaccctgtgtctactaaaaatacaaaaattagctggatgtggtggtgcactcctgtaataccggctattagggaggctgaggcagagacgcttgaacctgggaggcggaagttgcagtgagctcagatcgcaccactccactctagcctgggcagcagagtgagactgtgtccccccaacccctgcccaagaaaaaatcaacatcaacaaaaaaagaggaaactaatgtatatgagactgsggaaaatagtaaaaatcttgcataattctgtagtttgcttctttttaaacactttgcattttaaagaagcagactcaaaatcacagtgcactgtgggtgtgattgatgccagtcacacattctgctgttcaaaaggccatgactctacatcaaaagattctagttaaaatgttgccctgaagtgatgctcatggggatagtataagaaacaaatgtgcaaagatgggtagatgggaggtactggaggcctcggaacttcacctttgtgcagtttgtcgtccattggcacacatgaacttt

SEQ ID NO: 108620 - DNA, 601 bp, Human
tgactctacatcaaaagattctagttaaaatgttgccctgaagtgatgctcatggggatagtataagaaacaaatgtgcaaagatgggtagatgggaggtactggaggcctcggaacttcacctttgtgcagtttgtcgtccattggcacacatgaactttggatttggccacacgttttgaagatttgtgctttgcttcaagtttgtttttttttgttcgaaacttagttcccagacaggttttgcatgagaatcacttggagaattttaaaagccaagctccctgtctgattggatttrggagccatgtagtaggtttgaggaattgtccaaagctctgggtgggtctgtggcatagctaggcttgagaactgttgtgtttatctgccgtctcggggaatagttcttgagtgtgttgtgtgttgacaatcttgaggcggagtctcgctctgtcgcctgggctggagtgcagtggcgcagtctcggcttactgtaacctctgccccctgggttcaagtgattctcctgcctcagcctcccaagtagctgggattacaggtgtgcaccaccgtgcccagttaatttttgtatttttgtttt

SEQ ID NO: 108621 - DNA, 601 bp, Human
gttcaagtgattctcctgcctcagcctcccaagtagctgggattacaggtgtgcaccaccgtgcccagttaatttttgtatttttgttttgttttgttttgagacggagtctcgctttgttgcctgagctagagtgcaatggctcgatcttggctcactgcagcctccacctcctgggttcaagtgattctcctgcctcagccttctgagtagctgggaccacaggtgcccgccaccacgcctggctaattttttgtatttttagtagagacaggggtttcactatgttggccaggctggyctcaaactcctgacctcgtgatccgcccaccttgtgatccgcccgcctcggcctcccaaagtgctgggattacaggcgtgagccactgcgccaggccctgacaaactaaaatgatcagtgtgtcttccatttagatgcaggttggcattcaaatagaggcaatatatgactggtgaattgtaatttcaaaggaaagcagtaatggatcaaactcttgcactgttctctttcccttgcttaaaaaaaagtctgttccctctgaatctagctttatatagacgtttaaatccttaagtttac

SEQ ID NO: 108622 - DNA, 601 bp, Human
tttgttttgttttgagacggagtctcgctttgttgcctgagctagagtgcaatggctcgatcttggctcactgcagcctccacctcctgggttcaagtgattctcctgcctcagccttctgagtagctgggaccacaggtgcccgccaccacgcctggctaattttttgtatttttagtagagacaggggtttcactatgttggccaggctggtctcaaactcctgacctcgtgatccgcccaccttgtgatccgcccgcctcggcctcccaaagtgctgggattacaggcgtgagccacygcgccaggccctgacaaactaaaatgatcagtgtgtcttccatttagatgcaggttggcattcaaatagaggcaatatatgactggtgaattgtaatttcaaaggaaagcagtaatggatcaaactcttgcactgttctctttcccttgcttaaaaaaaagtctgttccctctgaatctagctttatatagacgtttaaatccttaagtttacttgctaaaaatcacctggggtgcttgttcaacatattcccaggcttcttgcttgaaagttaaaaaattcagcaattctagggttgtg

SEQ ID NO: 108623 - DNA, 601 bp, Human
acagctccccacaataacaaattatccagcctcaggcatctataatgccaccactaggctgggcacggcggttcacgcctgtaatcccagcactttgggaggctgaggtgggatcccttgagctaggagttcgagaccagcttgggcaatttagggagatgccatttctacaaaaaatgtaaaaattagccgggtgtggcagtatgcacctatagtcccagctatttggaaggctgaggtgggaggattgcttgagtccaagagcttgcggctgcagtgagctgtgatcacattacgtgcwctccatcctgggcaactgagcaagaccctatccaaaaaaaacaaaaaccctatgattgagaaaccgtgcttgccttggtaaatgttggttgttagtaataaagttgagtccctttgcggtttcttctctggcctgatccagggacccctcttactcccatgacgttatgggcatacgtttcacatttattattgggattggtaatcagatcttttaatctcctttgaactttgggagttgctgaaagcaccatatattttataaaagtctaaagtttataacctaaacaatagctaacta

SEQ ID NO: 108624 - DNA, 601 bp, Human
agacaagactcacagggctgaaaggaactcttggtcaaattggtccatctgtccttagggctttaatgggtgtaaatacattgcccgaggtggttaagtattcttttgttaatgaattctggggagaactccccttgtaactgcttttcacagcttggttatttacaaagacttttgattttacctgaatagaaagcttcttttgtcttttgtgtattagcacattgccagatcctgattaggtaggtatttgtgaagtgccttaactaatttgtaccttaaccaggcttcttgctagaayacatgtttctctaatgtatgcctgggtgctaatagtttggtgctatggaaactacttatatttggttattggggagcagaagtagtatgcatgatgaggctaaggtgatgcctgcctggcttcagctgtgaattttagaaatacactgattaaaggtaaatttttttttctgtccttactgctggatttcttaatctgggaggtacttgatggaatttagcctttttatcccttgaaattataagcagcattttgtgtgcactttttcttatacatgtacctttttctgctgtcaaaaga

SEQ ID NO: 108625 - DNA, 601 bp, Human
aacctgcctcccatttttttcctaaataagatagctagaaaaataaaaatgctacatacctccctaacaatttgcccacaaggaaattccttgtggacaaagaactcaaagccatcccctctgttcacctaagacaaatgcgtatctgattgcttcctctgccctgttgttttgctaagccagactgaggcataaatgactatgcctctactctcttctcacatggaacttgtgtattcagtgaaaggctaatcaagagacttaaaagaatgcaactgtttgtctattatctacctatgayctggaagccccctcccctgcttccagttgtccggcctttccaggccaaaccagtgtgcatcttacacatattgatgtctcatgtctccctaaaatgtgtgaaaaccaagctgtgccccatcaccctgggcacataccatcaggacctcctgaggatgtgtcacgggcacgtccttaaccttggcaaaataaactttctaaattgattgagctctgtttcagatacttttgggctcacagtatttacagacataattcagccctaatctagctgctgcatttagttgcatagtgtgaatat

SEQ ID NO: 108626 - DNA, 601 bp, Human
aataagatagctagaaaaataaaaatgctacatacctccctaacaatttgcccacaaggaaattccttgtggacaaagaactcaaagccatcccctctgttcacctaagacaaatgcgtatctgattgcttcctctgccctgttgttttgctaagccagactgaggcataaatgactatgcctctactctcttctcacatggaacttgtgtattcagtgaaaggctaatcaagagacttaaaagaatgcaactgtttgtctattatctacctatgacctggaagccccctcccctgcttccagttgtccggcctttccaggccaaaccagtgtgcatcttacacatattgatgtctcatgtctccctaaaatgtgtgaaaaccaagctgtgccccatcaccctgggcacataccatcaggacctcctgaggatgtgtcacgggcacgtccttaaccttggcaaaataaactttctaaattgattgagctctgtttcagatacttttgggctcacagtatttacagacataattcagccctaatctagctgctgcatttagttgcatagtgtgaatatttcacattttacttttacattttc

SEQ ID NO: 108627 - DNA, 601 bp, Human
agaattttgacatatgcctgacacaaaagtgctccgtaaatattagctattgtatcactggcaggaagttagcctggaaataagttttatggaattccagtgtagattgctttgtgattgttttgccagattttgctttcacccacaaaaacactaagctctgccaaccagttcggccattttgtaagttaggaaaataaacactaaagtgaaatggcggcttttgggcggggctcccacaggctggctccttttaagtggaatgttgctgtgctgccctcttgtggccatttgggaaacsgcgattaaaaatggaacagtaagtgttaatggcacttcgtttcaaagtccagttccaagaaggttaatcactccgtttttacctacttcagaaagtattttgaagagataccaaattctttttatccacaagcaaaaggaagtggtaaacctttttctcatcagcatttatttttgattggaatctgaattcccagttttgacttgtttttttatctgtgtgttgtattttccttttaattatttgttaagtaaaaaattataaaagttgtttgcaatttagatgttgaataattttcag

SEQ ID NO: 108628 - DNA, 601 bp, Human
tagtaagccactggtagtcagctaattttattactttgttatttaggtgaaggcttaaaggactccactcactaactcagtttgaccctttctattagtcttgtgggctttctgcctcctctactaaaccagcactaaagctacagcttagtactaatagtatttactattataattattaggtattaatggcaattctacatagtcttttaggaaatgtcgtttttttaagggaataatatgaatatatatatacgtatatatacacatgtacgctatatatacacacatatatacacayatacatatatatacatacacacatatatatacatacatatatatatatattttttgagacagagttttgctgttgatgcttgggctggagtgcagtggtgtgatctcggctcactgaaacgtccacctcctgagttcaagcgattctcctgcctcagcctccaaagtagctgggattacaggtgcatgccaccatacctggctaattgtttttttagtacaggctgggtttcaccgtgttggccaggctggtcttgaactcctgacctcaggtgttccacccgcctgggcctcccagagt

SEQ ID NO: 108629 - DNA, 601 bp, Human
cctggctaattgtttttttagtacaggctgggtttcaccgtgttggccaggctggtcttgaactcctgacctcaggtgttccacccgcctgggcctcccagagtgctgggattacaggcttgagccaccatgctcggcccataattacactttttttttttttgagacggagtctggctgtgtcatccaggctggagtgcagtggcacgatctcattttccatttccagtttatttagtgattattcctcttacgagaagtatgaaaattaagtaatgactttgttaaggcttttttttttcttctttaagcagttcccctcattagtacttgtattcagtcttacatctgattctggttccaaaaacaatttaaaaacacttttttttttttggagacggagtcttgctttgttgcccaggctggagtgcaatggcacgattgcggctcactgcaacctctgcctcctgggttcaagtgattcttctgcctcagcctcccgagtagctgggactacaggcacactaccatgcccagctaattttttgtatttgtagtagagatggggtttcaccgtgttagccaggatggtctcccatct

SEQ ID NO: 108630 - DNA, 601 bp, Human
tttttggagacggagtcttgctttgttgcccaggctggagtgcaatggcacgattgcggctcactgcaacctctgcctcctgggttcaagtgattcttctgcctcagcctcccgagtagctgggactacaggcacactaccatgcccagctaattttttgtatttgtagtagagatggggtttcaccgtgttagccaggatggtctcccatctcctgacctcatgatcttcccatctcagcctcccaaagtgttgggattacaggcgtgagccaccgcgcctggcctaaaaacactttttwaaaacactcattcaaatctttgctggttttgtgtagggtgggatgtacttgccgcccttggtttggatttggctctcatgattagacttactttagacaattaactagtttagacattaaaaatacttaaggtatataatgaagtgctgtgaattcactattaagcttcactactaagtttcagtcataaaatgtcactagtatcattccctgagagcatctgcctccctcaacccctaaaggcaaatatagttgtgaacttggtgttaatcttttcttgggtttgattttcattgttgt

SEQ ID NO: 108631 - DNA, 601 bp, Human
ttgcccaggctggagtgcaatggcacgattgcggctcactgcaacctctgcctcctgggttcaagtgattcttctgcctcagcctcccgagtagctgggactacaggcacactaccatgcccagctaattttttgtatttgtagtagagatggggtttcaccgtgttagccaggatggtctcccatctcctgacctcatgatcttcccatctcagcctcccaaagtgttgggattacaggcgtgagccaccgcgcctggcctaaaaacactttttaaaaacactcattcaaatctttgctkgttttgtgtagggtgggatgtacttgccgcccttggtttggatttggctctcatgattagacttactttagacaattaactagtttagacattaaaaatacttaaggtatataatgaagtgctgtgaattcactattaagcttcactactaagtttcagtcataaaatgtcactagtatcattccctgagagcatctgcctccctcaacccctaaaggcaaatatagttgtgaacttggtgttaatcttttcttgggtttgattttcattgttgttatttttgaaattacacaagtaatc

SEQ ID NO: 108632 - DNA, 601 bp, Human
tttggagtgagtctttctaggtcagcatgtgtgtcattgctaaaagtatagagagccagcagggcatggtaattgaagctcagacttgagatgtggctgcctgttttccatctcggtggtggtaactgctgtgacatatgtcagtattgtggaagtatctgataggtgttgagcttaggataggagaccaaaggatgttttctgggagaaggtgatacctaagcccacaaaattagagaggtatttaatttgctgtgtccgcagtgggtgcaggagctagaggggagcaatgctaggtctrgagtctggagcagtgggggtgagggaagaaatgattaagtcatgtgccttgagaaattgtcagaggccaggttttatagggcatgctgaaattggatgttatcagtgaccagaagacccggatgcctgggaggtgaacaagccttcagctgcctttgctatgggaatacagtttccaggtactgccttgcctaacatccctttcaagtagactgccctttctattaaataaatcccttccttacttacaaggaaattctggagctgtctctgtacctgtctgtccatgaacaaatagtgg

SEQ ID NO: 108633 - DNA, 601 bp, Human
tcatctttccccacttcccagtattgagaacctcccctcgacccctgctctcccattttttctcattgcttcctcatggtaactgaaaggcctccgtattgtaatgtgctgtggatcgcatggtgttatttgcagcagtcccagtttgcagtgtactgccctgtgcacctctagaagatgcagtgatggtaaatatagaacttccccttaccctttcaggttttgtgccacgtgtcttatctcctggcttctgaactcagggacttttctgttaatgttactgtaggttctgggtttttcyttgcccccctcagagcaaagatgggtagtttttaagcaagagtaaacagtccacctcttgctgtagagtccatccgtttgaggtctttttgcttcagagtatcttcccctctaccagcatgcccctcagttgctttttcaccattagaggaagatgaggatattgttttctctgtgcttgagattgatactctatcacccctcagtctctgtggtttctgttttgttcctttagatgacatctacctacttaggttgctgctccctatgggatgtttggaatgaagaagggaagggagat

SEQ ID NO: 108634 - DNA, 601 bp, Human
aaagtgctgggattacaggcatgagccaccgcgcccggcctgcttggtttggttttgttctgtgttttgtttttttcttgttgagaggggaatgatacttaacagataagacttcgtggattcatatatatctggtttcaaatcttactgtgttaactaggtgtgagagttaaatacttatgagcctcagttcagcctcatttgaatgaaggggacagtaatatccatgttcagagtttctgtcaagagcctgtccatagaaataacctgttctgtagcatcatgtaaacattcaggaaakggtagctattggggattttgagaatggtagcaataacgttatttggaatgtaaaagtataaatgtgaatttgaagattttggtcttatattactaaaattactatctgcaaatgttttaccatgagaatttttttttaagcagattcatgtgtcagttcttaaatatttttaaatctctctctctctcaaaataagtcactcagcctctgaagaagcttcgggttcagactcaggcagtcagtcggaaagtgagcagggaagtgatccaggaagtggacatggcagcgagtcgaacagca

SEQ ID NO: 108635 - DNA, 601 bp, Human
gcctgcttggtttggttttgttctgtgttttgtttttttcttgttgagaggggaatgatacttaacagataagacttcgtggattcatatatatctggtttcaaatcttactgtgttaactaggtgtgagagttaaatacttatgagcctcagttcagcctcatttgaatgaaggggacagtaatatccatgttcagagtttctgtcaagagcctgtccatagaaataacctgttctgtagcatcatgtaaacattcaggaaagggtagctattggggattttgagaatggtagcaataaygttatttggaatgtaaaagtataaatgtgaatttgaagattttggtcttatattactaaaattactatctgcaaatgttttaccatgagaatttttttttaagcagattcatgtgtcagttcttaaatatttttaaatctctctctctctcaaaataagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagag

SEQ ID NO: 108636 - DNA, 601 bp, Human; identical to SEQ ID NO: 54002

SEQ ID NO: 108637 - DNA, 601 bp, Human; identical to SEQ ID NO: 54003

SEQ ID NO: 108638 - DNA, 601 bp, Human; identical to SEQ ID NO: 54004

SEQ ID NO: 108639 - DNA, 601 bp, Human; identical to SEQ ID NO: 54005

SEQ ID NO: 108640 - DNA, 601 bp, Human; identical to SEQ ID NO: 54006

SEQ ID NO: 108641 - DNA, 601 bp, Human; identical to SEQ ID NO: 54007

SEQ ID NO: 108642 - DNA, 601 bp, Human; identical to SEQ ID NO: 54008

SEQ ID NO: 108643 - DNA, 601 bp, Human; identical to SEQ ID NO: 54009

SEQ ID NO: 108644 - DNA, 601 bp, Human; identical to SEQ ID NO: 54010

SEQ ID NO: 108645 - DNA, 601 bp, Human; identical to SEQ ID NO: 54011

SEQ ID NO: 108646 - DNA, 601 bp, Human; identical to SEQ ID NO: 54012

SEQ ID NO: 108647 - DNA, 601 bp, Human; identical to SEQ ID NO: 54013

SEQ ID NO: 108648 - DNA, 601 bp, Human; identical to SEQ ID NO: 54014

SEQ ID NO: 108649 - DNA, 601 bp, Human; identical to SEQ ID NO: 54015

SEQ ID NO: 108650 - DNA, 601 bp, Human; identical to SEQ ID NO: 54016

SEQ ID NO: 108651 - DNA, 601 bp, Human; identical to SEQ ID NO: 54017

SEQ ID NO: 108652 - DNA, 601 bp, Human; identical to SEQ ID NO: 54018

SEQ ID NO: 108653 - DNA, 601 bp, Human; identical to SEQ ID NO: 54019

SEQ ID NO: 108654 - DNA, 601 bp, Human; identical to SEQ ID NO: 54020

SEQ ID NO: 108655 - DNA, 601 bp, Human; identical to SEQ ID NO: 54021

SEQ ID NO: 108656 - DNA, 601 bp, Human; identical to SEQ ID NO: 54022

SEQ ID NO: 108657 - DNA, 601 bp, Human; identical to SEQ ID NO: 54023

SEQ ID NO: 108658 - DNA, 601 bp, Human; identical to SEQ ID NO: 54024

SEQ ID NO: 108659 - DNA, 601 bp, Human; identical to SEQ ID NO: 54025

SEQ ID NO: 108660 - DNA, 601 bp, Human; identical to SEQ ID NO: 54026

SEQ ID NO: 108661 - DNA, 601 bp, Human; identical to SEQ ID NO: 54027

SEQ ID NO: 108662 - DNA, 601 bp, Human; identical to SEQ ID NO: 54028

SEQ ID NO: 108663 - DNA, 601 bp, Human; identical to SEQ ID NO: 54029

SEQ ID NO: 108664 - DNA, 601 bp, Human; identical to SEQ ID NO: 54030

SEQ ID NO: 108665 - DNA, 601 bp, Human; identical to SEQ ID NO: 54031

SEQ ID NO: 108666 - DNA, 601 bp, Human; identical to SEQ ID NO: 54032

SEQ ID NO: 108667 - DNA, 601 bp, Human; identical to SEQ ID NO: 54033

SEQ ID NO: 108668 - DNA, 601 bp, Human; identical to SEQ ID NO: 54034

SEQ ID NO: 108669 - DNA, 601 bp, Human; identical to SEQ ID NO: 54035

SEQ ID NO: 108670 - DNA, 601 bp, Human; identical to SEQ ID NO: 54036

SEQ ID NO: 108671 - DNA, 601 bp, Human; identical to SEQ ID NO: 54037

SEQ ID NO: 108672 - DNA, 601 bp, Human; identical to SEQ ID NO: 54038

SEQ ID NO: 108673 - DNA, 601 bp, Human; identical to SEQ ID NO: 54039

SEQ ID NO: 108674 - DNA, 601 bp, Human; identical to SEQ ID NO: 54040

SEQ ID NO: 108675 - DNA, 601 bp, Human; identical to SEQ ID NO: 54041

SEQ ID NO: 108676 - DNA, 601 bp, Human; identical to SEQ ID NO: 54042

SEQ ID NO: 108677 - DNA, 601 bp, Human; identical to SEQ ID NO: 54043

SEQ ID NO: 108678 - DNA, 601 bp, Human; identical to SEQ ID NO: 54044

SEQ ID NO: 108679 - DNA, 601 bp, Human; identical to SEQ ID NO: 54045

SEQ ID NO: 108680 - DNA, 601 bp, Human; identical to SEQ ID NO: 54046

SEQ ID NO: 108681 - DNA, 601 bp, Human; identical to SEQ ID NO: 54047

SEQ ID NO: 108682 - DNA, 601 bp, Human; identical to SEQ ID NO: 54048

SEQ ID NO: 108683 - DNA, 601 bp, Human; identical to SEQ ID NO: 54049

SEQ ID NO: 108684 - DNA, 601 bp, Human; identical to SEQ ID NO: 54050

SEQ ID NO: 108685 - DNA, 601 bp, Human; identical to SEQ ID NO: 54051

SEQ ID NO: 108686 - DNA, 601 bp, Human; identical to SEQ ID NO: 54052

SEQ ID NO: 108687 - DNA, 601 bp, Human; identical to SEQ ID NO: 54053

SEQ ID NO: 108688 - DNA, 601 bp, Human; identical to SEQ ID NO: 54054

SEQ ID NO: 108689 - DNA, 601 bp, Human; identical to SEQ ID NO: 54055

SEQ ID NO: 108690 - DNA, 601 bp, Human; identical to SEQ ID NO: 54056

SEQ ID NO: 108691 - DNA, 601 bp, Human; identical to SEQ ID NO: 54057

SEQ ID NO: 108692 - DNA, 601 bp, Human; identical to SEQ ID NO: 54058

SEQ ID NO: 108693 - DNA, 601 bp, Human; identical to SEQ ID NO: 54059

SEQ ID NO: 108694 - DNA, 601 bp, Human; identical to SEQ ID NO: 54060

SEQ ID NO: 108695 - DNA, 601 bp, Human; identical to SEQ ID NO: 54061

SEQ ID NO: 108696 - DNA, 601 bp, Human; identical to SEQ ID NO: 54062

SEQ ID NO: 108697 - DNA, 601 bp, Human; identical to SEQ ID NO: 54063

SEQ ID NO: 108698 - DNA, 601 bp, Human; identical to SEQ ID NO: 54064

SEQ ID NO: 108699 - DNA, 601 bp, Human; identical to SEQ ID NO: 54065

SEQ ID NO: 108700 - DNA, 601 bp, Human; identical to SEQ ID NO: 54066

SEQ ID NO: 108701 - DNA, 601 bp, Human; identical to SEQ ID NO: 54067

SEQ ID NO: 108702 - DNA, 601 bp, Human; identical to SEQ ID NO: 54068

SEQ ID NO: 108703 - DNA, 601 bp, Human; identical to SEQ ID NO: 54069

SEQ ID NO: 108704 - DNA, 601 bp, Human; identical to SEQ ID NO: 54070

SEQ ID NO: 108705 - DNA, 601 bp, Human; identical to SEQ ID NO: 54071

SEQ ID NO: 108706 - DNA, 601 bp, Human; identical to SEQ ID NO: 54072

SEQ ID NO: 108707 - DNA, 601 bp, Human; identical to SEQ ID NO: 54073

SEQ ID NO: 108708 - DNA, 601 bp, Human; identical to SEQ ID NO: 54074

SEQ ID NO: 108709 - DNA, 601 bp, Human; identical to SEQ ID NO: 54075

SEQ ID NO: 108710 - DNA, 601 bp, Human; identical to SEQ ID NO: 54076

SEQ ID NO: 108711 - DNA, 601 bp, Human; identical to SEQ ID NO: 54077

SEQ ID NO: 108712 - DNA, 601 bp, Human; identical to SEQ ID NO: 54078

SEQ ID NO: 108713 - DNA, 601 bp, Human; identical to SEQ ID NO: 54079

SEQ ID NO: 108714 - DNA, 601 bp, Human; identical to SEQ ID NO: 54080

SEQ ID NO: 108715 - DNA, 601 bp, Human; identical to SEQ ID NO: 54081

SEQ ID NO: 108716 - DNA, 601 bp, Human; identical to SEQ ID NO: 54082

SEQ ID NO: 108717 - DNA, 601 bp, Human; identical to SEQ ID NO: 54083

SEQ ID NO: 108718 - DNA, 601 bp, Human; identical to SEQ ID NO: 54084

SEQ ID NO: 108719 - DNA, 601 bp, Human; identical to SEQ ID NO: 54085

SEQ ID NO: 108720 - DNA, 601 bp, Human; identical to SEQ ID NO: 54086

SEQ ID NO: 108721 - DNA, 601 bp, Human; identical to SEQ ID NO: 54087

SEQ ID NO: 108722 - DNA, 601 bp, Human; identical to SEQ ID NO: 54088

SEQ ID NO: 108723 - DNA, 601 bp, Human; identical to SEQ ID NO: 54089

SEQ ID NO: 108724 - DNA, 601 bp, Human; identical to SEQ ID NO: 54090

SEQ ID NO: 108725 - DNA, 601 bp, Human; identical to SEQ ID NO: 54091

SEQ ID NO: 108726 - DNA, 601 bp, Human; identical to SEQ ID NO: 54092

SEQ ID NO: 108727 - DNA, 601 bp, Human; identical to SEQ ID NO: 54093

SEQ ID NO: 108728 - DNA, 601 bp, Human; identical to SEQ ID NO: 54094

SEQ ID NO: 108729 - DNA, 601 bp, Human; identical to SEQ ID NO: 54095

SEQ ID NO: 108730 - DNA, 601 bp, Human; identical to SEQ ID NO: 54096

SEQ ID NO: 108731 - DNA, 601 bp, Human; identical to SEQ ID NO: 54097

SEQ ID NO: 108732 - DNA, 601 bp, Human; identical to SEQ ID NO: 54098

SEQ ID NO: 108733 - DNA, 601 bp, Human; identical to SEQ ID NO: 54099

SEQ ID NO: 108734 - DNA, 601 bp, Human; identical to SEQ ID NO: 54100

SEQ ID NO: 108735 - DNA, 601 bp, Human; identical to SEQ ID NO: 104006

SEQ ID NO: 108736 - DNA, 601 bp, Human; identical to SEQ ID NO: 104007

SEQ ID NO: 108737 - DNA, 601 bp, Human; identical to SEQ ID NO: 104008

SEQ ID NO: 108738 - DNA, 601 bp, Human; identical to SEQ ID NO: 104009

SEQ ID NO: 108739 - DNA, 601 bp, Human; identical to SEQ ID NO: 104010

SEQ ID NO: 108740 - DNA, 601 bp, Human; identical to SEQ ID NO: 104011

SEQ ID NO: 108741 - DNA, 601 bp, Human; identical to SEQ ID NO: 104012

SEQ ID NO: 108742 - DNA, 601 bp, Human; identical to SEQ ID NO: 104013

SEQ ID NO: 108743 - DNA, 601 bp, Human; identical to SEQ ID NO: 104014

SEQ ID NO: 108744 - DNA, 601 bp, Human; identical to SEQ ID NO: 104015

SEQ ID NO: 108745 - DNA, 601 bp, Human; identical to SEQ ID NO: 104016

SEQ ID NO: 108746 - DNA, 601 bp, Human; identical to SEQ ID NO: 104017

SEQ ID NO: 108747 - DNA, 601 bp, Human; identical to SEQ ID NO: 104018

SEQ ID NO: 108748 - DNA, 601 bp, Human; identical to SEQ ID NO: 104019

SEQ ID NO: 108749 - DNA, 601 bp, Human; identical to SEQ ID NO: 104020

SEQ ID NO: 108750 - DNA, 601 bp, Human; identical to SEQ ID NO: 104006

SEQ ID NO: 108751 - DNA, 601 bp, Human; identical to SEQ ID NO: 104007

SEQ ID NO: 108752 - DNA, 601 bp, Human; identical to SEQ ID NO: 104008

SEQ ID NO: 108753 - DNA, 601 bp, Human; identical to SEQ ID NO: 104009

SEQ ID NO: 108754 - DNA, 601 bp, Human; identical to SEQ ID NO: 104010

SEQ ID NO: 108755 - DNA, 601 bp, Human; identical to SEQ ID NO: 104011

SEQ ID NO: 108756 - DNA, 601 bp, Human; identical to SEQ ID NO: 104012

SEQ ID NO: 108757 - DNA, 601 bp, Human; identical to SEQ ID NO: 104013

SEQ ID NO: 108758 - DNA, 601 bp, Human; identical to SEQ ID NO: 104014

SEQ ID NO: 108759 - DNA, 601 bp, Human; identical to SEQ ID NO: 104015

SEQ ID NO: 108760 - DNA, 601 bp, Human; identical to SEQ ID NO: 104016

SEQ ID NO: 108761 - DNA, 601 bp, Human; identical to SEQ ID NO: 104017

SEQ ID NO: 108762 - DNA, 601 bp, Human; identical to SEQ ID NO: 104018

SEQ ID NO: 108763 - DNA, 601 bp, Human; identical to SEQ ID NO: 104019

SEQ ID NO: 108764 - DNA, 601 bp, Human; identical to SEQ ID NO: 104020

SEQ ID NO: 108765 - DNA, 601 bp, Human
acgtagaaaagcttccggccactgatgtccttcacgctcaggatctcggccagggctatgagaatagcatagacaggggccttagacaggccaggctatgagactccacccttccacgacctgaactccacccccaggccggatccctaagctccagcacttaggtctctcctaagcctccttcagtcacaagtgccacccctttccaggccccgccctgtacctctcggagcagctaagagccacgccccttcatcaaagtatctgcgcctcgcccgccccataattccagacgcccctgcccatcccgggatttcagttgactcccgcccctcgccctcaggttccttagtcccgccccccaacgtcactcacgccactcatcttcgttgtcctggttccgccgcagcacgggtaggcggcagccctcgattatctccccctggggagacagcgcgacgccagggtcggctactggggggcctcgggctctacccacctcccctggctccctccgccccgccccgggcaccggactcaccacctccgccatcttccctccctccactgccacttccggcccctctgggagacgtcactt

SEQ ID NO: 108766 - DNA, 601 bp, Human
gtagcagtggggatggctcaggacagaatgccaaagactgtcccccaaccctaccctgatgccccacctcaggcccagaactcacagtcaatgtaatggacgtagaaaagcttccggccactgatgtccttcacgctcaggatctcggccagggctatgagaatagcatagacaggggccttagacaggccaggctatgagactccacccttccacgacctgaactccacccccaggccggatccctaagctccagcacttaggtctctcctaagcctccttcagtcacaagtgccacccmtttccaggccccgccctgtacctctcggagcagctaagagccacgccccttcatcaaagtatctgcgcctcgcccgccccataattccagacgcccctccccatcccgggatttcagttgactcccgcccctcgccctcaggttccttagtcccgccccccaacgtcactcacgccactcatcttcgttgtcctggttccgccgcagcacgggtaggcggcagccctcgattatctccccctggggagacagcgcgacgccagggtcggctactggggggcctcgggctctacccacctc

SEQ ID NO: 108767 - DNA, 601 bp, Human
cgtttctgcagagagaaaccaacaaaggtgggtcagaaggtagagaaggtgggacctgagaagaaagcaaggtccctggaattgctgagggtaccgttgagcggtggttgggctgcaggcaggagctggaggagagcggctggtcaggctcgccaccgggaatggcctcccgctccttgggcaggttgaagcggagtgtgatctggaccgggattggcaaggtcttcccgctggcctgcgccgaggccggctgtagagataggtccagggtcttcctctggggcggggatggcagtgggayggggaaggggaagaggggtccctcacctcaaaattatcaaaccccaccctcgccttctgaaggacacaggactagctactggactctgggagctacatgtgcaatttggcccccatcctttgcaagatgaagtcagggtgagagggagccgcctcctgcccatccaggagcccctaatgccaacagacaagagaaataggaggcaggagagaaaaggtgaagtgggggacctactcaccacctctctctctggagagccaggacgggacccaggaagtccgttcttagtgggggtcttgg

SEQ ID NO: 108768 - DNA, 601 bp, Human
aggttgtaagagacagctcagcaggacaccacagctcacagccctttgacaggtttccttcaagcctaacagcaaccctaagggggaggtaccatgatccccaatttccagataaaaaacctgaaaccctaaaggatcgatgatgtggaaaagatcacccaatgaccccattttttagatggagtctcagtctgtcgcccaggctggagggcagtagcgcgatcttggctcactgcaatctccacctccggggttcaagcagttctcctgcctcagctttccgagctggattacaggcacycgccaccacgcctggctaatttttgtatttctagtagaaacaaggtttcaccatgttggccaggctggtctcaaactcctgacctcaggtgatccgccagccttggttggactcccaaagtgctgggattacaggtatgagccatggtgcccggccccaatgactcatttgaaccatgttctgcctgtctcctaatcccaccaacactagctctgcccaccaccccttctttatttttaaactcatcactaaataactctccaccctgcctgcatcccttccttttcacccagttccctt

SEQ ID NO: 108769 - DNA, 601 bp, Human
actgatctagtattagaaagtttgagaaaacaggttctacgaatccccataatgacacaaggaacacaggctgatggtttatctggatgagacagggtcttccttaagagctctgaagaatgtggccctgacttaattcatcaatagggccagcttgaggacaattagtatggtgtgagatctatgactgttaattctggggtggaaaaatagcaactgttttctctgtgattctcatatttcagaatgcagaaactctggcttcctggagtttctattattgattcaaaaaaaaaaaaaaccgttaaaaaaaaaagaaatttaaagtaccacaattttcactaatattatttgttgtttacactgggccaagataaataatttttaaaatcttaacctttttaacactaactcctattatttgaagtatatacctctgtgggtcaattgatccagctgcatagccaaaacaggaatgctgacagacctcctgtaaccaggctgatatgcttcagacacagcatgttgtccaatgtgtgagagtagcactgatacctcagcacttttacttgctgttttgagaccaatagaacctgatttc

SEQ ID NO: 108770 - DNA, 601 bp, Human
ctcggaagccccaaggtaaatatgaggggtcactgctttaaaagaataaaacataactgatctagtattagaaagtttgagaaaacaggttctacgaatccccataatgacacaaggaacacaggctgatggtttatctggatgagacagggtcttccttaagagctctgaagaatgtggccctgacttaattcatcaatagggccagcttgaggacaattagtatggtgtgagatctatgactgttaattctggggtggaaaaatagcaactgttttctctgtgattctcatatttcagwatgcagaaactctggcttcctggagtttctattattgattcaaaaaaaaaaaaaaccgttaaaaaaaaaagaaatttaaagtaccacaattttcactaatattatttgttgtttacactgggccaagataaataatttttaaaatcttaacctttttaacactaactcctattatttgaagtatatacctctgtgggtcaattgatccagctgcatagccaaaacaggaatgctgacagacctcctgtaaccaggctgatatgcttcagacacagcatgttgtccaatgtgtgagagtag

SEQ ID NO: 108771 - DNA, 601 bp, Human
cacaatatagagggaaaatacaaacatttaaagttcaagcctaggaataatttgttagtatttagtttagttattaagcaaacatctttgcccttgatattttaaagttagaggtttagtcctatagctagctaagggagtttgagatgtagaatattaaagctaggagctaaagataaatttttcaacgacatgcctttctgctcggaagccccaaggtaaatatgaggggtcactgctttaaaagaataaaacataactgatctagtattagaaagtttgagaaaacaggttctacgartccccataatgacacaaggaacacaggctgatggtttatctggatgagacagggtcttccttaagagctctgaagaatgtggccctgacttaattcatcaatagggccagcttgaggacaattagtatggtgtgagatctatgactgttaattctggggtggaaaaatagcaactgttttctctgtgattctcatatttcagaatgcagaaactctggcttcctggagtttctattattgattcaaaaaaaaaaaaaaccgttaaaaaaaaaagaaatttaaagtaccacaattttcact

SEQ ID NO: 108772 - DNA, 601 bp, Human
ccacgcatctgtagtcccagctacttgggaggctgaggcaggagaattgcttgaacccaggaggtggaggttgcagtgagccaagattgcaccactgcacttcagccccggtgacaatgagagactccatcttaaaaaaaaaaaaaaaaaagagggccaggactgtatttcctggaaaagatttttttttttttttttttttttgccgaacaaaacagacttaagtttgaaaagtgaaaggaggaatagatgcttgaaaatcccagcacttgtaattcaaccacagaaaaacactggatamaaaacaagactagtggcagacacccacttaatgaaacagagaaacatttttccaggccctaatgttgagcaaccaaaagttttaaaacatctcaagaggccaggagcggtggctcacacctgtaatcccggcactttgggaggcccaggcgggcggatcacgaggtcaggagactgagaccatcctggctaacacagtgaaaccccatctctactaaaaatacaaaaaaaaaattagccatgtgtggtagcaggtgcctgtagtcccagctacttgggaggctgaggcaggagaatggca

SEQ ID NO: 108773 - DNA, 601 bp, Human
tagtagagacggagttttgtcatgttggccaggctggtctcgaactcctgaccccacgtgacccgcccaccttggcttcccaaagtgctgggattataagcgtgagccacctcacctggcctacttcttgacatgacattaatgtgttctaaattaactatggattgaacatgtgtttttgaaatcagtagaatccaaacttaaccgctgtggtctgggacacacgtggtctgggaaacatgtttaaaataatgttcagtgcagtttagcaagaagtttgggaaggggaacctagtttggrtggtttagacatatgatctagtggatcaggcacagagtgattctgcatggtggtgttcctgcaaagtgcattccaaaccacaaaatgctaataaagcaaactagcccccaaatgctgaaattcaggcaaaagtaaaacctaataatagaattataagcttaaattataaaacagagaagggtgtttggaaaagagcctattgcatttggggaaattaagacaaactgaagtggcaattctgacaagaggaaggagttaaatgggaatgtttattttgaatataaacaagaaacagtgctt

SEQ ID NO: 108774 - DNA, 601 bp, Human
tagggctgtctggacaagtttcttcaatttcaacttaaggtcactccagtcctaaatttttcccatgtcagttatacaaagcttttcatacaccaaattttaagacccctttgttgaagctaacgtagtattagataccttttctccaagccgaatactgccacatttcagaatgttgatgtcatttttgcagtcatccatgaagccacagattaaacggtaatcactaaaaatgatggccgtcatcttggtaatgtactggtgacactgatactcagtgatgttgcctcggtgatccacyaagcaggaaaccatgtaaccttttccaaccggttcatcagcacattctttaatctgctcaaaataaagtagctgttttacaaaagtgttccatgctcgtatcaaacaatatttatcaaagagaaaaatgtctgaaattttcctgttgatttcctaattctttacttggaagaaaaaaagaaaaatgcttagaaatatatccaaggaaaacatttaggaatacattcattttaaagaaaaatagtgtcatccctactcagactgttgtgccttctagaaaaacctgattaatgtgttttgc

SEQ ID NO: 108775 - DNA, 601 bp, Human
ccctgtggagactttaaaaggagccaggtttggaattggatataattttcaacatcctaaataaagtcagaagagcttcctgaatcatcagtgacttaagtgcttttgtgccattttgagagtctgctgggaaggaaaacactgcgttctttattaaagctgtcctttctttatttgcctgaaagatttatgccaagccacagagtttttcaagaccaactcagtggtacactcggataagggatcaggccctgtgctcatattaaggaaagggcatcagggctttggtgacagccagacmatacacagcaagaaacccttcatttgaactgtgtgctcagttccaggatcctaacaccatgtcccctttgtcagtgatagacgcctgccaaccatgaacaaatagagggcaaagggacaaatgggttttattttccatcatatttcctgaacagtagattaatgagcagcagcaactaataggtgatgccacaggtctcagggtccctctcccactggcatccattacttttcaggagtttttttcatttttgctgagcaaacaaattcagaataaacctggccagatctctattgtgac

SEQ ID NO: 108776 - DNA, 601 bp, Human
gaaaagcataaaagtactaatactgtggcacatgtccgcaattaagttcctttgttggcagccacagtctttttcttcagatgatgtaaatcatttatatctttacttttggaaatctgccctttcattttgacaacatttattattatataaaattctaaagcctttattaatgtatcttctttgttctaaaatttatatgaacatttgaaaaaatcatagttttgaaatcatgacatttatgtgttcatacaaaggcaaggtacaaacagattaaccatgaatcctctcctcggtcctytggaggaggccaagtcaaagccagtcatagaagagtttcaagcttcagtggcagcaaatttgaaactgacaagcctgttgttttctgtgttcagaagctgctttgttaattttcagtataagttttctatctgaataactggcttcagaaaagcaaactacgggttttagaaaaaggcagagaagagctgagaacatgcctccctcttttttaaatttggctgtagtacagagtgaatgatataggaaggaaggtgttttttcagaagttcatgtgtgagtctatctcaccgtccccaaa

SEQ ID NO: 108777 - DNA, 601 bp, Human
aactacacacctgcacattatgagaaaataagctcatttaggtttaaaaagttattaatacacaggcttggcatatgagtaataaattatcctataaatgaacttacaataattttttgttaactttattatggtagaaaaacatctgcttaaaatctactgccattgccttgatccgtttttagaagtttgataggcagtatttttcttccccatattccgtgtcctttaacaacaacggcccccacaaaaaaaaacaaaaaaaaaaaccaacaacagatgctaacactaatctctaaayagtaggcaagaactcagtttttatctctgctataaaccattctctatttcaatccttctgctgtcttctgtaatctacctcactagataaaggaaaaaggaatattagaattactcaaattaactggttaaaagcaggaaataataaatgaaataataaataataaatgatacagctaccgagagaaaagcataaaagtactaatactgtggcacatgtccgcaattaagttcctttgttggcagccacagtctttttcttcagatgatgtaaatcatttatatctttacttttggaaat

SEQ ID NO: 108778 - DNA, 601 bp, Human
tcatgtctgtaatttcagcactttggaaggccgaggcaggtggatcacctgaggtcaggagttcgagaccagcctggccaacatggtgaaggcccatctgtactaaaaatactaaaaatacaaaaaattagccaggcatggtggtgtgcgcctgtaatcccagctactcaggaggctgaggcaggagaatcacttgaacccagtaggcggaggttgcagtgagccgagatcgtgccactgcactccagcctgggcgacaagacagaaactccgtaaaaaaaacacacacacacacacacacaaaaaaaaccacatcggctcaaagttctggtcatagttcatgtcaagactgaaattacactgctgaaatctctgttcatttgtctctaaaaaccaggcatttcccaaataacagtgcttgctttttttttttttttttttttgagacggagtctcgctctttcgcccaggctggactgcagtggcgctatctcggctcactgcacgctcccactcccgggttcactctattctcctgcctcagtctcctgagtagctgggaccacaggcgcccgccaccacgcccggctaattttttgtg

SEQ ID NO: 108779 - DNA, 601 bp, Human
gctcatgtctgtaatttcagcactttggaaggccgaggcaggtggatcacctgaggtcaggagttcgagaccagcctggccaacatggtgaaggcccatctgtactaaaaatactaaaaatacaaaaaattagccaggcatggtggtgtgcgcctgtaatcccagctactcaggaggctgaggcaggagaatcacttgaacccagtaggcggaggttgcagtgagccgagatcgtgccactgcactccagcctgggcgacaagacagaaactccgtaaaaaaaacacacacacacacacacacaaaaaaaaccacatcggctcaaagttctggtcatagttcatgtcaagactgaaattacactgctgaaatctctgttcatttgtctctaaaaaccaggcatttcccaaataacagtgcttgctttttttttttttttttttttgagacggagtctcgctctttcgcccaggctggactgcagtggcgctatctcggctcactgcacgctcccactcccgggttcactctattctcctgcctcagtctcctgagtagctgggaccacaggcgcccgccaccacgcccggctaattttttg

SEQ ID NO: 108780 - DNA, 601 bp, Human
aaaagaacagtttctgagctgactcacattttcacaaaaacgctcccgatcatctcggcaagcaaaatataaatgccggtctaagtgaaagtcatccgatgacagctcagccacccggagaatggctttcttgcagagttcagaaacttgaatcttgggttctctttcttctgcttctttcaccaggcctttctccaagcatgataccacctcaccttgtgaatgtgcatcctaaaatagcgaggatattaatattttaaaacttttatcacatgggtttcaaataaacaacatttggctccacacacacacacacacacacacacacacacacaaagtaataaaaccccatcatagagttgacttattaacgttctaccaagaaatcaagtaagaaccaaccacattgtggaagttaaagaaaatgctctcaataatcttcagttagaatataatacttgcatgctacaaatggaaacagagatcctggaaagtttaagtattatagtttagttagcactagaaataagaacctgaatttttaaaaatttaaaatgtcaaaaattcataagaaacacaacagggccaggcatggtggctc

SEQ ID NO: 108781 - DNA, 601 bp, Human
agaaaaaatactaagtggagatcattagaagccagctgttaaccaaatgttcagtcatcaaggttgagcatccagttaccactttctgctatactgggaccaatttcttcttccatttctgtggcttttctacatgtgaggtttcttgatggcttattttacgttagaatagagtattaaaaaatatttaagtcacagtggctcgtgcctataatcctagtactttcagagacagagggaggagatcacctcaggccaggggttcaagaccagtccgggcaatacagcaatgccccatctytacaaaaaatttttaaaaaaattggccaggcaagatggtgcttgcctatggttttagctacttgggaggctgaggcagaagaatcgcttgaacccagaagttggaggctgcagtgagccatgatcacaccactgcactccagcctgggcaccacagcaagatcctgtctcaaaaattggggaggctgagctggagcactgcttcaggtcagaagttcgtgaccagcctgggcaacatagcaagactcaatctctcaaaaaacaacacaattaaattaattaaaacaaaattatatatgtg

SEQ ID NO: 108782 - DNA, 601 bp, Human
agggtttcattttcttggtttcagccaaatatgcttaaaacccaagtacctcacctctgaaagcggtgagctttatcagtcatttacgtttcggtataagattataagaaatattgtttcagagaaattgagaaagcttttttttttttttttttttgagacagagtctcactctgtcacccaggctggagtgcagtggtgcgatctcagctcactgcaacctccacctcctgggttcaagtgattttcctgcttcagcctcccgagtagctgggattacaggcgcccaccaccacgtccractaatttttgtatttttagtagagacggcgtttcaccatcttggccaggctggtcttgaactcctgacctcgtgatccacctgcctcagcctcccaaagtgctgggattacaggcgtgagccaccgtgtctggctgagaaagcttttaaaaaacaaataaaacattcattagtttcaaaataatacttaccttttcactcatggattcttcaaatttatggttaaagaggcacttatacactctgccctcaccagcttgtgtctataagatggaacatacacattattattactttagc

SEQ ID NO: 108783 - DNA, 601 bp, Human
atcagggtttcattttcttggtttcagccaaatatgcttaaaacccaagtacctcacctctgaaagcggtgagctttatcagtcatttacgtttcggtataagattataagaaatattgtttcagagaaattgagaaagcttttttttttttttttttttgagacagagtctcactctgtcacccaggctggagtgcagtggtgcgatctcagctcactgcaacctccacctcctgggttcaagtgattttcctgcttcagcctcccgagtagctgggattacaggcgcccaccaccacgkccaactaatttttgtatttttagtagagacggcgtttcaccatcttggccaggctggtcttgaactcctgacctcgtgatccacctgcctcagcctcccaaagtgctgggattacaggcgtgagccaccgtgtctggctgagaaagcttttaaaaaacaaataaaacattcattagtttcaaaataatacttaccttttcactcatggattcttcaaatttatggttaaagaggcacttatacactctgccctcaccagcttgtgtctataagatggaacatacacattattattacttt

SEQ ID NO: 108784 - DNA, 601 bp, Human
ctcaaaaaaaaaacaaaaacaaaacaaaacaaaaacacctaaaaaaaccaccacagtgagaaccctacttggcttctcactatctagatatcacaatcagggtttcattttcttggtttcagccaaatatgcttaaaacccaagtacctcacctctgaaagcggtgagctttatcagtcatttacgtttcggtataagattataagaaatattgtttcagagaaattgagaaagcttttttttttttttttttttgagacagagtctcactctgtcacccaggctggagtgcagtggtgcratctcagctcactgcaacctccacctcctgggttcaagtgattttcctgcttcagcctcccgagtagctgggattacaggcgcccaccaccacgtccaactaatttttgtatttttagtagagacggcgtttcaccatcttggccaggctggtcttgaactcctgacctcgtgatccacctgcctcagcctcccaaagtgctgggattacaggcgtgagccaccgtgtctggctgagaaagcttttaaaaaacaaataaaacattcattagtttcaaaataatacttaccttttcactca

SEQ ID NO: 108785 - DNA, 601 bp, Human
cccaatatgttaacttgacacacagcattcttttccactttaacaataccccgaacataaatttcactagcatcaaactggcaactaacataacatttgggatattctgttcaatgctttaaaatacaattattcaattattctatatcatctgaataataagatttgaataagattgttcaaatgatacaagaaaaaggaaatgagaaacatttcttcagctacacaggaaagtaaatgacaagatagcaaaattaattatttcaaaagccatcaactgttcttgcattcattcagggamaaagaactaaaagaggatgcttaatgatatagctgctgaaaaattaaatagctaattgcctagaaagcacattgatttggttaacctaaacttcttgaggaggcagggctggccttagtgtggttttatataaaattctctgattttactccccaaacaaagtaatatctgagaattttatataaaatcacactgaggattttatataaaaccacagtgagaggcgggtggatcacctgaggtcaggagtttgagagcagcttggccaacatggtgaaaccccgtctctactaaaaatac

SEQ ID NO: 108786 - DNA, 601 bp, Human
acatgtaaatatctcacagatcccaatatgttaacttgacacacagcattcttttccactttaacaataccccgaacataaatttcactagcatcaaactggcaactaacataacatttgggatattctgttcaatgctttaaaatacaattattcaattattctatatcatctgaataataagatttgaataagattgttcaaatgatacaagaaaaaggaaatgagaaacatttcttcagctacacaggaaagtaaatgacaagatagcaaaattaattatttcaaaagccatcaactrttcttgcattcattcagggaaaaagaactaaaagaggatgcttaatgatatagctgctgaaaaattaaatagctaattgcctagaaagcacattgatttggttaacctaaacttcttgaggaggcagggctggccttagtgtggttttatataaaattctctgattttactccccaaacaaagtaatatctgagaattttatataaaatcacactgaggattttatataaaaccacagtgagaggcgggtggatcacctgaggtcaggagtttgagagcagcttggccaacatggtgaaa

SEQ ID NO: 108787 - DNA, 601 bp, Human
agatattcaggcttctcctgtcactgttctgcatgaaacaggttttatactactgcactaataatgcaaatgctttgcccatggaaatcctatcaataagataactattagggtaaaaatgaaagccaaagaacaatctccattggcctacacaattaaagcttttagaaaagactacatttaagatattcactataagctcccccaacttctttgagctgtaaatgccaatggggaaaacttttttttttttttttttttgagacggagtctcactgtgtcacccaggctggagtgcagygcgcgatctcggctcactgcaagctccgtctcttgggttcacgccattctcctgcctcagcctctccaagtagctgggactacaggcgcctgccaccacgcccggctaatttttttgtattttcagtagagacggggtttcaccgtggtctcgatctcctgacctcgtgatctgcctacctcggcctcccaaagtgctgggattacaagcgtgagccaccgcgcctggccaggaaaacttaaaacaaaaagattaaaacaaaacaaaacaaaacaaaaacaggtcacccagacggtttgt

SEQ ID NO: 108788 - DNA, 601 bp, Human
gactgtaaaaatctgattttacacgattatcaggaaaataaaattcgagttgatatccagtttttaataaaaatgctaactataaaataatagactgattgtggctttctaaagttacactgagggaggagagcctcaagtttctactattctaggatataaagcgaaactatctcttgtgctccccaaaggaaagttcactgcacagggcacactggtgcacatggtacgttaagttgctctaagactcctatccagtaaaaagtaatcaacatggacaacaggaatgaaagggatgtaytaaatctctaatacattaacttgtgttttgtacctgacctacagttattcaactgtttataaacgctagatcaagaagaactttatctccccaagcaaagtatgctaactgtgaggtttagtgatagaaaaaggactcccaccatggcacacgtttacccatgtaacaaacctgcacatgtatcctggaacttaacattaaattaaattaaaaagaaaatggctcttccatgcatagttgccctagtatatgaagaaaagatagtgtgatttcaaaaatgacatgctctcttgatccttc

SEQ ID NO: 108789 - DNA, 601 bp, Human
taactaaagctaagacataattttactccacatccaaattctgtaaaactgttgtgtttcagaccgcaaagttttgtttcagactgtaaaaatctgattttacacgattatcaggaaaataaaattcgagttgatatccagtttttaataaaaatgctaactataaaataatagactgattgtggctttctaaagttacactgagggaggagagcctcaagtttctactattctaggatataaagcgaaactatctcttgtgctccccaaaggaaagttcactgcacagggcacactggtrcacatggtacgttaagttgctctaagactcctatccagtaaaaagtaatcaacatggacaacaggaatgaaagggatgtactaaatctctaatacattaacttgtgttttgtacctgacctacagttattcaactgtttataaacgctagatcaagaagaactttatctccccaagcaaagtatgctaactgtgaggtttagtgatagaaaaaggactcccaccatggcacacgtttacccatgtaacaaacctgcacatgtatcctggaacttaacattaaattaaattaaaaagaaaa

SEQ ID NO: 108790 - DNA, 601 bp, Human
agtgcaaatataggctgtctcctgattcatttttggtctgggtcccaggacccacactggcacagaggtttcccaaggaagtcaccagtaacaactgcaccctagaaacaacactgtggcaaaatcaaacggcagattccagaagccttccctcctgcccaggttggtattttaaagaagttacatttgtctgttttcccaccatgggatgcatagacacgcatgcgtgcgcacacacacacacagacacacgtgcacacatgcactggtgtctactctgggtcaaggtgagtaactaaasctaagacataattttactccacatccaaattctgtaaaactgttgtgtttcagaccgcaaagttttgtttcagactgtaaaaatctgattttacacgattatcaggaaaataaaattcgagttgatatccagtttttaataaaaatgctaactataaaataatagactgattgtggctttctaaagttacactgagggaggagagcctcaagtttctactattctaggatataaagcgaaactatctcttgtgctccccaaaggaaagttcactgcacagggcacactggtgcacatggt

SEQ ID NO: 108791 - DNA, 601 bp, Human
ctaccttgactgcaggtttttctgtttgagtcattgatggggactgcttatctttgttctcagtaatccctggaggtctttacaacatgaatatgaaggctgcctctttgctttcatctgcctacttgttaatcagattactaaacctggtgctcccggcaaagccagatttaagtggaaaagagtaaataaagaacattttcacttagagacctaattgggtcataagaatctagaatttgaattttgctgcaaagacactggtattaagtcaagtgtgctgtgctttattaaaagcagmtgtgcaatttcatttaacttgcagaaatatcaattacaaaaaacaggattatggtatttataatttcccattttcctcaactatttttctataaccaagaggtaaaccagagcttgctcattctaagtacatagaaaaatacttgtcattatgcagctggaaatgagactatattctttatcatttacttttccatcttgtcatggaacaaaggaaagacaggagaataggtacttcacattttttttcctgcctttaaggcacttggggcatagatgaaaaagctctaaattaaaatca

SEQ ID NO: 108792 - DNA, 601 bp, Human
ggctcacacctgtaatcccaacactttgggaggccgaggcgggtgggtcatgaggtcaggagttcaagaccagcctaaccaacatggtaaaaccctgtctctactaaaaacacaaaaattagctgggcatggtgtcatgtgcctgcaatcccagctactcgggaggctgagccaggagaactgcttgaactgggatccgggaggcagaggcagcactaagcgagattgcgccactgtactccagcctgggctacagagcaagattctgtctaaaaataaaaataaaaataaattgtatttktagtagagacggggtttctccatgttggttagaggctcatctcgaactctggacctcacgtgatccgccagcctcagcctcccaaggtgctgggattacaggtgtgagccaccacgcctggcttggtttggttttttgagacagggttttgctctgtcatctgggctggagtgcagtggtatgatcataactcactgtaaccttgaactcctgggctcaagcaatcttcccacatcaacctcccaaggggatgggactacaggcatgcaccaccacgccagctgattttaaaaactttta

SEQ ID NO: 108793 - DNA, 601 bp, Human
ctgataagtatcttaaatgtattttcatctgtagcagttcttccttcttccctctcccctgccccctctttgcttgatgtggttatttttacactgtaaatattcctaattagtttaaccacacagaaagctttgaggaagaatatgattttctaattctctagcacagcatgaacagcaggagttcttgcatagcagcatgagataaacatggactatactcactttgttgttgggtatggccaaatgcaggctataaagatttttgcagaatgggaaagctgctcttacttgcaactgwttttttttgtttttgtttttgttttttttgagatcgagttttcctcgttgcccaggctggaatgcaatggcacgatcttggcttcacctgcctcagactcccgagtaactgggattacaggtatgcgccaccaacaccccactaattttgtatttttggccgggcgtggtggctcacacctgtaatcccaacactttgggaggccgaggcgggtgggtcatgaggtcaggagttcaagaccagcctaaccaacatggtaaaaccctgtctctactaaaaacacaaaaattagctgggcat

SEQ ID NO: 108794 - DNA, 601 bp, Human
ttggctcacgcaagctccgcctcccaggttcacaccattctcctgcctcagcctcccgagtagctgggactacaggcacccaccaccacgcccggctaattttttttgtatttttagtagagatggggtttcactgtgttagccaggatggtctcgatctcctgacctcgtgatctgcccgcctcggcctcccaaagtgctgggattacaggcgtgagccaccgtgcccggcccagatattttcaattatctttttttttcacaagtttgttcaaatcaggatccagaaaaggttaactgataagtatcttaaatgtattttcatctgtagcagttcttccttcttccctctcccctgccccctctttgcttgatgtggttatttttacactgtaaatattcctaattagtttaaccacacagaaagctttgaggaagaatatgattttctaattctctagcacagcatgaacagcaggagttcttgcatagcagcatgagataaacatggactatactcactttgttgttgggtatggccaaatgcaggctataaagatttttgcagaatgggaaagctgctcttacttgcaactgattt

SEQ ID NO: 108795 - DNA, 601 bp, Human
aaggacttaataccattatcacaccactaagcaattattttaaaagctttactatcatgtaataccctgttagttttcaaatattttcctttcttttcttttctttttttttttttgagatggagtctcgctctgtcgcccaggctggagtgcagtggcgcaaccttggctcacgcaagctccgcctcccaggttcacaccattctcctgcctcagcctcccgagtagctgggactacaggcacccaccaccacgcccggctaattttttttgtatttttagtagagatggggtttcactktgttagccaggatggtctcgatctcctgacctcgtgatctgcccgcctcggcctcccaaagtgctgggattacaggcgtgagccaccgtgcccggcccagatattttcaattatctttttttttcacaagtttgttcaaatcaggatccagaaaaggttaactgataagtatcttaaatgtattttcatctgtagcagttcttccttcttccctctcccctgccccctctttgcttgatgtggttatttttacactgtaaatattcctaattagtttaaccacacagaaagctttgagga

SEQ ID NO: 108796 - DNA, 601 bp, Human
ggtaattatgactacacaggagaagaggctgaggcaatacatttactttggcttcaaaatactcacttccaatcccgggagatgaaatactgcagctctaagagacggtgttcacagtcttctaccatcttctctgtgtataaatgttccatcaggcacgacaagatcctagccattaaatgtgtaaaattgtaacaagagagaagtgttcagaactctatgtcaatatagtatttccctggtctgtagaaggcggcttttagttattttcttagggcaatcagatttatttttctaagartcactcaaattaactgaacctgacagtggttataccttcgatcaacttcagagccactcagcactgaagactatgcatgcacaagggcagtgtgcagctgctgtatttttaactggttatgaaaactttccaacacacaaagaagtagagaataatgtaacagccaccttccctccccataactttatcaatctgttgccaagtctgttttaactctaggcctctttgctgatattttaaagcaaaatcccagatactccatcatttcatttgtaaatatttcagcatgtttctttaaaa

SEQ ID NO: 108797 - DNA, 601 bp, Human
gggcagacaaataccaagagactgaggtatggaggtttctgctccaaccagtccatgggcagacaatgcaaatgtgttcagctgccaagaggagaagcctaaaatccatttgtagcctggctaaaagcttctaatggatccttaaacctaaataaagttaggacagcagaatttaactgtccatttgtgattcagattttgggaattaaaaaaaaaaatctggaaatcttcccccacccactttgttaaaaacataaaatcagatgatagaagctggtagggcaactctaagtgcactcayggaaggaagaagtttctagaagtgcagcaatcttctccccacaaaatagtctaaaaagttttcctaatatgactgaaatcagaagaatatacagcaaacaatttaaaaaacaaatgacaagaagaagaaatgaagtcgatattcactgcataccctccttccctgttcctcagtgcggtaggcgtgtctgtataaacaagagaacacagctccctgaggcataaattcactggtctcattccaaccgtgggtgtggcaaagacgagaagcgtctccctggcacttgcggtacaggacagg

SEQ ID NO: 108798 - DNA, 601 bp, Human
caggaggaagaggttgcagtgagccaagatcacaccactgcactccagcctggggtgcagtgagacacattcaagagtgaggctttgtctcaaaaaaaaaaaaaaaaaaggttaattttatgttatgtgaatttcacctcaatttaaaaaaaaaaagaaaagaaaaccagcaccacagactccaactctttcttatttaaaagagaataaacctcctaccccctagtcactatagtgaccagaaagatgccgggatgtgggagcccccatggttaatgagaggctcattatatggagagaraaaaaaaaaaaaaacaaattcccacgttttctcacacagcagtataaacactgggttagggagcagcaactgatgtatgccatttccttctgagtcccctcattctggatttgagatagccaggcttttgcattaagctcagaaggggtatttctaaggatggatgagaagtgataccatctcaactctccggaacaaaggcaggactgataatggagcatctcagaaggtagagaaagccatcgtggagaacaagtgcatgtcagtgcgcaccgggaagcagccgatgctgccgagacc

SEQ ID NO: 108799 - DNA, 601 bp, Human
ccaggagcggtggctcacacctgtaatcccagctctttgggaggctgaggcgggcagatcacctgaggtctggagttcgagaccagcctgaccaatatggagaaaccccatctctactaaaaatacaaaaattagctgggcgtagtggcgcatgcctgtaatcccagctaatctggagggtgaggcaggaggcggagattgtggtgagccgagatcacaccactgcactccagcctgggccaacaagagtgaaactccgtctcaaaaaaaaaaaaaaggggggggttattttggccaggcrcagtggctcacacctctaatcccagcactttgggaggcccaggtgagtggatcacctgaggtcaggagttcaagaccaacctggccaacatggagaaaccccgtctctattaaaaatccaaaaaaaaaaaaaaaaaaaaaaaaaaagccaggcatgacggcaggcacccgtaatcccagctactcgggaggctgaggcaggagaatcacttgagccaggaggaagaggttgcagtgagccaagatcacaccactgcactccagcctggggtgcagtgagacacattcaagagtgaggctt

SEQ ID NO: 108800 - DNA, 601 bp, Human
actgtttaatgaacacagggtttccttttggagtcatggagtgttttgaaactagacagacatgatgaccacacaacactgtaaatgtactaaatgtcactgaatttttctctttaaaatggttaagaccaggagcggtggctcacacctgtaatcccagctctttgggaggctgaggcgggcagatcacctgaggtctggagttcgagaccagcctgaccaatatggagaaaccccatctctactaaaaatacaaaaattagctgggcgtagtggcgcatgcctgtaatcccagctaatytggagggtgaggcaggaggcggagattgtggtgagccgagatcacaccactgcactccagcctgggccaacaagagtgaaactccgtctcaaaaaaaaaaaaaaggggggggttattttggccaggcgcagtggctcacacctctaatcccagcactttgggaggcccaggtgagtggatcacctgaggtcaggagttcaagaccaacctggccaacatggagaaaccccgtctctattaaaaatccaaaaaaaaaaaaaaaaaaaaaaaaaaagccaggcatgacggcaggcacccgta

SEQ ID NO: 108801 - DNA, 601 bp, Human
tagccaggcatggtggcacatgcctgtaatcctagctactcgggaggctgaggcagaagaatcgcttgaacccgggaggcggacattgtggtgagctgagattgcactactgcactccagcctgggcaacaagagcgaaactccgtctcaaaaaaataaataaataaataaataaataaataaataaataaataaataaataaaatgtgcaagaggcttcgaaaagcccatatctttagcaatgcgattatacatattcagcagtttctaatatactatataaacaacattcttttatgasagtatcctgataaaagtgaactggcttcattcagactaggttagttggaaagttttgtgtttgttgttttgcttagcaaaactaatgtgtcagtctatgaacaccaggtagaaggtcagatccaattcaagagagcatatacacttgactcaggagaaatgagttcaaattgacctaaatcagaaaaagcaggaaaatgtagatataacattatgagataggactggactcttctagatgagctatgaagaattagcagagggtaaagcaggtgaaaactagtatttttccaagggccat

SEQ ID NO: 108802 - DNA, 601 bp, Human
gcactttgggaggtcgaggcgggcggatcacctgaggtcgggagtttgagaccagcctgacctacatggagaaaccctgtctctactaaacacacaaaattagccaggcatggtggcacatgcctgtaatcctagctactcgggaggctgaggcagaagaatcgcttgaacccgggaggcggacattgtggtgagctgagattgcactactgcactccagcctgggcaacaagagcgaaactccgtctcaaaaaaataaataaataaataaataaataaataaataaataaataaataaawaaaatgtgcaagaggcttcgaaaagcccatatctttagcaatgcgattatacatattcagcagtttctaatatactatataaacaacattcttttatgagagtatcctgataaaagtgaactggcttcattcagactaggttagttggaaagttttgtgtttgttgttttgcttagcaaaactaatgtgtcagtctatgaacaccaggtagaaggtcagatccaattcaagagagcatatacacttgactcaggagaaatgagttcaaattgacctaaatcagaaaaagcaggaaaatgt

SEQ ID NO: 108803 - DNA, 601 bp, Human
ttaaatgttgcggccaggtgcggtggctcacgcatgtaatcccagcactttgggaggtcgaggcgggcggatcacctgaggtcgggagtttgagaccagcctgacctacatggagaaaccctgtctctactaaacacacaaaattagccaggcatggtggcacatgcctgtaatcctagctactcgggaggctgaggcagaagaatcgcttgaacccgggaggcggacattgtggtgagctgagattgcactactgcactccagcctgggcaacaagagcgaaactccgtctcaaaaaaayaaataaataaataaataaataaataaataaataaataaataaataaaatgtgcaagaggcttcgaaaagcccatatctttagcaatgcgattatacatattcagcagtttctaatatactatataaacaacattcttttatgagagtatcctgataaaagtgaactggcttcattcagactaggttagttggaaagttttgtgtttgttgttttgcttagcaaaactaatgtgtcagtctatgaacaccaggtagaaggtcagatccaattcaagagagcatatacacttgactcaggag

SEQ ID NO: 108804 - DNA, 601 bp, Human
ggtaacaaaacaaaaacacaaagatatgagataaacctgctatgaggaaactaacaaataaccctgtattttatctcccaaattttatacctcaaatatcttccagaataaaaattaaatgttgcggccaggtgcggtggctcacgcatgtaatcccagcactttgggaggtcgaggcgggcggatcacctgaggtcgggagtttgagaccagcctgacctacatggagaaaccctgtctctactaaacacacaaaattagccaggcatggtggcacatgcctgtaatcctagctactcgrgaggctgaggcagaagaatcgcttgaacccgggaggcggacattgtggtgagctgagattgcactactgcactccagcctgggcaacaagagcgaaactccgtctcaaaaaaataaataaataaataaataaataaataaataaataaataaataaataaaatgtgcaagaggcttcgaaaagcccatatctttagcaatgcgattatacatattcagcagtttctaatatactatataaacaacattcttttatgagagtatcctgataaaagtgaactggcttcattcagactaggtt

SEQ ID NO: 108805 - DNA, 601 bp, Human
aaccttatcaggccttgattctattttcaatctgtgctttgataatttctcatctctcattttaaatatgcactttaataatgatcatcagacaaattcacagtgaagagcacagattattttaagactctttattggcaaagtaattgggaaccaggggtctggaacacaggatacaactgatagctcctgcaagtcagatctgggattctaactccagtacacatcaaaagggtcctctgaagaaaaacaagtgaacacactagggtttgggtacttaaaagctatcttgtgtgggctktggaaaccgagctggagctatctgtagcattagtctattactattccttctagaggtttacaggtttagaggtttcaagtataatatcagctcactttcacaaagcatatcaacagctatttcttagcaaagtgctctgttaaaggatcaagtttaacttactattctgcaagaatctctctgtttcagaattagaatgtgaggggaagagaggagttgtaggaattatacaacagccagaatggaagaagaagaagaaataaaaaagctaaaggaaaataccccaaacttttgggagta

SEQ ID NO: 108806 - DNA, 601 bp, Human
tttaccacacccagctaatttttgtatttttagtagaaacggggtttcaccatgttggccaggatggtcttgaccttttttttttttttttttttgagacatagagtctcgctctgttgctcgggctggagtgcagtggcgtgatctcggctcactggaagctccgcctcccgggttcacgccactctcctgcctcagcctcccgagtagctgggactacaggcacccgccaccacacctgactaatttttttgtatttttagtacagacggggtttcaccatgttagccaggatggtctygatctcctgaccttgtgatccgcccgcctcgcctcccaaagtgctgggattacaggtgtgagccactgcacctggcctctaatcccatttttaaaatattttagtgggtttcaggatggaacagggataaacatacgtattcaatcttccatgcttagctggaagtcctcagcttttatgttctgaaacacacaaacattaccaaatgacctaactaaaagagcgagggatgagagaacgggaatgtgtagattgctcttgaatgtgactgtgatgtgaagtactgctgctatttttttt

SEQ ID NO: 108807 - DNA, 601 bp, Human
tgcaacctccgcctcccgggttcaagtgatcctcctgcctcagcctcccaagtacctggcactacaggcatgttttaccacacccagctaatttttgtatttttagtagaaacggggtttcaccatgttggccaggatggtcttgaccttttttttttttttttttttgagacatagagtctcgctctgttgctcgggctggagtgcagtggcgtgatctcggctcactggaagctccgcctcccgggttcacgccactctcctgcctcagcctcccgagtagctgggactacaggcaccygccaccacacctgactaatttttttgtatttttagtacagacggggtttcaccatgttagccaggatggtctcgatctcctgaccttgtgatccgcccgcctcgcctcccaaagtgctgggattacaggtgtgagccactgcacctggcctctaatcccatttttaaaatattttagtgggtttcaggatggaacagggataaacatacgtattcaatcttccatgcttagctggaagtcctcagcttttatgttctgaaacacacaaacattaccaaatgacctaactaaaagagcgag

SEQ ID NO: 108808 - DNA, 601 bp, Human
agtactaaaaggtttaagacaaaatggtagttccccacttctctgatttctggccccacaaaataactttaacatgtttagctgccctcctctgtatttctaaataacatcccagtgctttatgagggtttctaatccccctttttttttttctttttattgagacggagtctggctctgtggcccaggcgggagtgcaatggtgcaatctcggctcactgcaacctccgcctcccgggttcaagtgatcctcctgcctcagcctcccaagtacctggcactacaggcatgttttaccacrcccagctaatttttgtatttttagtagaaacggggtttcaccatgttggccaggatggtcttgaccttttttttttttttttttttgagacatagagtctcgctctgttgctcgggctggagtgcagtggcgtgatctcggctcactggaagctccgcctcccgggttcacgccactctcctgcctcagcctcccgagtagctgggactacaggcacccgccaccacacctgactaatttttttgtatttttagtacagacggggtttcaccatgttagccaggatggtctcgatctcct

SEQ ID NO: 108809 - DNA, 601 bp, Human
ataaatatagaactgctcctccgttatactttgaaaggcaaatttttaaagacatattccctttcggcctgaacaaatgagaaggcagaattaagaaaagtgaggtaaaaacacatgtagcaataacattagagtatgcaaagcctttgcagattttcccaaaatgctaagtagttcaaaatgaaaacaggggtaactgatatccatcttcagtttataagctcataagccagagcactgccctcaaagcagatgccaaaccactgttactggggaacacatactaataatgcctttaaasagagaaacccgtgcaacactagctcctgaaaaaacaccttcctttaaagagctatacacccagactgctctcataagtccatgatgacaatgataatgtgagagatgacgacgaaatgagagaaggcaatgaacttctgaaaactagaaagcaaaaaagaactggttgagaaacgtaattttacattatgacaattcaaatagagtactaaaaggtttaagacaaaatggtagttccccacttctctgatttctggccccacaaaataactttaacatgtttagctgccctcctctgtat

SEQ ID NO: 108810 - DNA, 601 bp, Human
taatacatgctgcagacagaggtgagtctgagatactcaggggagagtccctgtcaatttgtttctgtttttaacccttgctcctccagacatcacttacgtggcagaagttctgaattatgggctcacaggctctcatcagcaaggcttctatttgaatatcctgtagaaaattaaatatattaatacttctgctttagaaagagccagggtggaggaggagcagtttctctttctgaatcagtaatatctgatgggcaaataatctaatacatacttttggaaacgattctagtatttsaagtagatagccccagaataaatatagaactgctcctccgttatactttgaaaggcaaatttttaaagacatattccctttcggcctgaacaaatgagaaggcagaattaagaaaagtgaggtaaaaacacatgtagcaataacattagagtatgcaaagcctttgcagattttcccaaaatgctaagtagttcaaaatgaaaacaggggtaactgatatccatcttcagtttataagctcataagccagagcactgccctcaaagcagatgccaaaccactgttactggggaacacata

SEQ ID NO: 108811 - DNA, 601 bp, Human
gaaaggattcagtcaacatccaggcagctatgatgggatattggcagccaggtgtcactgaccagctggaagtgggtaactccgatggcacacttctcgttcatgtccttctggtgtttgttctgtatcagacactccatcaggtccccagagtctatctggttatctgccacatcctggggaagacagcatgcatttacacttcattggtaacaattaatgaacaaaacttgtagcccagtccgaaacaaatgcaagcaaggttagttctagaagccctcacaaaaaaaagacacaccayaaattgtaatcaaaataagcctgaagaatcacaatggtatacattcagtggcataaaactaacacagcactgtgttccgtataagacatgatatacgctttttttttcactttccgaaaagcagctggcttttgggacaatatctaacatagcctcccaactgtcagatcctaatggttcctgggtatgtttcactcccacaatttaaatagttcagtaaatgaatatgaaatagtcagaattcactcaatattgaggtactaggagacagttggaagaaggagccactattactgctaa

SEQ ID NO: 108812 - DNA, 601 bp, Human
tcttgctctgttgcccaggctggagcgcagtggcgatctcggctcactacaacctccgcctcccaggttcaagcaattctcctgcctcagcctttgaaacagctgggattacaggtgtgtgccaccatgcctggctaattttgtattttcagtagagacggagtttcaccatgttgctcaggttggtcttgaactcctggcctcaagtgatccacccacctcagcctcccaaagtgctgggattacaggtgtgagccaccacgcctggctggaaaaaaatgacttttaacagaacatcagwggtgctctgatgttccaaaaaaggaaaggattcagtcaacatccaggcagctatgatgggatattggcagccaggtgtcactgaccagctggaagtgggtaactccgatggcacacttctcgttcatgtccttctggtgtttgttctgtatcagacactccatcaggtccccagagtctatctggttatctgccacatcctggggaagacagcatgcatttacacttcattggtaacaattaatgaacaaaacttgtagcccagtccgaaacaaatgcaagcaaggttagttctagaagc

SEQ ID NO: 108813 - DNA, 601 bp, Human
accatgttagccaggttggtctcgagttcctgacctcaggtgatcagcctgccgcagcctcccaaagtgctggaattacaggcgtgagccaccatgcccggctggaaaaaatgatttttttgttgttgctgttgagatggaatcttgctctgttgcccaggctggagcgcagtggcgatctcggctcactacaacctccgcctcccaggttcaagcaattctcctgcctcagcctttgaaacagctgggattacaggtgtgtgccaccatgcctggctaattttgtattttcagtagagayggagtttcaccatgttgctcaggttggtcttgaactcctggcctcaagtgatccacccacctcagcctcccaaagtgctgggattacaggtgtgagccaccacgcctggctggaaaaaaatgacttttaacagaacatcagaggtgctctgatgttccaaaaaaggaaaggattcagtcaacatccaggcagctatgatgggatattggcagccaggtgtcactgaccagctggaagtgggtaactccgatggcacacttctcgttcatgtccttctggtgtttgttctgtatcagacac

SEQ ID NO: 108814 - DNA, 601 bp, Human
gaggtcagttcgcctctttcactcacactgcaccctgcttctctaagtacacaatccagccctacttggtcagttagatggcctgacctggaaaaattaaaaatgctcctttagcctatgggacctccatgtgagaactaccatcgccagatgctctgtccagacagtccgagtgtttgccacgctaatcaaaggagagatgcgggaggcctccagggctaaccccacgaggcagcaggagggctgcctaacatctcgcatactcattccggagctaagaggaacttcgggaaagtggaawgaaacaactacaagctacatacttcttttttatgtttgggcaaagcttcaacacgtcctccttgcaggccattttaaacttgtaagaaaaccgaaaatccttcatctgcacctgaaaggtaaagagaaagaaagtcagaagtttcgtggcaacttgtggtcagtagtggtagggcgcactttttcatatagctctcacaagcctgtttacaagaccctgcatggcttgacccacacctgagacatcacgacctgctcatctctccagtactccccctacaacaggcaggcttccttcctt

SEQ ID NO: 108815 - DNA, 601 bp, Human
gtcttaaccatcacagtagtggataaaatgcctcccccttgccctagcctctccccagctttccaagccctggcccactgtggtttctgggagcagaggctgggaggcattaccatctccagctcctccacacggagctgcctgcggcacttcagggacaccctgtgctccttggcttcctgcagagtgtcattgcgcacggtcgtgctcaggcagatcaccacgtccaccctgcagacgaaagaagcttgaggctggctggggccacacaagggcagatggcctgagagctgggcttggkgggggtcacaccattaagaattcaagatgccctttgggggaatgtctttcctgtaaggctcactgtattttttttcagggtgctaaaagctgcaatttgactgtgggtgtcatgaaaggcaggcagcagcatgaatgctgactacattcctgacagaaggggaagccacacagggcacatgtgtgcaacgacagttcaacatctgtgttaaaaacatgtgaccacagaggaatgctgctcttaactctaggactgtacttttgacctactgtgaaactcactcctgaaaggtagagaaac

SEQ ID NO: 108816 - DNA, 601 bp, Human
tttgtatttttagtagagatggggtgtcgccatgttggccaggctggtcttgaattacagacctcaagtgatttgaccgcatttgcctcccaaagtgctggaattacaggcatgagccacctcgctggcctaagtctcttttagtacaggcagggtttcatcacgttggccaggctggttttgaactcctgacctcaagcgatccacctgcctcggcctcccaaagtgctgggattacctgcatgagccacagcacccagcccctgaggacattactgatccagtgattggatcacatgcktagttagagcctgtcttacagctggacttccagttacatgtgggaagaaaggttttatcattcaaaatcaaaagaatgacacaggaagctaatggtcgtatgttaaaacttttgcacaggacttcaagtcttaaccatcacagtagtggataaaatgcctcccccttgccctagcctctccccagctttccaagccctggcccactgtggtttctgggagcagaggctgggaggcattaccatctccagctcctccacacggagctgcctgcggcacttcagggacaccctgtgctcctt

SEQ ID NO: 108817 - DNA, 601 bp, Human
cggctcactgcaaactccatctcccggttcaagtgattctcctgcctcagtctctcaagtagctgggattacaggtatgtgccaccacagctggctaaattttgtatttttagtagagatggggtgtcgccatgttggccaggctggtcttgaattacagacctcaagtgatttgaccgcatttgcctcccaaagtgctggaattacaggcatgagccacctcgctggcctaagtctcttttagtacaggcagggtttcatcacgttggccaggctggttttgaactcctgacctcaagcratccacctgcctcggcctcccaaagtgctgggattacctgcatgagccacagcacccagcccctgaggacattactgatccagtgattggatcacatgcttagttagagcctgtcttacagctggacttccagttacatgtgggaagaaaggttttatcattcaaaatcaaaagaatgacacaggaagctaatggtcgtatgttaaaacttttgcacaggacttcaagtcttaaccatcacagtagtggataaaatgcctcccccttgccctagcctctccccagctttccaagccctgg

SEQ ID NO: 108818 - DNA, 601 bp, Human
tgactaaaatgttaccttatgggcactagcttttgagaaaacattaaatattaccttcacattacttttacaattacaaaagaaaagcaaaaagttacctgagcgttgccatattgcacagcggaacagaagtttttgatgtcactcttgcaggcttcgtatagatctggctccaagcggatgtcctccgtctgcatgagggagccagcatggaaaggtgagcttggtttaggctggagatgtcatatgttctggagacttatttgttgactgcatcttgtctagtgaccctggcttctasatagcaaagtcgccttgcagcaagagaatcaggctttactttcaattctgtcaccaaatagctgcatggccttggaccttctttgcaaaacacaatgccaagtctaccctgaaacaccttatttagtccttcacaggactgctgagatgtgaaaatcactttggaaagtcaaaaccattatataaatgtagagttctacttttattattactttaatgaaagagctaggctcaaagttagggaaccaaatcttccagcttgaaatgtctttttttttttttttttttttttttttggaga

SEQ ID NO: 108819 - DNA, 601 bp, Human
caagaataggtagttatgaaaagaagcaatgagaaagctaggaaatgaaaaacaaaacttgattggtggtctcctggagcagaatggacaaagctgaagaataaattatatgctgggaaagagaactgaggagttacctaaaatgtagtacaaagaaatgaaaagtaccaaagaaaaagttaaagagacatggaagacggactcagatgctccaattgcctaacacgagttccagaaggaaggaaagggaaagcagtatgtgaaagagcaatgactgagaatgtcccagaactgaaggaasacatagattgtgagattgaaagagccaaccggaaacacacacaaaacaaaaaccatacctaaccacatcacactgaaactacagatcattacagacaaagagaagactctaaaacctatcagaaacagattaactacaaagcaatgagacttatattgacatcagactttgcatcagcaacagtctgatacaagaggacaatgaagtaattatctcaaaggctgaagccccatggcaatgcccttaactagaagaggtagccgagtagtaacgagaacatttttttaaaaatcatttgtt

SEQ ID NO: 108820 - DNA, 601 bp, Human
actaatatcataagaaagatgataaataaaatgaaccaaggagtcaaaaactgagggaaaggggtaatagagcaatcaaaacagaattttaaaatatacttaaaatcctcagaacaacacagaagacaacagtaaataagaatcaagaataggtagttatgaaaagaagcaatgagaaagctaggaaatgaaaaacaaaacttgattggtggtctcctggagcagaatggacaaagctgaagaataaattatatgctgggaaagagaactgaggagttacctaaaatgtagtacaaagaamtgaaaagtaccaaagaaaaagttaaagagacatggaagacggactcagatgctccaattgcctaacacgagttccagaaggaaggaaagggaaagcagtatgtgaaagagcaatgactgagaatgtcccagaactgaaggaacacatagattgtgagattgaaagagccaaccggaaacacacacaaaacaaaaaccatacctaaccacatcacactgaaactacagatcattacagacaaagagaagactctaaaacctatcagaaacagattaactacaaagcaatgagacttatatt

SEQ ID NO: 108821 - DNA, 601 bp, Human
cagacccaattctcagcctgataaattcacagctacacagggcaaacttatgtaaacaagtaactatgattagaaaaagatgagttatcactcaaaatacaaaagcataaagtgtcatgaaatgaattttaaggtagtgaattaagtatatcctgatatcttcccttccctaaaccttcagatatcatgaaaagaaagaaggaaagcagatgggaaggtgcagcagctggggctatcgcaggaagccatgagacttccgggaaatcgtcaaggcatggccaagaatcactaactagttgasgaacactaatatcataagaaagatgataaataaaatgaaccaaggagtcaaaaactgagggaaaggggtaatagagcaatcaaaacagaattttaaaatatacttaaaatcctcagaacaacacagaagacaacagtaaataagaatcaagaataggtagttatgaaaagaagcaatgagaaagctaggaaatgaaaaacaaaacttgattggtggtctcctggagcagaatggacaaagctgaagaataaattatatgctgggaaagagaactgaggagttacctaaaatgtagtacaa

SEQ ID NO: 108822 - DNA, 601 bp, Human
tctcttcctagttctgtttctagttctctaaagagtgtgattataacctgctgacatcttgttatggagacatggattgttcactgacttttagaaaattttccaaagctctctcacatcagagcctgacatttccatttttacatatgactcaatttcatcaggccagttaaaaagacttacattctaactttcaaaattctctctagaatttatttgatagtgtaaaaagtagcattttactttaaaggaaagctgaaataaaggagctagaacctttagtttaagtttaaaaaaaaatttttttttcttttttgagacagagtcttactctgtcgctcaggctggagtgcagtggcatgaccttggctcactgcagcctgcgcctcccaggagcgattctcttgcctcagcctcctgaatagctgggactacaggcatgtgccaccacacccggctaatttttgtatttttagtagagacggggtttcaccatgttggccaggctggtctcgaactcctgacctcaggtgatcctcccgccttggcctctgaaagtgctgggattacaggcgtgagccaccgtgccctgccgaacctt

SEQ ID NO: 108823 - DNA, 601 bp, Human
cactgagcctctcttcctagttctgtttctagttctctaaagagtgtgattataacctgctgacatcttgttatggagacatggattgttcactgacttttagaaaattttccaaagctctctcacatcagagcctgacatttccatttttacatatgactcaatttcatcaggccagttaaaaagacttacattctaactttcaaaattctctctagaatttatttgatagtgtaaaaagtagcattttactttaaaggaaagctgaaataaaggagctagaacctttagtttaagtttaaaaaaaaatttttttttcttttttgagacagagtcttactctgtcgctcaggctggagtgcagtggcatgaccttggctcactgcagcctgcgcctcccaggagcgattctcttgcctcagcctcctgaatagctgggactacaggcatgtgccaccacacccggctaatttttgtatttttagtagagacggggtttcaccatgttggccaggctggtctcgaactcctgacctcaggtgatcctcccgccttggcctctgaaagtgctgggattacaggcgtgagccaccgtgccctg

SEQ ID NO: 108824 - DNA, 601 bp, Human
agtcagggatcagctgtggactagtaataaactccctatccgttctgctaatccgcaagtcttcaagtgttacagtgtctgataaactctggttgagacacttgagcactgagcctctcttcctagttctgtttctagttctctaaagagtgtgattataacctgctgacatcttgttatggagacatggattgttcactgacttttagaaaattttccaaagctctctcacatcagagcctgacatttccatttttacatatgactcaatttcatcaggccagttaaaaagacttacatyctaactttcaaaattctctctagaatttatttgatagtgtaaaaagtagcattttactttaaaggaaagctgaaataaaggagctagaacctttagtttaagtttaaaaaaaaatttttttttcttttttgagacagagtcttactctgtcgctcaggctggagtgcagtggcatgaccttggctcactgcagcctgcgcctcccaggagcgattctcttgcctcagcctcctgaatagctgggactacaggcatgtgccaccacacccggctaatttttgtatttttagtagagacggg

SEQ ID NO: 108825 - DNA, 601 bp, Human
atggcatctgaggaacttattgtttaagcatgaatgtaacactgtaccaggtggctgtacagccctcaagccctacctacccaactctagtggggaaacctaggaattctccactaaccaatgtgaacaaggatgtgggctaaggacccacttggttcatcttaattacagggctataatcctaccaagcagtaaagggtagggtcctgaacacttactgctgtcctttaagtcagggatcagctgtggactagtaataaactccctatccgttctgctaatccgcaagtcttcaagtgtyacagtgtctgataaactctggttgagacacttgagcactgagcctctcttcctagttctgtttctagttctctaaagagtgtgattataacctgctgacatcttgttatggagacatggattgttcactgacttttagaaaattttccaaagctctctcacatcagagcctgacatttccatttttacatatgactcaatttcatcaggccagttaaaaagacttacattctaactttcaaaattctctctagaatttatttgatagtgtaaaaagtagcattttactttaaaggaaagc

SEQ ID NO: 108826 - DNA, 601 bp, Human
ttattctctactatttctcacatttctttctactgcctcactggttcttacacaggattggttccctatctagagggtgatgttaagtttaatggcatctgaggaacttattgtttaagcatgaatgtaacactgtaccaggtggctgtacagccctcaagccctacctacccaactctagtggggaaacctaggaattctccactaaccaatgtgaacaaggatgtgggctaaggacccacttggttcatcttaattacagggctataatcctaccaagcagtaaagggtagggtcctgwacacttactgctgtcctttaagtcagggatcagctgtggactagtaataaactccctatccgttctgctaatccgcaagtcttcaagtgttacagtgtctgataaactctggttgagacacttgagcactgagcctctcttcctagttctgtttctagttctctaaagagtgtgattataacctgctgacatcttgttatggagacatggattgttcactgacttttagaaaattttccaaagctctctcacatcagagcctgacatttccatttttacatatgactcaatttcatcagg

SEQ ID NO: 108827 - DNA, 601 bp, Human
cgtggtacaagaggagcaggtaggcctgaaagagcaccccaccccaacttcccctttctttcttattctctactatttctcacatttctttctactgcctcactggttcttacacaggattggttccctatctagagggtgatgttaagtttaatggcatctgaggaacttattgtttaagcatgaatgtaacactgtaccaggtggctgtacagccctcaagccctacctacccaactctagtggggaaacctaggaattctccactaaccaatgtgaacaaggatgtgggctaaggacycacttggttcatcttaattacagggctataatcctaccaagcagtaaagggtagggtcctgaacacttactgctgtcctttaagtcagggatcagctgtggactagtaataaactccctatccgttctgctaatccgcaagtcttcaagtgttacagtgtctgataaactctggttgagacacttgagcactgagcctctcttcctagttctgtttctagttctctaaagagtgtgattataacctgctgacatcttgttatggagacatggattgttcactgacttttagaaaattttc

SEQ ID NO: 108828 - DNA, 601 bp, Human
agctcatttttgtgttttttttgttgttgttgttgttgttttagcagagatgaggtttcaccacgttggccaggctggtcttgaactcctggtatcaggtgatccacccacctgggcttcccaaagtgctgggattacaggcatgagccaccacgcctggccactttttttttttttaaggctagtcaagtgaagcaacaggaatgtagaagaacaaataaatctgtaagtagctgtgatcaattagttgtaaacagcaccgcacttggaccagcctgtggtcacccttaacatctatccraaagctgatgaaagcagcagcctgaaggcatcacgtggtacaagaggagcaggtaggcctgaaagagcaccccaccccaacttcccctttctttcttattctctactatttctcacatttctttctactgcctcactggttcttacacaggattggttccctatctagagggtgatgttaagtttaatggcatctgaggaacttattgtttaagcatgaatgtaacactgtaccaggtggctgtacagccctcaagccctacctacccaactctagtggggaaacctaggaattctccac

SEQ ID NO: 108829 - DNA, 601 bp, Human
gacaaaacattccacctgattcacacatttttagatatccaccttcctaaagggagcatattatgtcaatgatcatgactacaaccatggatttatctattcaataaacatttactgagctctcactacactgtttttaatcagcaatatgacttgttaacgagtacttctggaggtcctcaggaatctttctactctgcggggttttgtgcagactccaatactctaaggagtcctcagaaaaatcaaggggacatcagcaaccttccccataacagacacttttgagaacactgaaaatagaaatacaatatccaactcactgtgaccattaacttacgaggtcttccaactcagaggtgaaatgtttctgttccgaatcagattacccgtacattctcctggcacactcatgaagttttattgaatttctagatttttctttccaaggactgccggcctgattccttctgaacgttcttttagggcagttttctggttcttgtggcctcctctctcccctgactctccctccatttttctggatgctcctcaaaggaggaaggccctgcttacactcagactcctcccttaaaattcc

SEQ ID NO: 108830 - DNA, 601 bp, Human
taaacgttaatatttttattggtgtgatacaattactgtgttactttaagaaatatgaaaacgtgaaatcttaaaatcagagtaatatgctatattaaaattctcaatcgggactgggggtggtggcttatgcctgtaatcccagcactttgggaggccgaggtaggagtctgagacccgtgtgggtaacacagcaagacccccatctctatagaaaattatttaaaaaaaaattagctgggcataatcgtgtgccctgtggtcctagccacctgggaggttgaggtgggaggactgcttsagcccagtttgaggtccagtgagctatgactgcaccactgcactccatcctgggagacaaagtgtgaccctatctcaaagaaaaacaaaaacaaaaaaataccaattagataaaggcacatttgtttacaaaatgttctactttacctctgttgtcctcagaaagaaaaacagaaaggacagggcataacatctactacaagagcaattcttatttgtgtttacagatgtcctgaatgagaggaatatcaacatgatggaactgaaatcaactctgcagattctccatttatacataagg

SEQ ID NO: 108831 - DNA, 601 bp, Human
aagtgtgtgaagctggcttctagtttcggcaccaggaaaaggaccatgatgatgactttaacttctgcttccctaataaatacctcaattctccctgttcatcaaatctttagctccagtcatgacaaggccagttcaaactcgcaggcttattcctaaattcatgatgccataaaggtctagttttggcatcacccaggtccccagggaatgttgtctatgactgggctacaactacagaccatacagaccacagtagctgcaactgatgtctaagagggagtctttgctcttcccaagrgagttcagacaggatcaagagtgaacacagagacttacgacgcccgcggccaggggtgatggctgcgcagtggtgtttaatgtccagggcacaagcagtatgaagtaccgggtcaacaaagatgtctgctttgctttccttcagcatgtttagcacttcctggaaagggagggtcattgcagacagagcttttgaaggggaaatgcatcagatctgttgtctgtaaatacttcatatactaataaaaaaggggggaagttgagggctaacaacagagaccactttgggacaggttgcaag

SEQ ID NO: 108832 - DNA, 601 bp, Human
acagagtgagactctgtctcaaaaaaataaataaaaatacaaacaaacaacttctattagttttattgggtatacgtggctcaaaaagaactctcacacttgccttggctccctcctcacacagaacctgtctactgagtccactgtcgtcaccggggaagtgtgtgaagctggcttctagtttcggcaccaggaaaaggaccatgatgatgactttaacttctgcttccctaataaatacctcaattctccctgttcatcaaatctttagctccagtcatgacaaggccagttcaaactmgcaggcttattcctaaattcatgatgccataaaggtctagttttggcatcacccaggtccccagggaatgttgtctatgactgggctacaactacagaccatacagaccacagtagctgcaactgatgtctaagagggagtctttgctcttcccaagggagttcagacaggatcaagagtgaacacagagacttacgacgcccgcggccaggggtgatggctgcgcagtggtgtttaatgtccagggcacaagcagtatgaagtaccgggtcaacaaagatgtctgctttgctttccttc

SEQ ID NO: 108833 - DNA, 601 bp, Human
ctgtacttaaaaaatacaaaaatgagccaggcatggtggtgggtgcctgtagtctcagttactcaggaggttaaggtgggaaaatcacttgaacccaggaggcggaggttgcagtgagctgagatcatgccaccacactccagcctgggtgacagagtgagactctgtctcaaaaaaataaataaaaatacaaacaaacaacttctattagttttattgggtatacgtggctcaaaaagaactctcacacttgccttggctccctcctcacacagaacctgtctactgagtccactgtcgycaccggggaagtgtgtgaagctggcttctagtttcggcaccaggaaaaggaccatgatgatgactttaacttctgcttccctaataaatacctcaattctccctgttcatcaaatctttagctccagtcatgacaaggccagttcaaactcgcaggcttattcctaaattcatgatgccataaaggtctagttttggcatcacccaggtccccagggaatgttgtctatgactgggctacaactacagaccatacagaccacagtagctgcaactgatgtctaagagggagtctttgctc

SEQ ID NO: 108834 - DNA, 601 bp, Human
caccgtgttggccaggttggtctcgatctcctgacctcgtgatctgcctgcctcggcctcccaaaacgctgagattacaggcgcgagccaccgcgcccggccctgaccacgttttcaaacgcacttattgctagtctcacaataaggacaagaccagtgcgatatctaaaagaggctggacagccacagcgaggagagtggcatggcctttgctcaaggatgacatgcaaattggtgaagtgttccatatttttttgtttttttaaaaaaggagattctcttggtcattacctttgctgcrtaactccacatctcaatccggtcattgaggcgctttttgcactcgggctgtaacctcacccgcttatcctccagtgcttccatgagacaggacatttctgtgggaggaaatgaataataagaagaacctgaaactgtacagaatagagaaatttctgtaaagatgaggaagagggtgcacaaccaccagagaattcagatctgcaggctcaacaaagttaaatacatactaggaaacttgatccaggatccaacaatggagagaaatgatatgtaacctccagggttggcgtccgaagcc

SEQ ID NO: 108835 - DNA, 601 bp, Human
tactgttttttagtagagacggggtttcaccgtgttggccaggttggtctcgatctcctgacctcgtgatctgcctgcctcggcctcccaaaacgctgagattacaggcgcgagccaccgcgcccggccctgaccacgttttcaaacgcacttattgctagtctcacaataaggacaagaccagtgcgatatctaaaagaggctggacagccacagcgaggagagtggcatggcctttgctcaaggatgacatgcaaattggtgaagtgttccatatttttttgtttttttaaaaaaggarattctcttggtcattacctttgctgcgtaactccacatctcaatccggtcattgaggcgctttttgcactcgggctgtaacctcacccgcttatcctccagtgcttccatgagacaggacatttctgtgggaggaaatgaataataagaagaacctgaaactgtacagaatagagaaatttctgtaaagatgaggaagagggtgcacaaccaccagagaattcagatctgcaggctcaacaaagttaaatacatactaggaaacttgatccaggatccaacaatggagagaaatgatatg

SEQ ID NO: 108836 - DNA, 601 bp, Human
gaggagagtgttgactactgtgacagacaggagccctcccttgtaccttcctgctgtcgacctatgaagactttctctgattgttcctcttgacttgttacccttgacttggaagtaaaagggtgataaaattggccaggaaggaggggtggtcctgggattactctcttgatcttaggccactgcagatgtctatcccaatatgagtcaatacaaaagcatggctctaaaaaccagagggactctgggcaagtcgtgacctctgaagtcagtttccttcactgtaaagtgacgaaacagwcattatacttacctcacagggtttcaaagttcaaatcaggcaatacgtccaccaaagcgttatgtaaactacaaagcaatgtatgcacgagaagaactgttattcttctcactgaggctgaacctctgtaggaaaaattacccctagcccaagtctacctgggtatcatacacattcatgagtgtcctacagtctttcttcatccccttcttctccatgttccagaccagatgagtactggcctcaaatatgtatttttctcctaaagactgtaaaatgataaaagcaagcttcatcata

SEQ ID NO: 108837 - DNA, 601 bp, Human
gaatcaggaccaaaagggtccccaggtgcacatgtccccattcttttgcatcccagcctggctgctgagatggtgtggcccagaggcatctgggctgtttctatgctcatatcacgtacacagaacagagtagggaggcgtgagatgaatgagatttgagctccaatagttgccaacacaaaacaagccgtgaattactctgagtcactctgaagcaataatacacagctcaaaggactggacacaatgaggcagaatgaagtaacgcagcatctcctgctgccgcttccctgagccaccsgctttaaaggcaactttcttcccttggcagaagggtgaggagagtgttgactactgtgacagacaggagccctcccttgtaccttcctgctgtcgacctatgaagactttctctgattgttcctcttgacttgttacccttgacttggaagtaaaagggtgataaaattggccaggaaggaggggtggtcctgggattactctcttgatcttaggccactgcagatgtctatcccaatatgagtcaatacaaaagcatggctctaaaaaccagagggactctgggcaagtcgtgacctct

SEQ ID NO: 108838 - DNA, 601 bp, Human
tccatcacagtgatcaccactaacaccaggacactgaagatgtgtcgggccctggacgaagggctccccctgccctcactcatttagcactcacaccaagcctagcaagcagatttcaccactcccatactctggatggagaatcagtgcccaggggtgagtgtggttaaatgacttctataaggccatgggttcttctatcttttggtttatgctctttaaatgcgtttgctgcctttctttaaaaaacaaagataaaagttgacatcgttttacatattctatattttgtaaattctatttttttttttttttgagacaaagtcttactgttacccaggcattgtgcagtggcatgatgtcagctcaccacaacctctacctctcaggtttaagcgattctcctccctcacccacatgagtagctgggactacaggtgcacgccaccatgcacagctaatttttttggtatttttagtagagacggggtttcactgtgttgggcaggctggtcttgaactcctgacctcgtgatccgcccacctcggcctcccaaagtgctgggattacaggcatgagccactgcgcccggccttgtaa

SEQ ID NO: 108839 - DNA, 601 bp, Human
gactctgggggtaccttacttcaggattcctttccgagtgctagaacacaggggcccgcctcccagctacagcctacaaattgggggccctcctttggagcctgggaaggggcttcttgcgtgatcaggcctcagtggctagcgctgggatgtagccttctctggacagccttgagaagccgcggtgtgcccatctgtccagtgggcaaactccactctctggggctgtttccaggattcaggaagcaaatgaatgagaacagcccgtgcagccacctctccctcccaccaacccctcttkcctttcttgtctcccagatgggcggccacttctccattccaggaactactcatttgtggtggtgtggctgccaaatgataacatcctcctcctgtcattattgtcattgttattgttgttatcattgtcaagggataatgtcccttcttgattcaacatcttgaatcccaagtaaggagtggggtggaggctgtgttatcatccccaccttagctgagctgggaggctcagaagggactgtgatcacccaaggccactaggctggcgtaaggccttgtgtctgccatcccagagccttgg

SEQ ID NO: 108840 - DNA, 601 bp, Human
gctccaagcagcacaaatctcctcttttgctaccttgtctctagctcattgccttctgtctaccgtggtggaaaggtgtggacttgcagccagctgggcctggcctgatctcaggctggactgtggtgtgggcccctttgagtgaccatcttcctgcctgcccaggcttctgggacgggggtggggggtgtttgcaaagctctgtctctttcacttgccttgtgaccttgcacaggttgtcttggcctctctaagtcttggttgactctcctaaacaagtttattttattttatttatttwtttattttttttttttttgagacagagtctccctctgtcatccagtctggagtgcagtggagcaatcttggctcactgcaacctctgcctcccaggttcaggccattcttctgcctcagcctcccgagtagctgggattacaggcgtctaccaccaagcccaactaatttttgtatttttagtagagacggggtttcaccatgttggccaggctggtctcaaactacttacctcaagtgatcctcatgccttggcctcccagagtgctgggattacaggtgtgagccaccaagcctcgcc

SEQ ID NO: 108841 - DNA, 601 bp, Human
gtttgcaaagctctgtctctttcacttgccttgtgaccttgcacaggttgtcttggcctctctaagtcttggttgactctcctaaacaagtttattttattttatttatttatttattttttttttttttgagacagagtctccctctgtcatccagtctggagtgcagtggagcaatcttggctcactgcaacctctgcctcccaggttcaggccattcttctgcctcagcctcccgagtagctgggattacaggcgtctaccaccaagcccaactaatttttgtatttttagtagagayggggtttcaccatgttggccaggctggtctcaaactacttacctcaagtgatcctcatgccttggcctcccagagtgctgggattacaggtgtgagccaccaagcctcgccccaggagttccaagaccagcctgggtaacatgacaagatgccattctacaaaaaataaaaaaattagccaggtagggtggtagtcccacacctgtagtcccagcaactcaggaggctggccctgggaggactgcttgagcccaggatgtccagactgcagtgagccgtgattgcaccattaccctccag

SEQ ID NO: 108842 - DNA, 601 bp, Human
tgtatttttagtagagacggggtttcaccatgttggccaggctggtctcaaactacttacctcaagtgatcctcatgccttggcctcccagagtgctgggattacaggtgtgagccaccaagcctcgccccaggagttccaagaccagcctgggtaacatgacaagatgccattctacaaaaaataaaaaaattagccaggtagggtggtagtcccacacctgtagtcccagcaactcaggaggctggccctgggaggactgcttgagcccaggatgtccagactgcagtgagccgtgatygcaccattaccctccagcctgggtgacagaaccagatccggtttcaaaaaaagaaaagaaaaagtgcttacttacctaacgcactgcctggcacatagtaggtctacatggatggggctattgttgtttatctggctggttcctttgctatcagggacaaaagctaaccagaatgaaagtgctttcacgttacacacttaagccttatgagggaggcattgctataatccccattttacagagcaggaaactgaggctcagatagctgagcagaacactctcactggaggctgtaaagtg

SEQ ID NO: 108843 - DNA, 601 bp, Human
ctcagcctcccgagtagctgggattacaggcgcctgccaccaggcccggctaattttttgtatttttagtagagatggagtttcaccatgttagccaggatggtctcgatctcctgacttcgtgatccgcccgcctcggcctcccaaagtgctgggataacaggcgtgagccactgcgcctggccagagggggtacattttaaatagggaaattggtgacatttgagcagagccttgaaggaggcgaggaaggaacccctggagacgggaagagaatccagtgcaaaggtcctgatgtggraggatgcccggaggccagtttagcaggccagtggagggagatcagatctgggagatattagggtgggaccaggcctctaggaacattgtgggcagggaggctgtctgagcagagggaagtaaagctggtggcgctactgctgtccctctggacctggccaagctgagggctctctcctttgatttccagcttcaactcagttttctcagtaagcagactccacaggcatgtaggcgccccgtgccatttttcttttaataagaagcagctgtgccggggatgctggcgtttccagctgcg

SEQ ID NO: 108844 - DNA, 601 bp, Human
agagatggagtttcaccatgttagccaggatggtctcgatctcctgacttcgtgatccgcccgcctcggcctcccaaagtgctgggataacaggcgtgagccactgcgcctggccagagggggtacattttaaatagggaaattggtgacatttgagcagagccttgaaggaggcgaggaaggaacccctggagacgggaagagaatccagtgcaaaggtcctgatgtgggaggatgcccggaggccagtttagcaggccagtggagggagatcagatctgggagatattagggtgggacsaggcctctaggaacattgtgggcagggaggctgtctgagcagagggaagtaaagctggtggcgctactgctgtccctctggacctggccaagctgagggctctctcctttgatttccagcttcaactcagttttctcagtaagcagactccacaggcatgtaggcgccccgtgccatttttcttttaataagaagcagctgtgccggggatgctggcgtttccagctgcgtttttatttggcctttggtgatgtgtccctccagggatatgtggatgagccgcgggggcactgcctgtgc

SEQ ID NO: 108845 - DNA, 601 bp, Human
ggcctcccaaagtgctgggataacaggcgtgagccactgcgcctggccagagggggtacattttaaatagggaaattggtgacatttgagcagagccttgaaggaggcgaggaaggaacccctggagacgggaagagaatccagtgcaaaggtcctgatgtgggaggatgcccggaggccagtttagcaggccagtggagggagatcagatctgggagatattagggtgggaccaggcctctaggaacattgtgggcagggaggctgtctgagcagagggaagtaaagctggtggcgctaytgctgtccctctggacctggccaagctgagggctctctcctttgatttccagcttcaactcagttttctcagtaagcagactccacaggcatgtaggcgccccgtgccatttttcttttaataagaagcagctgtgccggggatgctggcgtttccagctgcgtttttatttggcctttggtgatgtgtccctccagggatatgtggatgagccgcgggggcactgcctgtgcctcagtgggtgctgcaccagtgcacatcggatgcccgttggctcctgtccctgacagatggaggggc

SEQ ID NO: 108846 - DNA, 601 bp, Human
ggagaatcacttgaacccaggaggaggaacttgcagtaagcggagatcacgccattgcactccagcctgggggacagagtgagactccatctcaaaaaaaaaaaaaaaaggaaaaaaggaaaggccatgcaaggctcggttagggtggtctgcagtgctgggcctgctggaattggtacagtccagagggatctgtgggaatatggaaggcttggttctgccacacaccaaaaaagtgacctcacttctctgggcctcagtttcctcatctggaaaatgggaacatggtggtctctgcctmctgggagtggactgagaatcacgtagcaaattgttgtgaaacaggcagcatttgtgatctcgttggttggcttttgtctccttttatctgggatcaggactctgatgacaggtgtacgtttcttttctcttgctctgtcccccagactggagtacagtggcgtaatcatggctcactgcagcctccaactcctgggttcaggtggtcctctcacctgagtctcctgagtagctgggactataggcatgagccaccacacctggctaattacaaaaaaatttttttggcagggagcgatgg

SEQ ID NO: 108847 - DNA, 601 bp, Human
gaaaatgggaacatggtggtctctgcctactgggagtggactgagaatcacgtagcaaattgttgtgaaacaggcagcatttgtgatctcgttggttggcttttgtctccttttatctgggatcaggactctgatgacaggtgtacgtttcttttctcttgctctgtcccccagactggagtacagtggcgtaatcatggctcactgcagcctccaactcctgggttcaggtggtcctctcacctgagtctcctgagtagctgggactataggcatgagccaccacacctggctaattacmaaaaaatttttttggcagggagcgatggctcacacttgtattcccagcacttggggaggccgaggcgggcggatcacggggtcaagagattgagaccatcctggccaacatggtgaaaccctgtctctactaaaaatccaaaaattaggtgggtgtggtggctctcacctgtagtcccagctgctcgggaggctgaggcaggagaatcgcttgaacctgggaggcggaggttgcagtgagccgagatcgtgccactgcactccagcctgggcgacagagcgagactctgcctcaaaaaaa

SEQ ID NO: 108848 - DNA, 601 bp, Human
agggagcgatggctcacacttgtattcccagcacttggggaggccgaggcgggcggatcacggggtcaagagattgagaccatcctggccaacatggtgaaaccctgtctctactaaaaatccaaaaattaggtgggtgtggtggctctcacctgtagtcccagctgctcgggaggctgaggcaggagaatcgcttgaacctgggaggcggaggttgcagtgagccgagatcgtgccactgcactccagcctgggcgacagagcgagactctgcctcaaaaaaaaaaaattttttttttttagagacagggtcttactttgttgctcagtttggtgtcaaactcctgggcccaagcgatcctcctgccttggcttcccaaagtggtggaattacaggtgtgagccgccgaacccggccttagtttctttttccttaaagagaaggaactcatcattactctgttgatataaatggagtgcctatcagtgcaggcaatgttcttgctctggggatacagccaggaccaggacatgcaggcacgccctgttccccagatcctgaaatatcgaccagaagttgttcctggttcctttctaagtg

SEQ ID NO: 108849 - DNA, 601 bp, Human
tactaaaaatccaaaaattaggtgggtgtggtggctctcacctgtagtcccagctgctcgggaggctgaggcaggagaatcgcttgaacctgggaggcggaggttgcagtgagccgagatcgtgccactgcactccagcctgggcgacagagcgagactctgcctcaaaaaaaaaaaattttttttttttagagacagggtcttactttgttgctcagtttggtgtcaaactcctgggcccaagcgatcctcctgccttggcttcccaaagtggtggaattacaggtgtgagccgccgaayccggccttagtttctttttccttaaagagaaggaactcatcattactctgttgatataaatggagtgcctatcagtgcaggcaatgttcttgctctggggatacagccaggaccaggacatgcaggcacgccctgttccccagatcctgaaatatcgaccagaagttgttcctggttcctttctaagtgggaatcatggctgcaaacaagtaattggccgtgagagttatttacacacattttgtgtacggtgatgagaaatgggagaaaaaatgcccagcatcggatcaccagaggtca

SEQ ID NO: 108850 - DNA, 601 bp, Human
gccgaacccggccttagtttctttttccttaaagagaaggaactcatcattactctgttgatataaatggagtgcctatcagtgcaggcaatgttcttgctctggggatacagccaggaccaggacatgcaggcacgccctgttccccagatcctgaaatatcgaccagaagttgttcctggttcctttctaagtgggaatcatggctgcaaacaagtaattggccgtgagagttatttacacacattttgtgtacggtgatgagaaatgggagaaaaaatgcccagcatcggatcaccaraggtcaggagttcgagaccagcctggccaacatggtgaaccctcatctctactaaaaatacaaaaattagccgggcgtggtggcaggcgcctgtaatcccagctattcgggaggctgaggcggagaatcgcttgaacctgggggacggaggttgcggtaagccgagattgcgccgctgcactccagcctgggcaacagagcgagactctgtctcaaaacaaacaaacaaacaaaaaccaatgataggggatttggccagataagcgtgtccagacaaccgactatcaactcgctactcag

SEQ ID NO: 108851 - DNA, 601 bp, Human
taaaaatacaaaaattagccgggcgtggtggcaggcgcctgtaatcccagctattcgggaggctgaggcggagaatcgcttgaacctgggggacggaggttgcggtaagccgagattgcgccgctgcactccagcctgggcaacagagcgagactctgtctcaaaacaaacaaacaaacaaaaaccaatgataggggatttggccagataagcgtgtccagacaaccgactatcaactcgctactcagagggatctagaagaatctttaatgacccagaaagctgcacaagacctgttagrtaccagatgaaatgggctgtgggatcctgtcttgtttaaaacgattgtatttgctcagtgaaaagaccggaaagacatactctgccctaaccccacatgtgaatcgtctccccatgtgattcttggtttgtttttgctggtttggggattaggtttataatcaggaagacagatttctccaaagctgcgctctaggctgtccaagtgctttttcagagttacttattgacggataacagcccttgataggttcataacattgaaatcccctggtaataacctggattgtttctggatgag

SEQ ID NO: 108852 - DNA, 601 bp, Human
ctgtcttgtttaaaacgattgtatttgctcagtgaaaagaccggaaagacatactctgccctaaccccacatgtgaatcgtctccccatgtgattcttggtttgtttttgctggtttggggattaggtttataatcaggaagacagatttctccaaagctgcgctctaggctgtccaagtgctttttcagagttacttattgacggataacagcccttgataggttcataacattgaaatcccctggtaataacctggattgtttctggatgagggcggaagatggccttggggacagttstagatttagagaggaggttttcttttcttttctttttctttttttgtttttttttgagacgggatctcactctgttgcctaggctgaaatgcagtggcgtgatcacagctcacagcaacctcaacttcctgggctcaagggatcttcccacttcagcctcccaattagctgggaccacaggtgtgcgccaccacccccagctaattttaagaaattttttgtagaggtggggtctcattattttttgcccaggctagtctcaaacccctgggctcaagtgattctcctgcctcggcttcc

SEQ ID NO: 108853 - DNA, 601 bp, Human
cagttgtagatttagagaggaggttttcttttcttttctttttctttttttgtttttttttgagacgggatctcactctgttgcctaggctgaaatgcagtggcgtgatcacagctcacagcaacctcaacttcctgggctcaagggatcttcccacttcagcctcccaattagctgggaccacaggtgtgcgccaccacccccagctaattttaagaaattttttgtagaggtggggtctcattattttttgcccaggctagtctcaaacccctgggctcaagtgattctcctgcctcggcttcccaaagtgctgggattacaggcaagagccacggcacccggcctaggttagatttagagttttcagagttggcttaggcggtagaggctggcctttgaatggaaccctgtctcgctgtcgctctcagcgtttatatttggctcagagccacatctgccaaacttctgcccgatttgaatgaaagtgctgaaattataggcccctcggctgctgaaaaaaagtgagaacatcatgtaaaccgtaatttactgggattgccaactacaagctgtaattaagcccttattgtgttaaagc

SEQ ID NO: 108854 - DNA, 601 bp, Human
gcctaggctgaaatgcagtggcgtgatcacagctcacagcaacctcaacttcctgggctcaagggatcttcccacttcagcctcccaattagctgggaccacaggtgtgcgccaccacccccagctaattttaagaaattttttgtagaggtggggtctcattattttttgcccaggctagtctcaaacccctgggctcaagtgattctcctgcctcggcttcccaaagtgctgggattacaggcaagagccacggcacccggcctaggttagatttagagttttcagagttggcttaggyggtagaggctggcctttgaatggaaccctgtctcgctgtcgctctcagcgtttatatttggctcagagccacatctgccaaacttctgcccgatttgaatgaaagtgctgaaattataggcccctcggctgctgaaaaaaagtgagaacatcatgtaaaccgtaatttactgggattgccaactacaagctgtaattaagcccttattgtgttaaagctttggaaaaatccaagccaataatgagatatttatagggcattagctacaatctgaataaagggaaaatgtggccctgcgtc

SEQ ID NO: 108855 - DNA, 601 bp, Human
tgtgcgccaccacccccagctaattttaagaaattttttgtagaggtggggtctcattattttttgcccaggctagtctcaaacccctgggctcaagtgattctcctgcctcggcttcccaaagtgctgggattacaggcaagagccacggcacccggcctaggttagatttagagttttcagagttggcttaggcggtagaggctggcctttgaatggaaccctgtctcgctgtcgctctcagcgtttatatttggctcagagccacatctgccaaacttctgcccgatttgaatgaaartgctgaaattataggcccctcggctgctgaaaaaaagtgagaacatcatgtaaaccgtaatttactgggattgccaactacaagctgtaattaagcccttattgtgttaaagctttggaaaaatccaagccaataatgagatatttatagggcattagctacaatctgaataaagggaaaatgtggccctgcgtctgaagcaggactgcaaagagaggaaagacgcctgcttccgggtgcgttttgggtttctgtgaatattggtaactaggtccctgctgggtggtgggaaattttccc

SEQ ID NO: 108856 - DNA, 601 bp, Human
atgtggcttgttgggatgggtgtcctgcagtggaatagccccgccaggacttgggggaacagcatcgcaggccagggaaacagcaggtgcagaggcctcgcacacacccggcccgctgagtgccccctgcggaccggaaaggaccagtaggcacgtgagagttaggacgctgcccgtggaatgccgacttttctaaatttgaattacgcaagtagagcgtggagacagtgttcttggaaaaagggaaaccattacagatgaggaagagcacactgcccagcccgtcccttcctccagctcyacctgggagcaccactgtcacttcagggtatgtctagccagacccctctggtgtttctgtacttaggtacatgctggtacctatagagaatacgtggcaccattatgggtggttattttttttttttttggaacaggtctcactctgtcacccaggctggagtgcagtggcacagtcatggctcgctgcagccttgacatcctgtgctcaagccatcctcctacctcagcctcctgagtacctgggacaacaaccacatgccaccacgcccaactaatgtttataatcttttgtacagat

SEQ ID NO: 108857 - DNA, 601 bp, Human
taaaaaccagaatggagtgaatttcactgcacagtcatggaggggaccaggcagaggacagccctgggtcttggttttggagactcacagcctgcctggggatgcagggaccctgaagcaaggacatcttcctttggaggaagtggagatttgctccatctatataaagagtaataacagtaataggctgagaccctgaggctgggcagcgtgggtgtctatctgcgttggcttcgagggctgtaagatggggctagcagcgtcccctccagggtgggagtgaggccctgtatggcaaccygcggggtgccccctctgacttttgcttcctgcctggctgctcagtggccctggcaggggcaggcaccactgctctttctgttacaagagacctcctttggataaatctgaacacgctcccatggcagacctatggggcggtagacaagaggccagcagagctgtcccaggccctggtgacacctccatgcccaggtgaaggaggagcaggctacttggagcctgccctgtgacacactttcgcggtgatgagagcttctcagggctgcgatcctggcgggccagtcaagcgggcaggagc

SEQ ID NO: 108858 - DNA, 601 bp, Human
ctgaagcaaggacatcttcctttggaggaagtggagatttgctccatctatataaagagtaataacagtaataggctgagaccctgaggctgggcagcgtgggtgtctatctgcgttggcttcgagggctgtaagatggggctagcagcgtcccctccagggtgggagtgaggccctgtatggcaacctgcggggtgccccctctgacttttgcttcctgcctggctgctcagtggccctggcaggggcaggcaccactgctctttctgttacaagagacctcctttggataaatctgaayacgctcccatggcagacctatggggcggtagacaagaggccagcagagctgtcccaggccctggtgacacctccatgcccaggtgaaggaggagcaggctacttggagcctgccctgtgacacactttcgcggtgatgagagcttctcagggctgcgatcctggcgggccagtcaagcgggcaggagcagccccagccagggtgaccctgcctgctgggtgatacgccctggcacgaccaggccagccctggggaaagcccccagggcggatcagggagggacacagctgtcctggccat

SEQ ID NO: 108859 - DNA, 601 bp, Human
agtctcgctcttgttccccaggctggagtgcaatggcgcgatctcggctcactgcaagctccgcctcccaggttcaagcgattctcctgcctcagcctcccgagtagctgggattacagacacctgtcaccatgcccagctaatttttgtagttttagtagagatggggtttcaccatgttggccaggctagtcttgaactcccgacctcaggtgatccaccctcctcggcctcccaaagtgctgggattaccagtgtgagccaccgcgcctgggctggtgtggtttttttttttttttttggagacagggtcccactctttcacccaggttggagtgcagtggcatgatgtcggcttactgcaacctccccctctcgggctcaaaccattctcccaccacagcctcccaactagctgggaccacaggcgcgcaccacaatggccggcattttttttttattttcggtagagacagggtttctccatgttgcccaggctggtcttgaactcctgagctcaggtaatctgcctgcctcagcctcccaaagtgctgggattgtaagcatgagccacaacgccctgcctagaaataattttaga

SEQ ID NO: 108860 - DNA, 601 bp, Human
cttgagcccaggagttttagaccagcctgggcaatatagtgagacctcgtgtgtagaaaaaaaaaaaaattagcttggcctggtggtgctcacctggagtcccagctcctctggaggctgagacaggaggatcacttgagccctggaggttgaggctgcagtgagtgatgattgcaccattgcacaccagcccgggcaacagagccagaccctgtctcaaaaaaaaaaaaaaaaaaaaaagccaaagccagaatgtacagatttcttcaatttttcccatatgagactaatttaaaaaaawattttttttttttatcgagatgggggtcttgctgtctggaagtatacatactgagaaattttatttttcaaacaaaatcaccccttttcctgtcttaggactggacattgcatctagttgtcggatctccttaagcctttttctggtctgggaagcaactcagcccttccttgttttttataaccttggtaagtcatggaatgtccctcaattagggcttatctggaattcttcatggtgagcctggggtgtgagttttggggaagaaggccattggtgaggtgcccctctcttctgtga

SEQ ID NO: 108861 - DNA, 601 bp, Human
ttgagcccaggagttttagaccagcctgggcaatatagtgagacctcgtgtgtagaaaaaaaaaaaaattagcttggcctggtggtgctcacctggagtcccagctcctctggaggctgagacaggaggatcacttgagccctggaggttgaggctgcagtgagtgatgattgcaccattgcacaccagcccgggcaacagagccagaccctgtctcaaaaaaaaaaaaaaaaaaaaaagccaaagccagaatgtacagatttcttcaatttttcccatatgagactaatttaaaaaaaawttttttttttttatcgagatgggggtcttgctgtctggaagtatacatactgagaaattttatttttcaaacaaaatcaccccttttcctgtcttaggactggacattgcatctagttgtcggatctccttaagcctttttctggtctgggaagcaactcagcccttccttgttttttataaccttggtaagtcatggaatgtccctcaattagggcttatctggaattcttcatggtgagcctggggtgtgagttttggggaagaaggccattggtgaggtgcccctctcttctgtgaa

SEQ ID NO: 108862 - DNA, 601 bp, Human
aattttatttttcaaacaaaatcaccccttttcctgtcttaggactggacattgcatctagttgtcggatctccttaagcctttttctggtctgggaagcaactcagcccttccttgttttttataaccttggtaagtcatggaatgtccctcaattagggcttatctggaattcttcatggtgagcctggggtgtgagttttggggaagaaggccattggtgaggtgcccctctcttctgtgaatctttttttgtttgtttgttttttgtttttgtttttttgagatggagtcttgctcygtcgcccaggctggagtgcagcggcgcgatctcagctcactgcaagctctgcctcctgggttcacgccattctcctgcctcagcctcccgagtagctgggattacaggctgccaccatgcccggctaatttttgtatttttttttagacggggtttcaccgtgttagccaggatggtctcgatctcctgacctcatgatctgcccgcctctgcctcccagagtgctgggattacaggcgtaagccacctcgtccagccatcttctgtgaatcttatcaggagtataggataccaacaaga

SEQ ID NO: 108863 - DNA, 601 bp, Human
ttgtcggatctccttaagcctttttctggtctgggaagcaactcagcccttccttgttttttataaccttggtaagtcatggaatgtccctcaattagggcttatctggaattcttcatggtgagcctggggtgtgagttttggggaagaaggccattggtgaggtgcccctctcttctgtgaatctttttttgtttgtttgttttttgtttttgtttttttgagatggagtcttgctctgtcgcccaggctggagtgcagcggcgcgatctcagctcactgcaagctctgcctcctgggktcacgccattctcctgcctcagcctcccgagtagctgggattacaggctgccaccatgcccggctaatttttgtatttttttttagacggggtttcaccgtgttagccaggatggtctcgatctcctgacctcatgatctgcccgcctctgcctcccagagtgctgggattacaggcgtaagccacctcgtccagccatcttctgtgaatcttatcaggagtataggataccaacaagactgataaattattgacagtgataactgatgatgctgaccttgatctcttggctgaggtagg

SEQ ID NO: 108864 - DNA, 601 bp, Human
taggctggtttcaaactactgggctggtgatgctcctgcctcagccttccacagtgctggcattatgggcgtgagccaccacgcccactcatttctatattgctgtagctttatagtaagacttgaaatcaggccatgtgagtcctcttttttcttgtttctcaaaattgttttgtctagtctagttcctttgcctccacatatatattttagaatcagcttgttgatttcatagaaaagatcattgtgtattagtacgtggaaagccacggtattagttttttgtttgtttgtttgtttktttagacaaagtctctctctggcacccaggctggtgtgccaatagtgttgggattacaggcgtgaaccactgtgcccagctggtactggtttttataactgtgtattattccatccactgtcactacttccccaggaccagtacagtttctgcctcctcagtcttgcacctttaaccttgtcctcacccccaggctgttctccctgcagtggacagagggagcctgttaagaatatccttcctagctgggcgccgtggcttacgctgtaatcccagcactttgggaggccgaggtggaag

SEQ ID NO: 108865 - DNA, 601 bp, Human
cctacctcatggctttttcacatgctgcttccactgcctgcactgcccttcccccagataaccctgtggctcatttcatcagcattctaaggcctctgcttaaaagcctccttctcaaaaggctctccccctggccactctgctcaaacgccccaccctgttctctctgtccccttcccctgcttaatttttcttggaaccacttgtcattcctgtcattgttccacctatgcgtttggtttcttgttttctttttttggggtggagtcttgctctgactcccaggctggagtggagtggygatcttggctcactgcaacctctgcttcccgggttcaagcgattctcctgcctcagcctcccaagtagctgggattacaggcgcacgtcaacatgcccgtatatttttgtatttttagtagagacgaggtttcactatgttggccaggctgatctcgaactgctgacttcaggtgatctgccagccttggcctcccaaagtgctgtgattacaggcatgagccaccgcacccggcctatttgtttgatttctctttctgtctccccccactagaaggggaatgccccatggtagggcggt

SEQ ID NO: 108866 - DNA, 601 bp, Human
cgccactgcactccagcctgggcgacagagcgagactccgtctcaaaaataaataaataaataaaagaaggacgtgttcccttgttcttctatggggacatggggaactcctgtactgttttattttcctgaaatatttttattgaaatataattcacataccataatacctaatccttttgaaatatactattcagtggattttagtatattcacagttgtgtaaccagcaccactatctgattttgtagcactttcatttcccctaaacccatacatatgaagcagttcctccctcccscagcacctggaagccactaatgtcctttctgtctgtgaatttgccaattttggatatttcctataaatggaatcttacagtatatggccttttgtgtgtggctttgtttatttagcatcatgttttcaagattcatccatgctggttgggtgcagtggcgcacgcctgtaatcccagcatttgggaggctgaggcgggcagatcacttgagggcaggaattgatgagaccagcctgcccaacatggtgaaaccccttctctactaaaaatacaaaaattagctgggtgtagtggcacatg

SEQ ID NO: 108867 - DNA, 601 bp, Human
gtggattttagtatattcacagttgtgtaaccagcaccactatctgattttgtagcactttcatttcccctaaacccatacatatgaagcagttcctccctcccccagcacctggaagccactaatgtcctttctgtctgtgaatttgccaattttggatatttcctataaatggaatcttacagtatatggccttttgtgtgtggctttgtttatttagcatcatgttttcaagattcatccatgctggttgggtgcagtggcgcacgcctgtaatcccagcatttgggaggctgaggcrggcagatcacttgagggcaggaattgatgagaccagcctgcccaacatggtgaaaccccttctctactaaaaatacaaaaattagctgggtgtagtggcacatgcctgtaattccagctactctgggtggctgaggcacgagaatctcttgaacctggggggcaaggttgcagtgagccgagatcactccactgcactctagcctgggcaacagagcaagactctctctctctctcaaaaaaaaaaaaaaaaaaaaaaaaaagaattcaccaatgaagccacctgggcctggacttttct

SEQ ID NO: 108868 - DNA, 601 bp, Human
gaagggtctgtgcctgttgtggtgccaggcattgacatccttcactcccacccccgtcaccctcatgaactagtgaactagtcctgtggaatagggccttatgcgtgctagaccctgggtttgtcctgctgacaaccccatagtgtaggtgctgttatcccaatttcatagagaaactgagggctggggaagtggcagccttcattcagttcctgccgtgaggctgtggctgagctgccaggctgcagagtcttcacccaatgatcttgctcagttgtccccatgaggaagctgagcctgrccttcctgtctctggagtccaaggtttcctttccttgtgtgcccctggaagtgctgtgtggtgaccgggatggtgcctggcagatggagattagacgcaggttggattggtgcctcattggtcaggagggctgctcttagctgtgtgccaatagaccggatgacttaatctctctatccttggtttccccatctgcaaaacagggttggccagagccctgtgaaggtggaagaaggccctgtgtgcctggagctttgtgcagtgccctggagatgctagcttgtttttctttcttttttt

SEQ ID NO: 108869 - DNA, 601 bp, Human
ggtgctcgggtgagaaaaaacatcatgcggccaggcatggtggctcacacctgtaatcccagatctttgggaggctgaggcaggcggatcatctgaggtcatgagttcgagaccagccttgcaaaaccccgtctctactaaaaatacaaaaattagccaggtgtggctgggtgtggtggctcacacctgtaatcccagcactttgggaggcggaggcaggtggatcacaaggtcaggagatcgagaccatcctggctaatatggtaaaactccgtctctactaaaaatacaaaaaattagycgggtgtggtggcgggtgcttgtagtcccagctactcaggaggctgaggcaggaggatggcatgaacccgggaggcggagcttgcagtgagccgagattgcgccactgcactccagcctgggtgacaaagcgagactctgtctcaaaaaaaaaaaaaaaaaaaaaaaaaaaattagccgtgtgtggtggcgtgcgcctgtagtcccagctacttgggaggctgaggcagcagaattgcttgaactcgggaggcaaggttgcagtgagccaagatcacgccattgcactccagccagggca

SEQ ID NO: 108870 - DNA, 601 bp, Human
gtggtggctcacacctgtaatcccagcactttgggaggcggaggcaggtggatcacaaggtcaggagatcgagaccatcctggctaatatggtaaaactccgtctctactaaaaatacaaaaaattagccgggtgtggtggcgggtgcttgtagtcccagctactcaggaggctgaggcaggaggatggcatgaacccgggaggcggagcttgcagtgagccgagattgcgccactgcactccagcctgggtgacaaagcgagactctgtctcaaaaaaaaaaaaaaaaaaaaaaaaaaaattagccgtgtgtggtggcgtgcgcctgtagtcccagctacttgggaggctgaggcagcagaattgcttgaactcgggaggcaaggttgcagtgagccaagatcacgccattgcactccagccagggcagcagagcgagactgtttccagaaaaaaaaaaaaaatacaaaaattagccagacgtggtagcatacgcccgtagtcccagctgcttaggaggctgaggcaggaaaatcacttgagcccaggaggcggaggttgcaatgagccaagatcctgccactacacttcggctggggtg

SEQ ID NO: 108871 - DNA, 601 bp, Human
tttttttgagatggagtttcactcttattgcccaggcaggagtgtaatggtgtgatcttggctgactgtaacctctgcctcccaggttcaagcgattctcccacctcagcctcccgagtagctgagattacaggcatgcaccacacctggctaattttgtatttttagtagagacggggtttctccctgttggtcaggctggtctcgaactcccaacctcaggtgatctacctgcctcggtctcccaaagtgccgggattacaggtgtgagcaaccgtgccggctttttttttgttttttkttttttttttttttgagacagtctcactctgttgcccaggctggagtgcaatggcatgatctcacaatctcagctcactgtgacctctgcctcctgggttcaagcggttttcctgcctcagcctctcgagtagctgggattacaggtgcccaccaccacgcctggctaatttttgtatttttagtagagacggagtttctccatgttggccaagctggtctcaaactcctgacctcgggtgatctgcccgcctcggccccgcaaagtgctgagattacaggcatgagccaccgcactcaa
